United States Patent 10,407,724 (METHODS AND COMPOSITIONS FOR SCREENING AND TREATING DEVELOPMENTAL DISORDERS) - sequence listing, part 75

SEQ ID NO: 1968 - DNA, 71056 bp, Homo sapiens
cactgctcttccggacgcaattttgaggaggtcggagcggaaggacgtcgtggagattgcttgcgctggggtgccacacttaggctgagctgcaggttttcgcacagtcgcgagttaacctctgcttgctccagaggcctcgtcctaatccacctcggctgacggcgcgggatccctggctccgcgaggtctccgaattgtccgagctatctgctatgcagaactttgccccttttgttgtgtttgactcctgtctctaaccctagtctggatggttttgtttctgtcccactttacagataggtacaacgaggctcagagaggtgaagttccttctaaggggccgtagagagtggagagtcgatcgctgttcagatagcgatctggctgggcgcggtggctcacgcctgtaatcccagcccagaggcttaggcgggcgaatcacctcaggtcagcagttcgagaccaacctggccaacatggtgaaacctcgtctctactgaacatacaaaaaattagccgggcttggtggcgcgcgtctgtagtccaagctacttgggaggctgagacaggagaatcgcttgaacccgggaggcggaggttgcagtgagtcgagatagtgctagtgcactcccgcctgggcaacaagagcgaaactccgtctcaaaaaaaagagagaaaagatggtgatctgctggttacgagcatagtgctgcagttagaccggggtcctcctccccaccctgtcacttcacaaatgtttactgagagtctagacacccttgggatgcttgagatacgttggcgtataagataaacacagttcctgtccgtactatgaggttgacctacatcagcagttgtgcagtcttgaactagtatagtcattgcataaagttggcatgatatcatgtcctcatgcagttgtgaggatgaaatggaattatgtatatggagataacattagcttttctgaggctcagcattctttccagtatgtcagagtggcttttgtatgtagatactgacacaatcaatgcatatgggacacatacatgacaggatgctactctaggtacattgtataatgatacatatgtaagtacatagtacattctagatgtgtgtgtgtgtggacatagtgcgttctagatgtgtgtgtatctggactatgacatgaccacaagatacatgcgtatatagatcttgtgactacatcctatgaaatacgtttccatatgccctgtttaaatcagggtttctcaactctgcactattaacattttgggtcctgattattcttttttgtttttggcaagggggcggggtgtcctgagcattgtagagtgtttagaaacatccctggcctgacccactagatgtcagtagcacctctccccaggtggtgacaaccaataatgtctctggacctttccagatgtctccttggggttagaaaacataaccctgttgaagaatcacagggttatgtgaaagtgcataaaccatacacacatactgtatgcataaaacctatgagacctcttgtgaacttttttagtatattactatagtagataacatttcaacatgtgccaggtactaatttgagtgtttcatataccttgtgtcatgcaatggtcacaacaactttatgaaactggtactatgtccctgttctacagaggagtaacctgaggcttggaggaagagtaactggctcaggatttcacaggtagtagtggcagagctggaactgaaattcaggcaatctgaatccagaacgaacattctttatctctttaccaaacaaacctttttttttttttgtattttgagacggagtctcactctgtcgcccaggctggagtgcagtggtgccatctcggctcactgcaacctcggcttcctgggttcaagcttcctgcctcagtctcccaagtagctgggactacaggcacacagcactgcacccagctgatttttgtatttttttttagagatagggtttcaccatgttggtcagacttgtctcgaactcctgaccttgtgatccgcccacttcggcctcccaaagtgctgggatgacaggcgtgagccaccgcgcccggcccccccaaaggcatttttcgtctctactaagccctcacacaaaatatacaagtgtgtaagtaaatttctctttctatcataaacattggccttggcataggaacgttaagtaaaactgaaaatgcaaatgaaccttgacatttttagtttcaaatattgcccccaaattcagcaaatttccaattactgtcgttgcatggtggtatcctcagcagatgggtgcaggaccccctgcagatgccaaaatctgtggatgctcaagttcctgatatacaatggtgtagcatttgtttataacctatgtacaccctcctatatgctttaacccatttcccatttagaaaaaaaaagtacttgacttggtgtggtggctcacgcctgcaatcccagcactttgggaggccgaggccggtggatcacttgaggtcaggagttcgagaccagcctggccaacatggttaacacccgtctccactataaaaatacaaaaaattagctggatgtggtggcgagcgcctgtagtctcagctactcgggaggctgaggcaagagaatagcttgaacctgggaggcggttgcagtgagccgagatcacaccattgcactccagcctgggcgacagagcaagactccgtctcaaaacaaaacaaaaaaaagaaagcaaaaaaagtgcagctcgctgccagcacagtattctcagggcaagcaagatatgagttaagtaatccctagattgcttataatactggctgggcacgatggctcacgcctgtaatcccagcacttagggaggccaaggtgggtggataatgaggtcaagagatcgagaccattctggccaacatggtgaaatcctgtctccagtaaaaacacaaaaattagccaggcgtggtggcacgcacctgtaatcccagctactcgggaggctgaggcaggagaatcgcttgaacccaggaggtggaggttgcagtgagctctgatcatgccaccgcattccagcctggtgacagagggagactccatatcaaaaaatatatatatttaatatatatatcaaatcatatccatatcaaaatatataaatatatatacatgcatatatatgtatgtatacctaaaacagtgtaagtactgtgtaaataaatagttgttaacctgtattttttgtttgcattttttattgttgtgttgttatttttgttggtttttgtttgtttttgagatggagtctcactctataaccccggctggaatgtggagtgcagtggtgcaatcttggttcactgcaacctccacttccctggttcaagtgattctcatgtcccagcctcccgagtatctgggattacaggtgtgcgccaccacgcctggctaattttttttctgtgtttttagtagagacggggcttcacaatgttgaccaggttggtctcgaactctcgacctcaggtgatccgcctacattagcatcccaaagttctgggattacaggcgtcagttactgtgcccttactgtgtgtgtttgttttgttttgttttacttcaaatattttcttctttttttttttttgagatggagtctcactctgttgcccaggctggagtccagtggcaccatctcggctcactgcaagctccgcctccccagttcacaccattctcctgcctcagcctcttgagtagctgggactacaggtgcccaccaccacgcccggctaattttttgtatttttagtagagatggggtttcaccgtgttagccaggatggtctcaatctcctgactttgtgatccgcccgcctcggcctcccagagtgctgggattacaggcgtgagccactgcacccggccttacttcgaatattttctattgtagttggctgaatctgcagatgtggaactcacaaatacagagggctgactatagatgagaaacacattatattcaagatttaccacttaagagtcctttctctaggtgcttatagaggttgagtatcccttgtcccaaatgtttggaaccagaagtagttcagattttggattttgatatatctgcgtatatataatgagatatcttggggttgggacccaaggctaaacatgaaattcacttatatatatatgtttcatatatatcttatacacctagcctgatggtaattttatacaatattttaaataattttgtgcatgaaacaaagtttgtgttaagtacttacgtgtggaatttttcattgtggcatcgtgtgggggctcaaaaagttttggattttggatcatttcaggtatcggatatttggattagggatgctcaacctctacagttttttagtcctagctgggcgccgtgactcacacctgtaattccagcactttgggaggctgaggtaggtgaatcacctgaggtcaggagtttgataccaacctgaccaacatggcgaaaccccatctctactaaaaatacaaaaattagccaggtatggtggtgcgtacctgtagtacctgctactcgggaggctgaggcaggagaatcacttgaacctgggaggcagaggtagcagtgagccaaattcgtgccactacactccagcctgggcaacagagtgagactctcaaaaaaaaaaaaaaaaaaagagtttctgattttggagcatttcagatgtcagatatttggattggggatgctcaaagtatatagttttggagtccttttggccccactgaatgactcctgtaaactcagatgctgtcttaccaacctgttttgcactctcctgatttttagtaagctttttaactgtagaaatcacataaaaagcttaaagattttcatgaagaaaatagaatttgccttcattattttggtttttttccccatctttttatttcaagcttatagaaaagtcaaaagaagttacagtgatctcccgttatacctttcatctagactcactattaatgtctggccatgtttggttttctctatacacgagtgtatataggtatgcatctgtatacgtgtacatgtatgtatgtgtgttgtgtgtgtctttttttttcctgaaccttttgaaagtaagtttgaggaacagttaccaggctgctgcagtgatctgtaagtggaaatgatggtgttttgtggtgtgagggtgtcatcgtaagtgctaggaggaggcgagtacaggacatcttaggtgcatacaggagagactcctaatgagtcttttctggtatccccaagaggcttcatgaagacagtgactggtaaactgcaacccaaaggactgtttggaattagccaggcaacaggtggaacagagcattgcagaggagaacatgcgtttgaggaaactgcatgtagatgtgtatgtccagatcatcccaggttgagatgaaaaaatggggagctgctgcagaaaggaatgagatttttttttttttttttttgagatggactctggctttctcacccaggctggagtgcagtggcacaatcttggctcactgcaacctctgcctcccaagttcaagcaattctcctacctcagcctcccaagtagctggattacaggcacccaacaccatgcccaggttatttttgtgtttttgagtagagatggggtttcgccatgttggccaggctggtttcccaactcctgacctcaggtgttctgcccatctcagcctccctaagtgttgagattacaggcgtgtgccactgcgcctgacgggagtagatcttttaagccaggcttaggaattgagattttattttaagggcaatggggagccattgaaggtgttgtttgtttgttttttgagatggagttttgctcttgttgcccaggctggagtgcaatggcacgatcttggctcactgcaacctctgcctcccgggttcaagcgattctcctgcctcagcctcctgagtagctgggattacaggcatgcgccaccatgcccggctaattttgtatttttagtagaggtggggtttctccatgttggtcaggctggtctcgaactcgcaacctcaggtgatccacccgccttggcctcccatagtggtgggattacaggagtgagccaccacacctggcccagatttacaatttttaaagaatactctgactggagggtgaagaaagaattggagagaggtctgagaagaggcaagggggccagttaggatccatgggcaagatggtggcagtgagaatgcaaagaggtagatgagattttcaggagaaagacttgacagcacagaactagatagggcgaggtgaggtagagattgcagaaagtcagaggcgagtcccagctttctagcttgggcagccgagtgggcgatggagcccttgactaagtagccagggagggaggagacactgaggtcagttgtgggtgtgattcgaagtgcctgttggagatgggttagagatgtctggctggcccctctgagctccaggatggaggcctggttgggaggcagtgcaggcaagtaacgccctgtgccttcttcccacacagcctcagcctcaccatgtgtgtcaggagctgtttccagtccccccgtctccagtgggtgtggagaacagccttcctgaaacacacccagcgcaggcaccaggggtcccaccgatggacacaccttggaggcagcacctacagagcggtgattttcgacatgggcggagttctcattccttctccagggagagtcgctgcaggtgagctattgattctgtttcactttgtgggactagagtggtggtgggagaatggagggtgatcgggaaggcagaggggaacacttgggcagcagtgtgtcccagcaggccatgctctggctctcgagtcgaattccaagcaccactagggggctgagtgtcttgggcgcatgattcagcttctccaaatcttactttcctcatcattaaatgagctaatggtagtgccttcctccttgggatttggcggagagttatccgtgggaagcacttgcttagcacagtgattgctcagtgcatcctaaattctcaatcaatgatgagctgccatgaatgctgtgattagaatttaaccaccaaggcagggcacagtggctgaagcctgtaatcccagcacttttggaggccgaggtgagagggtcgtttgagcccaggagttcaagaccagcctgagcaacatagtgagaccccgtatctgcagaaatttaaaaattatctgggcatgatgacaggcacctgtagttctagctactcaggaggctgaggtcggaggatcacatgaatccaggtggttgaggctgtagtcagccgtgatcatgccactgcactccagcctgggtaacagagcaagacccttactcaaaaacaaacaaccaaaaatcccaaagaatttaaccacttcttcttgggaactgttctacttctgaaatctagaatgctgaaattccccttttgattacagccttcctcccttctaccccactccctctaaacctgcttctggactgacagggtaagggtcagccctctggtctctggtcttctctttaccagccccttcctggttttacttcttttctactcagttcagtttttattagttaaagtcgttttggcttcaagcagtagaaaacctaacaaaacagtgactgaaacaagctagaagtttctttctcttgcacataaaagcccaggtatgtggtctggggcactgtgtgatgcgactctgtggtatcagggactccgactctttatagcatgttgctctgctgtgacttttcatttccactcttacattgtggtctgtcttggctgtgtcgcctcctgctatcatattctcatgccagccagcaggaaggacaaagggccaggcagccatccctctccttttgaccttctgtggtggctggttggccagttctccatcctaaatcaacccaggcacaggttttctatgcctgcgtgtctaggctttccagcactgctgaccaaattactcagccgtgctaactggctgcacaagctggtttctgagctccagcctcagttgggccattggtgctacgcctgagcctctctgttccttcactcttatctctctgttccttcactcgtatctctgtcatgtttacctcaggggctgttccagactgtccactccccctgctccttaccacccccaaatattcttgctctgcagatagctgaatctgttcttctacaaagaacataaagactaaacctgagcaacacagtgagaccctatggtgagctaggattgcaccactgcaccccagactggcacaacagtcttttttagagaacctgtctctaaaaaaaaaggcagcagggaagaacataaagatcactggacagaaagtttcttgactttctctagaatatcttaagaaccaattcacttctctccattgccactgcctccacccttgccttctctcacccaaatgatgtcatcagcctcctaacttcctctgcctctggctctctggattttacaaaatctcctcccagctccagaattaacctttctaaaacatggatcgtgcttctgcgcttagcagctcacacctgtaatctcagcaatttaggaggccgaggtgggcagatcgcttgagcacaggagttcaagaccagcctggccaacctggtgaaaccttgtctctacgaaaaatacaaaaagcgtacctgggcatggtggtgcatggatgtagtcccagctacttgaggggctgcggtgggaggaactctttagcctgggcgattgaggctgcagtgagctgagattgcaccactgcactccagcctgggtgacaaagtgagaccctgtcacaaaataataaataaaataaaaataaagcatagatcttgttcctttcatccctggcttgaaaatcttgaatgcctgcatgtggtcccctagattaagtctagaagctttcacctgggattcagggctcctctcagttttagctttcctgctatggactacctgatgctccccaggcatgccaggcacatttgcatgtttgtgcctttgcaagctgtgtttcctccctgcctcctctgcctgttcaaatcctactgatgcttttaatggcaaatttaaggggatattattcagcaatgactggaatcttttgaacactcagtaaatctcatggttgttactaacttcaagagtcctcttctgtcaagacttctccaacctcatttgcaacctgggcagaatgttcctggatagccaattcccattaagtttcaccttcaccgagatatttttgtttgcagtgggatatgttcatgtctcctctatggggctcttggattccaggaccccaggtctgggatttcttcacttcactgttgcagtgttagctctgcaggctggctcagtcattcaggaaatgtttgatgggtaaatgtgaacaaaatagtgatgccttctactttgtcttttgcttgactggagcttctaatgttatttatttcaaatgaaccatatcaagggtcatttgataagaatatactagaattggccaggtgcggtggctcatgcctttaatctcagcactttgggaggacgagatgggcggatcacttgaggtcatgagtttgagaccagcctggccaacatggcaaaatccaatctctactaaaaattcaaaaataagcggggcatggtgatgggcacctgaaattgcagctactctggaggctgagcagggagaaccacttgaacccgggaaacagaggttgcagtgagctgagatcataccattgcgctgcagcttgggagacagagcaagactctgtctcaaaaaaaaaaaaagtatatatatatatacactagaattactgtactatactatttttttttttcttgagatgggatcgcgctctgtttcttaggctggagtgcagtggtacaatcatggctcactgcagcctgaaactcctgggctcaagcaatcctgcctcaggctcccaagtagctgggactacaggtgtttgccactatgcctaatttttgttttttatagagatggggtcttgctatgtttctcaagctagtgtcgaactcccgggctcaagtgatcctcctgccttggcctcttgagtcattggaattacaggtgtgagttaccatgcctcacctgctgtctgtttttgtatggcctgtcagccaagaatgacttttatgttttgaaatacgtaattgaaaaatatcaaaacaagaataatattttgtgacatgtgaaaattatgtgaagttcatatttcaatgtccataaaaatgaaattttttagaaaaccatcttgcccatttgtttacatattgtccatgactgcttttaccctgtactggcagagttgagtaatttcaacagggtccgtaatgctttcaaagcctaaaatatttaccatctggcccttttcagaaaagcttgatttaagctgttagtttactataaaattagtacgcacaacaaagaattcaaagtatagcccaaacattttagtttttttattttttattttactttatttttctccaagaatgcattttcagaccaaagctcaaacactttaagattgaatttaggccgggcacagtagctcacgcctgtaatcccagcagtttgggaggccaaggcaggtggatcacgaggtcaggagattgaaaccatcttggctaacgtggtgaaaccccgtctctactaaaaatacaaaaaattagccaggcgtggtggcaggtgcctgtggtcccagctacttgggaggctgaggcaggagaatggcgtgcacccaggaggcagagcttgcagtgagcctagatggcaccactgcactccaacctgggcgatacagcgagactccgtctcaaaaaaaaaaaaaaattgggcatggtagtccatgcctgtaatcccagatactcgggagactgaggcaggagaattgctggaactcgggaggcagaggttgcagtgagccaagatagcaccactgcactccagcctgggtgacagatcaagactccgtcttgggagaaaaaaaaaattgaattcagagggtataatgatttcgaaacttcaaaatgtttgactttaaaatttttgttagtgtgatagatgaaaattccatctttgtggtttcttttcttttccttttttttttttttttgagacagagcatcattccattgcccaggctaaagtgcagtggcgtgatcttggctcactgcaacctccatctcccgggttcaagcaattctcgtgcctcagcctcccaagtagctggtattacaggtgtgtgccaccatgcttggctaatttttgtattttcagtagagacagggtttcgccatgttgaccaggttggtctctctcttttttttttttttttttgagacagagtcttgctctgtcgcccaggttggagtacagtgatgctatctcagctcactgcaaacttcgcctcccgggttcacaccattctcctgcctcagcctcccgaagtagctgggactgcaggcatccaccaccacgccctgctaattttttgtatttttattagagacaggtttcactgtgttagccaggatgatctcaatctcctgatctggtggtccgcccgccttggcctcccaaagtgctgggattataggtgtaagccactgggcctggccttttttttcctgttattttaatgttcatttgcctgattgcaactgaggttgcgccttttttttttttttttgagtcggagtctcacatttgcctgattgcaactgaggttgcgccctttttttttttttgagtcggagtctcactctgtcacccaggctagagtgcagtgctgtgatctcggctcactgtaacctctgtctccctggttcaagctattctccttcctcagcctctcgagtagctgggactacaggtgtgcaccaccacacctagctaattttttatatgtttttagtagagatggggtttcaccatgttggccaggctggtcttgaactcctgacctgaagtgacttgcctgcctcagggttccaaagtgctgggattataggcacaagccactgcatctggcctttttttttttttttttcagagagcatcttgctgtatggcccaggctgtcaggctggtctcgaactcctagtctaaagtgattctcccgcctcctgagtagtgagcctttttttttttttttaatattattggtcattcagtttttccgtgaattgctcacttttcttgttgattttcagtaaacctttttttttttgagacagacttttgctcttgttgcccaagctggaatgtaatggtgcaatcttggctcaccacaacttctgcctcccaggttcaagcgattctcctgcctcagcctcctgagtagctgggattacaggcatgcaccaccacccctggctaattttgtatttttagtagagacggagtttctccacgttggtcaggctgctctcgaactccctaccttaggtgattgcccgccttggcctcccaaaatgctgggattacaggcatgagccactgcgcccggccggtcataaccgtttatctgttacatgatttgcaaatattttctcccttttatgccttgtcttttgattttattgataatgcttttagctgtaccaaagttttctttttcttcctttctttttgaaacggaattttactctgccactcaggctaaagtgcagtggagtgacctcggctcactgcaacctctgcctcccaggctcaagctatcctcccacctcagcctcacaggtagctgcactataggctcgcaccaccacacctggctaatttttgtattttttgtagagatgggttttcaccatgttgcccaggctggccttgaacttgggagcataaacaatctgcccacctctgcctctgcctcccaaagtgctgggattttagccatgagtcaccacgcccagccttctatattattttctaagttttagaattttgtttttctgacttggatatttactgtattgggaatttgttttgtgatggcctgaaagatgatttaacttaatttctattccatattgaaacctagttatgccaaccccatttattgaatagtcactgctaaaagagcataaaatacagataaaatttcctgctgccacctcgaccctttcccagttggttccagacttaagtggttatcattgtgaaaagtttcttgtttatttttgaaaaattgcccgtgtgtgttgggggtgggtgtggggggcatatacaaattggatcatatgctgtagactgttccatagcttttttttgactcagtatgatattttgccatctttttcatatcagttggcatatgtctaggatctagtttggaggttagtaaactttttctataaagggctagacatggtggatgtgatggcttatggctacgatcccagcactttgggaggccgaggtgggagactgtttgaggccaggagtttgagactagcctgggcaacatagtgagatccccatttctacaaaaaataaaaaaattagctgggcatggtagcacgcacctgtaatcccagctactcaggaggctaaggcagaaggatcacttgatcctgggagcttgaggctgcagtgggccatgactgtgccacagctccccagcctgggcaacagcaagaccccatcttaaaaaacaaaaataaagaagggctagataggctttgtgagccatactctcagtcacaactattcacttctaccattgcagcaagaaagcaataatagacaatagtaaacaagtgtggttgtgttccaataagactttatttacgaaaataggtagagccaggcatgctggtgtgtgcctgtagttccagctactagggaggctgaggtgaaggttcatttgagcccaggagtttgaggccagcctgggcaacacagcaagaccccatctcttaaaaaaatagataggagacagatttggccccaagccatattttgctgacctttgggcaagtttatatgttttaacatctgtgtggtattccgttatatgaatatatcataattgatgtaataaacaccttattagtatacatttaacttttctagttctttttattatgagcaattctgcacaaacaaccttgtacataacctttgcttactttcataaatatatatggaagaaatttctgaaagtagaattactacgtcaaatgtatgtgcatttcagattttgacagaaattatcaaattgctgtctgcagaggttgtgcttgtttacgctcccgtcaacagcatatgatggtgccggtttcctcacatgcttgccaactccgagactgtgaaaaatgctatatgctttagctctaaaattaaagtattttttggattgagttttaaaagtcttgttattttcaaaggacatataccagattgttaacattagttatttctgaaagaagataggactgcttgtccttttactttccttccttccttccttcctcttctttttttttttttttttttttttttaagacatggggtcttgctctatgtccctaggctgcagtgcggtggcaccatcatagctcattgcagcctcaaactcctgggcttaagcgatccttccacctcagtttcccgagtagctagaattacaggtgcaacccatcacgccaagctaatttttaaattttttctagagacagggtttaatcatgtggcccaggctggtatcagactcctagcctcaagcgatcctcccattttggcctcccaaagtgccgggattataggtgtgagctactgcacccagcctactttcttttgcatagttttctatgaaatatattgtctgaaaaattttcaatgcacagacactactttatcagaaaaaaacaacaaaggtgttttaattccaaaacaaaagctatatgtaaagtgtattttgtcttagatatataattatgaatgttgtatgtatatatttgcccccagcatctgtattatagacagaaaaagcaactgtggatgaggagaaacagtccttgcacaaatgttcccagtattctacagatgctgatgctgatccatccactgccttagctctttgtggacagaaatttccttcttggccaggcacagtggctcacacctgtaatcacacacagtaccttgggaggcccgaggcaggcaggcagatcacctgaggtcaggagtttgagatcagcgtggccaacatggcaaaaccctgtctctactgaaaatacagaaattagccaggcttggtggtgcacgcctataatctcagctacctggggggctgaggcacgagaatcagttgtacctgtgaggtggaggttgcaatgagctgagattgtaccactgcactctagcctgggtgactgagtgaggctttttctgaaaaaaagaagaaatttgcttccttatccacaaagacagcatttcaggcgaacatttcagtgtactcactccatgctgtgaagaattactatagcctatagaaggaagggcatgttctaggggccaccaggatctggcttcttccttcatgtgcttccatagtctctgccaggtccaggtaagtgacctaacatatggtccagtgaatatgagatcaaggaataaaattcatcatgcagtgcccggagtcctctcaagcaaccactgaggatctgatgcttcacagcagtgtgctctctgttgtacacattagcattgctcttcctctgggggtctaaggttgagattttgcattttgtgaatgtctgcaaatttccaacagcatccaccctggcagtacagcgagtccgtaggaactggtatggtaattttcctgagctccctaaaccccagcatgtatcaatgtattccacttttgcatattttgcttcctatagaatgggaggtacagaatcgtatcccttctggaactatattaaaggccttgatggaaggtggtgaaaatgggccctggatgagatttatgagagcagaaataacagcagagggttttttacgagaatttgggagactttgctctgaaatggtgagtggtaaacatacctacatttccatatttttctttttgccttgagtagtggttgcaacattcatgtataagttagttaaactgaaaataaagtgaaacctaataacccattacatgttttaaagttatttcttaggccaggcgcagtggctcatgcctataatcccagcactttgggaggcccagggggtggatcacctgaggtcaggagttcgagaccagcctggctaacatggtgaaaccccgtttctactaaaaatacaaaaaattagctggctgtggtggcgcacatctgtaatcccagctatttgggaggctgaggcaggagaattgcttgaacctcaggggtggaggttgcagtgagctgagatcatgccattgcactccaacttgagcaacaagagcgaaactgtctcaaaaaaaataataataaagttatttctttcacccctaggtgttcaatgttcaattcatatatgaataactaaaaatattcttagccaggcgtggtggctaacacctgtaacttcagcactttgggaggctgagacaggagaagtgtttgaactctggagtttgagaccagcttaggcaacatagccagaccttgtctctactaaaaatcaaaaaaattagccaggcatggtggtgcacacctgtggtcccagctattcaggaggctgaggcttgagccctagggattgaaacttcagtgaaccatgaccgtgccactgcactccagcttgggcaacgtaacaagactctgtctcaaaaaaaaaaaaaaaaaaattctttactaagttcctccagcatatatttttttaatgttttctggtgtattataaaggatgttatgaaggatacgaatgaacagccagatgacaagatacctgggggcaaaggttttagagccactgtgccctttccaggcctgccaccctcctcccagcacctccatgcattcagcaacctgaaagctcccctctaatagatactaaaacaggagctgtctacataatggctttgataaaaaagcttttttaaagcaataataatattgaacattttttctgtactgtgcactgttctaagctctttatataactcatgtaaccacaatagctctactaaaatataatttaaaatatagtaagaaaagttctgtaggtagatggtgatgatggtgatggttgcacgacaacacgactgtacttaatgccactgcactgtgtacttaaaaatggtcgagtgcagtggctcacacctgtaatcccagcattttgggaggccaaggagggcggatcacctgaggtcaggagttcaagacaagcccggccaacatggtgaaaccccatctctactaaaaatacaaaatttagccaggcgtggtggtgggcatctgtaatcccagctacttgggaggctgaggcaggagaattgcttgaatctggggggcagaggttacagtgagccaggatcaagatcacaccactgcactccagcctgggtgacagagtgagactccatctcaaaaacaaaaacaaaaaaaggttaaaatggtaaattttgtgttacatatattttccacaatttatatatatatatatatataaacatatatgtgtatatgtaatagtaaactttgaaaacattatgcaaagtgaaagaagccagtcaaaaaagactgcatggtgtatgattccatctgtgtgaaatgtccagaataggcaaacccatagagatagaaagtagattggtggttttctagtacaaggagactttgggggaaatgaggagtgactgttaatgggtacggtttactttttttttttttaattttttttttgagacacagtctcactctgttgcccaggctggagtgcagtggagcaatctcggctcactgcaacctctgcctcccgggttcaagcgattctcctgcctcagcctcccgagtagctgggactacaggcgtgtgccaccagctccagccaatttttgtatttttagtagagacggggtttcaccatgttggccaggatggtctcgatctcttgaccttgtgatccgcccaccttggcctcccaaagtgctgggattacaggcgtgagccaccacgcctggctggtttgctctttagagtaatgaaaatgtcctaaaattgatggcagtgatggttgcacaactttgtaaatatattaaaaaccattgaattgtactctttaaataggtgacttgcatggcatgtgaattagagttcagtaaagctgttctaaaatctgtgtgtgtatatgtatatataaaacagcagacttgcctttgcagattttgaaatgtgataatataagagttttctttctttctttctttctttctttttttttttttttttgagacggagtcttgctctgttgcccaggctggagtgcagtggcatgatcttggctcactgcaacctccgtctcctgggttcaagcaattctcctgcctcagcctccccagtagctgggactacaggtgcgtgccaccacgcctggctaattttttgcatttttagtagataaggggtttcaccatgttagccaggatggtctcgatctcctgacctcgtgatctgcctgcctcagcctcccaaagtgctgggattacaggtgtgagccactgcgcccagccttataagagttttcaaaacccacacagattgaatttaaaaacaagaaaaaaattgatcagaaactaaagttcataatggtgatactgaggcaatataaaaagcattaaatgacttctcaatcattaaaaattaaattacatatacttcatatacttttagatttcactgtatcctcttatgatatgctgttttttttttcaactagcaatccatgagcagaataaagaactcatttaattgtaatattgatataaatagctccattccctactgtgttgctcaggctagagtgcaatggcttgatcatagctcactgcagctccaatctcccaggctcaagccatcctcccacctcagcctcctgagtagctgggaccacaggtatgtgccaccaagcctagctaagttaaaaaaaaattttttttagatctcactttgttgcccaggctggtgtcaaaatcctgagctcaagcagtcttcccacctcagcctcccacagtgctgggattacaggtgtgagccactgtgcccagcctataactctagtcctggataacttttaaaaaccttatatgagagttcagcacaggggctgaggaacacagttcctgcaggcagcaagctatgagcctgggctcttgtagcagagagcagaaggacgccaggaataagcattttttttttctgttggccatgagtgtttgtcactcttaatgattgctgttctcctgtgccctctcctgttcttagttaaagacctccgtgcctgtggactcatttttctctctgttgaccagtgagcgagtggcaaagcagttcccagtgatgactgaggccataactcaaattcgggcaaaaggtcttcagactgcagtcttgagcaataatttttatcttcccaaccagaaaagctttttgcccctggaccggaaacagtttgatgtggtaagcttgagctaattgaaaaccattggaacagaatctgtgccctcgcttcagggtgcaatgttaaatgctatcttccagcaggtcttgagtgagggagtttttccttcagccacttgactaagttaggtttaaatgcaatatgttgaaaacagaccctttaagatatcactgtgttcttagcaaggtcagacatttatggcatttgattactggttgacacttcagctttacattctaaattcgaaccttagtcttcatataacacaagcatctctgtcagccctcatatcgtaatggatcctttggccttttctaagaccaactatgttgccttctatttctgtgacgttagttcctagaccagtgctgtccaataaaattttactgccttcctcggcctgatttacttccatactaaatccatctgctccatgtgtgtatcccaacctgtcatgtgataaacctatcgttttgacatgcttggctatatttgggtactttacctatttatttatttttatttttttattttgagatggagtctcgctctgtaacccaggctggagtgcagtggcacaatctcagctcactgcaacctctgcttcccaggttcaagtgattctcatgcctcagcctcctgagtagctggaattacagatgtgtgccaccatgcctggctaatttttatatttttagtagagacgggggtttcaccatgttggccaggctggtctcgaactcccaacctcaagtgatccacccacctcagcctctcaaagtgctgggattacaagtatgagccaccgtgcctggcctatttatttttttatatatatatatatatatatttttttttttgagaccatctcactctgttgcccaggctaaagtacagtggcaccatctcggctcactgcagcctccaccttccaggctcaagcagttctcctgcctcagcctcctgagtagctgtgattacaggcatgcaccaccacccctggcaccaccacccctgaatttttagtagagacagggtttcaccatgttggccaggctagtctcgaactcctgacctcaagtgatctgcccacctcagcctcccaaagtgctgggattacaggcatgagccatcgtgcctggcccctatttgggtactctctttttttttccttgagagaaggtctctctctgtcgcccaggttggagttcagtggcgcaatctcagctcattgcatcctccacctcctgggctcaagcaattctcgtgcctcagcctcctagtagctgagactacaggtgcatgccaccacgcctggctagtttttgtgttttttatgaatattagagactgggtttcaccctgttggccagggtggtctcaaacttcagacctcaagtgaccaacccacctcagcctcccaaagtgctgagattacaggcatgagccactgtgcctggccctatttggatactttaaaaatgtttgtttttgtcttataaccaacagcagtgataattccctttagaaactccaaagcccagattggcagttgatcttccagcaccttttagagttgtgatggatcagaaggacccttcccctggcccattcctccaaggatattctgagtcagtgcaaaagggaacagctcatgaaatatagtgagagtcatggtagcctctagaacacatcagattaaatttctctgataactcaagtattggacattttgctaccagagcccctttctgattctttccatctttggaagagctacttttgctggactccaggaagtggcatattaccttagccctacatctgcctatgcctgggtgtatttgtacccttcgttgggccagtgagattaaagattttcaactctgcctacacatcacatgacctgggagtttgtaaagatgctgggtctgtttccctggaggctttcattgagtatgtctagttgggatccaggcatgtgtatttcgaaaaagctccacaggtgattctgccttgcagctggggtgagataccccaagacgcagtgagggacttcagattctgtccatgcttttctcttatcagacagcctctgtcatgcttaccttgagaaggaggcttcccctccatcttcctgggatagagccttgataaataaaatcatttttatctgatctacatttggaaaaacactgaccttgttcccacagttcctgctttgccaagaaagtaatagaagccctgaataagttcatgccatcatgtgcaaaataagaaagagaaggctagagatcttatcaaataaatcttaagaatttattttacttcccccagatgtaattcacctagtgagaggagccgaatgcttcctggaactttgccccatcccccccaattccctccactctcctagctcttgtctcagccagtacagctctgccacttccatctggtacgttacatcgactggtgtctgaaacaccctgcttctgtacttctcactattgacgttttctttagggtagcctcttagactttttttttttagctcattcaggtccttaggagacaagagaaagtagaaaggtccagtttattccagacatttatttacctgaaagggcagttctcacccaacccagaatgcaagtgtagggtagagagaggggccactgggtttgtccttggccttggagagcttgggtcattccaagtggcaagtcagagatttagttctgttcttagggcagatcagagggtattggttataggctatgtggctataggagattgggcccactctataggagattacgccctggggacactgtaaaaggactttcggggaatcagtggatcagagacagcctgacactgagaaggctttcccgtgttctcctgaactctcaccagcaccctccacccattacggatcagatatgtggctgaagcaaggtcgtcagagtacaggagcctcttagcatgtcaggaacagtgtcagccctcccatggaatttctgtctaaatggagtatggatgggtttttaacctctgaaataaacactaagttcgtatttattttatacctgtaatagtgtcttctttctgcaaaaaaaaaaaaaaatggcgaaatgctttccgtcaaactgacatgtacagcttttcttctgctctgtttagccccaagatgtgacattagccaaatgctttgtcattttggaacccacttaagtttcatttaagtttcacaacttactgagctaagataggtacgatgactattaatattattcccattttattgatgatggcactgaggcccattatggctttgctcgtttgcacagggtcacagtgtctgaaacagacactttggtttctcgagtttgcccccacgttgtaacccagtattgtcaaattactcaatgtaagaaggcaacatcattttatatcataacactcttaaattacttgttataataaatctcaactgtccttcttatgcttttcctctcaaaaagtttaccagcatgcatgtgggagctccacctttcgggacattcatctctcattcctgtccctccatcagattgtggagtcctgcatggaagggatctgtaagccagaccctaggatctacaagctgtgcttggagcagctcggcctgcagccctctgagtccatctttcttgatgaccttggaacaaatctaaaagaagctgccagacttggtattcacaccattaaggtaatagtcactaatttttgaactccctcccatgcaccagccactaatgcaatgtttctctgtaatctttttacatttgtagctctagctttccttagggtttccccctgtgtttccatagtcatcttattttgtgttaattatgaaatctatgtgactagctgcttgtattttcaatgggaagcaagacaaacaggtactgcgaaggcaggttgagaaaagagatgggaaaggaggtgaatggcaggcttaagacctttgtgggggtgttcacactgtcctcatgatccagtgatgctgccttaagtggggagccagtggccaccagccatgcaggccatgcagctcactgctgtaaagcacgagaagccatgtgagggggtctcatgccaacttttttctattctttttttttttttttctcatacagggtcttgttatgtcacccaggctggagtgcagtggtgcaatcatagctcactgtagcctcaacctcctgggcttaagtgatcctcctacctcagtctcctgagtagctgaccagaggcatacaccaccacacccgactaatttttgtattttttgtagagacagggttttgccgtgttgcccaagctggtgtcgaactcctgggctcaagcgatctacccaccttaccctcccaaagtggtgagattacaggtgtgagccaccatgcctggcttctattcttctatgtttgggttttcatcgtcgagctgatgggcctgtagggtaagagcaaacgttgtaacataatcttctttcttcttggcacaagagggtattgtgaaatttttttttttttttgaaacagagtttcactttgtcacccaggctggaatacagtggcatgatcttggctcactgtaacctctgcctccctggttcaagcaattctcgtgtgtcagccccctgagtagctgggactataggcgcacgccaccatgcccggttaattttttgtattttagtaaagacagggtttcaccatgttgcccaagctggtctcaaactcctaagctcaggaaatctgcccgcctcgcctcccaaagattcacggcctcaccacgcccggccgtgaatcttttttgagatgaggtcttgctaggttgccgagggctttgaactcctggactccagcagtcctcccacctcaggcttcccaagtggctggaactgtgggtgcacaccatcatgcctagctgttttgtgaaccgttgaccagtgcttctctctgcaggatagaaagttcagtgtggttaggagttaaatgggaagaggaaatgcattctactgctccctcattagctaaatatcctgggttcgaaggccttcctcagagtactgacttctttgataatttccctctaaaggactaccctttgtaaaaagtaaagtagaggttcttctttaaagactttccttattatttaattaggaataaatagtaacttcttttagaagcaaaatttatttaaagacctgtgctaaattttttgttgttgttgttgttgagacggagtctcattctgtcgcccaggctggagtgcagtggtgcagtcttggctcactgcaagctccacctcctgggttcacgccattctcctgcctcagcctcccaagtagctgggactacaggcatccactaccacgcccagctaatttttttgtatttttagtagagacagggtttcactgtgttagctaggatggtctcgatctctcgatctcctgacctcgtgatacgcctgcctcggcctcccaaagtactgggattacaggcgtgagccaccacacccagctgacctgtgctaaaattttttttttttttttttttgagatggagtcttgctctttcgtccagtccagactgcagtggtcctatcttggctcactgcaagctccatctcctgggttcgcaccattctcctgcctcagcctcccaagtagctgggactacaggcgcctggctaattttttgtatttttagtagagacggggtttcactgtgttagccaggatgatctcgatctcctggcctcgtgatccacccgccttggcttcccaaagtgctgggattacaggcgtgagccaccgcgcccagctatgctaacatttttaaatatttgctagctgcaataaagaaattaatgtattttatgtttttagttcctgcaatttagtctaaatatttgccttggcctgctaatactggtccaagcaagtattgggtcatagcttgttcctcttctttatttgaaggtgtttttatttttctcagcattttacaagttacttccttcttcctttgttttcctctacctttgcctcttttaaaaagttttaagttgctagccaattaggacaaatacagaatgtaaagtctcgttccagccaatggaaactggacacagcagtaggatggatgcgtcagcttataaatgaccctgtctcctttgtttggtgtactgttgtggcaaaactgctggtgagtgtaccctttctgcaggaagtaaaaatggccttgctgagtaaattaaatttatgttcaagtgctatgtctttgtggcaccggggaacaaacatttcagacacctcctaggaaacagataggagcccctgaggccaggattgactgctggcacctgttcaatatatattctctgcacctgtactaccatgaattgtaaaattaaaaatatatacgtgtatatattctcaacatcctgtgaaaggaagggaaaaataacaacaacaaaaaatatacatctacatattctctctgaaaccaggttaatgacccagagactgcagtaaaggaattagaagctctcttgggttttacattgagagtaggtgttccaaacactcggcctgtgaaaaagacgatggaaattccgaaagattccttgcagaagtacctcaaagacttactgggtatccagaccacaggtatgtgggcttctttcatgttttggtagctctctccaaggcgaaggttttggtctgtttctcacttttcaaccctaatggaatgggctggagacaaagaagctttacagtgaggaaaatagccattgggcctggtgcatcggagcactgctttcagttttgcttgggaaaaagcattaacttccctatttatgcatctccaaaagtgtacctatcccactcttacacctgagagtgtggtatggcagtggttgcctgctttcaacagggagaggaacttggggactgcagtgtgtgctcagaggattttacagtttctaatgctttgagacgacagcccattttgtgaagacgacttagaagttacatcggcaggcgggtgcggtggctcacgcttgtaatcccagcactttaggaggccaaggcaggtggatcgcgaggtcaggagtttgagaccagcctggctaacttggtgaaaccctgtctctactaaaaatacaaaaattagctgggtgtggtggtgggtgcctgtaatcccagatactcgggaggctgaggcaggagaattgcttgaacccaggaggtggaggttgcagtcagccgagatcgtgctactgcactccagcctgggtgacagagcaagactccatctcggggggaaaaaaaaaaagaatttgcattgctgaccggggcgtagtggctcacttctgtaattccagcattttgggaggccaaggcaggtggataacttgaggccaggagttcgagaccaggctgaccaacatggtgaaaccttgactctactaaaaatacaaaaattagctgggtgtggtggtgcacaactatagtcccagctgctctggagactgaggcacaacaattgcttgaacctgggaggcagaggttgcagtgagccaagattgtgccactgcactccagcctgggtaacagagtgagactccatctcaaaaaaaaaaaggaaaagaaaaaaaaaaagggctgggcgcagtggctcatgcctgtaatcccagcactttgggaggctgaggcaggcggatcacctgaagtcaggagttcgaggtcagcctggccaacatggcaaaaccccatctctactaaaaatataaaaattagctaggtgttttggcgggcgcctgtaatcccagctacttgggaggctgaagcaggagaattgcttgaacctgggagactgaggttacggtgagctaagatagtgccactgcaggcctgggtgacagagcaagactccgtcccccccccaaaaaaaaaaggaaaaataatgttgctgggtgtggtagctcacccctgtaatccccagtactttgggaggccgagatgggcggatcatctgaggtcaggagtttgagagcagcctggccaatatggcgaaaccccatctctactaaaaatacaaaaattagccgggcatggtggcacatgcctgtagccccagctacttgggaggctaagacaggagaatcacttgaacctggaaggtggaggttgcagtgagctgagatcatgccactgcactgcagcctgggcagcagagcaaggctctgtctccaaaaaaaaaaaaaaaagttgcatgattttaaaacgcaacaaattgtctccatttcttggagacaagttttctctttcctccttcacattcccccctcagaaaaccaggtgccttgtgtgctttagaggacacttttgggccaggggtggtggctcatgcctgtaatcctaccactttgtgaggctgaggtgggcagatcacttgaggccaggagtttgagaccagcctggtcaacatggcgaaactccatctctactaaaaatacaaaaattagccgagtgtggtggcgcatgcctgtagtcccagctactggggaggctaaggcagaatcgcttgatcccaggaagcagaggttgcagtgagctgagatcacgccactgcactccagcctggacgacagagggagagtccatctcaaaaacaaaagaaaacaaaaaagaagacttacaaaattttttaaattaaattaaattaaattttttttgagatggagttttgcccttgttgcccaggctggagtgcaatggcatgatctcagctcactgcaacctccgcctcttgggttctagtgattctcctgcctcagcctcccgagtagctgggattacaggcacccactaccatgcctggctaatttttgtatttttagtagtagagacggggtttcaccacgttggtcaggctggtctcaaactcctaatctcaggtgatctacccgccttggcctcccaaagtgctgggattacatgagcctccgcacctggccaaagaagacatttttcccaggtaataaaggcttcacccacttgctccgtgaaaaaggcttttattgatggagtttcatgttaggatgttttccagcaattggattattggtagtggcctctgcacagctgaggcgcccactctggccagccagaagaactcaggccgagttctgttgcttgcctactcttctaaccaagtgaaatcagtctatacccagggttcagtcttcttatggagctgagaatgaattagtttcacctcagccaggatcctgcaagggagccacagaattcagcctagtgcagtgggaaattacatctcatgaaagcagctttgggtcaggccgaaggcctctgtgtcactcctttcagctgtcccagcagtgtcaggcagagggacgtgcaagggcacctttcatcctcaggcttaaagcattccatttggcaagatgggttgccatggctgcgtttgtgcttgataaacagaatgaacatgtttttattcatggagcaggagctggcaggaaggacaaaattggacacctgcacaaactgagaaaattactgtggtataaaatgaatggcctttgacaaactgtagtggcatgtgatcctggacctgagttggcggagtgtagacctgggactcagtcactcctagtaggcagagaagaggtacttttcttgcactgcatggcagatgaggatattttgaagcccaaatgcagaactcattagaaagaaagaatgtctgctcagatctgtcctccagggctggtttgagttttctttgttttcaaacttgcaggcccattggaactacttcagtttgatcacgggcagtcaaatccaacttactacatcaggctggctaatcgtgatctagttctgaggaagaagcccccagggacactccttccatctgcccatgccatagagagggagttcaggtaagttttcagggccaggggagcacttgcccactagcctccactgtgcacaagctcagccctaaactgaaaagtcagcactccataaaaataccccaagacatttaaaactacaattatgggccaggcttggtgggtcacacctataatcccagtgccttgggagaccgaggcaagaggatcattgagcccaagaggtcaagaccagcctaggcaatgcagcaagaccctgtttctaccccccatccccccccaaaaaaaagcctgggtgtgctggcatgaacctgtagtcacacctactcaggaggctgaggtgggaggattgcttgagctgggaggttaaggctacagtgagttactgtggcatcattgcactcccacctgggagacattgtgaaaccctgctccaatcccccaaaaagccaaatgtaaattagaactattctggaaaacaatatgatacaatttattaaaagcctcagcgttttcatactttcagacctaataattccaattctggggctctgtcttaaagaaataattctaagtagggggaaacagctgtatgtattaatatgctcaccataaagttgtttaataataagaatttggaaggccaggagcagtagctaccatagtcccagcactttgggaggctgaggcaggtggatgacttgaactcaggaattgaagaccagcctggacaacatagtgaaaacctgtctctaccaaaaatacgaaaaattagttgggtgtggtggcacatacctgtagttccatctactcaggaggctgaggtgggaggatctcttgaacctgggaggtggaagctgcactgagccgaggtgggcaccactgcactccagcctgggtgacagagcgagactgtgtctcaagaaacaaacaaaagagtttggaaactacttaaatatactataatctgtaccataatcaggaaataattaagtaaaccttggtatatatactgtcgcaatgacagtaatagtaatagctaacatttatcgaatggttaatatgtgccaggcactaaaataaatgcttcgaatgtctgttactgcagagcatcctcacaactctatgatatgttacaattatagtcctcatttacaactgggaaaagtaagccttaaagaaaccaaggcaggcagatttgctttgagctcaggcgttcgagcccagcctgggcaacatggtgaaaccctgactctacaaaaaatacaaaaattagccgggtgttggtgacttggacctgtagtcccagttacatgggaggctgaggctggagaatcacttgaacccaggaagcagaggttgtagtgagctgagatcgtaccgctgcactcacaaagtgagaccctgtctcaaaaaaaaaaaaaaaaaaaaattaaccagcatacccagggtcataaaactagtaagcaagtgctagagtctggctttatagccagtctgtgagatttcatagctcacctttaatgattatgctgttattgcagctaataaaagtatgcctataataacaaatgtgtatgataaaattttaagatagtaaaggcagatacaaactgcatatatagtattagctgattttttttttttttttaggcagagtgtcactattgtccaggctggagtacagtggtgtgatgatacctcactataatctcgaactcctgggctcaagtgattctccgcctcagcctcccaaatactacaggcacatgccatcatgcctggctagttttaaaaatttttttgtagagatggggcctcactatattgcctgaactcttggcctcaagcaatcctcccaccttggcctcccaaagtattggggattacaggcatgagccagcgtgcctggccaaggtttttgattattaattcaatttaacaaaaatgttgttactcagatattttatttcatcttgttttagatttggtaagttgtaatttctaaggagtctgttcatatcacctaagctgttgaatttatgatttataatattcccttactatccttttaatatacgtaggatctatagtgatatcctttttttttttttttttttttttttttttttgaaatggagtcttgctttgtcatccaggctggagtgcagtggcatgatcttggcttattgccacctccatctcccaggtccaagtgattctcctgccttagcctcccaagtaacagggattatagtcacacgccaccatgtccagctaatttactatttttagtagagatggggtttccccatgttgaccaggctggtctacaacccctgatctcaagtgattcacctgcctcggcctcccaaagtgctgggattacaggcgtgagccactatgcccaccctagtgatatcctttctttatcactgctggtattaactgataatttgtattctctctctcttgttagtctagctagggatttatcaattacattgatctgggaaccacagtttggttttgttacttttttctattgtttgttttgttttgaggcggagtttttgctctgtcacccaggctggagtgcagtggcgcaatctcggctcactgcaacctctgcctcccaggttcaagtgattctcctgtctcagcctcctgagtagctgggattacaggcatgcgccaccatacccaggtaatttttgtatttttagtagagatagggtttcaccatgttggtcaggctggtccgaactcttgacctcgggtgatccgcctgccttggcttcccaaagtgctgggactacaggtatgagcctctgcgcctggcctgtttttcttttctaatacaagcatttaaatatataacttttaaggctgggcgcagtggctcccacttgtaatcccagcactttgggaggccgagccaggtggatcacctgaggtcaggagttcaagaccagtcttgccaacatggtgaaaccctgtctctaataaaaatacaaaagtaagccaagtgtggtggtgcacacctatagtcccagccaatctcgaggctgaggcaggagaatctcttgaacccaggaggcagagattgcagtgagcggagattgcagtgagccaagattgtgccatggcactccagcctgggcaacataatgagactctgtctcaaaaaaaaaagaaaagaaaaaaagaagtgcattgtttaattttcaaatatttgggggtttttttcttgatattatatgtgaatgaattctagtttaattccattgaagtctgacaaataccctgcaagatttcaattttttggttttttttgagatggagtcttggtctgtcacccaggccgtagtgcagtggtgcgatcttggctcactgcagtctccacctcctgggttcaagcaattctcctgcctcagcctcctcagtagctcggactacaggcacataccaccatgcctggctaatttttgtatttttagtaggtatggggtttcaccacttcggccaggatggtctcaatctcctgacctcatgatccacctgcctcggcctcccggagtgctgggattacaggcatgagtcactgcgcccggccttttgtttgttattttttgagatgcaggtttgctcttgtcgcccaggctgcactgcagtggcatgatcttggttcattgcaacctccgcctcctgggttcaagtgattctcctgcctcagcctcctaagtaggtacaattaaaggcatgaggcaccatgcccggctaatttttgtattatttttattattttttgagacagagtctcgctctgttgcccaggctggagcgcagtggcacgatctcggcccactgcaagctccgcctcccaggttcacgccattctcctgcctcagcctcccgagtagatgggactacaggtgcccaccaccactcctggctaattttttgtatttttagtagagacggagtttcaccatgttagctaggatggtctcgatctcctgacctcgtgatccacccgcctcagcctcccaaagtgctgagattgcaggcatgagccaccaagcctggccctaatttttgtatttttaatagaaatggggtttcgccgtattggccaggctggtgttgaactcctgacctcaggtgatccgcccgcctcggcctcccaaaatgctgggattataggcatgagctagtgtgctgggctagattttaatttttattgaaattttttgagatttattttatggaccagcacatgacttatcttggcgaacatattgtgtttacttgaaataatgtgtattttgcaatatctgagtgagtggtatacaaatgtccatcagatcaagttggtagtgggttcagatgtatgtctttagataaatctatttttgtctaattctatcattactgagaaaggagtgttaaaagctcaactaagacttgtggatttctccatttttttctctttaattttgatcatttttacttgatatatttcgaagctctgttgtttagcacatacatacttatgattgtaatatctttctgatgaacttgcagttgtatcattttcaaatgtccctctttatctctggtggtacactgtcgtaaaggctgctttatttgatattaaagtagcctcaccagctttcttatgcttagtgattgcataatgcttccatttccatccttgtttttgcagcctatctatgtttatatattcagcgcatatctcttgtagacatcatataattaggtcatgtttttctgtccaggctgaaaacatctgtcttttatttttattttatttcttttatttattttattttatttttttttgagatggagtctcgctctgtcacccaggccggagcacagtggagcgatcttggctcattgcaacctccgcctcctgggttcaagtgattctcatgcttcagccacccaagtagctgggattacaggcacgcgccaccatgcctggctaatttttgtatttttagttgagaaagggttttaccatgttggccagggtggtcttgaactcttaggctcaagcagtcctccccctcagcctcccaaagtgctgggattacaggcaggagccaccatgcatggccaacttctgtcttttaattggaatctattcatcttttgagtttaatgtaattattgatatgtttgatttaggtctacaatttcaccattggttttttgtttgtcccatcatttttttgttcttacctacttttgggtcaattgaatattttttagaatttcattttaatttatgtaccatttttaattcagaaaagtaatttcaggccaggcacaatggcttatgcctgtaatcccaggactttgggaggccggggcaggtggatcacctgaggtcaggaatttgagaacagcctggccaacatggtgaaaccgcgtctctactacaaatataaaaattagctggttgtggtggtgcacatctgtaatcccagctactcaggaggctgaggcctgagaatggcttgaacctaggaagtagaggttgcagtgagccaagatcgtgccactgcactccagcctgggtaacagagcgagactgtgtctcaaaaaacaaaacaaacaaacaaacaaaaaacaaagaaaagtaacttcaagaaaatctcatcaattcagccagcaattttgtttattttcatttgtccttgcaggattatgaaagcccttgcaaatgctggagtacctgtccctaacgttcttgatctctgtgaagattcaaggtaaagttcagatgtttttgctattgcactttcaagctacaggagagaaaagcccatatgctaacacaaattccaatttgttaaagacaaataaaatttgggtaggagggaaaagaaactttatcacaacctctcccagaagttctcagatatttaagttatcctgcaagataagtatatgcctgctttagggataattggtagaaaacatcttttttaacattcaaaaaatacatattaatctagtttcatgttgcttgtctttatttatttttttaatcagagtctttctaaactgttttgttttgtttttttgagacggagtctcattctgtcacccagactggagtctcattctgtcacccagactggagtccagtggcctaatctcggttcactgcaacctctgcctcctgggttcaagtgattctgctgcctcagtctcctgagtagctgggattacaggtgccccctactatgcccagctagtttttgtaatttttgagtagagacagggtttcgccatgttggccatgctggtctccaactcctgacctcacgtgatccacccactttggcctcccatgatgctgggattacaagtgtaagccaccgtgcccggccctaaactatttatttatttatttatttatttatttattttttattgataattcttgggtgtttctcacagagggggatttggctgggtcataggacaatagtggagggaaggtcagcagataaacaagtgaacaaaggtctctggttttcctagcagaggaccctgcggccttccgcagtgtttgtgtccctgggtacttgagattagggagtggtgatgactcttaacgagcatgctgccttcaagcttctgtttaacaaagcacatcttgcaccgcccttaatccatttaaccctgagtggacacagcacatgtttcagagagcacagggttgggggcaaggtcacagatcaacaggatcccaaggcagaagaagttttcttagtacagaacaaaatgaaaagtctcccatgtctacttctttctacacagacacggcaaccatccgatttctcaatcttttccccacctttcctgcctttctattccacaaagccgccattgtcatcctggcccgttctcaatgagctgttgggcacacctcccagacggggtggtggccgggcagaggggctcctcacttcccagtaggggtggccgggcagaggcgcccctcacctcccggacggggcgggtggccgggcggggggctgacccccccccacctccctcccggacggggcggctggccgggcagaggggctcctcacttcccagtaggggcggccgggcagaggcgcccctcacctcccagacggggcggctagccgggcggggggctgacccccccacctccctcccggacggggcggctggccgggtggggggctgaccccccctcctccctcccggacggggcggctggccgggcagaggggctcctcacttcccagtaggggcggccgggcagaggcgcccctcacctcccagacggggcggctggccgggcgggggggctgacccccccacctccctcccagacggggcggctgtccaggcggggggctgacccccccacctccctcccggacggggcggctggccgggcggggggctgacccccccgcctccctcctggacggggcagctggccgggcggggggctgacccccccgcctccctcccggacggggcggctggccgggcagaggggctcctcacttcccagtaggggcggccaggcagaggcgcccctcacctcccggacggggtggctggccgggtggggggctgacccccccacctccctcccggacggggcggctggccgggcggggggctgaccccccgacctccctcccggacggggcggggggctgacccccccccccacctccctcccggacggggtggctgcccggcggagacgctcctcacttcccagatggggtggctgccgggcagagaggctcctcacttctcagatggggcggctgccgggcggagggcctcctcacttctcagacggggcggttgccaggcagagggtctcctcacttctcagacagggcggccgggcagggacgctcctcacctcccagacggggtctcggccgggcagaggcgctcctcacatcccagacggggcggcggggcagaggcgctccccacatctcagatgatgggcggccaggcagagacgctcctcacttcctagatgtgatggcggccgggaagaggtgctcctcacttcctagatgtgatggcggccgggaagaggtgctcctcacttcctagatgggatggcgtctgggcggatacgctcctcactttccagactgggcagccaggcagaggggctcctcacatctcagacgatgggtggccgggcagagacgctcctcacttcctagatgtgatggcgtcacttcctagatgtgatggcggccgggaagaggtgctcctcacttcctagatgggatggcggcggggcggagacgctcctcactttccagactgggcagccaggcagaggggctcctcacatcccagacgatgggcagccaggcagagacactcctcacttcccagacggggtggcggccgggcagaggctgcaatctcagcactttgggaggccaaggcaggcggctgggaggtggaggttgtagcgagccaagatcacgccactgcactccagcctgggcaccattgagcactgagtgaacgagactccatctgcaatcccggcacctcgggaggctgaggctggcggatcactcgcggttaggggctggagaccggcctggccaacacagcgaaaccccgtctccaccaaaaccagtcaggcgtggcggcgcgtgcctgcaattgcaggcactcggcaggctgaggcaggagaatcaggcagggaggttgcagtgagctgagatggcagcagtacagtccagcttcggctcggcatgagagggagaccgtggaaagagagggaggggagaccgtggaaagagagggagagggagaccgtggaaagagagggagagggagaccgtggaaagagagggagagggagaccgtggaaagagagggagagggagaccgtggggagagggagagggagaagactattttaaacagctttgtaacatgctttttgagtgtctcttctttcctaatgttttaattatgtaacatttgaaaccttcagaaaaggtgaaagaagaaaaactaatacaatgaatacctgtttacacttcatctagatcaaaaattaaaacattgttaacattttgccacatttattttctgtatatgtgtgtgtgtatacatgtatacttttaacatgtagataatgattttttttggctgaaccttttgaaataagtttcagacagcatgcatctctcaagaataaagacattgaccgggcatagtggctcactcctgtaatcccagcacttaaggaggctgaggcaggtagatcacttgagcccaggagtttgagaccagccagggcaacatggcaaaaccccatctctacaaaaacaaacaaaaaattagccaggcgtggaggtgcacacctgtagtcctacctacttacccggaagattgtggtgggaggatcacctgagcctgggaggtggaggctgcagtgagctgtgatcacatcactgcactccaggctggatgatagagtgagaccctgtctttttttttttcctttcttttcttcttcttcttttttttttgagatggagtctcactctgttgcccaggctggagcgaaatggcgcggtctgggcacactgcaacctctgcctcctggattcaagcagttctcctgccttagcctcccaagtagctgggattataggcatgtgccaccacacccggctaatttttgtatttttaatggagacggggtttcgccttgttggccaggctggtctcaaactcttgacctcaagtgatccatccgcctcggcctcccaaagtgctggattacaggtatgagccactgcacccggccgacattgtttttcataaccacaacaccagtatacctaactaacaattatttaataataatactgaatatctaacccatgttcaaatttccccaatccaaaacatcttttgtaataatttttcaacttgaaacatttgtaatggtaggattttcaaaacaattttttagagtagtaaactggaggctgaggcagatggatcacttgaagccaggagtttgagaccagcctggccaacgtggtgaaaccccgtctctactgaaaatacagaaattagctgggcatggtggcgctcacctggagtcccagctactttggaggctgaagcaggagaatcatttgaacctgagaggcagagtttgcagtaggccaagatcgcaccactgcactccagcctaggtgatagagtgagactccatctcaaaaataaataaataaataaatagagtagtaaactgtttgctagtaatgaccaaaagatggattagtgacatgtcattgggtcaccttagtactgctgggtggtatatacaccactcataccaccaaaaaatgataaaaataacctcaataacaagaagggatacttattgaacccttattggaaccagagaccatgtcaggcactctgtatgtttgttccctaattcatttctttttttaagtaacaaataccctggaagctcccttaattcttgcaattaccctttgaagtatgtatgttttacagattaaaaaacaacaacatggctgggtgcagtggctcacgcctgtaatcccagcactttgggaggctgaggcggatggattacgaggtcaggagattgagaccatcctggctaacagagtgaaacaccgtctctactaaaaatacaaaaaattagctggttgtggtggcacatacctgtagtttcagctattcgggatgctgaggcaggagaatcacttgaacccgggaggcggaggttgcagtgagccaagatcgtaccactgcacttcagcctaggcaacagagcgagactccatctcaacaacaaagctcagagaggtttaataagtctctcagggtcactcttcaactaagagcagagttgggatttaaacctggttccaaccaggtgcagtggctcacacacgtaatcccaacactttgggaggctgaggcagtcagattacctgaggtcaggagtttgagaccagcctggccaatatggtgaaaccccatctctactaaaaatacaaaaattagtcaggcgtggtggcatgcacctggagtcccaactatttgggaggctgaggcaggataatcgcttgaacccaggagaaggaggttgcagtaagccaagatcgcgccactgcactccagcctgggcgacagagcaagactccatctcaaaaaaataaataaataggccgggagcagtggctcacgcctataatcccaccactttgggaggccaaggcgggtggatcacgaggtcaggagatcaagaccatcctggctaacacggtgaaatcctgtctctactcaaaatacaaaaaattagccgggcgtggtggcgggtgcctgtagtcccagctactcaggaggctgaggcaggagaatggtatgaacctgggaggcggagcttgcagtgagccgagatcgcgccactgcactccagcctgggtgacagagcgagactccgtctcaaaaaattaaaaaataaataaataaataaacaaaaaataaaaacctggttcggtgtgactccagaggtccttctctgagccttgctgcttgctacattattacactttgaatccattcctgtggcttacacaaatgaaccagggagaagagaaaagcatgctgtccaagaagcatagatgggtgtgcatgtgtgtgtgtgcacgtgtgtatgtatatgtgtgtgtgcatgtatgtggatcgatccattgcaagagaggatacttctaatgcactgtgcttatgtgaaaggaaaaaggaagtatccagtgctctgggtctgaactcttcaccagctctcaacctgtatacccagggaaagtgacaaagaatagggtcatgactaacagcctgccacattatgactctgatccctgaaaccccttctgtgttcctcccagtgtcattggcacccccttctatgtgatggagtactgcccaggtctcatctacaaagacccttccctgccaggcttggagcccagccacagacgagccatatacactgccatgaacacagtcctgtgcaaaattcacagtgtggatctgcaggctgtgggacttgaagactatgggaagcaaggtgagcaggaggccacgtctcccatgctggttgtttcatcactagtgcttctgcttttaggatctgaatcgttttgggtcgttttgagtattagcacaccaagcgtaaggcagacttagcttcttccttggaaatccagtttagttttaatggaggtgttgctgacttaggcatttgggccttcaataaatccctttatgaactacacagtctttcttccctgcaacttttttttttcattttttctttttttcccttaaatattctgctatccaattccctgcaacttttatctcactagaccatttaaattttttttctgatactgaccataggtatttaaaatgtatttttctccgttttttaccctttcccctaaatattcttttcaacaggaatatatgtattttttgagatgggggtctcactgtgttgcccaggctggtctcaaacttctgggctcaagccatcctcctgtctcagcctcccaagtagttgggactctgggcatgtgccaccgtgtccagtttcaacagggatagtttttttgtttgtttgttttttgagacagggtctctctctgtcgcccacactggagtgtagtggtgtgatctcggctcactgcagcctcaacctcttgggctcaagcaatcctcctgcctctccctcttgagtagctgggactacaggtacgcaccaccatgcccagctaatttttgtatttttagcagagacaggtttttgccacattgcccaggctctacccaaactcctgcgctcaagtgatttggcctcccaaagtgttgggattacaggcatgagcctctgcagccagccctcatgtagttcttaccacatgccaagaatagttctaagggctttacatattttattctcccaacagctctatgaggaccatctcaagatgaggaaactaaagcatagagatgttaagtaacctgcctgagatcacagagctagagaacaacagagctgggtttcatagcctggcagtctggctccagggttcatgtgctcagctaaccactgttgtttagccaaaaagtgatttatgaaaggctattaggaagcacagaagatctttttttttgagatggagttttgctcttgtcacccaggctggagtgcaatggcgcaatctcggctcacttcaacctccgcctcctgggttcaagcgattttcctgcctcagcctcccaagtagctgggatgacaggcacccaccaccacacctggctaatttttgtatttttcagtagagatgcgctttcgccatgttggacaggccagtctcgaactcctgacctcctgcctgcgttggcctcccaaagtgctgggattacaggtgtgagccaccatggccggccacaaggtctttaagaggaccagagatcatacttggagaccatatagctaggaacagcacccagaccacactaatccagccaaagagctggtgacttccaccttggggcagcaggagcatcatgtgggaaattctccagtcataggaacgtgttcaaagacactgcaccacccagtgcagagcatgacaaagggtttcactgcactggtttttttttccgctactttcagaggttgctgaaattgcacaccaagttctaatcctatttcccgcaggggactatattccacgccaggtacgaacctgggttaagcagtatcgagcttccgaaactagcaccatcccagccatggagaggctgatcgaatggctgcccctccatcttccccgtcagcagaggaccacagtggtgcacggggacttcaggtagatgtggtggcagggagagctgaaaaatgacagcaaggatgctccaagggggaattgagcaattggtcttggtgcaatttacagctgggaattattcctattacaaagcacctgtctgtgtgtggccttttcaggcagggtttctcagctctggcactgtgacatgttgaattggataagtttttgtggtgggagctactgtgcattgcaggatgtcaggcatcatccctggcctcaacccactcgatgacagtagcacccctccccacagagtgtgacaaccaaaaatcttcgcagacctggtccagtgttcccagggagggcagcattcctctgttgagacccactgtttgaaagtaaggcagagtctatggccataccaccctgaacaggcccgatctcatctgaaagtaaggcagagtgagggtgccactcacctcccaagaggcctggggatggacattctcactgggtgtaatgaaaggattgaaagagagtgacagggtctctgggggtatgtgatgagtctgtagcacggctaaaatgggaacttcagtatgcctggcgtctggcggcagtgtctagctttatcttatcatctcttgctgtgaaaactgcccgttaggtacttttatagggtagtgtttatagtgttttctgcttcgcagcacctggagacctgcttttgatgcaagcatgccttatttggcttgtcttcttgcccatctggggactcaggccttttattaaacaagactagacagtgaaggctaattttaaagacatttccgtttcttttttttttttttttagacatcgtctcactcagtcgcccaggctggagtgcagtggcgtgatctcagctcactgcctaccccacctcctgggttcaagcaattctcccgccccagcctcccgagcagctgggattacaggtgtgcaccaccatgtgtggctaacttttgtatttttggtaatccaaaaatacaatacatttttagtaatacaaaaatgtgagatggggtttcatcatattgatcaggctggtctcaaactcctgccctcaagtgatctgcccactttggcctcccagagtgctgggattataggcatgagccaccatgcccagccttaaagacatttctttgccttccaaatttgattggcctctcttcattggcttgaccggtgtccctcgctcccggcttcttccgttagccagccacctttggggatccccctgggtctgagagtggacagctgagctttctttgtcatgtggtcatcacgggagcttgaggaacctgcttctgcatcagagactgatggggccaagtgcttcccccacactgccttgaacgtggcatgcagttgggctgcatttgaccccctcctccatcttctttctccacttgggattctagagcacttgcctgacaacactttccttgccagccattgccatgtatttcctttggcggggaagacctcaggtggcctttgtgtcaccagcccacaacagctgctccgtggaccttgtctttgcttctcttggcacctcaacaatccacgaatgtgatcaagtatacagcaggcaggagatatccagtgcagtctgagcaccccctcccctagctatagtgaagtatgatgatcatttaggatgttgcctccaggaaaggcatcctctgattttagagagcgtgctgctgcttattgatcaacacagtcagagatagttctgtcttttgatggatagaagaacatttcttgctagtggagtgaatcagcggtggtgggagcataaactgctgcagctactttgaaaagtagtaggcagtggccaggcacggtgactcaagcgtgtaatcccagcactttgggaggcgaaagcgggcagatcacttgaggtcaggagttcgagaccagcctggccaacatgccaaaatcccatgtctattaaaaatataaaaattacctgagtgtggtggtgcccctgtaatcccagctactcgggagggtgaggcaggagaatcacttgaacccgggaggcagaggttgcagtgagccaagaccgcaccactgcactccagcctgggtgacagagtgagactccatctcaaaaaacaacaaaaaaagaaaagtaatgggcagtaacatggaagatgggaatatgctacaacccatcgtttcttgtaaagaagcatctgctgcagctttgcaccaagagactcaggtgaagatgtttgttttggtcatgcttgtaattataatacatgataaataaagtgtagtttggccatatgttggaattctatttagtgagtaaaataaaccaatttgctgtacataagtcataagtctcaaaaaagataatcgaagtagaaaaaagtttcaaaagggtaatatatcatttatgaaaatttaaaaataattgaaagaacactatatgtggtatataggtacaggtatagataagagaaatatagaaatgtctgagactgatatataccaacttcagggtagcagtaaatctcatttttaaaaaatctgaagcaaatgtaacaaaaaagcacgtacaatatctgttaaatctggaaggtggacacatgagttctgtcattatgtcattctctgtatttttctgcatgcttgatgtttactttttcttttaaataaagcatgcattacagacagccctggcaggaaacagaaagcatgaaagaggctatctggggagagttcaatatagggttatttagttcaatatagcgtggtttagaggaaccgctgaagaacagcgtggagtcccggggccagtaacagtgaggggtcagtctgacagggcaagcatgtgctgtggttattgctactctacaacaaactttgtcagaactgagtggctgtcaacaacgacagcagtcattttgcttatgaatctttgcagtctggggacaggacagcttatttcaaagtagggcggctgtcgggtggggctggatcttctgaagacttgctagcatgctggccctgggcagagaagatattaacagccgggctccttgggcctctctttctgtctctttgtggttcccacatggtctctccagcatggcaacttctgggtaactggactttttttttttgagacaggatcttgcactgtcacccaggctggagtgtagtggcaattcataggctggaacataactcactgcagccaccaactcctgggctcagtgatgctcccaccttagcctcctgagtagctgggactacaggcgtgcactaccacgctcagctaatttttaaatttttttttgtagagataggatcttgttatgttgcccgggctggtcttgaactcctgagcttaagcagtcctccgaaaatgtggggattacaggcatgaaccattgctctcagccctggacttcttacctgggggctcagggctccaaaatagtgtgtttcaagagacagagggctgggcagaagctgtatcacgttttctgacctagtctagtttcaggaatccctcagcatcacttccacgtgtcttatatctgttagaagcaagatgcttcactgggccaagcattagactctaccttttgtgggaggagtgtcaaaggatttacagatctgttttaaaaccatcacagggagggagtaattcccggaacccagagaggctagctctctggggaaggctgcagagaaggagctggggaaataaataaccaggccctttcccatctcctgcttttgattggctgagtccagctggaagccagagggcaagggagcctttggagcacacagcccagggagctcaggcacccgggcacagaggggatgggagggtggggagccaagcctaaagggcaaacagaccacgcagaatccaccctagccggcagttttcttagtgctgtctctattcctcctgcgacttttcaggctcgacaacctggtgtttcatccagaagagccagaggtgcttgctgtccttgactgggaactttctaccttgggcgacccccttgctgatgtggcctacagctgcctggctcattacctgccatccagttttcccgtgctgagaggtaggaactgctgctggaggatagtgggggagcaagccagttctccaagcatttgggagcaaactcagctgaagtagtccgtgattgggcgggggaagtgaaagtgaggtcctggtggttctggtgggaaacataactagaatgcagtcctgtcacatttacgggaaagtggatataggatgtgttttaagtgaaaagtatgcctgtataggtaccgcttatgcttttacacagctaacttctatttagggttttaaattaaaaacacattcattgtggctgggtgtggtgtctcatgcctgtaatcccagcacgttgggaggccaaggcgggtggatcacaaggtcaggagttccagaccagcctggccaacatggtgaaccctgtctctactaaaaatacaaaattagctggacgtggtggcgtgtgcctgtaaccccagctactcgggaggctgaggcaggagaattgtttgaacctgggaggcagaggttgcagtcagctgagatcatgccattgcactccagcctgggcaacagggcgagactccatctcaaaaaaaacaaaaacaaaccacatttattgtgaaaatactagagccaacagatagcaacaacaacaaaacagttaaaatcattagtagtcccagagataaccatttgctgacatttcagtatctatccatgtcatcttttcttctgtgtgtatatgtacatttcctaaaacaaaacaaaaatgtaacatgatctaatggcatgctttttttcacttcattgtatactgtagacatgttttcatgacattaagtatttcttctatagcataatttttaatgagagcatataattttattgtatagaattaagggaagacggccgggcgcggtggcccacgcctgtaatcccagcactttgggaggccgagacgggtggatcacgaggtcaggagatcgagaccatcctggctaacatggtgaaaccccgtctctactaaaaatacaaaaaaattagctgggcgtggtggtgggcacctgtagtcccagctactcaggaggctgaggcaggagaatggtgtgaacccgggaggcggagcttgcaatgagctgagatggcgccactgcactcgagcctaggcaacagagcaagactccatctcaaaaaaaaaaaaagaattaagggaagacatttgggttaattcctatttagatatttaatttgtttccaattttttagtattacttcccctacttccatgaaaaaaaggcagtgaacatccttgtagtaatatatttgcctatatataaggtatactcctaagattaatacctaggaatggaatatattacatgcttctaaatcatgaaaatgtcacaactggaggaaataagtgaattttttttttttttgagacggagtctcgctctgttgcccaggctagagtgcagtggcgcgatctcagctcactgcaagctccacctcccaggttcacaccattctcctgcctcagcctcctaagtagctgggactacaggcacccaccaccacgcccggctaaatttttgtttttgtagtagacatggggtttcaccgtgttagccaggatggtctcgatctcctgacctcatgatccgcccgccttggcctcccaaagtgctaggattacaggcgtgagccactgcgcctggcccgtgaaattattttatttgctataattatcattttcataatttggtgagatctttttatttttatatttatttatttatttgtttatttgtttatttatttttgagatggagtctccctctgtcactcgttttatttatttttgagatggagtctcactctgtcgcccaggctggaccacagtggcgcaatctcggctcactgcaacctctgcctcccgggttcaagcgattctccggcctcggcctcctgagtagctgggattacaggcgtgtgccacaatgtctggctaatttttgtattttcagtagagacagggtcttcaccatgttggccaggctggtgtcgacctcctgacctcaaatgatctgccctcctcggcctcctaaagtgctgggattagaggcatgagccactgcacccagccaattgtttttttttttttttttttgagatggagtcttgctctgtcacccaggctggagtgcagtggcgtgatctcagctcactgcaacctctgcctcctggattcatgcaattctcctgtctcagcctccctcccaggtagctgggattacaggtgcacgccaccatgcctggctaatttttgtatttttagtagagacagggtttcaccatattggtcaggccggtcttgaactcctgacctcaggtgatccacctaactcggcctcccaaagtgctgggattacaggcatgagccactgtgctcgacctgagatcgctctttccatatcatttttgatcaaatgactggttgaagataatatgcatccacccttaactgtggccagatggaattggaagctcccattccttcctttactgccagttgagtctgaaacctgtaagagccaatttgtgaataatgacttcatgcctggatccccagccatctaagggagcaagagccaatgcaggaataagctaacccatggaactggtcgtgaaactaatttgcaagggacatggcgattttcagaatttaaatatttgccagccacaggggcgtgtcacgtcagtgactacccatgaatggctctgtctttctcgcaggtattaatgactgtgacttgacacagctgggaatccctgctgcagaggagtatttcaggatgtactgtctccaaatggggctccctcccactgagaactggaacttctatatggctttttcctttttccgtgtggctgcaatcctacagggagtctacaagcgatcactcacaggtaatgggatggctgccctgaagagccactgcggggtgagtcacagcaaggaccgtgcctccacctggaaaccctctcagggccacagaggctttggagagaccgatttggccaggattctctgaggttcagttaatctaaccatttgtccataaatattttctttacaatatttatttatttattatttgtttttgagacagggtcttgctttgtcaccctggctggagtccagtggtttgatcctggctcactgtaatctctaccttctgggttcaagcgattctcctgcctcagcctccagggtagctgggactacaggcctgcgccaccacgcctggctaatttttttttgtatttttagtagagatgaagtttcaccatgttggccaagctggtctcgaactccgggcctcaagtgatccgtctgccttggcctcccaaagtgctgggattacaggtgtgagccaccatgcccagcctctttacaatatttaaacttgttttttaattattaaagtaatgcacaaagaaatttttccagttaaagcattcatgcacatgatcaaaatttggtcatatagaattatgtaaaattgtatctcacccttttcaacaccattcctcaaagataaatgttactgttaagagtttcctgggccctccagtttttctgtttatctgtcttctctctctcctcctacttttacacaaatgtgatcatcctatgtgtatttttcggtactttgattttaaaattttgtaagcttaagaatttctgtgaaatatgtgtgtgaccatttgcatatttaacaactatatgaggcaaatttcttggtgtgtgtgtgtgtgtgtgtgtgtgtgttgagacagtttctcactctgtcgcccaggctggagtgcagtggtgcgatcttggttcactgcaacctccacctcaccagctcaagcaattctcatgcctcagcctcccaagaagctgggattataggcacataccaccatacccgcgtcatttttttgtttgtttttagtagagatggggttttgccatgttggccaggctggtttcgaactcctgacctcagatgatccatccacctcggcctcccaaagtgctgggattacaggcatgagccactgagcccggccagtccccaagtctttaggtaaaacccctgtggtctttgacaacttccttgctcgctagtatgacaaaatgttccaggttcatcttgtctatccagcctacccaacatggtgaaactgtgtctctactaaaaatacaaaaattagccaggcatggtggcgggtgcctgtaatcccagctacttgggagactgaggcaggagactcacttgaacctgggacggggaggttgcagtgagccgagatcgtgccactacactccagcctgggcgacaagaatgagactctgtctcaaaaaaaaaaaaaaaaaaagacttgggagccaacctgaacaggctcccacttgctaacaataggaaactttgggcatcaccaaggatgatagctgaaatggatgaaacacatcaggtatgtttaaatccatgagtagtagccgggcatggtggctcaggcctgtaatcccagcactttgggaggccaaggtgagcagatcacttgaggttagggattcaagaccagcctggccaacatggtgaaaccacatctctactaaaaatacaaaaattagccaggtgtgatggcgggcgcctaaaatcccagctactcaggggactgaggcaggagagagaatcacttgaacccagggggcagaggttgcagtgagctgagatcgcgcctgtgcactgcagcctgggtgactgagcaagacactgtccccccaaaaataaaaattaaataaataagtccatgagtagtgatacaaaaacaaagagacaaagtctcattgatgacctcagaggttgccaggaaagcaacttattattctgaaaattggaaaatggggtgggggggtggggaatcaagcatttgtcctgtctttcctgtacaaatgatactgcaggctatccaaataatcaatgagggaatgtttctctctagagaagtatcctggacagaataatatagaatttgcatatcaccaatttgcaactcctaatgcattaatggatgtgggcaataagcttcaatgaaagccaacaccactgagagacagacagccagacattatatacctcctgatgcttccctcaaaagttacactgactctgcccaggtctccagtgctagctgccaactcatgggaaacacagggttcagagggacatgttcagcagcaccctgggcacagcactcacaaaatccagattctggaaaacatcacagggcaaacaactcagtttcttcaaacacttacatttcaaggggaggaaaagggtgaaaaaggaacctgtagattgagagagacttaaaagaaacatcaggctgggcgtggtggctcacgcctgtaatcccagcactgtgggaaaccgaggtgggtggatcacctgaggtcaggagtttgagaccagcctggccaacatggggaaaccctgtctctactaaaaaatataaaaattagccaggcctggtggcgggcacctgtaatcccagctactcgggaggctgagataggagaattgcttgaacccaggaggcggaggttgcggcgagccatgattgcatcaccgcagtctagcctgggcaacaaagtgagactgtctcagaaaaaaaaaaggtggggggagcggggagagacttaaaagatacgttagccagttacagtgttgggaccttatttggatcctttcttgaacaaattatttggaaaaaattttgatgatagtcactgaaacttgaattctgagtggatagtcgatgatatgaagaagttaacagttaacgattttttaagggtaataatagtattgtgggttttttaaaaaacatttgtttttagagttttgaaagaatcctagatgagatatttgggatttactccaaaaaatccaggacagtgggagtggggatggcagggaatgaaaccagactgggctggcatcgatcattgcggaaggcgagcagtagaacccgtaggcttgttattctctcctctctactcctgtgtgtctttgaaattttccaaaaggaggccagtcatgatggctcacgccggtaatcctagcacactgggaggccgaagtaggtggatcacctgaggtcgggagtttgagacccctggccaacatggtgaaaccccgtctccactaaaaatacaaaaattgcctgggtgtggtgatgccgcctataatcccagctacatgggaggctgaggcaggagaatcacttgaacccgggaggcagaggttgcagtgagcagagatcgtgccactacactccagcctgggtgacagagcaagactccatctcaaaaaaaaaaaaaaaaaggccaggtgcggtggctcatgcctgtaatcccagcactttgagaggccgaggcggggggatcacgaggtcaggagatcaagaccatcctggccaacatgatgaaaccccgtctctactaaaaatacaaaaattagctgggcttggtggtgtgtgcctgtaatcccagctactaggtgtctgtaatcccagctaactagggaggctgaggcagatgaatagcttgaaccagggagtcagaggttgcagtgagccgagattgcttcactgttcactccagcctggtgacagagcgagactccatctcaaaaaaaaaaaaaaaaaaaagaaaagaaaaagaaattttccaaaagcaaaacttaaaaacaaaaggcaaggagaaagaaggagaaaggaattcatcatgggatttgctagtgctgatggagtgtttagctttgcagtcagtgacaccccaagcttgctggcagcctgtgttctcagccaggttgccagagtcttctgagagaagcagttgcagtaggggaattgatcattcattcccaagtatatgagcctctactaaaagccagcactgtgctaggtggtcctggagatacacagtcatgagaaaaactgtccggagaaaaaccagtacccagagaatttctagtttaactgtacctggtctgataagcaggggatgctggaagcaggaatttctggaaacaatattttccctcttttaggaaaatacagtatcagctgtaagccactatttcccattttttttatagttttccaataaacactaaccagaaatatttacttaaacagaatggctgctaagtccttatggtgatgaatagtcctggtcacctctgatatttcctagccggctgccaagttttctccctgctctgctccagtgacctgggaaaagcttaatagactgcccattttagagtctccacactgagtgtcctcagcctgtctctcaggaagccctttgacatgtttttaagatcctgtgagccatcgttgtggcttctggtttctctcggcccagagctaaaacaccccacctgtttgccaccagacagaaaaatgtctgtttgttcaggcctttattcctcttatcttactgtgcactcctttccctccctctgggaagccagccagacacactgaggaaatggcttagttttctcatgtaaaaacaacaaaatccattttttgaaagaataatataaaaacgtatgatgaatggggaaaaaaccaactatacaaacataaatattacttctgtacatttgtcttctacaattagctttaaaatcatttttgtttgaacagctgagatatttggtactggccaggaaaactggagcttagagaaggggtatctgtttccaagacattctctctatggtgtcatttacaaaagacttcaaatcagcattagattgggaaggggatgagagagaccagagcccagtgagcagaagattaacagtatgtacctgcccagcccatgtgtccttctccttccttaataagtgggtgcagaaattagatttctggtagatggccactgaaattctataaagtgcttatgactgcaagttaagtggacaccagtgatgtggtctcttctgctggaactacattttggaaaatataccagaagcaatagatctaaatcaatccaagcttatacaagtgacttttttcagggacaaagtagcagtctcagagtgggagccaaccaaatagaagaaaattaagaatacacctcttactctgttagaagaagaaaatccttatgaataataaggaacataagggagtatctttcccttcaatgtgctgtgtgcagtccgaggaataaggaataagcccccactgtgtgtctgcaaggaagaggctatctggtttctgactgacttccctgggttaggttcatacctagcacccagaaggtcctcagtagagacctattgaggtccagtaggctaactctctgcagggtagcaaagaatttgctctgagtttgttcctaactctgtaaggaatagtttaaactatctttaacaccaaagctgcatgaaaatggctgtctcagctgggcatggtggctcatgcctgtaatcccagcagtttggtagactgagacaggaggattgtttgaggccagaagttcgagaccagtttgggcaacgtagtaaggccccatctcttatttaaaaataaataaaatatttatttttttgagacggaattttgctcttgtcacccaggctggagtgcaatggcatgatctcggcccacggcaacctccacctcctgggttcaagcgattctcctgcctcagcctccccggtagctaagattacaggcgtgcatcaccacacctggctaaattttgtacttttagtagagacagggtttcaccatgttgcccaggctggtctcgaactgacctccagtaatccacccacctcagcctcccaaagtgctggggttacaggcgtgagccaaagcacccagcctaaaatgaaatcatttaaaaaaagaaaatggctgtctctttagaactatcaatttatccatttattgggtacagtctcttggggacatggaagtgctagaagtaatccaggagagctggctgtgaaaaagttcactgtgaggagacattgtacacatagcaatctggatgtgtctcagatgcagggctcagagtgatggaggccatactgaaaaggccacatgctgagtgacatatgtatttatgggacatcctggaagagacagactacagaaacagagatcagtgggtgctggggatcaggggggcaggggttgagtacaaaagtacactggggaaatttccagatgatggaaatattctgtttttttttttttttttgaaatggagtctcgctctgttgcccaggcaacctccgcctctcgggttcaagtgattctcctacctcaggctcccaagtagctgggactacaggcatgtgccaccatgcctggctaatttttgtatttttagtagagacaggtttcaccatgttgaccaggctggtctcaaactcctgacctccggtgatccacccgcctcagcctccaaagtgctgagattacaggtgtgagccattgcgcctggccgaagtattctgtatcttgatggcaatggtagttacccaactatggatttgttaagacttgcagagttctacattaaggaggtgtatgtacaccactcctcaatttttttatttttatttatttatttttttgagatgggtgcctcactctctcccaggctggagtgcaatggcacgatctcggctcactgcaacctctgcctcccaggttcaagcgattctcatgccttagcctcctgagtagctgagattacaggcacacaccaccatgcctggctaatttttgtatttttagtagagatgggggtttctccatgttggccagcctggtcttgaactcccgacctcaagtgatccgcccacctcagcctcccaaagtgctgagattacaggtgtgagccaccgcacctggccaccttaattttttttaatggggaaaaatatgtttgtaaaaaaagtcttgatgcacattttacaagaagaaagagacgctgtgagagccaaatagtgagctgagtgatgctggtgttgattccctccagagacagtggtgtctagaagttggctcttcctttagtcagttgtggcattgctgttatcaattttgtagcaagggtggtctaggatgcaggacttcttatagcccactggcaacggcagaggtgatctggggtgttactgattaaatgtagtcttttaggaaagcagagatcaagagcagggagcaggcagacctaagttggactctggcccccagccccctaacttccagctcgtccaagtcacctccttctctaagactcagttttcttgcgtgcaaagtgcaggtgaaagcagttgtattgctttggggattcagtgagctatagtggctcttagcacagtgtttggtacttagcaagtgctcagcaaatggcaatagctgctgaagtgacagtgtcatcacatgttaacatccctatgatgggtcgtgtgggagtaatcactgtttttctttgattctgcttagggcaagcaagctccacatatgcggaacaaactggaaagctgaccgaatttgtgtctaacctggcgtgggatttcgcagtcaaagaagggttccgggttttcaaagagatgcccttcacaaatccgttaacaaggtcctaccacacgtgggccaggccccagtcccagtggtgccccacaggcagcaggagttatagctccgttccagaagcttccccagctcatacctcaaggggaggtctggttatctctccagagagcctctctccacctgtcagagagctgtatcaccggctgaagcacttcatggagcaacgtgtgtaccctgcagagccagagctgcagagtcaccaggcctcagcagccaggtggagcccctccccactgatcgaagacctcaaggtaaagcagccatggtgaggtggtaagaccccaataccatggcataccctccccgaccccaccgggctcacctgaaccatcccaggcagtgaagatacaggagctccgagttgaatgatctttgcttccatcgtctcagaaagagccagctcttcatgactcagtttccatctcttgctcttgctgtgcctgtgtcacaggcagatggctcaggtgtgactgcacagcccaggcagtggaatgcttggccttagaaagccagggcaggttaggcctatctgatgggtatttgaattatgtaaatttgaaacagtgctgtatcagctaataaatctctctctagagaacccgtaatatcacagctagagggccagatccactgtgagctgagtttctgtgttgtctcccagtgctgtcacttcagctgataaacagaaacacccgctgttccttatcacgtgaaccttggattgtgttagttttgaaattacttgagatcttcaggagcataatgcaatcatcatctacttttctttttttctctttttttttgagacggagtcttgctctgtgcaacttccgcctcccaggttcaagcgattctcctgcctcagcctcccgagtaactgggattataggcacgtgccaccatgcccagctaatttttgtatttttaatggagatggagtttcaccatgttgttcaggctggtcttgaactcctgactttgtgatccgcccgcctcggcctcccaaagtgctgggattacaggcgtgagccaccatctctctcttttttttttttttttttttttttgagacagggtctcgctttgtcacccagggtggaatgcagtggtgtggtcatagctcactgcagtctcaacctcctgggctcatgtgatcctcccacttcagcctcctgtgtagctgggaccacaggcacagccaccatgcccagctcctcatatcatttttttgggcacacgtgcatgtttggttgtctgccttgtttcctccaatccctttcattgttttccacggttcaaaataaaatgaaatcttccactgtggtttcctgacttattttccccatgataggagaaagccaaagctgaaggactttggaaccttttcctacccttagaggctgatcccgagaaaaaatacggagcaggactgaccaatgtggaatatgcacatctgtgtgagctcatgggcacgtccctgtatgcccccgaggtaccttctttaaagttttcctcagtgtgtgggaacatcctgatcttcataagaactcaatcctaaacagataaaccagattcagaagcactggcatgaacttgaacttttttttttttttgagatggagtctcgctctgtcacccaggctggagtgtagtggcgaaatcttggcgcactgcaacccctgcctcctgggttcaagtggttctcctgcctcagcttcccaagtagctgggactacaggcatgtgccaccacacctggctaatttttgtatttttagtagatacagggttttaccatgttggccagactggtctcaaactcctgacctcaggtgatccacctaccctggccccacaaagtgctgggattacaggcgtgagccaccatgcccatccaatttgaagcttgaaatattaatgtgagaaggccaggcatggtggctcacacctgtaatcccggtacttttggaggccgaagtgtgggggatcacttgaggccaggagttcgacaccagcgtgtgcaacatagaactctgtatgtacaaaaaaataaaaaattaatcgggtgtgatggtgcatacctgtagtctcagctgcttgggaagctgaggcatgggaggatggcttgagctgaggaagtcgaggctgcagtgagccatgatcgtgccacgatactccagcctgggtgacagagcttgactctgttttttttagaagaggacatgacagtcatggtcacgctccttttccttctcaggtatgtaactgctctgcgcctgacacgggcaacatggagctgctggtgaggtatggcaccgaagcgcagaaggctcgctggctgattcctctgctggaggggaaagcccgctcctgttttgctatgaccgagccccaggtacgtcgcctgggctgccacccacttgcctggccctgttgttgtcggccccacagggaacacgggctgtctgctggcgtctctgactggaatatgctccccactcaggttgcctcttcagatgccaccaacattgaggcttccatcagagaggaggacagcttctatgtcataaacggtcacaaatggtggatcacaggtatttggcctaaaatgcactttccaaatgcacatcagggagtctgtgctgttaggcgcgtctctcaatgcctgggaggagcctctgctttttcaagttgacacaaaggagattctgtcacttagcgcccccagcagaggcagctgggagaataggagggtaatccgtggagcacactgttctcagaggtggcacttcacagggcagggacgtcccccggtgcccacacatggacggatgcctccctgcacatgtgaccccaggaatctctccacttcctgctgttcattctgctttgggcagctccccttccttggtggcttcctggctcctcgatcaggtgtgttacatcctaagggctaatgacaatcctgacttttagggattgtccagtgttacttttgcagggcccctacaagtagccgtggagcttacctcccggagcccatacctccctggacattaagaatgagcatccccattttgcaaaggaggaaaccgcactcagacttaggtcccttgcctggggtatgagcccccagccagcaagtagagaacccagagtcaaaggttcacctgattccaaggcccgggcccagagccgttatgtgtgcaccacctgtgggagccgagccagctggcagggatcaagtagcggttttcatcctcttgtctctaaattatattttctactctatgtgatgcttttaaaaacttgctcttatgatgttggattcattcctcactgggacaaaacccaatttgctcttatttctggtcagcagtctgcagatgctcatctgattacatggagccttaaagagctctgtctgcttccttactgtgcctttcttgggccaggaccacgtgtgtagagatttgatggccctggtgtcagatgatggggtctgtctctctcctttcctggcaggcatcctggatcctcgttgccaactctgtgtgtttatgggaaaaacagacccacatgcaccaagacaccggcagcagtctgtgctcttggttcccatggataccccagggataaaaatcatccggcctctgacggtgtatggactggaagatgcaccaggtgagacctccaggggcgggtcacccctgggtgtgggtctggtccccaggaaacaccactgaggggcccctgctcttgttcaggacttgccacatcccacgtctgagggtatgatgacatttggagtcacatgctcctgcatttcatttccatacatgaatatcaaccatgcaggcggatttcagacaggcatttatggatttttttccctcttctaaacttagaaagtaatcaggagtctgtgacacaggaagccatacagggcagacgcaggaagtggaccccaaacctactcttccaggccccagtgtgaacagctgacctctaggccacagccctggtttggtccgctcccagtttggttctctgctaatagtgttcacatttttactttcagtgttttcataggatcactacattgtcacaaaccactaggagcttcagcttaaggtggcattattatgtttttataaaaggaatcacagaatagtcatttgccattataaatcagtgattcattttctgtgtttaacaggctgtttcctgccgtccttttccctttaaccatgtcccagtaagaaggctaaataaagggcagggacattgccagcagataacccagactgaggtgaggaataaacacatccaaggaaaatgactatggctattgctcacagtgatcgtttgggtctttcaggtggccatggtgaagtccgatttgagcacgtgcgtgtgcccaaagagaacatggtcctgggccctggccgaggctttgagatcgcccagggcagactgggccccggcaggatccatcactgcatgaggctgatcgggttctcagagagggccctggcactcatgaaggcccgcgtgagtgctttcccccgcacccagcactgactcagaaccaccaccttctgctttgctgtcggacttcaattcctacctgttttctgagtgcagtcctagcaggtgaagcaaggtgatgtccttgccaagaagttgcattcctgtctgctttgcatctgctactttgctgcagtttggattcagagcagaatggaccccactctgtcgaggtgacctgaagggaaacgccaggctctgtagcagcagaggcaaggttccaaggtgtaaaggtcatgctgctagcacattattaaaaatcagtctgggtgcaatggctcacagctataatcccagtactttgggaggtctaggtaggagggttgcttgaagccaagcatttgagaccagcctaggcgaaaaagagagactcagtctctacaaaaaaaaaaaaaattttttttttttttttgagatggagtcttgctctgtcaccaggctggagttcagtggtgtgatctcggctcactgcaacctccacctcccgggttcaagcaattctcctgccttagcctcccaagtagttgggactacaggcacgtgccaccacgcccagctaatttttgtatttttagtagagacagggtttcaccatgttggccaggaaggtctcgatcccttgacctcgtgatctgcccgcctcgggctcccaaaatgctgggattacaggtgtgagccaccgtgcccggcaaaaaaaagaaaaagttttttttgttttttttttttttgagacggaatctcactctgttgcctaggctggagtgcagtggcgcgatcttggctcactgcaacctctgcctactgggttcacaccattctcttgcctcagcctcccgagtagctgggactacaggcacccgccaccatgcctggctaattttttgtatttttagtagagatggggtttcaccatgttagccaggatggtttcgatctcaccgtgttagccaggatggtctcgatctcctgacctcatgatccgcccacctcagcctcccaatgtgctgggattaccggcgtgagccaccgtgcctggccaaaaagaaaaagttttaagtgccaggcatggtagcatgtgtctctagtcccagctactcaggaggctgaggcagaaggatcgcttgagcccaggagtttagggctgcagtgagcagtgatcacaccactgcactccagcctgggtgacagagtgagaccctgtctctttaaaaataaataaataaataaaaatcagacaccagggagatcccatgttgcttgtttttgtccctaggcttccatcatctggcctgtaccaccctcctccacagcacatccagaaaactttattcggccataatcctaccacccccaaagtttggaaacctaggttaaaagacagctgcttccaggacaggaattcaaattggtgattatcaatttcagaaaggtgacgcaaaccctgagaccaaaaccagtgtctcacaagaactgctattgaaagaacagaggcagtctgaattttttattaccgagcaaacctgtgatttacacccttttgagttaagactgaccagttattttttctttctaagtaaaacgctcctgtctatggactcaggtatggtgcttcagccccacatggaattaaattcagccttctggcagaataattggactgaatgagtcagacagaagtctccagaaagtgcatagcatgaacatggcacctccactgaagacttggttggagtaattaggaatctacaaaagatttgctacaaggaggttcaccacagtgcttattgaaatagcaaaattctgaacaacctataaggctaacaatgactgttggccaaataaaacacaagatggcatacagtgagactttaaatgatgctgtggaaatctattccttaacatggagaaattgctcactatatacacttaaatttaaaaaaaaagactgtggccaggtgtggtgacactcccagcactctgagaggccgaggcaggcagattgcttgagcccaggaatttgaaactagcctgggcaatacggcaaaacctcatctctataaaaaataaggctgggcgcggtggctaacgcctgtaatctcagcactttgggaggctgaggtgggcggatcacttcaggttaggagtttaagaccagcctcgccaacatggtgataccccgtctctactaaaaatacagaagttagctgggcatggtggcacatgcctgtaatcccagctacttgggaggctgaggcaggaggatcacttgaatccaggaggcggaggttgcactgagctgagattgcaccactgcactctagccggagtgacaaagcaagactccatctcaaaaaaaaaaattaaaattaaaaaattaaaaatagtagccaggtggggctgggtgtggtggctcatacctgtaattccagcactttgggaggccgaggtgggcagatcacctgaggtcgggagttcgagtccagcctgaccaacatagagaaaccctgtctctactaaaaatataaaattagttggacgtggtggcgcatgcctgtaatcccagctacttgggaggctgaggcaggagaatcgcctgaacccgggaggtggaggttgcggtgagccgagatcgcaccattgcactccagcctgggcaacaagagcgatactctgtctcaaaaaaaaaaaaaaaaagtagccaggtgtggtggcacacatttatagtcctagctactcaggaggctgaggtgggaggatctcctgagcctgggaggtcgaggctgcagcgacctgtgagtgtgccattgcactgcagcctgggtaacagagcaacaccctgtctgggaaaaaaaaaaacaaacaaaaacaggctgttagctttgatgcaaaataatgttttgttgttgttgttgttgttgttgttattgttttaagcaggctggccgggtgctgtggttcatgcctgtaatcccagcactttgagaggccaaggcaggcagatcacctgaggtcaggagttcaagaccagtcaggccaaaattatgaaacaccccatctctattaaaaaaatacaaaaattagccaggtgtggtggcaggcacctgtaatctcagctacttgggaggctgaagcaggagaatcacttgaaccccgggaggcagaggttgcagtgagccgagatcgcgccactgcactccagcctgggcaacaaaagcgaaactctgtctcaaacaaacaaaaaggctacaaaaccatatatagagtgtggctcccgtttttggaaaaaataagtatatataaaaaaactatagaaggatagaggagaatatccaccaaatattaactagtggtgactagatggtgggattctaggtgctcttactgtcttctctttttttgttctgaaaacaggtagtttttctgccatgagataaattatttgtgtagattgtttttagtgaaaaaaaaaaaaaaaaactaggctgggtgtggtggttcatgcctgtaatcccaacacttggggagaccaaggcaggaggattgcctgagtctaagagtttgagaccagtctgggcaatgtagtgagaccctgtctctacaaaaaattggaaagttagctagatgtggtggttcttgcctgtggtcccagctactcaggtggctgaggtaggaagattgcttgagcccgggaggcggaggttgcagtgagccaagatcacgccactgcactccagcctgcgcaacaaagtgagaccccgtctccaaaaaaataataaaaaaaagaaggaaaaagaataaataaaacaagaaaaaaaaaggaatacttagaaccttttctgatgccttgtgactttcagaatttaaaatcccccttgcagataaggccacccacggcggaaggccgggagcgagacggggctgaggggaccttgctcccattggagctgcagggcaggaaggggtgctgcggtcagcagagggcacccttcgcctgcgccgtgtgcagtgcctgcagtcactccctcattcccaggagtagccttgggtcagatgctggctcagatctataactgctcctgtctggtagccaggcctgcccagatgtgcaatggctggaataaagggttcttggaagcaatttgttacaggcaccctgtgggctgtggctggctgtggcacacgtgaaggttgtgtgtcagacctactccctggacatggcgcatggctgcacacaggcaccttggctgagaagatgcacagtcctggtttcactctcctcccctgccctgtcctgtctgcttccacccagctctgcaggccaccagcccccgcctctcgtggccacccccagcccagcatgtcctcagccgcacatctcctgtgtcgacaggtgaagtcccgcttggcttttgggaagcccctggtggagcagggcacagtgctggcggacatcgcgcagtcgcgcgtggagattgagcaggcacggctgctggtgctgagagctgcccacctcatggacctggcaggaaacaaggtaggggcaggggcacgagggggcctcccagaggcagagattcttcctcctcactcagcaaagcatgagagcctggcttcttgacattagaaactttatttcacctctacttggagctgtttgggcagtttttcaaaaattggaaaggcacaagaagagaggactggcctttgtgttttactgacctggtgagctgcttagtccaaggcagtgggtctgatggggccacagggcccctgggtggccctggactcccagggccattggtggaggtgttgggcaacctaagagtaaggcagggaaaagggaccctctgctggccttcatctgaatattgaattaacaaaaatagaagcttattttcaagtgtgacattagtcattcactaaggctctttttaaccttttatttatttattttttgagacagggccttgctctgtagccaggctagaatgcagtggtacatcatggctcactgaagcctcagcctcccaagtagctgggactccaggcgcaaacctccatgcccagctaattctttattttttgtagagaccggctctcaccatgttgcccaggctaactaaggctctttctaagtgcctgtgatgaccaagcacaatgccatgttgaccttgctttgtccagctttctgtggggcagcctccaaccccacccaagaccctcaaccatcagggaccaacccatgctcatgctcacagttcctggttctttgacgctggcgtgctagatatggtggaggctgctgggtgtctcccttgaacaccctgccccagggcagatcactgtagctcggtttcccagagccctgagtggccttggtccactgctgcttggaggcagagctggccgtgaccctgagcaaagcacaggaccctccccttatcccttcagtgtgtgctggctgtgttccccgtcatctgggaagacagccacattctgccagcacttgcttcgcatcttgtgacataagataatagttgccaacatggcgcccttcatccctgggtgctgtcaagccgtacaccaggcaggggcagcctcacccagctcacatcagcgagaccttggggcctctgttttggacggtggtgtttgacttcttgctgggaatctgatcattcttccaggctttctgccttcgggtcttttttgtggtttagtttttcgttttgtttttgagagacagagtctcactcggtggcccaggctggagtagagtggcacaatcttggctcactgcaacctccgcctcccgggttcaagcagctctcttgcctcagtttcccaagtagctgggactacaggtgtgcaccatcacgcccagctaatttttgtattttttagtagagactgggtttcactatatgttggccaggttggtctcaaactcctgacctcaggtgatctgcccgcctcggcctcccaaagtgctggaatcacaggcctgaaccaccgcgcctggcctgttgtttgtttttgagagggggtctcactctgttgtccaggcttgagtgcagtgttgcaatctcagcttaccacagcccccaacttcccagactcaaacaatcctctcacctcagcctcctgagtagctgggactacaagcacatgctaccacaccctgctagtttttgtatttttagtagagatgggggacgggggggcctcactctgccacccaggctgccctcgggtcttttatgatcgcatctcctcctccttacaggctgcagccttggatatagccatgattaaaatggtcgccccgtccatggcctcccgagtgattgatcgtgcgattcaggtgagcacagaccagacagttggcttatttgaaccatcaatactagatgccaaactctcctatcttcagccgcccagcctcccatagaccctggcagatgccctgtgtcacccactcaccatgcatgcaactttccttttcctcttcagaatgacccagcaaggtgggaggtgccatcgtacccccattttgaatgtgaggaaacaggcacagaaaagtgaagtgacttgtccaggtcactgagcttgcaagtagctgacctcaaattcacatgaacttgggttttcataagcccagagcccaggctctttcccatgcaggggggccgcctccttagatcctaacccccggccccagcacagggcagaaggcacctgcagagtgggcctggggagtctggaggccgtgggatggcaggtgtggccccatggaagccctctggaatattagtgattgtatcacataggtgccacagggaagtccgggaagatggttgttatgggccatcaagagcaggctatcattcctggggctctcggagacaagggctgacccagggccgcctccctccactctgtgtctgccaggcctttggagcagcaggcctgagcagcgactacccactggctcagttcttcacctgggcccgagccctgcgctttgccgacggccctgacgaggtgcaccgggccacggtggccaagctagagctgaagcaccgcatttagagccttggggctgcagtggctcaatgtcctggctggtccagctgtgcccagatctgtcactgatgtgcctcgaaagatccggtgtttgtggctcctgcaccctgctcagcagctctgtcccgggacagtcagggtggactcaatctttctggttctccacagaagacgtctctgcaagaagcctggagtctgtttcaggccaggaggaggggatttgctgagggccaagggggttctgggacagagtctggaaagctggtcttcaggctctcagtcccaggctgggcaggcacggtcacttcacttcagcctttcagtccctctctctctgcctgtgggaatctggacacattttgggaggcctcccaaggctgtgggacgtgcttgctctggcagctgcagggttcctgtctggcctccctggtgagcagaggggcggccacggcgggcggtggcctagagacccaggacctgggcgcctgggaaaatggaatgcaacccacattgtaaagccactggcatctgattatctccatttgaacacacagcacagaacaatcatttaaatgttattttggaaaggggttttggggacacagaagaataagtaaacacatctcggaggctttgtgga

SEQ ID NO: 1969 - DNA, 71056 bp, Homo sapiens; identical to SEQ ID NO: 1968

SEQ ID NO: 1970 - DNA, 43100 bp, Homo sapiens
cattggctgccgcgcggggcggggagcggggtcggctcagtggccctgagaccctagctctgctctcggtccgctcgctgtccgctagcccgctgcgatgttgcgcgctgccgcccgcttcgggccccgcctgggccgccgcctcttgtcagccgccgccacccaggccgtgcctgcccccaaccagcagcccgaggtcttctgcaaccaggtgagcccaccggccgggctcgcgctttgttttccggcccgagtcccccgcaggcccctaggaaggccccgcgccgccgtgggccttagtgtactcatctggggctcgaggggtttgcagaggctgacctggaagcacatctgccccctcctctcctgcaagcattttagccccttcgccgcctctgacagtccccgtcccatttccccgtgacttgggccccctctccgtcttcgcccagcctcggtctgttttccagggccaactctcggggttccgttctccccatggtccttgctttcgggtctccgcagggtccccaccctcacccactcagaagacgcgaccaagtccctctttgcaggaactttcctgtcttttccttagtcatcccctttaccccctgactcatgccctcatccaaggagttcaaaaggaaaaaccaggaaagaggtgatttgcagccacgttctccagttcaccatgggcgaggccacgctcggctgcttccattgctgggagtagggaatcctggaggaccttcggccccagggggccgaccccaaggggtgtctgcggcttccaacgccggcttcgaccaaaccaaggaggagctttccaggataaaactgattcctgtggtccatttattgattgctcaatcagtaatactttggaatattttttgttttgatctttgagtttggttaaagttctagacttcacagaggctgaaattggttatgaaagagtttgttttgtttgtgccagtgcatgttggctgccttctctgacttaagctttttctcctataaatggaaaggcgctctgagggttaggttcacacaggccctcatcaaccagtcacttcatagttaatcacagctcctgtcctgtctgcacagcctttgtgcagcactgttctaagcgtctacctgttttgcaatttaaggtaatttttacaacagcctcagtaggaagggactgtaattctccattttacagatgaagagactgagtcacaaagaggtttagtgactcacctaaagaccaaagtcagtggcatagttggggttcacagctgaacttccaggagtaagcccctaaccagaacattccatggtatgttgtgactctgggtgggaacaaagggaccaccgatcctctgggactattgctgatttgggatgctgtagagctggctcctagccagctgctttcaacagcacacctgctggtctggccctgagtgtggctgcaaatctggatataggtgatgggtaaaggcacatgcgtgtgattttaggggatgttacaaaggtcatttgcaagggaatttttaaaaggataaaataaaatcttttgcataacacaagctaaaaaggcagcagctatggctcccttggcagcctgtgcaagttcatgcttggaagacttgagcatcaaaagatctagcagaggccaggtgcagtagctcatgcctgtaaatcccagcattttgggaggccgaggtgggatgatccgttgagcctaggatttcgagaccagcctgggcaacatagcaagaccctgtctctagtctctactaaaaaagtaaattagttaggtgcggtggcacatgcctgtagtcccagctatatgggaggctgaggtgggatgatcccttgagcctaggatttcgagaccagcctgggcaacatagcaagaccctgtgtctagtctctactaaaaaagtaaattagtcaggtgcggtggcacatgcctgtagtcccagctatatgggaggccgaggtgggaggatcacttgagcctaggagttcgaggctgcagtgagctatgattgggccactacacttagtctgagcaacagaacaagaccctgtctcagaaatgtcctcaaggaacagccatcgccctaggaacccttctggccacaggatctgattaaaatctttatcctttatcacatgcagatgaggcagctgggtccagatatgcacccaggcccataggtaacacatcctgttctccagatttactctgtgggtgtaggctggaggagccgagtcaattccctgtggctgcttttctttatcagactttttgagatcattaaagtaacacatgcccactgtataaaattgcagaggactgacttacaactctctggacatggtcagtcaaggtgattcatgcctgtaattccagcactttgggatgccaaggtgggaagatcgcttgagattagatgtaaggctgcagtgaactatgattgtgccactgcactccagcctgggcaatggagcaagaacccatctcttaaaaaataaataaataaataaacctctctggataccccattttactccctccaagagcactgtgaacaggtgggtgtgtctcttgtagacattttgtttgcatttacaagtgcctgcagcaagagagagagagagagaatgcaagcacaccagacttttttttttttttaacataaatgagatgcaaccacttatattctgaagctcgccgtctcactgaacaatgtacctgggttatcattctgagtacgttcagatctcatttaaccctttccaaggaccacagagcattctactctggtggcgccgtgctggaactggacctcttagagccccctgggctgtttgcagtgtggccttattgctgactcagcagggaagagggatggtgcatacagcagtggactctgcacctcagctgcctcatctgtaaaatggggtaaaatggctgggtgcagtggctcacacctgtaatcccagcattttgcaagactgaagcaggcggatcacgaggtcaggagttcgagactagcctggccaacatagtgaaaccctgtctctactgaaaatacaaaaattagctgggcatggtggcgcgcacctgtaatcccagctacttgggaggctgaggcaggagcatcacttgaacctgggaggcagaggttgcagtgagccgagatcacactactgcattccagcctgggtgacagagcgagactccatctcaaaaaaaaaaaaaaatgtggggggtaaaattccatctgcatcaccgaattgctgtgaggaccaaatggggtgaggcttctgcagccacaggcagtgctggcttcatggccactggtgcctccatattgactgcagccttaagcaggagctgggataacagtgacgctgtggacttgcagtgtcttggtgatcaaactccatttgatatggatgctgttgtatttgcagtttgtttcctgaaggggtgagctagattgtggtaaagtagaatgggagtttggggtgaattaaaacttgcatctttattcttaccctctctttctgtttttgtttttgttttgagacagggtctctcactgttgcccaggctggagtgtagtagtgctcactgcagcctcaacctcccaggctcagtcaacaagttatcctcctacttcagtcttccaagtagctgagactacaggcataccccaccacacctgactaatttttgtattttttattttattttatttatttgagacagactcttgctctgttgcccagggtggagtgcagtggtgtgatcttggctcactctaacctccacctcctgggttcaagcgattctcctgcttgagcctcctgagtagctaggattacaggtgcccaccaccacgcctggctaatttttttgtattcttagtagagatgaggtttcgccatgttggccaggctggctggtcttgaactcctggcctcaggtgatccacctgccctggcctcccaaagtgctgggattaaggcactgcagccagccaattttttataatttttatagagatggggttttgccatgttgcccaggctgggtcttgaacttctaggctcaagcaatcttccctccttggcctcccaaagtgctgggattacagtgtgaagcactgaactaaagagagaactgacaggcaattaaggatggatttcccaaggctaggtgtggtggctcacagctgtaatcccagcactttcagaggctaaggtgggaagattgcttaaccccaggagttcgagaccagcctgggcaacatagcaaaactccatctctacaaaagcttaaaaaaattagctggacatggtggtgagcacctgtagtcacagctacttgggcggctgaggcaggaggattgcttgagccaaggagtttgaggcttcagtgagctttgatcttgccactgcactccatcctgggcaacactgcaagtatacataggcaccatacagaaatgttcattgcaacttcttttatgtcagtaaaagcttaggaaataagccagctcgagctccattgggaaatagatgaacacctatgttacagttataggaggaaataatcctctgcatgtagcagttacaaatcattggctcaacctgtacaaataatgtatctcaaaaacaatatgtcaaggaggaaaaatgtccagcactctacaccatatgaaaccatgaaaactgtacaaaactttatgttgtatgtagatagacagatctccataaaaaatgtgtaagaatgtgctggaaggaaaattctccttggtgtgagggtggttactgcctgagtgggcaggacaggataagggtagtgatgaacgaggactctggcttcatttaaatgtttgatttctttaaaaattggccaggcacggtggctcacgcctgtaatctccgcactttgggaggctgaggcgggcagattgcttgagcacaggagttcgagaccagcctgaccaacatggtgaaaccctgactctgctaaaaatacaaaaattagctaggcctggtagcccacgcttgtaatcccagctactccggaggctgaggcatgagaatcactttaacccgggaggcagaggttgcagtgagccgagatcgcaccactgtactccagcctgggtgacagagtgacacttcgtctgaaaaaaaactccccaaaaaacaaaaaaaacttaataccccatgagcagatattaaaagaaaaaagaaaaaatataatggtcccctgatgtgccacccctgcagataatcactgttaacggtatatctgaagcagaaatttgctttttcttgtttgcctgggagattcttacagaatgagccaaaacctgtgttttggagtgactttgtgctgactgaatctccctattgattgtacaggttgatgacttctttaggagtgtcctttgtttttgtttttgtttttgagatgtagtctcactctgtcgcccgggctggagtgcagtggcacgatcacggctcactgcaacctctgcctcccgggttcaagcgattctcctgcctcagcctcctgagtagctgggattacgggtgccgccaccatgcccagctaattttgtatttttagtagagttggggtttcaccatgttggccaggctagtctcaaactcctgaccttgtgatccacccgccttggcctcccaaagtgctgggattacaggcgtgagccactgcacctggcctcttttttttttggtttttttttttttttttgagacagggtcttgctctgttgcccaggctggagtgcaatggcatgatcataactcactgcaacctcaaactcttgggctgaagcgatcctcctgcgtcagccactagaggcactgggattataggcatgggccacaacatccagctaggagttttaagagcctctatagaaatagatttaggtggccgggcatggcagctcatgccctggcataagagtgaggcctagtgacagagtgagactccgtctcaaaaaaaaaaaacaaaaagaaatagatttaggcaggctgggtgtggtggctcatgcctgtaatcccagcaccttgggaggccgaggcaggcggatcacctcaggtggagaccagcctgaccaatatgatgaaaccccgtctctactaaaaatacaaaaattggccggtgtggtggcatgtacctgtaatcccagctacctgggaggctgagacaggagaaacgcttgaacccaggaggcggaggttgtggtggggcccagtgacaccgcccgcctcagcctcccaaagtgctgggattacaggcatgagccaccgtggccggcccgtgtttttaatcagagaacacaaatgggcattcaatacttcctgcctgcccagaatctgtgggacacacttgagtttcaggtgacagggctataataatgtttgtgctcctgaggtcaagctgagttgagaatttacatgttgtggacatgtgtatgtattccctgctccagtaatcatgattattcatcacctattttccatcaggccctctactgaggacttctacctgcatttcacctttcatcctacccgcaactctataagcctggtagtattgctgtcccgtcttgcgggtgaggaaactgaggctcagggaggtcaagttcacattaagtataactaagggcatgtgtgtgaaggttgggcagggcagaatttgaagcccactttcaaacttataacttaatgtgaacttgacctccctgaataatgatcagaccataagaatgtattaataaacatttaagggacaattgaatagaattttaaaatcagagaggaggagccatgtttgtattgttcacttttgcattcctggcacctagcaccttagcataggatcactgttgggtaaatatttattgaataatgaatggttgccatttacgaaaccatgtttacagttttgtgctccagaagtgaggtaaagggttgcttaatgagaacccagtatttctactcaaaaggaccttattgcaaagtatttggaagtttaaaagagtgggaacatggggacgcatagggagtggtgaaactggctcagggaaagtccattgcagcaagatagaggttgccaaaccgtaagcagaacaagttgaaaccgcgcctgtctggcaaacagtccaaagtggaattgaaactcccatctttgaagtggtgaaaaaaggccctggggtgggggagtggggcagagggctggcgtctgtctgcctgggttagtcttggttcgggagtgtcccgagcaagcctggggagatgactgcccctcgccttgatccccaactaacctggggttctggattatgtgtggggaagagggaatgtgtgtggcattccgtgtttgtcttgaactttactccctggaatcttgtaatacaagcaatggcatctgctttccatcggacataatcacctaaccgcagattagcaagtgaaagagcacatgccgttgggatcatcccaggctgcaaaaccgcgccattagcttgctcactctttgggaaaatacggtgttccagggacggggatttcctaggtaacatgtccagttctctcatgcatcaaagcttgaactgaaatctttctagaatgtatcctgcctccttaaatcagaactactgaacacagtttagcctttcattggagaccctgggcagatgattactgaacacagtttagcctttcattggagaccctgggcagatgataaccacccattgtcatgaggtctgggggtggtggccagaatttcattctctcctggccttggtctgacctccgcccccaaggtccagttgtcctgctctgggcactgaccctgccccagctcctgagcccctcgaccaccacaatcaccactaagtctctgcctggcatggagaacaagatagccaaggtgaagagggatcctgttaccctctaactcagtagttctaatttctacacagtaatctgccccatgtttggaaaaacgcatgtgaaagggttcgccacagctgttgctggaatggcgatcacttgtcctaaaagtgcatttgtaggaaatcgttaaataaaccatggcctgaccgtgttgaggaacgctatgtggcttaacatgaggcagagctgcctgtggaataacgtccaagagaaactgagaaaagcgagttagcaaacagcaagtctattacccccacttagaaaggacacggcagtgtcccggttctctggtctcctgggtcctcccagcatcaagtgcagatcctggcacacagcaggtagaatcgcgagccccccgctctcccctcacctacaccctgcagccactcctcctgtccccaggctcttcctagcagtcacccttcagacccctcagctggccaagcctcctcctgcttctcacttgcttggttttgcttgtttcctgcgccctctcctcaccaggacttcagctcccacaagccaggacttggctcttggactccctgtgctggagtggccagggctgtcagtgaaagcttatggaatgcgtgggtgaatgaatccaatttttacaaaacaaagtgagatgtatttattaaaatatgtaggaattagagtattttgatagaaaatctttatgttttgcctacagtctagattgaaaatgtcaactccagacatcactgtgcttctggaaactataaagaggaagtgggagctaggacatccccccaccacgccccgcccaagagcgtttacgtgtgttatgtaagtcgagcttcgggtttctggtcaggaggttataaagcatttggcccagagtctggcctggtgtttattcaggaaaactgctcctcacttgaagcagaactttggcagaaactcagtgtgagaacagttcctacccagccccccaccggggagggaagccactgagtctggctctgggagaagggaaatgggaaatgtaaaccggaggaggtttccagcgtcctacagcagacccaggtttatcttatcagtggagaagggaggatgggttgttgaaaatgcagcctggttcaacagtgaagggtgattgagaacattctgggctttgaaaggcaaacatgccagggagtggtctttccaggatcctaatctaaatcagaggggccagcccagcgaggaaggggtggggctggtggggttttagccagactggcccacctctccccttcctacttcctgatctttgcaaaataaagtttaaaatccaggacaatttagtatgctttggtgcagggaacaacataaagagtatagacctggccctcgctcctaagaatctttaagctacgagagagctgcaggatctagaacactgcaggaccccctgcgggcaaggtcctagcttaggaactgtacactcgttcttgcatttaaccttcacatcagcccccagaagtactcgatgaggcatctgggaagtgaagggatttgcccagggtcaaatctgtgagggatggagtcagaattcaaacccaggccgggcatggtggcgcacagctgtaatcccagcactttaggagtccaaggcaggaggatcacttgagcacaggagtttgggaccagcctggccaacatggtgaaagcccatctctacaaaaaatacaaaaaaaatcccacctttatttaagaaaaaaaattcaaacccagatctgtttggctttgaggttggtgctttttacaacattcagaataaaattttttttttttttgagactctgttgcccaggctggagtacagtggtgcaatcttggttcactgcaacctccatctcctaggttcaagcaattctcctgcctcagcctgtcgagtagctgggattacaggcaagtgacaccatgcccagctaatttttgcatttttagtagagacagggtttcaccatgttgtccaggctggtctcgaactcctgacctcaaatgatccacctgccttggcctcccaaagtgctgggattacagggatgagccactgtgcctggctcagaatcaaaatgtgaaatcaacgtgtgttgagtcagtaagtaaaccataaagatggagatttgggaatcagaattccaacctccttgaaggcagacctgggctatggctggaggttggagttgggaaaaacacaggccttggagtcccaaagacctggcttcaaagcctggctctgcctttgctgctgtgtgacctagagccaagtggctggactcttctgtgcccagcatcctctgctgtgaagtggagaggatgaagttcacctcctaggtttgctatgaggtttaaatgggaacaatccaagtacacagaaccgctggtgtggggctggttcttgaggggtagctagtgaatgttagccatgtccatgacacgcagagggctgagtggacttcctccctgggtgggggaggaagaagcttggggatagtacaaggccaaccagacctacttccacccagcccagcctagtgcttctctgtactctcctaaccctgctgacccaagtgctttgctgtgaggcagttgtgtgtgaggcgtgaaccctgagcctgtgctacagggggaaggagagaaggatgcctactcaatggctgcaagctgcctgcccgccccccacgcccgtgagcccccatcttccagcaggcagacccgggaactcccttctcctccacgggcaccccgaggaggagctgactttcagagtcggggagtaaacacccaggacctgctgcccaggcacggcatagtccaacttgaacttaggtctggcagtttcctggctttgaacctgagctctttattgccacacctgtccccacactggaaatgacccagccctcccgtggaaagaaagaagggtgccatttccctaaaaattaacgattgactaactaatatgaaaccacacaagcacgcctccagaaccccagttaatgtttacccatgttcttctccggtgccaagagcctttcctgtgggtgcacaactgcgggttccaccatagagattatgcggaacaaatttcagcctgggaatatgattcctgctaggcccttacctgaacgactccttcctggggcactctgtttccaccctgccatcgtcatggcgttgggcattcactccatgcttggcgcagagactgcagaccctcacatggctttataaaaagggggctctagggtgattcccaccctacagatgaggaaacaaagacacaggggtgaggtgcttgtcccatgtgacaaaatcaggagcaaaagagcccatattcggccaggcgcggtggctcacgcctgtaatcccagcactttgggaggccgaggtgagtggatcacctgaggtcaggagttggagaccagcctggccaacatggtgaaaccccgtctctactagaaatacaaaaattagccgggcatggtggcaggcatctgtaatcccagctactcaggaggctgaggcaggagaatcgcttgaacctgaaaggcggaggttgcagtgagccgggatcgctccattgcactccagcctggggaacaagagccagactttgtctaaaaaaaaagaaaaaaaaaaccctcacacctgtaatcccagcactttgggaggcccagacgggcggatcacgaggtcaggagattgagaccatcttggctaactcggtgaaaccccgtctctactaaaaacacagaaaaattagccgggcatggtggcaggcgcctatagtcccagctacttgggaggctgaggcaggagaatggtgtgaacctgggaggttggagtgcagtgagctgagattgcgccactgcactccagcctgggcaacagaatgagactctgtctcaggaaaaaaaaaaaagcccatattcgtccagattctttttttttttttaagagtctttttctgtcacccaggctggagtgcagtgatgcaatcacggcttactgcagcctcaacctcccaggctcaaatggtcctcccacctcagcctcctgagtagctgagactataggcacgcaaccacacctggctaatttttcactttttgtggagagagggtctcactatgttacccatgttggtttcaaactcctgagctcaagcaatcctcccaccttggcctcccaaattgttaggattacaggcgtgagccactgtgcctggccacccagattcttgtcttgaacctctgctcctttttgtgttttcttttttgagagagggtcttgctctgtcacccatgctggaggcagtggtgtgatcatggctcactgcagcctcaacctcccagactcaagcaagtgatccgtccatctcagcctcctaagtagctgggattacaggcgcatgcgaccacacttggctaatttttcattttttgtggagatggaggtctcactatgttactcaggttggtctcaaattcctgagctcaagcaattctcatgccttggcctccaaaagtgctgggactacaggtgtgagccactgtgccaggccaaatgtctgcttttgaccagtgagcctggccacccctccccagccctgttgtgagcctcactccaggctttgcttggcagctcggtattctttatggtccgagactctggcccagagtgaccatggatgtctcactggagttctaggccagggccaggacatgcagggatgctggggccaaagggacccccaaggaaggcaggcagagaggcagatgtctttgccttcacgtcacctgtagcctttgcctcagcactggtgaggtgaccatggaccctgccaggacactggtttaccaagcccgaagggaacagcttgctgggagatgtcttctctgcactccccaagaccatcgcccagtgcctggaaagcagagggcgaactctggcactttatgtatgtatttatttttattttttgagacggagtttcactctcgttgcccaggctggagtgcaatggcgtgatcttggctcactgcaacttctgcctcctgggttcaagcgattctcctgcctcagcctcccgagtagctgggactacaggcgcctgccaccacacctggctaattttttgtatttttagtagagatggggtttcaccgtgttggccagactggtctcaaactctggacctaaggtgatccgcccaccccagcctcccaaagtgctgggattacaggcatgaacaccgcacgcagcctcgcactttaataggtgactttaggtaataagtaaggacccttcctctgagcaaatggaggggctttggctctctgacattggcctcatgaggaaggaagtctttcccccagatgtggcttggttgggtgatggcctggtctgaattacattctagaggcggaaccgtcttgggacccgccctcctccctgaccccgttttttatcacttcctttctggttcaccagtaactctggccacctttgctttttctcaaatctaccagacttattcctgccctggggcctttgcacttgctattccacagcctggactgctggtcctccggctcttcctgtggacccctccttttcatcattccggactcggtcaaatgtccactcctcagggtgacctgcccctaccaccacggctggagttctctaccccccaccttagtcaccttctctggatcctcttcttcccttcgccttcatctgtacagtctgaggtggtcttctgtgtttgattgcctctttatttcctgggcaccatgagagcatggtctttgttggcttttggctgtactgtgtcctcagccctagaactgtgcctggcccatcgcaggtgttcattaagtgtttgctgagtgagtgaagtaataatctagggctgggcatggtgactcacacctgcaatcccaggaccttgggtggctgaggagggagtatcgcttgagtccagcctggggaacatagagggacctcatctctacaagaaatacaaaaattagccaggcgtagtggcgtgtgcctgtggtcccagctactcaggaggctaaggcaggaggatcacttgagcttaagaggaagaggctacagggagccatgatcacgccactgcactccagcctgggcagtggagtgagaccctgtctcaaaaaagaaaaaaaacaataaaaagaataatctaatttagttctcacaacaaatttgtgtgggagtggaatagaatgaaggtggttgcaaattgtttgccattccttctagggagaaggggaggctctctcctcaacctgggactctggactgagcctgtgactcactttgaccaacagaatttggtggcagaaatgaggccaagtgacttctgaagctagatcttaggaagcctttcagcttccacctgggtctctaggaacactgtctcaggggaagccagctgccatgtgggaagtcggactagcttgagccagccatgcagtcaggaagcccaagcagccatgtggtgccagacgagtaagtgcagaagccatcttgcacatccagcctcagaggtggatgactattggccccagctgtcctcacactgtagccacacaagggaactctgcccagatgagcccaaccaggggactctactgtgggagataagaaatcattttaagccaccaagttttagggtgctttgttacacagcaatggataactagaacaagtatgaacattctcttcattttttaaagaaaccaaggcactgagaagtcaagtgacttacccaaggtcacttggcagagtgagcattctggcctagattgtctgcaaggcctgtgcttttcatttgtaggctacaccactctgaaattaattcatatttgctttttcttgtttttttttttccttacaatactggtagtcagtattaggttgacagctggtcctgagaacttctttccttctcattgtagattttcataaacaatgaatggcacgatgccgtcagcaggaaaacattccccaccgtcaatccgtccactggagaggtcatctgtcaggtagctgaaggggacaaggtgagaactggtgacttaccttgggggagggatggattcgtcttctattttatacgtttttgtgtggtgaaagctttaccatatatgtgtattactttcacaagtaacagataccagtgaaaaattccgagtaaattaatcaatagaaacttgtctgcagacaacggtgttaattcacttagtgtagaactatagacttagaagtgaattcggcaaatatctaatacagtgtctcctttccagacctggaagttgaaggtcagagatggaaaccttgctgggtagaatttgggtctcctaagatctagctcctgtggaggtttgaattgtacagactgtaggaaccaatcgaaactgataatattctgtttaaaatttttaaattagactcttagtaaaaatattttgtgtttttggccgggcgcagtggcgcaggcctgtaatcccagcactttgggaggctgaggtgggaggatcacttgaacccaggaatttgagaccagcccggggaaacatagtgagataccatctctaaagtaaacaaagaaacaaataagtaatttaaaactaagaaaatacaggccaggcgcagtggctcaagcctgtaatcccagcactttgggaggccaaggtgggcagatcatgaggtcaggagtttgagaccagcctgaccaacatggtgaaaccccgtctctactaaaaatacagaaattagccaggtgtggtggcatctcttgagtaatcccagctactcaagaggctgaggtaggataattgcttgaacccgggaggcggaggttgcaatgagccgagattgcgccactatactccagcctgggcgacagagcgagatttcgtctcaaaaaaaaaacaaaaaaaaagaaaatacagaaattatccggattctcattcccaccaggacttcatgaaaggaggggaaggtcatgttattcaaccccattgctgaagtctggtgctcatcagggctctgccgggctaggagcattgtttacggggcaggttttctgtgcagcgatatgctgatgaccttctggatgtgtttgtattcggacctggttattactgagaagacctgagttttccaggaaggcttgagttttcctgtgttttctaggaagatgtggacaaggcagtgaaggccgcccgggccgccttccagctgggctcaccttggcgccgcatggacgcatcacacaggggccggctgctgaaccgcctggccgatctgatcgagcgggaccggacctacctggcggtgagtcctcagcccttctccccctcagatcccatgtggtgaataggctcgcagcatcctgtgaacagccaggaaccaagcatcctgtgaacagccagggaacacacatctgacacgggactgatgggaatggcataggatggacacctttagggggcacctctgtactaaccagaggagcctttcagtgtctcctttgtttttttgttttgttttgttttgcttttttgagatggagtctcactctgtcgcctaggctggagtgcagtggcgacatctcggctcactgcaacctccacctcctgggttcaagtgattctcctgcctcagcctcccaagtagctggaattacaggcacaagccaccacgcacagctaatttgtgtatttttagtagagacaaggtttcaccatgttggccaggctggtctccaacccttgggctcaagtaatccacctgcctcagcctcccaaagtgctgggattacaggcgtgagccaccgcacctggcctttgatgcggcgggtttggctaagcaagaaggatctgggggaggggagaggagctgtgtcagggaggccttcccaggagagagacccctgggaatggacacctctccctcggcccctccatggtgggccttctccctggctgcaagaggagaagaaaccaggaggcaatctcctcccagccacaattgattctgcacacagaagccagagcaaaccttccagaaggcagattatacatggcactctgctcttatccctgcatggcatgcggtgtccttaggataaaatcctcaacatggtctgtaagaccagcctgtaacatggcaagatcctgtctctacaaaaagttaaaaaactagctgagtatggtggcatatgcctgtagtcctagctacatggtaggctgaggcaggaggcttgcttgagcccaggagttcaaggctgcagtgagctgttgtggtgccactgcgctccagcctgggcaacagagtcagatcctgtctcaaaaaaaaaatgacccagcctgttctagttccatcatctgagtcatgctgcactgcagtcctcacattcacatgtgctcctgagcctgggctcccatgcttgatggccaagcctctttgagcatcagcgcttgcacctgcctgggatgctcttcgccctgctgccatctgtaccatcccctttgcccagttgccccctacatatcattcaggttctagcctaaagggctcatctctggctgatgtttctagacagggctgggcagcctggctccctgctttctattttttagcattcttttattattattattattttttgagatggagtctcactcttcacccaggctggagtgcaatggcacaatctcggctcactgcaacctctacctcccaagttcaagcaattctcctgcctcagcctccccactagctgggattacaggtgtgcaccaccatgcccagctaattttgtatttttgataaagtcaaggtttcactgttttggtcaggctggtctcgaacacctgcctcggcctcccaaagtgctgggattatagctgcaagtcactacatccggcctctagcactcttaacacatgtgactgaggacttgtgtcattatgcacagtctctttgctctgtaagctccacgctggtctctatcccagcacctggatatggtagagagcagaagctaaaagagtgtgtttatgaaatcactgagtgagaaattggtggctcatcctgcctggcccccttcctcctcctccctgcctttggagagaccatggcaatagtccagagatgctagtgacatttggggcacaaagcggactctcaccctgggcttgcaccagcccttctcagtcccagccttggcgccctctgtcagccctttgttttcctctcattcctgcacccatgtctctgctgaccttgttttcttctcaggccttggagaccctggacaatggcaagccctatgtcatctcctacctggtggatttggacatggtcctcaaatgtctccggtatgggctcagctttcctgttctttgttctggcaggggaaaaggggaggcaacgttgttaggaggtaaaaattaaattacaaaaattcaaaaggggcagagcgcggtatctcatgcctataatcccagcactttgggaggctgagccaggtggattacgtgaggtcaagagtttgagaccagcctggtcaacatgatgaaaccccatctctactaaaaatacaaaaattagctgggcatggtggcgcacacctgtaataccagctactcaggaggctaaggtagaagaatctcttgatccctggaagtggaggtcacagtgagccaagatcacgccactgcactccagcctaggtgacagagtgagactctgtctcaaaaacaaaaacaaaaaatgaataaattacaaaaattcaaaaggatcacaggagtcagagaaggctactctatttagactccagctcatgggaaaatccttcaatatcacaaattgtgattagtcataaatgctttcttttgttcttgagtcacttttggtactttctgtgttatttggaacttgtccattttatcgaggttatctaatttgttggtgtacaattgttcacagtattctcttataatcctttttatctctgtaagatctgtagtgttgtcttcattttcagttttacttatttgggtcttctctctgtttcttagcctagctaaaggtttgtccattttgtaaatgttttcaaagaaccaaacttttggttttgttgattttattatttttctattcaagaaaatattgtcttttgtctatctccgtttcagtctttatttccttccttttactagctttgggtttggtttaatcaaaaatgtttgattgattgattgattgattattattattattttttgagatggagtctcgctctgttgcccaggctggagtgcagtggtgcgatctcagctcactgcaagctccgcctcccgggttcatgccattctcctgcctcagcctcctgagtagctgggactacaggcgcccgccaccatgcccggctgattttttgtatttttagtggagatggggtttcaccgtgttagccaggatggtctcaatctcctgaccttgtgatccaccctccttggcttcccaaagtgctgagattagaggcgtgagccaccacgcctggcgattgattgataattttaattttttttttttgaggcagggtctcactcttgcccaggctggagtgcagtggcacaatcatagttcactgcagtgttgaccttctgggctcaagcaatcttcccacttcagcctcctaagtagctgggaccacaggcgtgcatcaccatgcctggatactttttaaattttttgtagagacgggggtcttgctatgttgcccaggctagttttggactcctgggctcaagtgatcctcccacctcggcctcccaaagtgctgggattacaggcatgagttactatgcccagcaaacataaacatttcaatgaccaaggaacaagggctttgttaaagcccatgtgttggagctgccagaaattcactgaggccaggcacagtggctcacacctgtaatcctagcactttgggaggctgaggcgggtggatcatttgaggtcagaagtccaagaggagcctggccaacatggtgaaaccccatctctactaaatatacaaaaattaaccaggcagtagtggcgcatgcctgtaatctcagctactcaggaggctgaggcacgagaatcacttgaacccaggaggtggaggttacagtgagccgagatcgtgccattgcactccagtctgggtgacagactgaggctccatctcaacaaaaaaaaaaggaaagaaagaaattcactgagcccaacttaaacgatagagtcaagaggtctctaatgcaaaaggccattgagtctcactcacctccctgcttgcttcattctcctcagctacactggctttgagggccagtttttacattgggacctggtagcccacaccacctgttcttgtacctccatgcctgattccagccaggctaagctgtcatcttttagttgtaatgccatattcctgagggaggaccctgagtggctggccttggttctggccagctgtggccaagggtggacagatcatttgtgtacataatggctgcctccctatgacatgtaaacagaggtggtggggaggaagcagtgccagaagagtagaggttggacaagaaaacagttgggccgggcgcagtggctcactcccataatcccagcagtttgggaggccgagctgggtggatcacctgaggtcaggagttcgagaccagcctggccaacatgatgaaaccccgtctctactaaaaatacaaaacttaggctgtgcgcggtggctcatgcctgtaatcccagcactttgggaggtcgcggcggggggatcacgaggtcaggaaatcgagaccatcctggctaacacggtgaaaccccatctctactaaaaatatatatatataaaaaattagctgggcttggtggcaggcgcctatagtcccagctactcaggaggctgaggcaggagaatggtgtgaacctgggaggtggagcttgcagtgagctgagatcgcgccactgcactccagcctgggcaacagagcgagactctgtctcagaaaaaaaaataaaaaataaaaaaattaaaacttagatgggcgtcttggcaggcatgctacttgggagtctgaggcaggagaaccgcttgaacctgggaggcggaggttgcagtgagctgagatcgcgccactgcactccagcctgggagacaagagcgagacttcgtctcaaaaaaaagaaaaaaaaaaagaaaacagtcggtatccttcacaacaggtgcacacagccagggcaatcacgcctccccggggacactgggcaatgtccagagacatttttggcagcctcgactgcgaggggaagggtactactggcatctagtggatagaggtcagagatgctgctcaacatcgtacaatgcccaggacagtcccacaacaaagaattctccagccccagatgtcagcagtgccaaggctgaaaaactccctctgcaaggacaccccagagagagcagcctggtacatctcagttggggccacatgctttcctgaattttggcattctgcttttgtgctgatgaaataacttctggggcttgcaaaacacatgtcatgtagactgtgtttgtatagatctgggggagggaagctgcaatgcctgggcttgcatagattggcaaccccctagctagctttcttccagggtcacaaacccatgttcaaacccaggtcactagccaggtgctaatggctcgagcctgtaatcccagcactttgggaggccaaggcaggaggatcacttgagctcaggagtttgagagcagcctgggcaatatagggagacccacatctctacaaaaaatttaaaaacattagccaggcatggtgacatgtgcctgtagtctcagctactcaggaggctaaggtgggaggatcacttgagcccaggaggtcaaggctacagtgagttatgattgtgccactgtactccagcctgggcaactgagcaagaccctgtttctttctttcttttcttttttttttttttttttgagacagagtctcgctctgttgcccaggctggagtacagtggcgtgatctcggctcactgcaacctccgcctcccaggtttaagccattcttctgcctcagcctcccgaggtgctgggattacaggcacccgccaccacgcccagctaattttttgtatttttagtagagacggggtttcaccaccttggccaggctggtctcgaactcctgacctcgtgatctgctcacctaggcctcccaaagtgctgggattacaagtgtgagccaccacacccagcaagaccctgtttcttaaaaaaaacaaagaaggtcaggcatggtggcaggtgcctgtaatcccagctacttgggaggctgaggtagagaatcgcttgaacctggggggccgaggttgcagtgagcccagatcacaccactgcactccatcctgggagacagagcgagacgctgtctcaaaaaaaaaaaaagaaaagaaaagaaagaaaaaaaaaaaatctaattcctgggcatgagccccagagagtgggattgagtagattggaaatggactcctgggatctggtgttttttacaagaaccccaggcgattctgaggcttgggggttagctacctagagtagattttcgtgacctttgcagtcacttgtctctctctgaataagccaaaagcaaagacagttttcagaaagactcagctggaccagtttgagtcttctctttctgccagggtttgcaggggtccctgacaatcattgattcgagcttgaacgtttctttgtttaaaggtattatgccggctgggctgataagtaccacgggaaaaccatccccattgacggagacttcttcagctacacacgccatgaacctgtgggggtgtgcgggcagatcattccggtgagtccagcctccctggagtttcttcagggtgccctgagatttggcagtctgccagactcattgcagaggttctggggtggtgtcggaaggcagcctgggtggcaggtaagaagatgggctctgacaaagccaatccggtttgagtctcagcactgccactcgtgaattctgtaaccttgggcaagtcacttatcccccaagcctcagtttccccatctgaaaagtggaaatgaacatagtgcctgtcttagggaggtaattagggcttagcatggtgtcacggacataaaagcacggataaatgtgagtctgtcatcgttgtgcaccgcctgcctcatccattcatcttaaaaccacgatggatggagttaggggaggacacgcagggttcagagaactcggtgctgcttctgccctctggggttgccaccttctgctacccagtgtagttctctgaggaagcttggatttcgagggctgctgttgtttgttgcagtggaatttcccgctcctgatgcaagcatggaagctgggcccagccttggcaactggaaacgtggttgtgatgaaggtagctgagcagacacccctcaccgccctctatgtggccaacctgatcaaggaggtgcgtggcttatcctggtcttaacctctaaatgcccttgttgaggcttgttctaaaggagttctgagaagggtctcaggggtccctaaacagggaggtgtgtttgtggagcccccatcaccatgtgaaccagagtggctccctcttagcttttttccacattggacttcactgcaagatcccctttgaagaattaaaaatattgctctaggccaggcttggtggctcacgcctgcaatcccagcactttgggtggccaaagcaggagggttgcttgagttcaggagtttgagaccagcctgagcaacatagcaagaccccatctctacaaaaaattaaaaatcagctgggtggcatgcacctgtagtcccaactacttgggaggttaaggcaggaggatcacttgagcccaggagtttgaggctgcagtgagctgtgatcacaccactgcactccagcctgggtgccagagagagactcggtctcaaaaaacaaacaaaaacccactgttgttctaagtgaatgctgtcaggggaggggcaaagacacagggaaccccagcgaacagactccttctccgtcccatttagaattcccatgtagtgccccatacaattagcttctgaccacatgtgtccttggcagactgtcccaccctctctgagaaaggatgtgtcttcccctggttgagcccttcagaataggagggtgactcccaatgtcccctggctgtttgctcacaggctggctttccccctggtgtggtcaacattgtgcctggatttggccccacggctggggccgccattgcctcccatgaggatgtggacaaagtggcattcacaggctccactgaggtaaggtgaccctggcctcaagcttgcagcctccttggcccaagctccccctgtcctcagtggacgacatgctcaaggtgagctcccgggtgtcaagcggaggccttttcctccaggacgaccctgtaggtaccaggaggggtggggcagggttgagcccttcgtggtctggttgccacactagctgcccttgggaggggccagtgtcccatgtggactaaggaggccaggcctggccagactccacatagcccagagctgaccgcttgccccaaatcaaagcatcttggccaggtcagactccttgaccaggactgccattgtggttaaaaattagccttgtgtggtggtgtgtgcgtgtggccccagctacttggaaggccgaggcaggagggttgccagagcctgagaggtcaaggctgcagtgagctgagatcacgccactgcactccagcctaggtgacagagcgagaccctgtccaaaagaaaaaaaaagtgaacgtctatttggtgaaattctctaggtctctcgtggtccagttgctcactcaagctgtgggggactctgttctgtgtctatagagtgctggactcttttctcccggcactgagagcttgttcctgtctttctgtccccacagattggccgcgtaatccaggttgctgctgggagcagcaacctcaagagagtgaccttggagctgggggggaagagccccaacatcatcatgtcagatgccgatagtgagtttccagctggagaaggcctggccttgaaggtagccctggccacctgtgttgtggctccagccgatcctgtcgcccccccagtgcccaatggcgttggttgctgtccctcgggcctcaggataagacgccagcgcagggcctgcatggcctggccttggcctgtccccagcctctccctggctgctctctgcatcatcaggctaggccacgcccctgctatctgactcatccacttgccgccatcacgccctttgtcctggttggcagtgggctccgagagcacccctcatctccctgtatctgtctctggcacccagcaggcatcaacccttacagtggtgggaacaggctccattgggcaggcggccaccagggccagggtcctcctcctcactgtcacctttctgtctcctgcccacttcccgcagtggattgggccgtggaacaggcccacttcgccctgttcttcaaccagggccagtgctgctgtgccggctcccggaccttcgtgcaggaggacatctatgatgagtttgtggagcggagcgttgcccgggccaagtctcgggtggtcgggaacccctttgatagcaagaccgagcaggggccgcaggtgagccaggcagtgccgcagggtctgggtgtctagagccagcatgagaagcagagagggcatcgggctcagatcagttgggactgggttcaggtctcagctctaccacacagcagctgtgtgcctttgggaagctatgttccctccctcagccttcatttccccatcccgagccgtgccctgcctcattcacagggtggctgtgatgtagaaattaatcctgggaagcactttgtaaattgcatatatgtaacaaataccaggagtgtctgcaaaagggagtgtgtgtttccaagaccttggtcatcagtagaagtgtatccaccagaagatacacagctctgtgaaccttcgtgtctgagagccatggtatggctagtatagggactttatttcacttcatgttttgagctgtttgattttatttatttatttatttacctatttatattttagagacaaggtctctctttgttgcccaggctggagtgtagtggtgcaatcatacctcacctcagccttgaattcctgggctcaaggagtcctcctgctttggcctctcaaagtgctgggattacagacatgaaccaccacacctggcctggattttacttttgagcagttgtaggtttatagaaaaatagagctgaacgtacagagggtgcccatatattccttcgcacctccctgttccaccagtttcccctttattcacatcctgcatgagtgtggttcatctgttagtattgatgagccaatactggtaccttattattcacttaggtctgtagtgtatattcgggtttttttttttaatttttattttttttggagacagagttttgttctgtcacccaggctgcagtgcagtggcacgatctcgactcatgcctcccgggttcaagcaattcttgtgcctcagcctcctgagtagctgggactacaggtgcgcaccaccacgcctggctaattttttgtgttttagtagagacagggtttcactctgttgcccaggctggtctcgaactcctgagctcgggcaatctgctgtcaggcacccagcctcggggtcattttttgtgttgtacttactatgggcctagacaaatgtatcataatgtgtatgataccatcattctagtatcatataaatatatttgtgccctgaaacccccgtcctccacctattcttccctcttttcctcccctgagccctggcaggcaaccactgatttttttttttttttttttttttgagacagagtctcgctccgtcaccaggctggagtgcagtggcgtgatctcggctcactgcaacctgtacctcctgggttcaagtgattctcctgccccagcctcctgagtagctgggacttacaggtgcatgccaccatgcccagctaatttttgtatttttagtagagacagggtttcaccacgttggccaggatggtctcgatctcctgacctcgtgatccacccacctcagccttccaaagtgctgggattacaggcgtgagccattgtgcctggccgatctttttattgtctctatagttttgccttttccagattgtcttatacgaatcatacagtaggtagccttctcagactggcttctttcttttagcagtttgcatttctgattcctcagtggggagccacagccatgtctgaggatggactggccttgccatgggacagggttatgtgcccaacatccccctctttgattttttttagagacagggtcttgttctgttgcccaggctggaatgcagtggtgtgatcatggctcactgcaggcttaacctcctggcctcaagtgatcctcctgcttcagcctcccaagtaggtgggactacaggcacacgtcaccacacctggctaatattcatattttttatagagatgaggtcttgctatgttacccaggctggtcttgaattgctgggctcaagcaatcctcccacctcagcctcccaaagtcctgggattgcaggtgtgagccactgtgcctggcctccaacatctctatctttaatagctttattgagatataattcacgtagcataaaatgcaccattttagtgtacgattcagtgatttttagtatattcacaactttgtgcaaccatcaccactaattctataatattgtcattgcctcccctaaatatcctgtacccattagcagtcactccccattcctccccctaccaggcccaggcaaccaccaatctatgttctgcctatagatttatctattttggacattttatgcaaatggaatcctacatggttctttgtgtctggcttcttccaagtagccatgttttaaaggttcatccatgttgtaataagaatgtatcagaacataaaaggccaagtaatattccattgtgtgaatagaccacattttgatttttctattaatctgttgacagacttgattgtttccaccttttggttactgtgaatagtgcagctaggggcactaacatttctttctttcttttgagaccgtctcgctctgtcacccaggctggagtgcagtggcatcatctcagctcactgcaacctccacctcctaggttcaaacaattctcctgtctcagcctcctgagtaggtgggactacaagtgcacgccaccacgccctgctaatttttgtatttttagtagagacagggtttcaccaagatggtcaggctggtcttgaactcctgacctcaggtgatccacctgcctcagcctcccaaagtgctgagattacaggtgtgagccaccgcacctgtcctaacatttcttttcttttttttttttttgagacagagtcttgctctgtctccaggctggagtacagtggcacgatctcggctcactgcaacctccgtctcccaggtttgaatgattctcctgcctcagtctcccgagtagctgagattacaggcgcccaccaccatgcccagctaattttttgtatctttagtagagacagggtttcaccatgttggccaggctggtcttgaactcctgaccttgtgatccgcccacctcagcttcccaaagtgctgagattacaggcttgagccactgcacccgtcctaacatttctttttgtctcatttctctttgtggctaattattaagataatataaacttgcattaataaatttaatgagaaagtgtttaggctatgtgtggcagctcacatctgtaaccccaacactttgggaggctgaggcaggagaatctcttgagcccaggatttcgagatcagcctgggcactacagcaagacctcatctctactaaaaaaaaaaaaatgcaaatcatgaccagcctggccaacacggtgaaacctcatctctactaaaaatacaaaaactatttgggcgtggtggtgggcgcctataatcccagctactcgggaggctgaggcaggagaatcacttgaacccgggaggcgcaggttgtggtgagccaaaatcgtgccaccgcactccagcctgggtgacagagtgagactccacctcaaaaaataaataattttttttttaaaaaaaagcaaaaaaaaattagccagatgtagtgatgcgtgcctatactctcagctacttgggaggctgaggtgggagcccaggaggtcaaggctgcagtgagcagtgatcacaccactgcactgctgcctgagtggcagagtgaggccctgactctttttaaaaaaaggtatttaatgtaaaaaataagactttgttgcatttcttttattctccattggtaaccactcatgcacacacagttatgctgttgtatgtttattttttaaaaaataggctgggtgtggtggctaacccctgtagtcctaacacttgggagggaggccaaggtgagtcaattacttgagcccaggagttagatactagcctgggcaacatagcaaaaccccatccctactaaaaatataaaaattacccaggtgtggtggcacacacctgtggtccagctactcgggagactgagatgagaagatacctgagctcagggagattgaagttgcagtgagccgtgattgtgccactgctcttcagactgggcaatagagtgagaccctgtcgcccttctcccctaccctataaaggagtatataagtgcatattgttctacaagctttacttctttttttttttttttttgagacgaagtctctgttgccagagctggagtgcaatagcgcgatcttggcttactgcaatctccacctccctggttcaagcgattctcctgcctcagcatgtgccaccatgcccagctaatttttgtatttttagtagagacggggtttcactatgttggccaggctagtcttgaactcctgacctcatgatctgcctgcctcgtcctcccaaagtgccgagattacaggcgtgagccactgcccctggcccaagctttccttctttttacagagtatcttgggccatctttctgtgtcagttagttcacagatctattagtgatgacaatatactggatgcaccgtaataattttaaccaacccctctactgatttatacttagaattgtttccatcttttgcctttacaaaatgctcccccagcctgggctacaaggcaaaaccctgtctctactaaaaatacaaaaattagcccagcgtaggggtgcatgcctatagtcccagctactcgggaggctgaggtgggaggatcatttgagcatgagaggcagaggttacagtgagtggagatcgcaccactgcactccagcctgggtgacagagtgagaccccatctcaaaaacaaaaatacaaaaaaaaaaaaatactccctagtgaatatccttgttcatttctctttgtgcatatgtagaataaattcctagaagttaaatagctgggccaaaggatctgagtatataatttttgagcaatattaataaaccacttgctctaaaggctgtaccagtctgtcatccttctaacagtatatgtaacggtctcttgctatcagtgtattttcttcctaaactttttggtaatcttatagttgaaaagtaaagattgatttgatgtccttttctccggtaggctgaggaagttgggccttttttgtgttttctgctattggccctgtgtgtttcctcttctgatcttgctttcttatgaccttggtccatttcccagttgtcttgttgcctgcataattctaagcctgaagcctaggagaggtctgaatccgatgtctccataactctgggttccttctcccacaggtggatgaaactcagtttaagaagatcctcggctacatcaacacggggaagcaagagggggcgaagctgctgtgtggtgggggcattgctgctgaccgtggttacttcatccagcccactgtgtttggagatgtgcaggatggcatgaccatcgccaaggaggaggtgagcacttggggccagtgctctggaaacattcttggcgggaggtgaggtaaacagttcagcctggcatcctgatgctgtcacccatctgctggcttggggccagatctcaagttatacccagaaccagtgcccataacacgctattcatagtatgtatctgatcttgtccctcctcttcagcttgtaccctctgtctgggagatcgtctgcattcctcagcatggcctgcaggccttggtgtcctggccctcagagccaggagtctaggaatgacattgtctgctccttcccatgaccttttttctttcagtcagattcttgctctgttgcccaggctggagtgcagtggcataatcatggctccttatagccttgaactcttgggctcaaatgatcctcccacctcagccttctgagtagctgggactacaggtgctcaccaccatgcctggctaattttaaaaaaattttttagtacaggctgggtgcagttgctcacgcctgtaatcccaacactttgggaggccgaagtgggtggatcacctgaggtcatgagttcgagaccagcctggccaacatggcaaaaccctgtctgtattaaaaataagaaaaaattagccctgcgtggtggcgcttgcttgaaatcccagctactctggaggctgaggcaggagaatcgcttgaacctgggaggcagaggtttcagtgagccgagatcgcgccactgcactccagcctaggcaacagagcgggactctgtctccagttttagccacgcctggctaatttttgtatttttagtaaagacagggtttcaccatgttgatcagactagtctcgaactcctgacttcgtgatctgcctgcctcggcctcccaaagtgctgggattacaggcatgagccaccacgcccggcttattttttctcttctcgttttgagatggagtctcactctgtcgccaggctggagtgcagtggtgcaatctcagctcactgcaacctctgcctcccgggttcaagcgattctcctgcctcagaccctactagtagctgggattacaggcgcacaccaccacgcccagctaatttttcttattttcagtagagatggggtttcaccatgttggccaggcttgtctccaactcctgacctcaggtgatccacctgcctcagcctcccaaaatgctgggattacaggtgtgagccatcgtgcctggccaaaaattttttttttttttttgagtaaagacagggtctctctgtgtttgccaggctggactcgaactcctagactcaagcagttctcccaccttggcctcccaaagtgctgggattacaggcatgagccacaatgcccagctgacttaaattctttgacactaaatctacgtgtcacgtgtgaataacatacctggcaggattgtttagaaatgggatactgtatgtaaagcccggggcgcacaggaggaagttggcccctgttagctccattccctctgtgttctgctgagcttgatggctgttgtcttcccctggaactgttagagcatggctgggggcttatcccccaatctggaatcatctgttctgctctgagagagctcgatggcaggtgcctccgtgttgccgaaccctcctacgctgctctctcactccagatcttcgggccagtgatgcagatcctgaagttcaagaccatagaggaggttgttgggagagccaacaattccacgtacgggctggccgcagctgtcttcacaaaggatttggacaaggccaattacctgtcccaggccctccaggcgggcactgtgtggtaagagcctcccagcagcccctcacaacccaacagagattcctcaaagccagggcctactggaatctggtggtcaccatcctggaatttggggagctgggctcagtttctcctgggtcagggtgtgatgtcgatttgagaggtcctgctacctcacctccgaaggatcaagcttctctgtggtgcaaaggccctgcacctgaacttggcaggcagcggagtggtggggctcctccccagctgcctcagggcaggagaccagagcagagggacccatgattgtgacactgatcctaaaagcttagcctctgcttcacacttagcccccactaggatggctatatttttattatttatttatttttagttttattttttcagacagaaaaaaatattctacccaggctgaagtgctgtggggtgcgattatagctcactgcagccttgaactcctgggctcaagcaatcctcccacctctgcctcctgagtagctgggaccacaggtgtgtaccaccacacctggacaattaaaaaacatttttattttttgtagagatgagatctcgccatgttgcccaggctgggctatatgtatatatattttaaagtattggtaaggatgtggagaaatcggaaccctcctatgttgctgatgggaatggaaaatggcacactcattgtggaaaataatttgggagctcctcaaaaagttaaacatgaagcccccatatgacccagcaattccactcctaggtatttatccaagagaaagaaaaacgtgctcccacataaaaacgtgtatatgaatcttcacagcagcattatttgtaacagccaaaaggtgaacacaacccaaatgtccgtctgtagatgaatggatacagaatgtgatctgtccatgcaatgaaatgtggctcagccacagaaaggaatgaagtagctgtatgagtctgttctcacactgctggtaaagacattgcagagaccgggtaatttataaaggaaagaggtttaatggactcacacagttccacgtggctggggaggcctcacaatcatggtgaaaggtgaaaagcatgtctcacgtggtggcagacaagagaagagaacttgtgcagggaaactcccctttataaaaccatcagatcttgtgagacttactcactgtcacaagaatagcatgggaaagacctggccccatgattcaattacctcccacaacacgtgggaattgtgggagctacaattcaagatgagatttgggtggggacaaagccaagccatatcagtagccatgcatgcaatagcatggattaatcttgaacataacattgagtgaaagaacccagactgtctgggtgcggtggctcatgcctgtaatcccagcactttgggaagccgaggtgggtaggtcacttgaggtcaagagtttgagaccagcctggccaacatggtgaaaccttatctctactaaaaacacaaaacttagctggctgtggtggcaggtgcctgtagtcccagctactcgggaggctgaggcaggagaatcgcttgaacctgggaggcggagattgcagtgagtggagatcatgccactgcgctccagcctgagcgatagagtgagactccaaaaaaaaaaaaaaagaacccaggcacaaaaggccacatgctgtgtgattccatttacagtattataaatatctagaataggcgaatccatagagatagaaagtatgttagtggttgccaggggctgggggagggaggaatggagagtgcctgcctcctgggcacagggcttctttcagtgtgatagaaatgttctgcaattagacagtggtgatggtcacacaacactgtgaatatgctgtcaaccagtgattgtacactttaaaatggtgaattttaggctgggtgcagtggctcacccctgtaatcccagcactttgggaggccaaggtagacggatcacgagatcaggagatggagaccatcttggccaatgtggtgaaaccccgtctctactaaaaatacaaaaattaggcctgggcctggtggctcacacctgtaaggccgtggtggttcacacctgtaatcccagcactttgggagtccgaagtaggtggaacatgatgtcaggagttcaagaccagcctgaccaacatggtgaaaccctgtttctactaaaaatacacaaattagacgggtgtggtggcatgcacctgtaatcccagctacttgggaggatgaggcaggagaatcgcttgaacccgggaggcagaggttacagtgagttgagatcgtgccattgcactccagcctgggtgacagagcaagactctgtctcaaaaaaaaaaaaaaaaaaaattagccgggcgcagtggtgggcacctgtaatcccagctactcaggaggctgaggcaggagaatcacttgaactttagaggcagaagttgcagtgagccgagatcgcaccactgcactccagcttggcaacagagtgagactctgtctcaaaaaaagaaaagaaaaagggcagggcgctgtggttcacacctgtaatcccagcactttgggaggccaaggcgggcggatcacgaggtcagaagatcaagaccatcctggctaacacagtgaaaccccgtttctactaaaaatacaaaaatttagccgggtgtggtggcgggcacctgtagtcccagctactcgggaggctgaggcaggagaatggcgtgaacctgggaggcggagcttgcggtgagccgagatcgcaccactgcactccagccagggcgacggagcgagactctgtctcaaaaaaaaaaaaaaaaagaaaattaaaaataggccaagcgtggtggctcacacctgtaatcccagcattttgggaggccaaggcaggcatatcacgaagtcaagagtttgagaccagcctgaccaacatggtgaaaccctgtctctactaaaaatagaaaaattagctgggcatggtagcatgcacctgtaatcccagctactcgggaggctggagattcgcttgaacctgggaggcggaggttgcagtaagctgagatctcaccactgcactccagcctgggcaacagagtgaaactccatctcaaaaaataatctcaaaaaataataataataaataaaaataaataaataaatggtaaatttcaaattcaaataaaatttaataatttttttaaattgcaaaaaaaaaaaatgaaagaaaagaaaagaaagccatccaggtgcagtggctcataccagtaatcccagtgctttgggagcctgaggcaggagaattacttgaggccaggagttcgagaccagcctgggcaacatagtgagaccccatctctacaaaaaataaaagataaaaaaattagccaggcatagtggcacatacttgttatcttaactacttgggaggctgaggcaggaggatcactgaagaccaggagttggagaccagcctgggtaacataatcagaccctgtctcttaaaaaaaaatttattgccaggcgtggttgcacgtgctggtagtccagctactcaggaagctgaggcaggagaatctcttgaaccccagatgtggaggttgcaacgagccaagatcatgccatggcaactccagcctgggcaacagagaaagattctatctcaaaaaaaaaaatttttttttaagttaaaaataaaataaagactttggggcaatacagggggtcctgggagtgtaacccataacccccaagagtgatttctgcaatctcgtttcaaattacagggtcaactgctatgatgtgtttggagcccagtcaccctttggtggctacaagatgtcggggagtggccgggagttgggcgagtacgggctgcaggcatacactgaagtgaaaactgtgagtgtgggacctgctgggggctcagggcctgttggggcttgagggtctgctggtggctcggagcctgctgggggattggggtctgttgggggctcggggcctgccagaggttcaggacctgccggggactcagggcctgctggaagttcaggacctgctggggatcagggcctgccagggatttagggtctgctgggcgggccaccttttggcctctccctcatgcttgaggccatcagtgtttcctactaatttcccattttaagcctgagaagtgacaagagagggtaaagacccagcctctgctctgtcccatgagaaatactgagggacgtgcccccatcaggcctatgcggtcatttgctgggcttcgttatacgccaaggcctgtaggcctgagaagagggagagacttcagggggcggagcggagaggaaaagcttctagtaagaatcttttcagattttcaccaggcgcggtggcttttcaccgggcacggtggctcacacctgtaatcccagcactttgggaggccaaggtgggtggatcacgaatgaggtcaggagtttgagaccagcctgaccaacatggtgaaaccttgtctctactaaaatacaaaaattagccaggtgtggtggcgtgcgcctgtaatcccagctactcaggaggctgaggcaggagaatcgcttgaacacgggaggcggaggttgcagtgagtcgagattgtgccattgcactccagcctgggcaacagagcgagactccgtctcaaaaaaaaaaaaaaaagaaaagaaaaaagaattagctattaggttggaatggagcaattcccacagtaataaaaatatttaaaaataaataatacaaacataagctattaggcatgagatatcaaggcccataaccatatgcatctcctttgatttgcaacttcaatgactggaatatagcctgaaggacccatcagaaatacaaagaaagcgttccttccataaatattcatcactgctttatctctaagaggggaaaatcagatgtaaacttaatgcccaataaattatggaacaccccaatcaaggagtaacaggtatctgttacaaatgtttttgtagaatatttgatatgaaaaatgcttagcctttaaagtaaaagcagtatacaaactaatatatcatcaatataagcccaatttttggaatttatgtacatagatagatactcagatacatttacttataaatataaaaaaagaaaggaaaaactggagcgtggtgttgcatgcctgtagtcccagctactcgggaggccaaggtgggaggatcgcttgagccacaagtttgaagctagcctggaaaatgggttgagcaggcctttccaggattggaatcaccaggctggagtgtactggtgccatcacagctcactgcagcctccacctcctgggctgaagtgatcctcgcatctcagtctcccgagtagctgggactacaggtgcacatcaccattcctgactaatttttgtatttcttgtagagatggggtctcactatgttacccaggctggtctcaatctcctgggctcaagtgattctcctgccttggtcccaaagtgctgggattataggcatgagctaccacacccagcctggctctcagttttgtaagtcgaaaaacttggacaggccaaattgaagagtcatgttcgccaatttcataagcgattaatttggcaatgtagcaagataccatcttattaaaaacaaaatggccgggcgcggtggctcacgcgtataatcccagcacttctggaggctgaggtgggtggatcacaaggtcaagagatcgagaccatcctggccaagatagtgaaaccctgtctctactaaaaatacaaaaattagctgggcgtggcggcacatgcctgtagtcccagctacttgggaggctgaggcaggagaattgcttgaacccgggaggtggaggttgcagtgagccaagattgcaccactgcactccagcctggcgacagagtgagactcaaaaaaaaaaaaaacaggccgggcgcagtggctcacacctgtaatcctagcacttttggaggttgaggtgggcagaccacgaggtcaggagatcgagaccatcctggctaacatggtgaaacctcgtctctactaaaaatacaaaaacaaaattagctaggtgtggtggcaggtgcctgtagtcccagctactcaggaggctgaggcggaagaatggcgtgaacccagtgggtggagcttgcagtgagccaagatcgcaccactgcactccagcctgggcgacagagcgagactccgtctcaggaaaaaaaaaaaaagaaaaaacaaacaaacagggaaatatacactgaagtgaaaatgatttactgtgaatactaattatagtttaaccagaaaacataaacacaagtgatgtttaaggaagaggcaaatgggttgagctagcctttccaggattggaaaagaggaggctcagggcaagcctgccagctgtggagcaggtgagaaaaggcaaacgggactcattcagggccacagtgccaagcctgagactggagaggccgaggacacaacctgtgttcctgaatagctcactggaatcaactaaacgtgtttacttgtttagtgtggaaactttccaatctatgcaaagaataggtataatggtagaatgaggccaggagtggtggctcatgcctgtaatcccagcattttgggaggccgagatgggcagatcacttgaggtcaggagttcgagaccagcctggtcaacatggtgaaaccccatctctactaaaaatgcaaaaattggccaggctggtggcatgtgtctgtggtcccagctgcttgggaggctgagacaagagttgcctgaacccgggaggtggaggttgcagtgagctgagatcgcgccactgtactccagcctgggcaacagagcaagactctgtctcaaaaaacaaacaaacagaccgggcatggtggctcacgcctgtaatcccagcactttgggaggccgaggtgggcgaatcacaaggtcagaagatccagaccatcctggctacggtgaaaccccatctctactaaaaatacaaaaaattagccaggcgtggtggcgagtgcctgtaatcccagctacttgggaggctgaggcaggagaatggtgtgaactcgggaggcggagcttgcagtgagccgagatggtgccactgcactccagcgtgggagacagagcgagactctgtctcaaaaacaaaacaaaacaaaacggaaaaaaaaaaacagtagaatgagcctctgtatccccaccataaagctatgacaaagatcagctcacagccagtcttgtttactgtataccccacccacttcccagtgggtacacttcatccactgcccgagcagagtccacaacagcaggaggtggccatgtgggtggacagcctgtgctgggctttgagttatgacatcggataaaaggtccaacttcagttggtgagtcttaaatcttggcacatgactagtgttaaggaggcgatgtccaggatggccacgtgacagggtggtatctaagctgatatacctgaaggatgagtggaagtagagatggtgaggggaggaagagaagaacgtactaaacaaagagcatagcttctggaaaagctgtgatggcgagaaatatggctcttccaggaactgcaggaaggttgctggtggtggaagatgtagtggttagtggggagagagcaaggccagaatgcacaggcccttgttggccatgatgtggggtttgatgtctttgataatggagtttgatctcagctatgggagcattttaagtagaagaattaggtggctcaatttttttttttttttttctgagccagagtcttgctctgttgctcaggctggagtgcagtgctgtgatcttggctcactgcaacctccgcctcccgggctcaagcgattctcatgcctcagccacttgactagctgggattacaggcgcctgccaccacacctggctaattttttgtatttgtagagatgaggtttcaccctgttggccaggctgatctcgaactcctggcctcaagtaatctgcctgcctcggcctcccaaagttctgggattacaggtgtgaaccactgtgcctggcccactcaatttgtatttttaaaagattgctctgcttaatctatagagacagaaacttattactggtcatctagggcatggggaatgggtagtggctgctcatgggtgcaagattgcttttggagatgatgcagatgttctaaaactggagtatggtgatgattgcacaacttaaaatattctaaaagcaattacacttgattgtgcataaatcatatctcaagaaagttgtttaaaaatttaagaaagcggccaggcgcggtggctcacgcctgtaatcccagcactttgggacactgaggcaggtgaatcacctgaggtcaggagttcgagaccagcctgaccaacaaggtgaaatcccttctctactaaaaacacaaaaattagcaaggcttggttgcaggtgcctgtagtcccacctactcgggaggctgagacaggagaattgcttgaacctgggaggcagaggttgcagtgagccgagattgcgccactgcactccagcctgggcaacagagtaagactccgtctcaaaaaaaaaaatttaagaaacctcactctgcttgccctagggagaatggaccatccagtatgaggagggatgagggagctgtcaggagactgctccaaggagaaagatggtggtttggattggagtggtgcagtgcaggtggagaaaagagggtatatgtgacaggaagccaggagtaggattggcgactctggatatagagaggaaaagcaaaactaggaatcaaagatggcacccaggtttccaaggaggggttgagtggtgacgccagtcctgtgatagggaacactgaatgaagtactgtggttctctttagggttgtgtttggggtacctgtccaaacccaagaggtgatgtggagaacacatctagggagatgggcttggagctccaggggcaagacccagatttgaaatagaaattctgacatcattggcctataactcttcatcaaaatcatagttacaggccacgtgccatggctcacgcctgtaatcttagcactttgggaggcccagacaggcggaacgcttgagcccaggagttcaagacaagcctgggcaacatagtgacaccccatctctaataaaaatacaaaaagttagctgggtgttatggtgcatgcctgtagtcccagctacttgggaggctgaggtgggaggatcgcttgagccaggaggtcaaggcagtagtgagctgtaattgcacccctgtactccagtctggggagaaaaaaagaaaagccctttctgctcacacttagtcagctcctagctgaggggacctacagatcacagggaagcaggaagatctaacggcttctctgtcccccttacaggtcacagtcaaagtgcctcagaagaactcataagaatcatgcaagcttcctccctcagccattgatggaaagttcagcaagatcagcaacaaaaccaagaaaaatgatccttgcgtgctgaatatctgaaaagagaaatttttcctacaaaatctcttgggtcaagaaagttctagaatttgaattgataaacatggtgggttggctgagggtaagagtatatgaggaaccttttaaacgacaacaatactgctagctttcaggatgatttttaaaaaatagattcaaatgtgttatcctctctctgaaacgcttcctataactcgagtttataggggaagaaaaagctattgtttacaattatatcaccattaaggcaactgctacaccctgctttgtattctgggctaagattcattaaaaactagctgctcttaacttac

SEQ ID NO: 1971 - DNA, 43100 bp, Homo sapiens; identical to SEQ ID NO: 1970

SEQ ID NO: 1972 - DNA, 3135 bp, Homo sapiens
taaacggtcaacacaagtttatttattctcacataacaatactgagtggatatttaggtcagtaaggcacagttctcctccacttaggaatctcccatcttcaggccttgccttctccagagcctggtcaccatctgcttccagttggcagaaggagtaacagcacaggggagcacctgttggaggtctgtatgggccaggcctggaaactgcacacctcttctggtcactttccgctggggagagcataggcacagagccacacttaaattttactttgaggaatgcagtgtaggtgtatgtccgacaaagaaaacaataattcggtagacaaataagtctccactccaatattcaattacttacttaacttatgctctggtatgtctcaaattaacctagatagaaatgaactctgaatcttccacttccatcaagtttttcactcactcaatggcatcattatccatccagttgcttaagcatacatttgaaagttatccttggtctgtttcttatccttcccttccacatctaatccttcaggaagtcctgacaatgttacctccaaaatatgtcttaaatccatcttctcagccaggcacggtggctcacgcctgtaatcccagtactttgggaggccaagggaggtgaatcacttgaactcaggggttggagagcagccggggcaatgtggagagacccaatctctacaaaaaaaatacgaaaaattagccaggcatggtggcatgcgcctatagtcccagctactcaggatgctgaggtgggaggatcgcctgagcccaggaggtctaggttgcagtgagctgtgatcacgccactgcactctagacagtgggaccgtttaaaaaaaaaaatccatcttctctacacctttaccgccacctccttagttcagacagtgtaataatctctcatctgcattattctccaatagcctcctaatagctctgtttccattcttgctttcctatattctattctctacaaagcagagtgatcttttaaaacaaatttgttcacatcactctttactttaaaaccttacaatagcttagaataaaatccaaagtcctgattatgacccccaaaggccacatatgatgcagcccctgcccacatctccaacctcatcctttttatacttttttttttctttttttgaaatagagacggggtttcgccatgttggccaggccggtctcgaactcctgacttcaagtgatccgcccgccttggcctcccgaagtgctgggattacaggcgtgacccaccgcgcccagcctccaacctcaccctttatcagtctcctcctactcgatctactccagctacaatgaccttcttgctgattcttgaacatatttagcttatttccaccttaaaatttctacccatctgcccagaaatctttccttggatttccaatagccagccctttctcattcctcaggggtctcagcttaaatgttacctcctgagattccttccttaatcatctaatacgaagaagtccccacatccagttattctcttacctcagcatcctgtttatgttcttcttagcatcagactcgggctttttcctgtttattacctacttcgttttcctgaaagatccatgtgccggtaccatgtgttgttcctactgtttctccaatgtctagtagatttggcacatactgatgtgcaattaatacgtgaatgaagaaccattgacagacgattagtcaaaagctcttgcaaagccctttgataggttatcggtggagagtagggagcacaaacctggggtcccattctagcttgaccacttctcggctgtgcacaaactagtctagctctcctgagcctcagttacctattttgcaaattagggatgggaacatccatacctcacgacgccaaacggctaccttgtaaagacgaaaggaggaaatgcaggaaataactccacgtaaggttaatgctccgtaaacagagctgctactgctattatatattctatacaatcctgcgcccttaacggcaggaccctttcagtgcttcagtcctgtcttctctctcctgggttgacctccacagatcctctcagaagagcgttttccaggcgtgaatctccgcagagtggagataaaggctgaggccccaacgcacgcgcactcacgcgagtccgggcctatgacgtcattagcgcagcgccatcgccgcggaaggcccaggggcctgtcctgtatgcggcgtgtcttagggaggcccaggcggacgcctgcaagtcgggtgcgcggttcgggggcggctcggaaaccccagcggaaggcagcaaggggcgcgtggggccgtggagtcacgaagctgggcggcaggaggggcggcctggagctcccgcggggcacagcgcgtgcgtgagggcggccggcggggctgcccggcgcgggtgtcccggcgatgtgtggcgctgaggcggcggcgggagcagcggcgccgagctctgcttcggcttcggcttcggcttcgcggcggtgcaggcggcggaggcggaggcgcaggctcttctttaggacctggcgagcccaggtctaagcggcggccccgcgaggcccttgcacggcgccccgggtcgaggccctccccgcctcgccctaccccaggagcctgcctccccagctggggatgaggctaggaggcggccgcgtggggcccagcacaaagacctgtccccaggggccgccgcctccgccgctgctgctgccgccagcctagagccgcccgccgaagcagagccggcgccggggtcctcatccccaccggtcccgaggggcggctgctgcccgtcgccacgaggcccaggggcccgagtgccgagccctttgctccctcggccgcgcggggacagggctgctgagcagcctccgcctctcccggctgtgggggccccactgagtatgtcggaggagagcgacatggacaaagccatcaaggtaagggggaggtgccccctcttcccccgcgttgtcctgtggcgttcttctcggctctagcctcaaaaagcagggagattttgcagtgagaggttccatcgactaccgggtttcggcctcccccggattccgt

SEQ ID NO: 1973 - DNA, 50951 bp, Homo sapiens
ggcggccgcgtggggcccagcacaaagacctgtccccaggggccgccgcctccgccgctgctgctgccgccagcctagagccgcccgccgaagcagagccggcgccggggtcctcatccccaccggtcccgaggggcggctgctgcccgtcgccacgaggcccaggggcccgagtgccgagccctttgctccctcggccgcgcggggacagggctgctgagcagcctccgcctctcccggctgtgggggccccactgagtatgtcggaggagagcgacatggacaaagccatcaaggtaagggggaggtgccccctcttcccccgcgttgtcctgtggcgttcttctcggctctagcctcaaaaagcagggagattttgcagtgagaggttccatcgactaccgggtttcggcctcccccggattccgtggatcgcgctttacagccctggggccaagggttatgggtgtgggtgtaggtgtgtgtccgactcccgccagcttccctggtgagtgtgatttgtgctcagctggaacagaggtgagtggcctggagacactattaagtgtcaatgaatgggacgaagagagccctactactactactacacgtttcgatcactccccaaggccgccagcatttgcttccggatggtctacagaacttggagagttggaatttatccatccctcccgatttgtttgaaatcagccttctggaaatctgcagttggaaaaaggtggttcgccgtacaaaacctgtcctttggggaataggttgtcctcacttttccgtgtattctcccctttttctttttcctcttctttctcctaggaagcattgagtttacttaggaaaagttaacagttcctgtgacttaactgcacttaaaccaaaagaaaagcaaatgtgtgttcgaaaattacacaaataaaataagttttctaaaacctgtttttaactttttttttttttaaaggcacattttgcccactcagggccagttatctgtcttgacagctgtagctaagaaattagtcttatgaaaattaaacattgacgcttaaagtttgatgtattatttacttatttgtagtgttaagtcagcccagtgcattgaataatttcattttatcttgaaggacaggcatctattggcagcttggggttattttccccttcaagacagttactagtaatgattaagaatttacatttctaccaattctttaggtggtgtatatagtttctcaaaatcatcaagtcattccaaagaaacttaaccctttaaaggaggcatcaacatataacatatacattaaggaagaccaggttttttgtctgtttgtttgtttttgagacggagtctcactctgtcgcccaggctggagtgcagtggcccgatcttggctcactgcaagttccgcctcctgggttcacgccattctcctgcctcagcctcccgagtagctgggattacaggcgcccacccaccacgccctgctaattttttcttttgtttgtatttttagtagagacggggtttcaccgtaatagccaggatgggctcgatctcctgacctcgtgatctgcccgccttggcctcccaaaatggtgggattacaggcgtgagccaccgtgcctggcccaaggaagacgaggttttaaatcataaagattctaaaagactgccttgacatatccttcttttgttttgggttttgtttttttttttgagtcggagtctggctttgtcatccaggctggagtgcagtgggatgctcttggctcactgcaacctccacctcccaggttcaagtgattctcctgcctcagcctccccagtagctgggactacaggcacgtgccaccacacccagctaatttttttgtatttttagtagaggtggggtttcactgtgttagccaggatggtctccatctcctgacgtcatgatttgcccgcctcggcctcccaaagttctgagataacaggtgtgagccaccgcgcccagccttggtttgggttttattggcacagaggcatgatatgccgcctgaagttatttaattgggttgtgaatcaaagcgtatgtggccagtttttaaacattgtctcctgtgtgccagatggtgtcctagacacaaatggtacaagccagactcctagatgtccctactgtcatgtagcttatattctagagggtggggttactgctaggtggttttaattaagtgtggaaagggtgaggagtactgtgttaaatagggtagtccgaggaggtgacactgtagagttctgatggaaatgcgagagcaagccaccactgtctcagggaagagtataacaggcagtgggaatagcaaggacagaccttgaggtagaagcaggtgtagtgtgatgtaggaagagcaaggtggctggaatgcagtgggtcagtggagatgatgtagagcagcaatgggaagcaaggcacttagggccttgtaggccatcgtaagaactttgggtttgaccctgattaaaaggggaactataggagagttttgaacagaagagagacatagttccaggagataagtatacaaatagggcagcaatgtcacttagtggttgttatagcttctctaggtagactcagttgaaatctcaccctatgtttttttttgatacagagtctcactctgtcacccaggctggagtgcagtggtgtgatctcggctcactgcagccgcctcctcccaggttcaagcaattcttgtgccttggccctccgagtagctgggactacaggcgcacaccaccacgcccggctatttttgttgttattgctattttgttgttattgttgttatattgctagaaaagatggggtttcaccatgttggccaggctggtctcgaactcctgacctcaggttatctgtccgccttggcctcccaaagtgttgggactacaggcatgagctaccacgcccagcccagcgtttctattttattagccgtgtgtctgagtacgacatcacttcacttctgtctcgttagtttcctcatctgtagatgggataaaagcactcccagcttatagggttttttgttggtttgtttgttagtttttgaggattaaatgagcagatatacccaaatgtgcttataataatacctaggccaggcacggtggctcacacctgtaatcccagcactttgggaagcctaggcgggcggatcacctgaggtcaggagttggagaccactctggccaacatggcgagacccccgtctctactaaaaatacaaaaattagccgagtgtggtggcacacatctgtaatcccagctactcagaaggctgaggcaggagaatcgcttgaacctggggggcagaggttgcagtgagctgagatcatgccactgcactccagcctgggcgacagagttagactccttctcaaaaaaataataatacctaacagcaagagctcaatgaatattagctcatagcaacttaagggtgctttagaaagagttgtttttttcacttgactcttgcccagcccaattttcttaaaatttttttagcttttcttcactcagaagtactcaataggtcatggtgaatctacgctaatttgggcatttccagccaatacctattggtggacttgaaaatcagtactgattaggatgtactgctttggaagcaagccagcattacatcaaataaaaaacatttggtctgtggcattgtgttgtattcattgttttgctttttggggggtgttcagcagatggtgagcactgagacaaacctgtagtgttcagctggaaagctattttcctggcctccagccacaacactttaactcttgctgccagactacctgagagtgggttgattggactttaagatctcatcctcccttatccacggttttgctttccacaattttagttacatatggtcaactgcagtctgaaaatattaagtggaaaattccagaaatcaataattcataagtttctttttctttttttttttttttgagacggtcttgctctgatgcccaggctggagtgcagtggcgtgatcttggctcactgcagcctctgcctcctgggttcaagcaattcttctgcctcagcctcccgagtagtagctgggattacaggtgtgcaccaccatgcctggctaatttttgtatttttagtagagacggggtttcaccatgttggccaggctgatctcgaactcctgacctcatgatccaccctcctcggcctcccaaagtgctagagttacaggtgtgagtcaccatgcctggctctcataagtttcaaattaagcactattctttgtagtgtaatgaaatctcttgccatattgcctgggacatgaatcatcccagcatgttcacactgtatatgcttcctatcctgtagttacttagtagtcatcttggttatcagaacaaacagtatgtatagggctcactactatccaagatttcaggcatccactggaggtcttggaacatatcctcccttatctgtggggactactgtactcttaaaaactttaggataaggggctgggcgtggtggcttacgcttgtaatcccaacactttgggaggctgaggtgggtagatcatttgaggtcaggagtttgagaccagcctggccaacattgtgaaacccccatctctactaaaaaaaacaaaaaaaaattagctgggtgtggtggcaggtgtctgtagtcccagctactcgggaggctgaggcaggagaatcacttgaacacgggaggtggaagttgtagtgagctgagattgctccactgtactccagcctgggcgacagggtgagactctgcaaaaaaaaaaaaaaaaatttaggataaggtcaaatggctgtaagtggaggctctatcttctattccctgtatcttctattacctgtatctctagtcccatagccccatgactttgctacacccaaggcacttagctaaatctggagagtgggcattttgggattagggattcttacatattgttttctattatgtatagcgagtcgttaatatttgatggagtttgtgaaaatccatttccttagtttttaaaattaaaaaaaattgtatagtttgtacatcataaaaatacccccaatataaatgtacagttcagtacattcagtgtaaatgttcagtaatttttagtaaatttatagaggcatgcagccatcatcacactctggtgtataatatttccatccctgctagaaagttccttctgcctggttgcagtcagccctgttcccattcctcgccccttacggccactgatttgctttgtcactatagtttttgccttctccagaaattatttccttaatagcttaccaattttatgtgtttgatttcttagcaaatttctcaggttcatccacgttagtgcatgctttagcagttcattctttttattgagcagtagtctttattgcttatccattctcagttataggacatttagattatttctagtttttagctgttgtgaataaagtgataaaactgtacaagttttgtgtgaatatatgtattcatttcttcagtgtagatagctagatgtggaataactgggcagtatagtaaatttatgtttaactttttaagaaaccaccgaactgttttccaaagtggttgtaccattatacattcccactggcagtgtttgaaagtcctgtttttttctaccatcttcacaaatattaggtattttcagtcttcctattttagtccttctggtgggtgtgtagtggtattatgcttttaatttgcatttccctaacgactaatgctgttggacatctttttgtgtgcagatttgacattcatgtttcttttctggtgaagggtctgttccaatcttttgccccatttttttttttttttttttgagatggagtcttgctcagtcgcccaggctggagcacagtggcacgatctcggctcactgcaaccaccgtctcccgggttcaagtgattctcccgtctcagcctcccgagtagctgggattacaggcacctgccatcatgcccagctaatttttgtattttagtagagatggggtttcaccatgttggccaggctggtcttgaactcctgacctcaggtgattgcccaccttggcctccaaaatgctaggattataggcatgagccactgtgctcggcctctttttgcccgttttagaattgcttttttttgttttgagatggagtctcgctttgtcactcaggctggaatgcagtggtacgaccttggctcactgcaacctcttcctccggggttcaagcgattctcctgcctcagcctcctaagtagctgggattacaggcatgcgccaccatgcccagctaattttttgtatttgtatttttatttttttatttattttttgtatttttagtagagatgaggtcttcaccatgttgaccaggtggtctcgtacttctgacctcaagtgatccgcctgccttggcctcccaaagtgctgggattacagatgtgaaccaccatgcccagcctaaaattgatttctttgccttattgagttataggattatttatttatttttttattaatttttttagagatggggtctcacaatgttgcccaggctggtcttgaactcctgggctcaagcgatctgcctgcctcagcctcctgaagtgctaggattactgcacctggccaagagttcttttttttttctttcttttttttttttctgagacaaagtcttgctgctcttgttgcctaggctggagtgcaatggcacgatcttggctcactgcaacctccacctcccgggttcaagtgattctcctgcctcagcctcccaagtagctgggattatgggcatccaccaccatgcctagctaatttttgtatttttagtagagactaaaaattttagttttgccatgttggccaggcttgtcttaaactcctgaccttgtgatctgcctgcctcggcctcccaaagtgctgggattgcaggcgtcagccaccgcacctggcctagagttctttataaactgaataaaagtcatttatcagctatgtgattggcaaatattttctcccagtctgtggcttatcttttcattttataatggtgtcttttgaagagcaaaaggttttaaattttatgaagtccagtttagcacatttttttctttttcttttattttgttaggacagtctcactccatcacccaggctggagtgtagtgatgcgatcacagttcgctgcagccatgtccttctaggcttaagtgattctccctcctcagcctcctgagtagctgggaccacaggtgtctaccaccatgtttggctaattaaaataacttttttttttgtagagacacgggtcccactgtgtagcccaggctggtctccagctcttgagctcaagcagtcgtcacactttggccttccaaagtgctagaattataggcatgaaccaccacgactggttgtgaaatatccttttttttttcatagatggagacttgctctgttgaccaggctggagtgtagtggcgtgatcttggctcactgcaacctctgcctcccaggttcaagcagttctcctgccttagcctcccaagtagctgggattacaggtgggtgccaccatgcccgcctaatttttgtctttttaatagagacggggtttcaccatgttggccaggctggtctcgaactcctgaccttgtgatctgcctgcatcggcctcccaaagtgctgggattacaggcatgagcaactgtgcctggccaaaatacctttttatttcatattgaagatgcagcttttacgtgggtgcgagagtgctataagaaaggcataactatagactctaatatttttcgagaaaaagtcattgtgtcttaaaaggaaggtaaaggatctaaagttggagaatttaatgccagcaaaggatggtttgataactgtagagaggtttggcttaaaaaaatgtcagggtaacaggagaagcagcttctgctgaccaagaggcggcaaacaagttcccagatgccattaagaaaatcattgaggagaaaggatatctgcttgaatgggtttttaatgcagacaaaaatgccctgttctggggaaaacaatgccacaaaggacatttatgagtaaggaagagcagtgagtgccaggatttaaggcaggaagagctaggttaactgccgttttgtgtaaacacagtcaagtttatgatcaggactaccctggtctataaagctgctaacctctgagccttcaagggagaagataaaacaccagctgccagtctgtttttaccaaaagaaagcctggataatgagaacccattttcttttttttttttttttttgagaggagtctcgctctgtggcccaggctggagtgcagtggcacgatcgcggctcactgcaagctctgcctcctgggttcacaccattctcctgcctcagcctcccgagtagctgggattatagttgcctgccaccacgcccagctaatttttgtattttagtagagacagggtttcagcatgttggccaggctggtcttgaactcctaacctcaagtgatccgcctgcctcggcctcccaaagtgctgggattacaggcatgagccaccgtgcccggccaggactgccttttaaagtttttttgacacaatgcccctggccactgagaatcccatgagttcaacactaggctttgaagtggtctacttgtccacaaacagtgtctctaatccagcctgtagatcaggaggtctcaaggactttttgagaaagagtctggctctgttgtccaggttggagtgcagtggggtgatctcagctcacttcaacctctgcctcccaggttcaagcaattctcatgcctcagcctctcgagaagctggaattacaggcatgctccacaatgcctggctaatttttgtatttttaggagagatgaggtttcaccattttgcccaggttggtctcgaactcctggcctcaagtgatctgcctgcctcagcctcccaaagtgctgggattacaggcttcagctgccgcacctggtccaggactttcaagactcattacatgggatactctggaaaagattgttaacaccaaggaagagaatcctgatagaatgtagtgaaagtctagagggattacaccactgaagatgccattgttatggaaaaagctgtggaagccatcaggcctgaaacaataaattcctggtggagaaaactctgtccagatgtgcgtgacttcataggatttatgacagagctggttaaggaaatcatgaaagagattgtggatatggcaaaaaaggtgaagggtgaagagttttaaggtacagatcttggagaaattcaagagctaatagacaccacacctgaggaattaatagaagatgacttgatggagatgagtgcttctgtgccagacagtaaggaataagatgtacaagaaacaggggcaggaaaaaattgacattagacaatttgccagaagggttccaattattcaagacttcctttagctttgtttatggaatatggaatggaaccttctgtgatactggcactgaagtgaaagcaaatggtggaagaaggattagtattgtatagaaatgtttttagagaaatggaaaagcaaaaaagtcagacagaaatgaggatgtatttttgtaatgttacaccagatgtgcctgcctctcctgccttcctttccatgcccttcacctcttctacctctgctgccccaagacagcaagaccaaccaactccttttctttctttccctcagtctactcatcctgaagatgggtgaagacctttatgatgatgcacctccacttaatgaatagcaaatatgttttctcttatgattttcttaataacattttttctctatcttactctattgtaacaatatagtatgtaatacataaaatatgtgttaattgactttctgttgtcagtatggttaacaggctattagtagttaaattttgggggagtcagaagttatgtgcagatttttgactgcccagggtgtcagtgcccttaaccttcacgttgttcaagggtcaagtatattatcttatctattaacgtagtagagctttccatttctttagggcttcttcagtttctctaagcagtgttttctagtttccagtgtataaatctataaatcttgccttttgataaatttattctttttttttgagacagagtctcactctgtctcgcaggcttaagtgcagtagtgcaatctcggctgacggcaacctctgcctcccaggttcaagcaattctcctgcctcagcctcctgagtagctgggattacaggcttgcttcaccatgcctggctaatttttgtattttcaatagagacagggtttcaccatgttggccaggctgatcttgaactcctggcctcaggcaatccacctgccttggcctcccaaagtgttgggattacaggcatgagccactgtgtccagcctgataaatgtattcctgttttcttcttcacgcctgtaatcccagcactttgggaggctgaggtgggcggatcacgaggtcaggggatcgagtccatcctggctaacacagtgaaaccccctctctactaaaaaaaaaaaatacaaaaaactagccaggcgtggtggcaagcgcctgtagtccctgctgcttgggaggctgaggcagaagaatggcgcgaacctgggaggtggagcttatggtgagccaagatggcgccactgcactccagcctgggtgacagagcgaaacttcgtctcaaaaaaaaaaagaatggaattgttttcttcatttcatttttggattgtttgtcactagtgtatggaaatacagttgatttctgtatgttgattttgtattttgtatccttagtacatttgcatactagttcttatagatcccttaggattttctacatataaaacaaaatttttttgttttgagatggagtctctctctgttgcccaggctggagtgcagtggtgtgatcttagcttactgcaacctccgcctcccgggttcaggcaattctcctatctcagcctcctgagtagctgggatgacaggtgcctgccaccacacctggctaatttttatctgtttagtagagatggggtttcatcttgttggtcaggctggtctcgaactcctgacctcaggtgatccacccgccttggcctcccaaagtgctgggattacaggcttaagccactacgcccggcctggctgacagttttatcaggaatgggtgttgagtttttgttaaatattttcccttcatctattgagttaattatgtggtttttgttctttattcttaatatagtatatggtaatattacgttattttcagatattaagccaatcttgcattcctggtataaaccccactcagacccacttagtctggtgtagaatcattcttacatgttgctagtttcagtttgttaatattttgttgaggattgtttaatctatattcatgatagatactttcttgtgatgcctttttcgagttttggtatgaatgtaatgctagctttatagaacaagttagaaagtataccctcctctatgggatcattactatgaacatagtaaagattttcttttctttttctttttctttttcttttttttttttgagatggagtctcattctgttgccaggctggagtggagtgcagtggcatgatctcagctcactgcaacctccgcctccctggttcaactgattattttgtctcagcctcccaagtagctgggacttgaggcgtgcgccaccacgcccagctaatttttgtatttttagtggagatggggtttcaccatgttggccagatggtcttgatctcttgacctcgtgatccacctgcctcggcctcccaaagtgctgggattacaggcatgagccaccgtgctcggccagtaatgattttcaatatgaaataaaagggtattttacagccaggtgtggtggctcacatctgtaatcccagtactttgggaggccaaagtttggaatacattatttcgttaaatatgtggttctcagtggaatgggcagggattttacctcttgggagacatttggtaacatctggagacatttttggttatcacagttggtagcgggtgcttctggcacctagtgggtagacggcaggaatgctgctgaacatcctaaaaggccaaggcaaccccacaacagagaactatctggctcaaaatgtcagtggtgctgaggttgagaaacccaacaaatgtgtagtatttaccactgaaaccaatgtgcctagactttgtttcatgggaagatactcagttattaattcagttttttttacttgttacaggtctattcaggttttctttttcttcttgagtgagttttggtaatttctttctagaaatttgtccattttatctagtgctttaatttgttggcataaagtcgttcatggttttcccttttaatactttgatttctgtaaagtcaattgtgatgttccctctttcctttctaatattaataatttgtgtcctgccctttttgtattggtcaattcagctaaaggtttgttaactttgttgatcttttcaaataatcaacttttggttttcattgattttctctatttttctgtattctgttttatagctctctgctcaaatctttattattttcttctttctgcttgctttgagtatagtctgctctttttctacattttaaaggtagaaggttaggttagtgattgtgatcttttctaaggtaggcatttacagctataaatttctgtttcagcaccacttcaacttcatctcattatttttggcaaattgtgtttgcattttcattgagataaaatattttctaatatctcatgttaaatcttctttgacctcctggttatttataagtgtgttgtttaggccaggtgcagtggctcacgcctgtaatcctcgcactttgggaggccaaggcaggcggatcacgaggtcaggagttcgagaccagcctggccaatatggtgaacccccatctctactaaaattacaaaaattagctgggcatggtggtgtgcacctgtagtcccagctacttgggaagctgaggcagaagaatcgcttgaacctgggaggcagagattgcagtgagccaagattgcgccactgtactccagcctggtgacaaagtgagactccatctcaagaaaaaaaaatgcgttgtttaatttcttttttttttttttttcttgagatggagtttcgctcttgttgcccaggctggagtgcaatggcgtgatcttggttcaccgcaacctctgcctcccaggttcaagcgattatcctgcctcagcctcccgagtagctgggattacaggcatacaccaccatgcctggctaattttgtacttttagtagagactgggtttctccatgttgatcaggctggtctcgaactcctgacctcaggcgatctgcccaccttggcctcccaaagtgctgggattacaggcgtgagccactgtgtccagtcgtgttgtttaatttctgaatatgtatggatttcccaactttcccttctgttcatttctggcttaattccatggtggttggagaacttcatataatttattttcaattcatttagttttttttatgatctagaatatggcctatcataagccatttcagattaagactaactttaaattaatactaatagtttcagtaaaatatagaaaatgctccagtttagctccattgtctccctcttctttttttttctttcttttttttttttttgagacggagtctcactctgtctacccaggctggtgtgcagtagcatgatctcggctcactgcaacctccacctcctgggttcaagtgattctcccatcccagcgtcctgagtagctggaattacaagtgtgcaccaccatgcctgtctaatttttgtatttttagtagagatggggtttcaccattttggccaggctggtctcaaactcctgacctcaggtgatccacctgccttggcctcccaaaatgccagggttacaggtgtgagccactgtgctcagccttctccctcttcttttgtgttactgttgtctatgtattatatatgtatatattacaaaccagaaaatacagtgttgtagttatttgtttatgcagttaaatcttatgtgttttaaataagagagaaaggaataaaatatatttacagccttttatgttaacctacagtatatttaccatttttgttattcttcattttttccctcttgatccaagttactatctgatgtaaattctctgttgattttctggatatgtatttttgaaatgcttttatgaggattataatatgcatctttaatttatcacagtccactttgggttaaaattgactaaagtctggtaatatacagcacctttgctccaaggtagctctatttcctcctttctcccttgtgttcttattgtcatgtatatctttatatgttataacctatcttatgtatatttatgaaattaagagaagaaaataattttttccatgtttacctgttctagtactttctgttccttcttgtggatccaagttttcttttttcttttttttttttttgagatggagcctcgctcccgttgcttaggctagagtgcagtggtatgatctcggctcactgcaacctccacctcccgggttcaagcaattctccttcctcaccctccgtagtagctgggaatacaggtgtgtgccaccatgcctggctattttggggttttattttgtatttttagtagagacgaggtttcgccatgttggccaggctggtcttgaactcctgacctcaggtgatccctcccatcttggcctaccaaagtgctaggattacagacgtgagccaccgtgcccggcctgatccaagttctcatacagtagcattgccattctctccaaaggacttcctttggtagttcttgtaggccaagtctactagcagtgaattctttcagtgtttatttatttgataatgcctttatttcactgttaatttttgagggatagttttgttcaatatagaatttatgcttgacagttgttttttcagtactttcattatgtgattctactgtcttctggcttgcattgtttctgatgaaaagtcagccattatttatattgctgtccatgatttgtcattttttcccttcgtacttacattattttctctttctctttcagtgtttttttttgtgtgtgtgtgtttgtgtgtgtgtgtgagacagggtcttgctctgttgcctaggctggagtgcagtggcatgatctcagcttactgcaacctcaatctcctgggctcaagcaaccctcctacctcagcctacccagtagctgggaccacaggcacaggcatgcaccactacaccaggctaaattttgtattttttgtagagacggagttttgccatgttgcccaggctggtcttgaactcctgacttcaagtgatcctcaccctgcagcctcccaaagtgctgggattacaggcgtgagcaactgcacctggtcttgtctttcagtgttttgactgtggtatgtctaggtgtggttctttttgtgtttatcttatttagagtttgttgagcttcttggaggccataggttattactgttcatcaagttggggaaggttttgcctattatttcttcaaatattcccacctcccccatcttcacccctctttggctctcccattacacatatgttggaacgcttgacattattctacaggtctcatttttctttaatcttttttctgtctattctttggatttgatcatttctttctatgtattttcatgttcactaattattctgtcacctgaaaatctgttgagcacctctttttttttttttttttttccaaaacggagtcttgctctgtcacccaggctggagtgcagtggtgcgatcgcagctcactgcaacctccgcctcctgggttcaagcaattctcctgccccagcctcctgagtagctgggattacagcacctgccactgtgcctggctaatttttgtatttttagtagagacggggtttcactgtgttggccgggctggtctcgagctcctgacctcatgatccgcccgccttggcctcctaaagtgctgggattacaggcgtgagccaccgtgctcagcctgttgagcacctctgatcagtttttcatgccagtcattataatttttaactctagaatttccatgtggttcctcttcattttttctgtttctcggctgaaaatctctatttatcattattttttacttcgtcatcagttttctttaattctttggacgtttaaaatagttgcttttaagtgcaactacttgctcaatctagtatctgcatccaatcagagatggatgctattgatttctctttttcctgagcttaggtgacactttcctggtttttacaagtctagtaattttggttgaaaactggacatttagataatatagcaactctggattctgagttttcccccctgtggcttgttatatttacagttaattgcttagaattaaaccagaatctatttttcctttggtgtgctaatgtctctgcttagttttaaattattattagttttttcgagacggagtctcactctgtcaccaggctggagtgcagtggcatgatctcagctcattgcaacctccgcttcccaggttcaagcgattctcctgcctcagcctcccgagtagctgggattacaggcacccgccaccacgcccagctaatttttgtattctcagtagagatggggtttcaagctggtctcaaactcttgacctcgtgatcctcctgccttggcctcccaagtgctgggattataggcgtgagccactgtgcccggtcaattttaaaatttttattttcagctgggctcagtgtcctacgcctgttatcccagcacttctttttttcttttcttttctttgcttttcttttttttttttttgagactgagtttcgctcttgttgcccaggctagagtgcaatggcatgatctcagctcactgcagcctctgcctccctggttcaagcgattctcctgggttagcctcctgagtagctgagattacaggtgcccaccaccatgcccggctaattttgtaattttagtagagacggggtttcatcatgttggtcaggctggtctcgaactcctgacctcaggtgatccacccgcctcagcctcccaaagtgctgggattacaggcgtgagccaccgtgcccagcgaatcccagctacttgggaggctgaggcaggagaattgcttaaacctgggaggtggaagttgtagtgagccgagattgcgccatcgcactccagcctgggcaacaagagtgaaactccgtctcaaaagaaaataaaatattttcattttttcttcccagcctggcttttggtgggttgtccctgtatctgtttaacttagttgtcagccagtgatttgggcagaggttctcaaatactttcagcccctgaggcttttaccctatcctgatcaacttacagtcaaatgctctactgctgagctatacccccctgatcaatgtgtatgtgggtttggagaaactctaaaaaattgctgctggctctaaagtctcctttggttttcagtttttcctggttctcttaggtataatttcccagtcagtgatggtcatgtgaagagcttaactcagactttctatggctctgtttcaggattttcccattaaatctctggatgttctgcccatctaacaaagacaactgccaaagctgttcatttccatccacattcaccacttttagctggtagatccatgaattttcttcctcaccccaaattgagtccaccccctagagcagcagaactgctgattttcatagctggccccatgttgggaaaactagcattgtcaccagctgactatgctgtaagcagtggggatagaggagtagaaggatggcaggatcctaggctagaaagcttactatttttacctgaacctctagcagattttcaagaatctgtacttctcagtttgtttgatttacactgtattgaaatagttctttctgacaattttaatttttaacttttccattgtggcgaggaattgcctaccacttcatgctgtgaatacaagaatttctatgcctgtaatcccagcacaggcatggaaattcttgtattcacagcatgaagtggtaggcaagtgaggccgaggcaggcagatcacttgaggtcaggagttcgagaccagcctggccaacacggtgaaaccctgtctccactaaaagtacaaaaattagctgggtgcagtggtgggcacctgtaataccagctactcaggaggctgaggcaggaaaagcttgaacccaggaggtggaggttggcgtgagccgagatcgcgccactgcacaccagcctgggcaacaagagcgagactccgtctaaaaaaaaaaataatttccattttttcttagtttttgagcttcagagaatgactagggtctgccttactagagataaaggtaagaatagaggactaatgcccaggccacttctcaaacaagtagtattagaatcccctttgtgtcaggtagtttttttgttttttttgttgttgttgttttgtttgttttttgagatggagtctcactctgtcacaggctggagtgcagtggcgtgatctcggctcactgcaacctccgcctcccaggctcaagcgattctcctgcctcaacctcccaagtagctgggattacaggcgccgccaccacacccggctaatttttttatttttagtagagatggggtttcaccatgttggtcaggctggtctcgaactcctgacctcatgatctgcctgcttcagcctcccaaagtgctgggattatgggcatgagccaccatgcccggcctgcatcaggtagctttaaaaaaatcttctcaggcgattgtgatgtgcagttattgttgagatccagcagtttagaacagtgtttagaaaagcaagctttctctgtaaagggtgatataggaaatattttaggttttgcggtccctgtggtctctgttccaacccctcaactctgttgttgtagtgtgaaagcagccaaagacagtatgaaagcgagtagatatggctatattccaatacactttatttgcaaaaacaggcaatggctgaatttgctgaccccttgtcttggagaattctcaaaaatgattttattccaagtgtttgtatccttgttaatttaaggtagtgtgtatatttcttagcacaacccagcctttgcatttgtcattgatgtctttgaagaattagtccataatttccttcagtagaagtgttttaattgaccatgccttcctaccttctcctttgtcattaaaatatgtgagaaaatgtgccagccgtgggcaatctagttgaaaggtgtgtgttaacttttttggcccagttgggctcagtgaagccttagctggctagtgtttatggcaccatcaacaaagatggaagaattaagcctgggaaaaaggacaggaggtataaaaaatggggtccagaaattcagctgtaggagagcctggtagtggttctcctaccttctgcaaagttcagtgtcaaaactccaatcagagtctctacaagttgaactttcttggctgtccatcaggtagagtactaacttagtaagtacagtggagggccgggtgcagtggctcatgcttgtaatcccagcactttgggaggccaaggtgggcggatcacctgaggtcaggagttcaagaccagcctggccaacacagtgaaaccccatctctactaaaaatacaaaaattagttgggtgtggtggtgcgcaactgtaatcccagctacttggtaggctgaggcaggagaatcgcttgaactcgggaggcagtgaggccagatcacgccattgtgctccagcctgggcgacagagcaatactctgtctcaaaaaataaaaaaataagtacaatggagaatttggtcagacaacttatttttacatccgaggggttgggcatatgaactctgattataatgaatagttcagtagaacaaatcttattttccatagagtctactgtgagtgtatgattccattagttgagtggaacagtttttaccacgatgcttaaattctgcttcaactccctccttcccactactctattcccctgggtctcgtcagatactcctaagtcaaacaggtcatgtagcagataagtgaaggaagtaggcaggttaagtgggtaggtttgagttctgttgaggaggtggtgagtgaagatggagcctaggacctctctgattgggcagtacttgttcctaatctttatgctggggcctgggcagttacccttaatagatggaaaggtgcttagggtaggggatggtagaggacgccagagccatagattatagcctagatagtgcccataactcactgtgtgaccttgacaagctccataatcctgacgcacagtttttcagaagggagtttgtatagcgatcttttgggtcctcctaactcaatatcccttcatcacaaggctttagtctgcctttctagggattaattcctttctagtcattcattccatagttatttactgtatgctgagaacctttaccaagaattggacacagaaaggggtggagatgaagactttccaagcctggcacattcactggatagaggccttgttttcatacctgaacttagcctggtatactagctgctcagtgagtgtgtattacgtaagcaaatatcctattcctgtatactagcgagcgggattcttgtgctacatagtctatcagattttcattgcaacaaaacaacgtgaaagtcttatggattttgatttttttttttttttttgagatggagttttgctcttgtcgcccatgctggagtgcaatggcgtgatcttggcccacagcaacttctgcctcctgggttcaagccactcttctgcctcagcttcctgagtagctgggattacaggcatgcgccaccatgcctggctaattttgtatttttagtagagatggggattctccatgttggtcaggctggtcttgaactcccacctcaggtgatcctcccacctcggcctcccaaagtgctgggattacaggcatgagccactgtgcccggcaggattttgatttcttaaggtctgcagttggtttcctattttacctgtggaagcctgcaaaaatgaattttagactatcacaatttaaatatgtgactttcttgcctgtaaccccagctatttgggaggctgaggcaggaggattgcttgaagtcaggagtttgaaaccaacctgggcaacatagcaagaccctgtctctaaaaaaagaaaaaagaaaaaaattagccagatgctgtggtgtgtgcctgttttcctagttacttgggaggctgaggtggtaggatcatttgagcccaagagttcaaggctgcagtgagaaatgatcacaccactgcactccagcctgggtgaccctcggtcttctcggctcactgcagtctccacctcctgggttcaagcaattctcctgcctcagcctcccgagtagctgggactataggcacgcgccaccacgcccagctaattttcgtagtttttagtagacacggggtttcaccatgttggccaggatggtcttgataccttgacctcatgatctgcctgccttggcctcctaaagtgctgggattacaggtgtgagcccggccgagaccctgtctcttataataaataagtgagtgaatgaattaattaattaaattcttttttatctaaaagcatatggcaacagaggctaacatgcaatagttagccaagaattccattacaactttcattaaactgtagaggctctatcctaaactgttgaaagttatttatatcagaaatatacttacataatgaaattgacagaatatatctgtacacaaaatggtggtgttggaaattagatgtttactatgatattgattagttactattttttttgaacttttaagtctcagtttattcagttattccaataatgtaatcaacttgttcagggatataggcctctacagcttggcagcatatatctgactagtctttctagaatctcataaaatatacttgaccattgtagcaaagaggcatttagtaattgatgcattttgaaagagtatcttcctctcagaaccccccaaaagcattgattgtctatggaaatgtaccttatagatgagctgaataatttccttttatcgtgaagtctttgctttcttgttggaaaattgggaaacaatgtctgagtcattgtcatttagacaaaatgtcataaagccctgtagaacacaaagttctgcttatcagattctcttagaagatgagctgttgagtgacaggtcttctgttgtcccatctctgcttattcagtttgttaactgaggaatcattctctgtcctctccctttttttatattaataggaaacttccattttagaagaatacagtatcaattggactcagaagctgggagctggaattagtggtccagttaggtaagagatccatatgagaaactatggcaaattgttggcatgtgcaaactctgagaagggccatttgaaatacatcttgaattagacacatcaggtgtgccagatttgaggaataggctgaatttaacaagtacaggtttttatgttaggctttttctcatgtatttaggaattagttaagagtgactgagtcgcatggtctttttatagagtcatttaagatgtcgagactggccaggcgcggtggctcatgcctgttatcccagaactttgggaggctgaggcaggcggatcatgaggtcaggagatggagaccatcctggccaacatggtgaaaccccgtctctcctaaagatacaaaaattagccaggtgtggtggtgggtgcctgtaatcccagctactcgggaggctgaggcaggagaatcacttgaaccagggaggcagagattgcagtgagctgagatcatgccactgcactccagcctggccacagagcgagattctgtctcaaaaaaaaaaaaaaaaaaaaaaaagggtgtcgagactgtggggccactgtgagagtcacctatagccagctgaggccattattttttcattgacccacagccccaaaagcatggcttagaagctgaggcctgagcattggctgctgggcagaggggtgagatgcttctttcccccacctgctacccttgggggcaagtttgttctggatgcacctggccatatccttgatgagaagtacaaatctcaaagaaaaagcttgttaaattaattttcattctaacatatatgatctctgattgattttttttctccaaatctagagtctgtgtaaagaaatctactcaagaacggtttgcgctgaaaattcttcttgatcgtccaaaagctagaaatgaggtatgctttattgcctcgacttaattaaatagttgaagtgcctaagaattgttcttttgcaagtaaggcagcttcctagagagaatacagtgatgcataaaaagttttatgtccaaactttacctctcttccccattcatgctatcttagtaaagtagtcctagatctgtcaatatcaaaggccattgagtcatttcctttcagccacctcttgttcttttaaaattaatgtgattcttgtaccctcatgtattcagatttacctcagttttgcttattgaagaaggtacttaaaggtggagataaaatagcacaaggaagagtcaggtgaatggtgtataaaagtgatgctacaggaggactctgaggatgtttctagtttgtttcttctttttgagacagagtttcactcttgttgcccaggctggagtgcgatggcgcaatctcggcttacggcaacctccgcctcccgggttcaagtgattctcctgcctcagcctcccgaatagctgggattacaggcatgcgccaccacgcatcttgtatttttagtagagacagggtttctccatgttgatcaggttggccttgaactcctgacctcaggtgatccatccgcctcggcctctcaaagtgctgggattacaggcgtgagccactgtgcccggcctttagtttttaaaaatatacattgggtttgtttttgtttctgtttgaaaccgagtcttgctctgtcacccaggctggaatgcagtggcacgatcatggctcactgcagccttgacctccttaagctcaagtgatccttctacctcagcctcctgagtagctgggaccacaggcatttgccaccatgcctggctaattttgtttgtattttttgtagacatggggttttgcatgttgcccaggctggtctcaaactcctgggctcaagtgatccactttggcctcccaaagtgttgggattacaggtgtgagccactgcccctggttatacattggttttaaactatctggatatggtaatgacattctaataacatgtgcaatgaaggacttcttttgcataaagaaatgcaaataatttctaaaatgaaatgaattgtttgccagattttcatttgcaaataaatggaacagtaggaagtaaatctgttggtgagtttttattcatggaaaaagcattaaggagataatctttgaaaacactgggtttttacatcattctaagtgataaagtttttattgtaattagcttgtacctagtatggtcagtttttggagagaaaatgttggtatcccctacctattgatacatttcctctgttctctttaaggtacgtctgcacatgatgtgtgccacacacccaaacatagttcagattattgaagtgtttgctaacagtgtccagtttccccatgagtccagccctaggtaagactacacagtgtcatcatcaaatgcccacatgtaggccaatgtgtagtggagctgtcctctcttttatgtgctccctccccttccctctccttcttcctcctaccctcgcttcctctgcccttccttctccccctccatctccctttttgtaatttggaaaatgtcaagcatttgtaaaagcagacagaattatgtaatgaatcctcaagttctcatgatccatcctcaacagtaatcctcttgtggccagtctaatttcatctatgcccctaccactcttcacatcccctgatgattctgattactttctcatttcaagaaagcatttaatgtagaatttaaacagattctatttcaaatcagtgaaaggggcccaaatattattctaggcagagtcttagaggctgataaaacaaaaagcctttattattgcttagtctaactttccttttaaagaaagaaatcaacattattcttttagttaccaaatgtttggcaagcatattgggtggcattctaagtctctttgttaaaattcaaaattaaataaggtatggtttttttggggaagactgagatgtaaacccatcatcatagcagtgcaataggcactaaggacaggcatccctaaaatattctaagcttacaaaggagaggagctgctaactatagtctgggaggagaggtgtctcacaaaggctgtgtggaagctaggacttgaaggaagggtaggaattttccagatggaaaaagaagatagaattttaaaaacaaatgggaaatcaaacaaatgggaaaaaaacgcttatttttcacaactgtgctctgttggtgaaagcatttggatggaagctggaagcatatatgaaagaatggtagccaaaaatcacattaaaattttttttttcagaacatgagaatttttgctcttagtaactgtgttaccctggacttaggaagttgttacacactttgtagatgcagtatctttaggtcagcttcttaatgtttcagggttttttgtttctttttcttttttttttttttaacttaacaaaatcaaatgctttcaaacagggcccgactcttaattgtaatggagatgatggaagggggagagctatttcacagaatcagccagcaccggcactttacagagaagcaagccagccaagtaacaaagcaggcaagttaaccccaggtaccaatcaaactgccaccaaagttggttaacaagcacaatttcattggggggaagaaaagaaaacttaaagaaaagctctatttgacttctcattgcctgctttgttatgtaatcagaaaagatgttttgacaggagaaatgtgaccccttttatacttgggggtgggggtactgtgttcttaattggttgtcaactgtttcctgaggctgctgtgagatttcaataaactctggaaggaaggcatcttaactgctttgtagactgcagttatctttaggcatgtagctaccaagtactgttattggactttgcaataaaatgctgctgataccacctgaaagattgtatggtataaaaatgtattttaagagaattgtacataagatgcttcctgcatgtgagccacctttctgtgatttcttcagatttaataatatcctaagatctttgtaattctgaattattcctggttatattctatgttgacatcacattttattgctgtagaaatgatttatgtcacaaacaatactaggaatccagctgataatcacttcttgcagaggtgaaaagctaaaccctcaaggcttatcttcataccaggcaagcaaagcaaagagaattaggaagcacagcccaattgcttcttaataaaaagttcttccaagtttcccatgaaccttaagcaattttggatgcctcctttctggtagggaggaactgatacttggattgctgagaaaatgccatatggagagttaaagaacaagtaaaatctgttctttctgtttgatttttaaaattatacctttaattttttcaaatattaggattaaaggatgagctctgataatcttctataaaataaaaccccttcaaatccacataaacaggcaacattttcaacaagcatgatgagcaaaatgagtttccagtatgaattggaaaaacccagtcagctgatttcttgaccctcagctccctggagagtgccattcttgtctgagccctgctgtgggaactgcgcctgctgaccattgctcagcttaggtgtttcttctgcagtgtctgtcatacctcagatgaatgaaagtgggagcatttcatttttcccatttcttacaggatttacccatcagtttattctgacaaagaattgctgtaccatcatatttttctttctgtctgacaaaatacaagttgcagttaaactaagcttaatccattctgtttcttggtattccaagtttttcttaatttctgctttaaaattgaaagtgaacgcagtcttaatgaaggcttgttttttgacatcctgagttctctacgccaggtgtattaaagagtggtcttttctaagaagcgactgtttcattgtgtcttttttcagatagctttggctctgcggcactgtcacttgttaaacattgcgcacagagacctcaagcctgaaaatctgctttttaaggataactctttggtgagaagactgtttttctgcattttagtgctgcaactcttaacatagttcaggagtgggtgtgtttggagcgctctgaattcatggtgaaaaagctttaagccaaagtgcttcaaacagcttatttcttcaactcgttcccttgctagaggctcagagaagctgtactactgtactcccggcattgataattttggatgatactgatatgtatttgtgggacttaatgattttggatattatttggaggacctttgggaaggggcaggaatctgtatgctgttatatattatctcgtttcatttgctgttttccctttcagctctgtcccctgccccatgtctcaccagataagttgctctgtctatcatgaagcttatggcagatattaaaagtgaagtagcatcccagattgatgagaggtgatgggcttatagagtgaagggtccctaggccaagaccttgacgttagtgctgcccttacaagttctaaagcaaaaatagctgtgtgagtgggtaggaattccttacttctgcattactaaggacagttcctcagtgtgaatcattgtctccagacctggggacatgttattttcataagttcgcatctcagctggaaagaaacttgttagatctcagggtaacatgtcttacacctggattttcctttaatgtttactgagcactctggagcagtgactccttttttttttaatttcaggatgccccagtgaagttgtgtgactttggatttgccaagattgaccaaggtgacttgatgacaccccagttcaccccttattatgtagcaccccaggtaagcatgtgcggtttctgtcctaagatctgtcaccaagctgcccatcaactcgtgttccttctattctacagcacaagtaggcatatattacagatgggagggggagaacttagctttagaaacctacagattgctttatttggtgtagatcttttattcttttaaaatcaactttagccaggtgcggtggctcacgcctttaatcccagcactttgggaggctgaggcgggtggattacaagttcaggagatggagaccatcctggataacacggtgaaaccctgtctctactaaaaaaaatataaaaaattagccgagtgtggtggcgcacacctgtaattcgtgctactcaggaggctgaggcaggagaatcgcttgaacctgggaagtggaggttgcaaggagccgagatggcaccactgcactctagcttgggcgacagagcgagactccgtctcaaaaaaaaataaataaaataaaataaactttattgaggtatgatttagaagtatgatttacatacagtaaaatacctccacttcaaggagagtttgatgagttgtgacaaatatataccccatatggcgaccaccacattgaagatgtggaacacgcccctcacttcacaagctgcctgtgccactttgcagtcagtcccctcccaacttaacccctggccctaggcaaccactgacatgctttctgtcattattggttagttttgcctgttgaagaatttcagaaaaatgtaatcgtggactttgtatgcttcatttcttttgcttagcatgtttttgagatttgtccatgttcctgcatttatcactcgttaattccttttcattgccaagtagtatttcattatatacctaagctgcatttgttttttccattcactgacaggattttgggttgtttctcatttttggctattatgaagaaagctgctaggaacacttcttttacagtttttgggggacatgttcccccatgcccatatcttttttccaaaatggctataccattttatgcgtctaccagcaacgtatagagttccagtcatttcacatttttactaacgcctcatgcttgttgcttgtcagcatttgtcatcttagtcattctggtagcgggcagagtattacttcattatagttttaatcacgacattgtcctgatggccactattttggagcactttttgtacatgtgtattggccattctgttgtaagtatgggcattcatcttttgccattttgttattgttggtttcttgttaaagaattgaggtataagaattttaaaatattctggacacaggttctttgccatatgtatgttgtattcttactgctgctgtaacatattgtcacaaacttagtagataaaaacaacagaaatgtattatcttatacttctggaaatgagaagtctgaaatggtactcagtgctataatcaaggtgtcagcagggctgtgttccttctggaggcatttcttgccttttccagcttctagaggctgcctacattatttggcttgtagcctcttccttcatcatcagagccagtagcatagcatcttccaatgagtgtctctctctatgactttgaccctcttgcctgcctcttataaggaccctactgatcacattggccttacctagataactccccattttaagattcttaacttaattgttctgcaatacaaggtaaaataatcccagggattataacatggacatcttggggggccattattctgccttccatatatatatcatgaatattcatctcagtctgtgacttgccttttaattttcttaatggcctttgaatagcagaagttttgaattttaatgaagtctgtttcaccattttttttttaatgcttagtactttttgttcctaagatccacaagcataaatattttctctgatgttttcttataagaggttatagctttagcttttacatttgggtctgtaattcatctgagtttgtgtgtgtatgaaatgagagaccaggttctttttttcccccttaagggtgtcaagttgttgcagcatcattggtaaaatgttttttacaaatcatcatttgtaaaaggatttgtaaaaggattgcatcattgaattgcagttttttgtttgtttgtttgtttgtttttgagacggagtttcattctttttgcccagcctggagtggtgcaatggcgcgatctcgactcactgcaacctctgcctcccgggttcaaggaattctcctgcctcagcctcctaagtagctgggattacaggagcccgccaccatgtccggctaattttttgtatttttagtagagacggggtttcaccatgttggccaggatggtcttgatctcttgacctcgtgatccgcctgcttcggcctcccaaagtgctgggattacaggcatgagccactgcgcctggcctgaattgcagttttgttgaaaaccagctggccatatatctgttggtcttttctggattctattctgtttgtttaatatatgtatgtgtctatagcaagagcatctgcattattgtagctttatattatatcttgacttcagattcattctttttcaaaattgttttggctattctagatcctttgcatttctctacattttagaattcacttctgtataacagaaaagcctcctgggatttgactggggtggtatttaatctataggtgaatttggagagaactgatatcttaacaatataagtctcccaatcgatgaacaaggtatatatctctccatttgtttaggtctttaattttcctaaaaaatgtttatgcttcttaatgttacaggtcttgcacatattttcttaaatttatccttaaattttgtttttggatgctgttggaaatgatattgtaaaacatttcagctgggcgtggtggttcacgcctgttataccagcactttgggaggctgaggcaggcggatcacctgaggtcgggagttcgagaccagcctggctgccatggtgaaaccccatctttactaaaaatacaaaaatttgctgggcgtagtagccggtgcctgtaatctcagctacttgggaggctgaggcaggagaatctcttgaacctgggaggtggaggctgcagttagtcgagatcatgccattgcactccagcctgggtgactagagtgaaactgcgtctcaaaaaaaaaaaaattcattttctaattttaactagtttatagaaatactagtgttttttgtttgtttgttttgggtttttttttttttttttgagatggaattgcactctttgttgcccaggctggagtgcagtggcgcaatctcagctcactgcaacctctgcctcctgggttcaagcaattctcctgtctcagcctctgggatgacaggcgcccgccaccacacctggctaatttttatatttttagtagagacagggtttcaccatgttggccaggctggtctcgaactcctgacctcaggtaatccacccactttggcttcccaaagtgttgggattacaggtgtgagccactgcccccagccatactagtgactttttttttttttttttttgagatggaggcttgctctgttgcccaggctggagtgcagtggcgcaatctcggctcactgcaatctccgcctcccaggttcaagcgattctccttcctcagcctcccgagtagctgggactacaggcgcccgccaccacgcccggctaattttttttcatatttttagtagagacggggtttcaccttgttagccaggatggtctcaatctcctgacctcatgatctgcctaccttggcctcccaaagtgctgagattacaggcgtgagccactgcacccggcccatactagtgatttttgtatattgactttgtgtcttgggaccttcctaaattcatttattaaatctagtaaattttttgtagatttattaggattttcttttttttctttttcttttttgagagcctaaaagtgggcatgcctcttctgttgctcggcctttagtgttgggtttgagggttaaatcagtctactcaaaagttgagctgagtgtgagttttgttgttgctatcgttgtcttcagtgcctcagtggcatgggattcctgttttgttaccttatggttaggtgggatctgaaatgccattttttttaaaatttaaaaaaaatttttttaaaatattccacttctaccctcagtcttggccttgctagtgcacctgtacctcagaggggatctctctttacagtcttggcccccccttagcaatagattgctgtcagttactgcttggtccctgcaagcctgcagaaagggagatggcaatgggggaccgagaggtatctgtttctctgctgttgggcaggacctgtgttcttgagtctcatgaatatctggtggaagtctgtgcagaagagtatgggagcaggcatgagtcttccttgtttgtatggctcctagagggtctgtactcttatcctagcccacattttgcctttagcagtttgttaaaaacctcgctgaattctttttacccaaatggcatgtgatatcacttcctcctgcgctctgccataggtgagccagctttcactccccatctctccttggaagggcctgacttaaagatttccgaataattggttaacctgagacctgatctttgatgggttcaaaaaaagtgatgggccgggcgcagtggcttacccctgtaatcccagcagtttgggaggctgaggggggtggatcacttgaggtcaggggttcaagactagcctggtgaacatggtgaaaccccgtctctactaaaaagacaaaatattagtcgggtgtggtggcagccacctgtaatcccagcttctcgggaggctgaggcaggagaattgcttgaacctaggaggtggaggttgcagtgaacaaagattgagccattgcactccagcctggtgacagagcgagactccatctcaaaaaaaaaaaaaaaaaaaaaggatgattttataatttatctttgacactttccagctttctatatcctagcagaaacagaaatcccaacaatttgggtggaaggagggtgaggatcaaaaaactacctatgtggtattatgcttatataaaacctgggtgatgaaataatctgtataccaaacccctgtgaagacactgcagttcacctatataattaacatgcataaagcacatgtacccctgaacccaaaataaaagttaaaaaaaaaaagtcccaacaatttgattatgtatgcattcttgttcctttgtttttcctgccagggatctcttgagctcctgggatctgttggtttatggtgtttatcaaataaacaccatatcaaataaaaattaggaaatttttcagacatcatctcttcaacgatttttctactcctctacttgttttctgagacttccaatcaatgacatatatattagactgtacagggaactggagttctgatcttttgtattttcatccttttttccttttctttcatccttttttttctttctgctttcccttcccttcttcccttctgatatatactcaatagtggcactgctggatgataaggtatttctagttttaatttttttaggaagcttcccactgttttccatagtggtcatactaatacacattcttacagtgtacaaaggctcccttttttccacatcattgttaacacttgttatcttttatcttttttaatagccactgtaaaaggtgtgaggtaataatttcattgtggttttaattttaattttaatttttttttttgagatggagtcttgctcctggcacaagttggagtgcagtagcacgatctcggctcactgcaacctccacctcccgggttcaagcgattctacttcctcagcctcccgagtagctgggattaaaggcatgtgccaccacgcccggctaattttttgtatttttagtagagacagggtttcgccatgttgttcaggttggtcttgaactcctaacctcaggtgatccactcgccttgacctcccaaagtgctgggattacaggtgtgagccaccatgcccagcctgttttttttttctttaatatttctggcctacaaatgactccatttgcttatttttttaatgcagtgtatgaaagtttcaggtcttctgcattttcacctgcatttggtatggtcagtcttttttattttggccattttagtgtatatgtagtggtatttctttgtagttttaatttgcattccctaatgagtaatgatgtctgccatcttttcttttgtgtacacatttgtgtatgcacctgccttctgtatattttcttcgggaagtgtctgttcagaccttttctgtatttacaaaattgggttgtttattttcttattactgaatttgagagttctttgtatatttcagatatgaattcctttcttttttttgttggagacagggtcttgctctgccacccaggctggaatgcagtggcacaatcatgactcactgtagcctcaacctcctgggctcaagcgatcctcccacctcagcctccttaggagctgggaccataggcatacgccaccacatctggctaattaagaaatttttggtttttttttttaagagatggggcctcaccacattgtccaggctggtctcgaacttctgggctcaagtgatcctcctgcctcagcctcctaacttgctgggattacaggcatgatctaccacgtccagctgactctgactctttttttttttttttttaaactctcccaggttgtcaagagatggatacgaatcttttattagatctgtgctttgcaaagattttctcccagtctgtggcttatcttttcattctttaacagtgtcttttgaggagcagaaaattctaattttcatgaatgccagtttatcagaaaacttttttaaggcctgtgcttttggtttcctatgttgaaaatctttgtctcacccaagatcagtctcctatgttttcttctagaagttttatatagtgttaggttttacatttaggtctgtgatccatgttgagtcaatttttatataatgcatgaggtatggatccaagttcacttattagcatttggatgtccagttgttctagcaccatttgttgttctatttatttattatttatttatttatttatttatttattttgagacggagtctcactctgttgccaagttggagtgcagtggcggatctcagctcactgcaacctccgcctccagggttcaagccattctcctgcctcagcctcccgagtagcagggattacaggcacctgccactacgcccggataattttttgtatttttagtagagacggggtttcaccatgttagccaggatagtctcgatctcctgacctcgtgatcctcctgcctcggcctcccaaagtgctgggattacagacgtgagccaccatgccccgccttaatttttatcttttaagccccaccctcagaagcaaccgttcatgaaaaaggctgtcttttctctgcggcattgcttttgagcctttgtcaaaaatcatggagcatatatgtgtgaatttatttttggactctttattctattccattgatctctttatctatctttaccccaataccacactgtcttgattactgtagctttataataattcttgaaatcaggtagcgttggccctccacctttgttcttcattttcaaagttgtttttgctattctgacttccttgcatttccatgtgaactttacagtcagctgttgatttctataaaaaagcctactgggagttttgactggggttgttttagagctatcattcaatgtggaagtgctgagattttagtgatattgagtcttctgacctatgagcaagctgtatcactccattcatgtttgtctcataattttgctcagcaatattatgtagtcagtttataggtctctcacatatttgtgagatttattcttaatgcttgatattttttctgctgttgtgaatggtgttttattttcgggtttaattaactcactttgttgttcttgtgtaaaagctctatatggtggtcgtggttagagcccaggtcctctgcatggagactttagagtaggtttttttttttttttttttgagatgggattttgctcttgttgcccaggctagagtgcagtggctcaatcttggctcaccacaacctccacctcccgggttcaagtgattcttctgcctcagcctcccatgtagttgggattacaggcgcccaccaccatgcccgtctaatttttgtatttttagtagagatggggtttcaccatgttggccaggctggtctcgaactcctgacctcatgatctgcctgccttggcttcccaaagtgctgggattacaggtgtgagccaccgcacccagcctagtgtagttttttataagatggtcagtgaatttctattaggtgagatagctgcaggtcttagaggtggcactgaagatggcctttgcaaagttgcccaagatggcactgcagcccctggctaagtggtagcagttgtatcccatccgccccagcttcatgggcacaggggctgagacagtatcaagtaggtcggggtgtgggatgaagtccccttgcacagaacctcagcatcctgtgacttttcaaggaacagtgtggggctgctaatgttgtgaccccctctggagttcctcctcatgggacattagagaggttggccaggataatggtctcacggtggcagtggctacctccttggagcacttaacacctagactgacatgactgtcatagtccctgatggtaacagatggcttgaagctcatctgctggacagatctgctttcgcataggcataagggctatccccaggaaaaagtcagtgatctcagattccttgatgggcaggaagaagagaggaatctcctctaggaacttcatcttcatgtccttgacctgagtatttccctggctgatggataaattactggttgtaagaaaaaaacgtttttggaagtgtagtgtttatgtggagttttttttcgatggctgattgccagttgtttacctccttcagtctcatagtagcctgtctcaaggcaggttatcggtggtgtgattttcattaaatggtcccctttggtctgactcttgacaggtactggaggcgcaaagaaggcatcagaaggagaaatctggcatcatacctacctcaccgacgccctacacttacaacaaggtacaggaagagatatttctcttcatttgacagatgcagcccctctcctttagtgaggtgtttgtggccctctgggagtgtggccaattcctttctcaccccttaatattcctgccccaaagaagcagccagactcgcagaaaagtatttggaattcaagtttttgtttgatgaaatatcagataaggttcagccagactcgcagaaaagtatttggaattcaagtttttgtttaatgaaatatcaaataaagtttgtacccaattagcttttgcagtggtaattagggaccgtgatcatcagtcaggttatttttttgactgtccatatggtccactggccacactgaaaacatatggttggcttgtgtttttgaggtggaggccatttctgagacacagacgctagagaacactttgtggtcatttatggcaccattctttgttaccccataaaacacccagcttagaacagtatctgatacacatagcaagggctcctaagtgttacttggtaatattacggttcttaatctgtagcccacattttttttgttgtttttttgagacagagtctcgctctgtcgcccaggctggagtacagtggtgtgatctcagctcactgcaacctccacctcctgtgctcaaacgattctcctgcctcagtctcccaggtagctgagatgatgggtgcatgccaccacactcagctaatttttgtatttttagtagagtcggggtttctccatgttggccaagctgatctcaaactcctgacctcaagtgatccgcccgcctcggcctcccaaagtgctgggattacaggcgtgagccaccgcacccagcctgtagcccacatattgatcctgtctgttcctttttttttttttttttttgagacagagtcttaccctgtcgcccaggctggagtgcagtggcacaatctcggctcactgcaacctccgcctcccgggttcaagcaattctcttgcctcagcctcccaagtagctgggattacaggcgcctgccaccacgcctggctaatgttttgtatttttaggagagatgaggattcaccatgttggccaggttggtcctgaattcctgacctcaggtgatccactcgcctcggcctcacaaagagctgggattacaggcgtgagccaccgtgcccagccgatcctatctgttctaaagcacaagaggtttagggcctctagaaataggccctggagtcactgagtaagtagatcagaaaaaagatgctacttggggacttgaggctagatatagatgacagaaggggctgagaatggtaaaaaggcagtaggctgggacacttgctgtggctccactactcttaatctgtgtaacattggtgaggtcacttggtttcactcttgacagaggacctgagagatgacatgatctctgcagtattagttccctttctggaaagtgagggattgaaggtccctttccacccctgtaattttattctgtgattctgttctacagcatgggctgtgtcatccacaaatatctactagtataatgtgaaaacatgggcaggcctggcgcagtggctcacgcctgtaatcccagcactttgggaggccgaggtgggcggatcacgaggtcaggagatcgagaccatcctggccactgtggtgaaaccccgtctctactaaaaatacaaaaaattagccgggtgtggtggcgggcgcctgtagtcccagctgcttgggagactgaggcatgagaatcgcttgaacccaggaggcagtggttgcagtgagctgagatcgcgccactgcactccaacctggcgacagagtgagactccgtctcaaaaaaagaaaatacaggcgagagtacctgagacaccccattattcagcctttatgcagagcaccgcacagctgtggtgtgagggggagtgtggggccccagtggcaggctcacggggctgccatcttaggcaggcacctcttttatctcgctgttcaagaaaggcttgaattgaagcctctgcaaacccagttttcaaagcaaatggagctgcatttaactaaaataggagtcctttatgcagtgatataggccatggagtcaccttactacctgcagacatggtagttggtagcagttttctttttttcacagtatcttcccccagaatggtgtaagagcttgcaaatggacctagtgagtccttcatggtcaaaggaatgcatttagaccttctgttcttccctccagtcctctccatgatctgtgtcaaactgctttgggcctttatgaagtggcctgtgctgtactgtaggtgagcctacctgtctcttagttgctttgtttctacatagaggtttcacaaccagctggtttatatttatttcttttctggctggggcaaagcatcctatacctgtacacagggatcagataggtgcttgggcctaaagagtgagaatgaaagtacctgtacattttatcccagactggctttgtatgatgggatgcatgtatgtagtattggcagcttattgaaaatatggagagaggccaggtgtggtgagtcacgcctgtaatcccagcactttgggaggccaaggcgggcagatcacgaggtcaggagttcgagaccaacctgaccaacatggtgaaagcctatctctactaaaaaaaaaatacaaaaattagccaggcggcatggtggcacatgcctgtaatcccagctactcaggaggctgaggcaggaggaattgcttgaacctgggaggcggaggttgcagtgagctgagattacgccactgcactccagcctgggcaacagagcaagactctgtctcaaagaaaaaaaaagaaagaaagaaaatatggagataaagactagttctcctaagacttccttcagctttcctagtctctgttaagtgactctagtttatatcagcctatatattgcaggggctattcctgagcctgtcatggggtgtttatttgggggctctgcttctgctgtgagtgaccattttcttttttgctttcagagctgtgacttgtggtccctaggggtgattatctatgtgatgctgtgcggataccctcctttttactccaaacaccacagccggactatcccaaaggatatgcgaagaaagatcatgacaggcagttttgagttcccagaggaagagtggagtcagatctcagagatggccaaagatgttgtgaggaagtgagttcacgggctgctgggcatggaggccaaggaggcctccaggtggtggagcacaagggaatgtgggtagagaaaagtcactggtttcctaggcaggctcctccccgttttaatatcacagaaatctctctggagcctgaggtgactgttctcagtgtccacaccttggtgcgaatgaagctttcctccctcctgttgcatccctagactttgtccccagggtgtgaacccaggtccctccataggcagtctctgcacattaattcaagaccctaaattatagacctggtgtgctgtccttcttacctgtgagctggcatgtcatttgggacagatacaatgccaggaggtgaactaggtgccgagatgacaaacagcatccttggatgctgtggttatgtgggtttgtcaggcctggaccccaccctccaccttcgcgctgccagttggttgctttgagatggagtctcgctctgttgcccagggtggagtgcagtggtacaatcttggctcactgcaacctccacctcctgggttcaagtgattctcctgcctcagcctcggcagtagctgggattacaggagcccgctaacacgcccagctcatttttgtattttaagtagagatggggtttgaccatgttggccaggctggtctcaaactactgatctcaagcgatctgcccgcctcggccttcccaagtgctgggattacaggcgtgagccaccgcacccagctgctctggcatatcttaagatgggaagatttagtcagaattagggctagtgagtggatgagggagagttgatattcagagtcttttggtagctgtaggactaggtaagaagtcaggcctaaattagaatatgtttgttttttctgcccacctgtgtgggaggctgggtgcccatggacttaggcactgcccctgtcttcccactgctgggtcttcactgagcagtgtctcccttgttggtctcagtttcttcctctataatgggatgaaggtacatgtttaggggcaacacctgggagctgtctcccaacagtacagccatttctccgtggaaattactccctttcaaaagtaagcttgtcctgttgattagaaggtgggggttgggggcaggttctgtgtgctataaagagggactgttttctaaaatagacaagtacaagtttttaggaacgtgggtgcaatgattaaatcaccatctgtcttgacatgctatttccttgctgtattcccagctatttgaccaaaacctcaatgtcctgtaagtagttctttgccagttttctatagaatacatttcctgtccctagagcaacactgattatctttttggttttgggatcttccagataatcctttctttagaatctgaagccatctgttcagaatgatccagaagaaggtggcagacaagctgaaggagcagttaggcatgttgtcctgacatttgtaatgagagatggagttggaaggagggaacgggctgagatgagctaggaaccacatcagtgggaatgaacaagatggaaagaagcatgatctgaaggcagacagcacagaagcaacaccctgggcttagaaggaaatgccatccctgtctcagagactctaggtttttagcttttgaatgtctgtggaataatgggctcatgtcctgccatatggtgacatctaggagttttatattgggtagcaacctgcttttccagaacctcatgacccttcaactaattctgcagccactatcagccaaaaagagcactctgagttccttttggaagttaaagcccattgtcctagaaacctcagtatggagattcaaggtctgaggaactataagccatatgtaggattaccttattaaaccctagaactcaaaagtatcactggattaagcccttttctaccattttaatctcactttttccagtatacaaaggactgcctcaagccatagtacccctacaagtggttggagactagaatcccatctgtgctctgcaggtggaaagcccaggcttgcagaagtcagaagtaaccagaactgtttagagccaggtccaggaacttcctatggccttttggtagcaactgtgcatggcagccctgttggcgttttctccacaggctcctgaaggtcaaaccggaggagagactcaccatcgagggagtgctggaccacccctggctcaattccaccgaggccctggataatgtgctgccttctgctcagctgatgatggacaaggttttgaatgatgtttactttgttggctgaaaagactgtgttgggaaggaatgctggggcttggctcagtgaggggttagaggcaaaacagtgcagagtacacgatccttcccagagaaacatctctggtttcctgagagtcaggatccaaaataaggaatttctttcggtaaaagaccaaatcaaggcctggtgaatataaactaagggagcactcaaaggaatagcctccatatttctgctacagggctgcgggcacagaacagtttaagataccctccctttccccaaggggtttaaataagactggctgggaaggcaaggccaataaacatgaaacaaagagggaacatttcaaatatcagagctttgcatgttaactttcctgtgaatgctgtgggaattcagaaaaagagcacatctttgaagggatgtaattttcccaaagagaaggcagaacccctcacatgtattaactgtcttctgtgttgcagcatctgagttctttctcatgttcggacatgcgctgtccttgaagaatttgagtagacagtgtaaacgcccatgcgtggcgaacagcataagcaaaaaaacacatgcaaatacatcatcgggaaaaataatttggcctcactaatgggaagttaatgagatgggtgtggcagggccaggctttgcaagtggacagaggggtttaagtcttagtgggatgcagctgagaggccatagtagctttttgagaagagatttgccactaggaaggtatttagagatagtcagacttggcgacttgcagacttgccagcctaatacttctgcagtaatctagaagtcggaggtggctgtgggagcagagaagtagaggtgaatgaacaggctaaatatttttgaagaaaaatttctacagtttttcgtgatagactagatataaggggacagttgtggcatatctggtgataacattgacagattaggaaggaggctggtttgggtgagagggagtcttttaggttttagatattgtttgagatggcagaggaacattcaaatgaatgagatttatagggtgggaccatagtgtggctgtgagctcaaagcggtgacacagacttgagtgttaacagctttgaaggggtagggtggaagtgttagacgtctctttctaagtttagctggagcatggaagaaaaaggagaactggaaagtacagttctctgccttctctttgatttgtgggtggttgtcttcctgttgtccagaaatggtttggtcattcaaaaatccaaagggattacttagatcctggttgtcagcacatagaggttactcaagatcttaaaaatgaggagataaggccaggcatggtggcttacgcctgtaatcccagcagttttgagaggctgaggcaggcagatcacttgaggtcaagagttccagactagcctggccaacatgaggaaaccccatctctactgaaaatacaaaaattagctgggcgtggtggcatgcgcctgtaatcccagctactctggaggttgaggcaggagaattgcttgaacctggcagcggcagaggttgcagtgagtcaagactgcaccactgcactccagcctgggagacagagcaagactctctcaaaaaaattcttgttgtgaaaattcaggtggtacagccgtgttaaaaagtaaaagttccctttcattccctgccacagtcacacccctcagaggtgaggtaatctatggcttgatgtatacttcctgatcgttttctgggatacacacacacacacacacacacacacacacacacacacacattctgtccttcttttaaagtacaaaaatggaaaaaaaaatacaaaaatgggatcatattcctatgaagccttctgatgatttcgtctgcccgtagtgagattatacactgttcataaaagcacaaacttccagagttccagactccatgacagctatttctcactgtaaattacttgactggttgtggcctcggtcatgtggcctcagccttggccatgtgagatggtcagggctctgagctgtcagggctgaggtgaatcaataccgtctgtaaggcttcttgggcagcagcctgccagcctttccgctgatgtccatatgtgcctctttacacttcccctcagtagtggctttgagtggggttcctgctggtatttcttactcgcatttctgtccccccaccagggaagaagggctagttgttgtgtgacctttggttggcctggtgtttcctggttcctgttgatccatggggaaaagtcctttgccttatcaaaatatttatattccttcagcataagagtgaaattaccttcttagtactttgagcttttcctttccactttcttagactggctttttaggtgcccagcaatgaatatgaaaaactgacggcagtgtttgcattcaggcagtggttgcaggaatccagcaggctcacgcggaacagttggccaacatgagaatccaggatctgaaagtcagcctcaaacccctgcactcagtgaacaaccccattctgcggaagaggaagttacttgggtaactgagcttatttcttcgattcttcttcatggctggaatggctgagtactgggttctgaaatttaagaaatttaacttgctcagctaggggtctttagcctctgaagagggtggagaggataagttctttaaatagtatcaggagttggacactattgttatttttctgatacatctgttgccttatgtttagaggtaatatctgtccagagttggtttttggggtctcacgttgtcattacccctccctcaaactcttaaagcaccaagccaaaggacagtgtctatatccacgaccatgagaatggagccgaggattccaatgttgccttggaaaaactccgagatgtgattgctcagtgtattctcccccaggctggtaaaggtcacaccatttactaatcctctgtgtgtctgtgagtgtgtgtgtgcaggggtgggtgggtgtatgcatgcacatggcaaaaggaatggtttaattttgggttgtctgtttcatcttgtgttataagaaaagtacattatataaggtagtctatgcccactaaaaagattggacagtgggagcttagaaatgcagttaagttctgcccctcctttgtttctgtggaatttctagtttagacttaattggcagtgtcaggtgcaagcatgcaattttgtgttttcttagtttgacaacaagggcacaggttgggggatggagaatggaaaatgtgggtagggtctgaatctcattgcaggctgttaaccatttccagagcctttagagtgcaaggctgccattagctcataaataagagaatacctccttagttcagaagtggctcctgctgctactcatgtcatgggcagagtgacttacacgtgggtcctttggagtgagagctttctttcgttatgttctctctccactcatcggcgggtgaggggctattctcagcagataaatgagatgcttcacgtactaggccagaaaacagttgggttgacctatctatctccctagattccttgggttttaagagaactcatgtagtgtacctcagatagctttctaaagtaagaaatgagcttaggggagagaaagtagcccactctcccactttttggtctttggttgaccaggtgtcttttgttcagcaatagagtctgccacagcctatttcccatcccctggtgctaagactctggggccatcagtggatttgtataaagatgtcagagtaaaaaagagtccacataccagatgcggtctacataatgtagggactagcagtaaagcccttgtctggtgaagttttgcacattcagtcaacatttttcaaccagttggacatcacgtccctccatctctcacactaaaaccccatgatgctgcaggaaaaatgcaaattcctcttcatccttaccaataggagagaatgaagatgagaaactgaatgaagtaatgcaggaggcttggaagtataaccgggaatgcaaactcctaagagatactctgcagagcttcagctggaatggtaggagccttcatcaactcccttccccaggaatgcagacaagtgattatgtttagaacatataggatctctttggggcctgagctgcggctgttttgaagtgaagtgaggctggctggagagtgagtggagcattgtggaatgggggttagctctacattaactgcccaggcatacctggatatctggccctttcacttattttccggagttcaagtgaattgtgtattgcagattcaacactagaaagcccccatcacacaccacttgggtaaaaaaaacccccaaatttcagaactcctctcagataccaggactattcaccaggtcattaagaagcaacagatgctgaaggggagaaagaggacaaagtgccagcgagtccaccctgctgatcccgctgatctgcttggcttagagaagagctgtttcacgaaagaggagaaagtttgccaaatctactgctggttaagtttttttcccgaagcaaataaggtagagatgaatttcttgaactgccttgtttttcttgaggcggagtttcactctgtccctcaggctggagtgcagtggcgcaatctttgctcattgcaacctctgccttccgggttcaagtgattctcctgcctcagcctcccaaatagctgggactacaggcaagtgccaccatgcccagctaatttttgtatttttagtagagatggggtttcaccatgttggccaggctggtcttgaactcctggcctcaagtgatccacctgcctcagcctcccaaagtgctgggattacaggcgtgagcctctgtgcctggcttgaaactgattttaatattgtctttccagttgagcaaactgtactagacttatgctccaggatgctcagggaagggagcaaactgaagatttcaatgcctcacttgtttccgcgtttttttgttgttgttgttttttgttttgttttgttttttgagatggagtctccctctgttgcccaggctggaatggagtggtgcgatcttgacttactgcaacctccccgtcctgggctcatgcgattctcccaccccagcctcccaaggaactgggactacaggcacgtaccaccatgcccagctaatttttgtatttttttttttttagtggagacggggtttcaccatgttggccaggctcgtctcgaactcctgacctcaagtgatccacccaccttggcctcccaaagtgctgggattacaggtgtgagccactgcacctggcctgccttcttgtttcttagacatgccataagaaatctaaagtgctagcctggccattcccattcttggaggagattcacttccctgggatttttttaaagaaaaatttgagggccaggcacgatgggtcacgcatgtaatcccaacactttgggaggccaaggcgggcggatcatgaggtcaggagatcaagaccatcctggctaacacggtgaaaccccacctctactaaaaatacaaaaaaaaaaaaaaaaaaaattagccgggcatggtggcatgcgcctgtagttccagctactcaggaggctgaggcaggagaatcgcttgaacctgggaggcggaggttgcagtgagctgagatcacaccactgcactccagcctgggcaacagagagagactccgtctttaaaaaaaaaaaagggaaaaaaaaacttgaaatatgtcattttagaaaagtgatcacatatgaaataacagacttaagtgaattttcacaaagtgaacactcctctgtaaccagcacctagatcatgtagtagaacatgcatcctcttccagtcactccctccctccattcaaaggtaatcacagtcctgatttctagcactgtagcctaagtttgcctggttttgtattctttgtgaatggagtcagataagtctgtgttcttttatgtctggcttcttttagtcaattaaattttagtcattatatttgtgacatccatccatgttgtgtgtagcagcagatcattcattttcactgtatgaatgtgtgctatatttctccattctactgttgaatggactttaggattatttccagatttggggaattaagaaaagggctgtggtgaatactcttgcgaatgtcttttgatgagctcatttatcttacgtgtataggattagaattgctggttcatggaggtcttcatctgtctggctttagtgggtactgctaccagtttttcaaagtgaatttatgaactcccactagcagtgtttgggggttctggttacttcacgtccacaccaactcttgctattgtctttttaaaaaatcttcgttatcctggttagtttgtaggtggtattgcaatgtggttttagtttgcattacccttaaatgtacccttaaaacgtactgatatacattttaaatgtttatgggccagttagatttcctcttttgtgaagtacctattcaagtcttttgcccattttttttcactgagttgtgtttttcttatagatgtataggaattctttatatattctggatatgagtcttttgtcagctgtatgtattacaaagatcttgtctctctttgtggtttgcttgtgtgttgtgagctttggatttttactgccaggttagtggaactgtacaattgctacctgaaaaatgggggatctgaactgcttttgatcagtggtgggggtggttcccccactggtgagggtgaatttgatactggtaaggtggaccttattgggtctctgtcaagagtctgccacctctcaaagaatttgaggactgaccttgttctttttttgctttcaggtcgtggattcacagataaagtagatcgactaaaactggcagaaattgtgaagcaggtgatagaagagcaaaccacgtcccacgaatcccaataatgacagcttcagactttgtttttttaacaatttgaaaaattattctttaatgtataaagtaattttatgtaaattaataaatcataatttcatttccacattgattaaagctgctgtatagatttagggtgcaggacttaataatagtatagttattgtttgtttttaagaaaagctcagttctagagacatactattactttaggactgtgtagttgtatatttgtaagatgacagatgatgctgtcaagcaatattgttttatttgtaataaaatatacaaaaatcacttgccagcagtagaaaaaggaccgactataccgacctttctgattagtaaacagttgaatcaaggactctgga

SEQ ID NO: 1974 - DNA, 50951 bp, Homo sapiens; identical to SEQ ID NO: 1973

SEQ ID NO: 1975 - DNA, 1072 bp, Homo sapiens
ttgggatccttgacttgcccttagaaacctgaaaacttcactgggaagaccttgactacatacctccttacctacatgaggacggacactcctcctataataaatatagttaactttttacccaagagtttttctatagcatttctcatctctgaatttctcaacgtatatattaaaggactcagcatgtgtgtgataatggtataaaacacagtcatgaacttatcagtaggaaagtttgaaacaggtctaacatatatgaaaatacagggtacaaaaaagaggacaacaacggtactgccggagctgcaggtagacaaggctttacccctcttttcctgactgtaagttttaagggagcttaggatgactccataggagattaacagaaggttgaaaatgaccatacagattgctccactattgacaacaacagtgaggcctataaagtaggtgtcagtgcatgccagttccagtaatgggtgcatgtcacaactgaaatgaacaatgacattgggaccacagaaagggagactgtacacaacaatttgaaacgcagaatgtacaaaacctccaatcatggccaccaccaacagaaggaagcaaacctgtcgattcatgatggtcaaatagtgcagtggcttacagatggccacatagcgatcacaggccatcaccaccagaaggaagacctcagccccaccaaagaaatggtctataaatagctggcccatgcaaccttggaaggaaatagtctttttatcacagaataagcctacaattaacttgggagaaatggtagtggaatatgcagcatctataaatgacaggcaggcaaggaagaaatacattggggaacccaaggaagggctggcaataatatccaccacaatgagcaggttccccaccactgtcaccaagtatgtgagtaaaaacatgacaaataatgctttttgcacaccaggatcctgagaaaagcccaggaggacaaattctgtaatattgttattctgtctcatttactcttctttaaggcttgtatcagaggtgagagctcagggaaacagggcct

SEQ ID NO: 1976 - DNA, 2909 bp, Homo sapiens
ctagtaataacatgtttattcaaaatactaacactgttacattcttttcattctcagggcatattctactagagatgtactgtcctatgttttgaagtcacctggaagagttcttagtgtggttatatgactacatcaagagttttttacttttgatgattagggactgctttttaaaacttactttactccataatcttaaaatactcatacagttccacagtcacatttacactaacaaggcatatttgaagtccagctttcatccttgatcctgctactctaggctctcctttctcctaaagataagcattttcattatgtatcatgtttatcgtataggcatgaacacacgcgcggccccttccaggcagtcttcagtgatgtcacgtgttcccatggcacctgtattgtactcttatcagtcattatatggactttaacttccccagatattatttgggctcctccataagactgtgagcatctgaccactggagtgttgcttcccattatatccctgttatcaagcacaaggtcaggcacagagtaagactcaaaacatgttttggaatgtatgactggtatgaactacaaaccagtaagctgatgttttcattttgagtctataaatctaattttgtggtggttttgtgtatggctcaaggctcaaattgtaaaatttaatattatgtgaccaaagaaagttatacccagaacctcaatttcctcaccttcaaaatggggcagtttctcactcattggtctgctgtcacgattttaatgagctcatgcacaaacagccctttatataaggtaagtgctggataaatgttggctactataataaaataagcctctaagatacttggtcagcacaagtactacccaagagtatgcactgtaagtaaactgacaaaattgtgtatctaaaactggccagatgaaagagaaacttttaaggggcccttctgcgtgcccgacactgtgctaggcactcacactatcccgacccgagaaaccgatctgcgacccagaggaacttaccaagcctccagcatcttgtgcagccctactcatgggaccatctggatacccacccttgtctttacagggagcagaacacacctcttatgtgtcagaaaacaaagtccaggaagtatatttttacctgaggcaatatctgaaaattgtatgctacagcctccaaagtgagtcttcctctcagtacctctcttctaggcacatggagccctttcttccaagtattatgtttaaccacttaatgaatgaagtcctgaaactgcttacccatgctccctataatctctgagtaatcttccttttccacaacctcaggcataatctcatcttctgtttctattacaatttcaaattctggaaaaaggaagttgtggtctggaattatatggtccagatgatctgaaacaaaaaggacagcactattagtaatcatttagttttgaagacagtctaataatttgctgtctctaaagtactatattccctatagttctggcattttagataaagggtcataaattaaatgcctatatggtgacattattcagtgattcagacttcacagccttttttttttttttacaaaggtgttccaggcatgaaaaattttaaagtactatacctttcctaattttacctttaaagttgtcctggaaatatctgggttgacaaaggcgatgaaactgaactgagacttaaaaaaaagattacccacctggttgtgcacaagcctgcttatgtcccaatctccagtctagggtctgatgctccttgctgcagtaatatgctttgtggcatctggagcacgttttggggcctaaacagccacaaaccctgcagagatgagcaccagacttaagctggagacacactgattctcctgtttctgggggaggattctcagaaggtggctcatatgagtaaaaatcgtttttcctgggtagttgattcctaaaaactaaaaaagaatacagagaaaagttttatcttcaaacaaaacagcaattcacatattttatcctctgcacgtaaaactgaaaataacaacaacaaaaaagaaatgaaagtttttgctttcaggaataagcttttaaaatccagaaactagatttcgtccggtacacgcaactgagttgcctcctagaggtggtttgagttaatcaaattaataagactgatcgttaagaacgactgccaaaaatacgaaaaagctactgggatccatctttccaagacaatttctattatctgaattaacaccatacctggtacccactgattaaaagctgggggttaccaatgcgcgtgggcacagttagaagcttatgtagcaaaaatgagcacatcctggaagggcccgggagaaggtgctcctggggcagcgcggagagggagctctgaggctggggcggcagcggtgcttgccgccgtccccctggtcgctcccggaattaacgccgcgcacgcgtcggaggcatggccccgtcccgaccccgtttggcggctcacctcgcaggccggcacagcacggctgctcgcggcagcagaagaggaagatgcagcggtggaaggcgtccgggcggccaggcagcggcgcatacacctgcagcaggaaggagagcgggcggccgcacagctcgcaggccagggcctggggccccggcagcccggccgcgcccagccatgccggccgcccgcccaccttgctggggaactgctcgctgcgcagtcgccacgccggcgccgactcggcgaagcccagctccacaggcctggccccggcggcagccatgcggggcgcgggctggcgtggggcgcagcccacagctgggtcggaaggcggaaatcgggcgccgggccggaag

SEQ ID NO: 1977 - DNA, 2909 bp, Homo sapiens; identical to SEQ ID NO: 1976

SEQ ID NO: 1978 - DNA, 9084 bp, Homo sapiens
ctaaaggcaacttgcttaatgcattttttaatttaaattttttatgttgtacagtttattttaaatatagttgctattttttaacacagatgccaagtcggtgctgtgagattttctttctggtgatttggaccagtttgtctccctcttgatatatccatcccaaatggaaaggccctgtaaactgttacgatcatctccagaggttaactggaatatacaccaatgacagcttgcctgggtatgccaaaatacctgcaagaatgtccacatcatctggtgatgtccccaaataacagtttttaccatagaaagatcgttaacatgtttgctttaaaagtcattagcagtcataacgtacttacagattctgcctataaggaataatacataattttagatataaaggccccactagtccaggtttccttatgccactgtgcttcctactaagtgttgcgaccagctcttgtcactagttgatgacaacttactccagtagccacagggctgtgacaccatagttataggtgattttcatagatttagccatcccaggttcgaaactagtatcctctagctcttaagtagctgataacctccccatgggagaaactccatactgcagtttcccatatggtgctatgtataactatcttatacaattaatacaaattgcatatgtatacttatataatatggactactaggacagaactttttaaattacaaataaaatagccaagtagacaattacattagcaagtgatgttacctatgaaaacgtgaggatttatggtggcaatgcatttcagttaacagggatgtgttaggggacaatgtgagccaatgtagattaaggaaataagcctgagaaatttatcagaattagccgtcagtattcaagcactgatcaacagcaatgtgtcttaagggcaggcatcactggtgctgagagaactgggaattgtcaactgtgagctgctaggggatggaagaaaccttagtgtagtcttaggagccgcttgcttaaacagatgtatcagaaacataataggccaagggtcagccctttgaaaactgacttcagggccttcctttcctcaggctgctgcctcctaggccagacccttattttggcttacattccataacccttgtatgtgcgatagggaacctgtatacaatgctgacacggaaagggaagaccatcgccttttgcctttcagtgtctcatctgtaagcagggccgctggctgaccaagatcagttctgaaggtccagcctctttaaattccagttctgtgatcacaaagccactgttgttcctcatcctgccaactgtgatactgctgcttcagaattactgggtttcctgttcatcatactcaccaacctgaggtttggtatttctcaaatattctgggcttccagtacatactagagcctgtgataatcagctaatgatcagacaagtttgttgggagttttacctaagtatttttgtgttttaaaaacctagggtgggaaatgctcagagtgagatggtttgacttcattaggcatataacccatttttattataaaaagaaatgcacatataagtaaaaagaccattttagttagtcccaccattcgttggtaaccagttcactaagtgtacatctttgcagatttctgtgcatacatacaaatatttttacaagaataggatcataccatgaataccacctataatggtatgtctgttgtcaatataggtgttataattaagactgtgtagccttcctctgtggatgtaccaaaatttatttaattccctgtcactggacacttttgtttcactaataagtagacactgtgtaagcaatctgtcaacatctctgcacctctatttttggtataagtatttccttaggataaaatcccagaaatggaattgcaaggtataaaagattattaacatttttcaaggctttaagatgcctttacggtgtatctgttacatcctgcttccacacaaattcttctgtatagccagtacccaagctgcagctctcagcacaggtgaagacagccaggatgccccagtcaatgctcttgcccagtctgtcagccttcaggtagtttaggagctgaggcatgacctgagaagagggtgacacacagttagaaagctgcttcacagcagggagcacgagaccttctcagccaggatgattatagggatcttggtctttcaatcctcatactacaaagcaggattatagacattatacaattaacatgtttaacaatctaaaacttccttatgacttcaaagcccctctcaccttctgtttggtcttttccatttgagaaagaagttcacaagtggctgttaatgaattattttcattactaatatgccactcaaaagggctgaggcttctatttgggcaacttttactttgtatcattgcagatgttgttactcttgactcaagaaacactaattactagtaatgaatacagaaaggacatctatcaatgtagttatagagaccagagaggaatcttagaagtagtctaactcaaagagtgaataggcagaatagccacctgatatggaatcactttatacaaatcctgtcacctcaatttggacattgagagctttggcactaagaaccaagcagagttttgtgtatggtcctcataattccttttttacccaaagaaacaaaccaatattagctatgactttggtaaggttagtgaatccatagctcaagagcatttccaccctacccaaatggattttgatgctaacaaatccttttgggcagggaaggacatttatctttaatgcttatatccattttttctaacaaatccacaaaccaagattaaacagtaaagactcctctcataaagtatatagtcaaagactttaattactagaacaagaaaggaaggtatacattatttaaaataacaaaagttaacagaggcactaataataatgacataaccacactggaggtggagagcagtgtagatatcctcattgtcacagaagtcagtcaatagaccgtgtctgaaaactaggaaacagaaaaaaacaagacagttccttccagggaactagccccaaggtgaggcaggaaactgatgattttcattatagggtacccttccatactgccatgttgacccatgtgcacaaattaccttggtgaagtttttaatgtttaaaaacaatcatggtgattacacactaaatggtccttatttaaggtcatacctggaattccaatattctcttggcaccacaggggcaatctggaatatccttttcttgaggaatattttcaccagaaatccagatgggggcaatacctctgccatatctaagaatctaaaatcaatgaagatcatgttcaaataatcaataccttacctataagttgccaatggtaacatgctatctactccatgaatgttcctactcttgatgtagcactgacccaaaaggcatgtcacagttcccccatcagacctggctgtaccagtgtgccactaatgccttctcaatcacctcaaagtgattatttcagtttatctgactcagagggcatcaaaatatatctcccagatgatgcttttactacctaatgttggcaacttaatcctatgaatatattgtgaagggactaagaatgagcctctgctctaattgcagaattctgcccagagtctgtgcctaccttcatagttaaaaaattttaggagggacaaataccaagtgaaacatagtgttttgaaaactactacaaacataagtaaatttcactgtaataagcttcctacagcaactgagtggttttctgtattttgtctaaaagcatatgcattgctaaaaactgccttagtgtttaagacctagatctattcttcctgtgtatttatttgaaccagtgactggtttatgggagtttagttttctttcgtgatttacgtttatggtaggggaggttaaggagaaaaatgttaacatgtcacattttacaagccaaagttacctgttggaaatgggcaaaaataaccttttttctttctggcgggggggccaatggtgcctaaacctcatgtaccttaggcaacatctcattcatctcccatccctgatgcttgctttagaaaatgaaccctgtatgataaacagtataacctttagtcttttagtaactattaaatggatcagcactgcaaaacacctttctacatggcccatctgtgtgaggaactcctctaacaagataacaaaagcctgcttttataggctcctaaggaacagactaatgttactatgaagttatttcttacagattatactcataaaacatggcctgaagagaacacgatgaggagctatgagctccactttacctgttctggttcaagggctatctgagttttaaacttctgaaaaattttatcttccctggattcatgttttgccatggaatccagttcttcctcaagtgcttcacctgaaaaatcaacgtaactattatgaaaaacaggagtaatccccacaacttgacaattcacacatggagaggggacccacttttaatcagatagctttccctatttattcactcattcaagttggaccatctgaatttccaggtactccatccaactctattatatggacttccatttagtgcatctccttaaagcttcaaaataacagaatggtcaagggcttaggactgcccagcacatcacaggacacccaacaaatgtgagcccttatcattagtatcctcagctggtaggctcactcactcagtcatcaagtgttcatttctggcctggagcagtggctcacgcctgtaatcccagtactttgggaggccgaggcgggcagatcacctgaggtcaggagttcaagaccagcctggccaacatggtgaaatcccgtatctactaaaaatataaaaattagccagacgtggtggtaggtgcctgtaatcccagctactcgggaggctgaggcaggagagtcacttgaacctgggaggcagaggctgcagtgaaccgagatggtgacattgcactccagcctgggcgacagagtgagactccgtctcaaaaaaaaaaatgttcatttccttctccacattccttcctgggattacagccaccctaagccactgctgtccccaacagacccgtgtctctaagtataaccattagtctttgtaatgtacgttaaaatagaactgatataccttgggtcagagaagctaaaataactgctttgatgaaactggaaaggcactgatggtgttcacttgcaccatcaggtctgatggaggaagtgtaggatgccttcagattgatgttccatcaagtatacgtggaaagtttcagtataaccgttaggacactgtaaatgctgttccctcaggccctactgcctcctgccaagtctcaggtaagacacagctacctccaggaagcatttttctattcaattctccttttattttagaaaattttggacatacagaaaagtggaaatactataatgaaccgccacatatcattaatcagtttcaacactatcaagtccagtgtttcctttctctgccacttccacctccattactctgaagtaaattccacacatatcacttcattcataattaagttatgtacccctcgaaggcaaactctttccttttatttaccaatttgaaaatgagtctgttcccaagtatcctataaagatgattactgagtttttttaaagtatcattttgaacccattaaacatatctgatgcagttagcgtccttgtggatgttcaaactgtccatcttttgcaagcaggagccttttcatgttgcttgagttctgacatggccctagtaatccttatccttaatctttgatatgaccatgttcccacattatatgaacgtttcctgacctagttctggaatcaaccacctctccaaagagcctggagttccttttagagagaaatggtacgtagacacaatcaacattatcttcctcctacgcccaacatctcagttctcagtaacaccaacataattactcgtttcctttccccccaatacacacacaaccatctcaaaataaaagcaacagtctagtaataacatgtttattcaaaatactaacactgttacattcttttcattctcagggcatattctactagagatgtactgtcctatgttttgaagtcacctggaagagttcttagtgtggttatatgactacatcaagagttttttacttttgatgattagggactgctttttaaaacttactttactccataatcttaaaatactcatacagttccacagtcacatttacactaacaaggcatatttgaagtccagctttcatccttgatcctgctactctaggctctcctttctcctaaagataagcattttcattatgtatcatgtttatcgtataggcatgaacacacgcgcggccccttccaggcagtcttcagtgatgtcacgtgttcccatggcacctgtattgtactcttatcagtcattatatggactttaacttccccagatattatttgggctcctccataagactgtgagcatctgaccactggagtgttgcttcccattatatccctgttatcaagcacaaggtcaggcacagagtaagactcaaaacatgttttggaatgtatgactggtatgaactacaaaccagtaagctgatgttttcattttgagtctataaatctaattttgtggtggttttgtgtatggctcaaggctcaaattgtaaaatttaatattatgtgaccaaagaaagttatacccagaacctcaatttcctcaccttcaaaatggggcagtttctcactcattggtctgctgtcacgattttaatgagctcatgcacaaacagccctttatataaggtaagtgctggataaatgttggctactataataaaataagcctctaagatacttggtcagcacaagtactacccaagagtatgcactgtaagtaaactgacaaaattgtgtatctaaaactggccagatgaaagagaaacttttaaggggcccttctgcgtgcccgacactgtgctaggcactcacactatcccgacccgagaaaccgatctgcgacccagaggaacttaccaagcctccagcatcttgtgcagccctactcatgggaccatctggatacccacccttgtctttacagggagcagaacacacctcttatgtgtcagaaaacaaagtccaggaagtatatttttacctgaggcaatatctgaaaattgtatgctacagcctccaaagtgagtcttcctctcagtacctctcttctaggcacatggagccctttcttccaagtattatgtttaaccacttaatgaatgaagtcctgaaactgcttacccatgctccctataatctctgagtaatcttccttttccacaacctcaggcataatctcatcttctgtttctattacaatttcaaattctggaaaaaggaagttgtggtctggaattatatggtccagatgatctgaaacaaaaaggacagcactattagtaatcatttagttttgaagacagtctaataatttgctgtctctaaagtactatattccctatagttctggcattttagataaagggtcataaattaaatgcctatatggtgacattattcagtgattcagacttcacagccttttttttttttttacaaaggtgttccaggcatgaaaaattttaaagtactatacctttcctaattttacctttaaagttgtcctggaaatatctgggttgacaaaggcgatgaaactgaactgagacttaaaaaaaagattacccacctggttgtgcacaagcctgcttatgtcccaatctccagtctagggtctgatgctccttgctgcagtaatatgctttgtggcatctggagcacgttttggggcctaaacagccacaaaccctgcagagatgagcaccagacttaagctggagacacactgattctcctgtttctgggggaggattctcagaaggtggctcatatgagtaaaaatcgtttttcctgggtagttgattcctaaaaactaaaaaagaatacagagaaaagttttatcttcaaacaaaacagcaattcacatattttatcctctgcacgtaaaactgaaaataacaacaacaaaaaagaaatgaaagtttttgctttcaggaataagcttttaaaatccagaaactagatttcgtccggtacacgcaactgagttgcctcctagaggtggtttgagttaatcaaattaataagactgatcgttaagaacgactgccaaaaatacgaaaaagctactgggatccatctttccaagacaatttctattatctgaattaacaccatacctggtacccactgattaaaagctgggggttaccaatgcgcgtgggcacagttagaagcttatgtagcaaaaatgagcacatcctggaagggcccgggagaaggtgctcctggggcagcgcggagagggagctctgaggctggggcggcagcggtgcttgccgccgtccccctggtcgctcccggaattaacgccgcgcacgcgtcggaggcatggccccgtcccgaccccgtttggcggctcacctcgcaggccggcacagcacggctgctcgcggcagcagaagaggaagatgcagcggtggaaggcgtccgggcggccaggcagcggcgcatacacctgcagcaggaaggagagcgggcggccgcacagctcgcaggccagggcctggggccccggcagcccggccgcgcccagccatgccggccgcccgcccaccttgctggggaactgctcgctgcgcagtcgccacgccggcgccgactcggcgaagcccagctccacaggcctggccccggcggcagccatgcggggcgcgggctggcgtggggcgcagcccacagctgggtcggaaggcggaaatcgggcgccgggccggaag

SEQ ID NO: 1979 - DNA, 18539 bp, Homo sapiens
tggcggaagtgacattatcaacgcgcgccaggggttcagtgaggtcgggcaggttcgctgtggcgggcgcctgggccgccggctgtttaacttcgcttccgctggcccatagtgatctttgcagtgacccaggtaacagattgtactcttttctgacggttcgggcgaaggccaccactgcactgaggcctgggggcaatggtggggaagagactaggaattggcgcgcgtgcaggcccctcgggggacgttcctccctttcgtgctgccgccgttccggcctgtaacggccactcggccgccactcccgcctggtgccctactctgctgtgtttcgcaggcagcttcccatcgtacgattgtggggctcagggtactactggctggctgggcggcggcaggcgggacaggacagtcccttgcatcgaagaccctaagtttaccctgccctgtcctgccatccgcttcttctccatgttagaagcagattcacccagatctgtgcccgcctgttttgctgccaacattgagacttaaatattttgtcagaagcctgagacagcgggcacggtagcgcttaagatataatacacaccactttatttgcagggtctcccgtctctcggttcaggccatcatggttttccaaatctctaggtagacttttctgtgaaaagactgtgcttcatttagttatacagacactagaaggctatgcagaattaatttgattgcctccaaaaaatatcggatttgatgtttcaatttccaggagatgaagatacccagcaaacaactcttttctgaggataaattagtgcagtaatcactgtgcggtttcttctgtagacttacttgcaaaaagtggcctgaagccaccgaaggtcctggataaatctctaatcatacttataatggctttaaatcctgccgtcattatctcttgcctcaaccttagattcctgaaacgaaacttccgtcctccagttttactcctctcaaattcatctagtcttgccaaattagatctgttcatactgcacttccgaaattccataactgttattattgcctatgcaataacattgaaaactcctgatagtatgagcccaccaatatgtgctgtctcatctgctgcagtgaccttctatacagtcatactaagcttgttgcctgcatactgcatgctttttcaatctgtctctttctgcttgatttctcttttgtctgaagccctgatgtgtaaattcctactcaccttgtgagacccaagttagatggtccctgctttgtgaaaacactgcgctctcttcacagtgattggctgttagtctatattgtcttctcttccaggggtgtatatgggctcattcatgatcacatactgtattccaggcatagtgctagatgcagagatcacaaagacatgtaggctggtttctgcattcaaggaacttagcttagaccatacctgctgttataatactatgttttacagtagttatttgcatacccttcatattgaacactttgatgccaaggactatatcctcctatctttatatcctcatctgcaggacttctgttattgttattataggataactgtcaaaaaaaaagtatattttaaaaaatatctctgatatatttatttccagaagcagagcttgctttcttttttggtctgtttttcagtgatgagtatgtaggatagatagtctttgggggcctttgccctttcaaagtgatcgtcagagtctttcatacattcagcaaatatctgagtgtctgttctgtaccagcacatgcttgaagtgcatatgcctgaaggatctttggacatataatttgtaactttgagacctctaagttctatgtgagaatatgttgttataaactcatttcagatgtgtagtgagtaaagcgatgatgatttaagaaaagtcagataacaggcacagtttgcattaatgtgttctaaagaggtaaggttattacatttataaaaattcagggctttatctttgtgcggcttttttttttttaacagtttcattacagtaggagcttgataaatgatcactctgaagtatattggattgaatttgatatttacttaattttttgcccaagacattgtagaggatgtaaaattggaatatttaaagatctaaactttgcctaacagtgctgtgtatacagtgcttagtgaatattctgctctgatattacattttgcttaggaattatttttctctaggtgtttttcctcaaaagtttttaatgctggttatgacagctcgattttgagcattttccgattatttaaacatgtaacaaaatgatttttgttttgttggcgattttacatgcaatcgccggaaacatggaaggaataaaactttaggattataaggtaaaaacaaatgtattccaaaatagcttcattggttttcatgtttgtgttttgtatagccatagaactggcttataggactgtacaggttacctggatccttaaattaaactttagacttttttccaaagcagcatcactgtttcttggcgtgtgaagataacccaaggaattgaggaagttgctgagaagagtgtgctggagatgctctaggaaaaaattgaatagtgagacgagttccagcgcaagggtttctggtttgccaagaagaaagtgaacatcatggatcagaacaacagcctgccaccttacgctcagggcttggcctcccctcaggtaatatagcaggagggagagaatagggagggcggaaatctgaactgcaagagatggtatcaaaaggcaaggaagggcatttaatgatctgtttttgaaaatggtttaatatgttttttaagccttattttgttgagaagttctattaggctttgaataggcacaatggtgtttatttgggaagtctggaagctaagttatatatttatgaaacacctaatcttttgataaacacttatgagaatgttccaaatgactatatagggtctttgattttgaaaatcaccctcaccaaattattttctagttttatttttccccttttacatttcaagctctcaaccacccatctactttaaaaatttttcagcctgggtgcagtggctcacgcctgtaatcccagcactttgggaggccaaggtgggcggatcacctgaggtcaggagttcgagaccagcctggccaacgtggtgaaacctcatctctacaaaatatacaaaaattagccaggtgttgtggcgggtgcctgtaatcccagctactcgggaggctgaggcaaggagaattgcttgaacccgggaggtggaggttgcagtgagcagaggtcgtgccactgcactccagcctgggagacagagcgagactctgtctcaaaaaaaaaaaaaaaaaaaaaaaaatcaataacttttgttgaaatatacatacaaaaaaactcattttaagtgtctgttttgataattatatataatgtataaattacagaacatttcagttaccttaaaaagtcccttcttcccctttatagtcactctgctggccccaggtaactactgcatctgcttttcaatgctgaagattagttttgtctattctagaatttcatatagatggaatcagagtgtatgcttttttgtgtatgtctgacttcttagcccagtgtactgtttgtatatcagtagttaatccattgtatagctaagtatcactccattgtttggatgttccacagttcatccattctccagttgctcacatttggggtctttccagtttggagctattgcgaataaaagcactgtaaacatttgtgtagactttgaatgcactgtttttacttctcatgggtaaatacttaggagtaggattgctaggtcctatattggtatatgtataactttataagaaactgccaaactgttttttgaagtggctgtattgttttgcagcataagagatttaagttgctccacatcctcaccaacactttctgctgtcagtctttttactttcactctagtgattgcttagtagtatcttattgtggttttgatttttatttgcctgattactaatgtttctgagcaccttggcaagtgcttgtcagccactcatacacaggcccacctcactttactgcacttcactttactgcatgtttgacaaattgaaggttgtggtaaacctgtacccagcaagtctgttggcattatttttccaaaagtgtgtactcacttcatgtcttggggttagattttggtaatttttgcaggatttcaaactttttcattattatccgttattgttatcaaacttttttttttctttttttttgtattttttttttaattttttttttcagtcactctgttgcccaggctggagtgcagtggtgcagtcttggctcactgcaaactccatctcccgtgttcaagcgattctcctgcctcagcctcccaagtagctgggattacaggcatgcgccaccacacccagctaaattttgtatttttagtggagacggagtttcaccatgctggtgtcaaactactggctgcaagtgatccatccgccttggcctcccaaagtgttgggattacaggcatgagccactgtgcctagtcaaaccttttcattattatctgttattgtgatcagtgatctttgatgttactattgtaattattattgaatgccataaactgcacctgtataatacaggaacttaattgataaatgtctgcagcgtgaccaaccattcccccatctctctccctctgcttggtcttccctattccttgagacacaacaatatggaaattaggctaattaataaccttacagtgacttttaattaagtgttcagatgaagggaagagctgcacatctctcatttgaaaccaaaagctataaatgattatacttagtgaagaaggcatgttgaaagctgagacaggctaaaagctaggcctcttgcaccaaatagttagccaagttgtgaatgcaagggaaaagttcttaaaggaaattagaagtgctactccagtaaacccacaagtgataagaaagcaaaacagccttattgcttatatggagaaagtttgaatggtctggatagaagatcataccacccacacatccccttaagccaaagtgtaatacagagcaaggccttaactctcttcaattctgtaaaggctgagagcggagaggaagctgtagaagaaagttttgaaactagcagaggtttattcagagctttaaggagagaggccttctccacaacataaaaatgcaacatgaagcagcaagttatctggaagatctagctgagataattgatgaaggtgactatactaaataatagatttttaatgtagatgaaacagccttctactggaagaagatgctatctaggacttttatagctagagaggagaaatcagtgcctagcctcaaagcttcagaggactggctgactagttaggggctaatagagctggtgagtttaaattgaagccaatgctcatgttctgctctaaaaccatagagccttaagaattacgctaaatctactctgcctgtcctcagtaaacagaacaacaaaacctgatgagagcacgtctgtttacagcatgatttactggatattttaagctctttgagatctgctcagaaaaaaagtttaatttcaaaatattactcactgacagtgtaactagttgtccacaagctctgatggagaagaacaaggagattaatattgttttcatgcctgcttaaataatatatccattcttcagcccatggatcaaggagtaatttcaactttcaattcttactatttaagaaatacagcagggcatggtggctcatgcttgtaatctcagtactttgggaggccaaggtggaaggatcactcaaagctaggagctcaagaccaacctgggtaacaaaacaagtccctgttgctacaaaaaaaaatttttttttaattagctggtcatggtggcatgtgcctgtagtcccagctacttgggaggctgaggcgggagggtcacttgagtccagaagttaaaggctacaatggagaccctgtctcaaagaaaggaagcagggagggacatatgctgtagctgccatagatagtgattcctctgatgaatctgggcaaagtgaattgaaaaccttctgaaaaagattcaccattctagatgccattaagaatgttcatgattcatgggaggagggtgaaatatcaacatgaataagagtttggaagaggttgattccaaccctcgtggatgactttgagaggttctagacttcagtgctggaagttactgcaggtgtagtggaaatagcaagtgaactagaattagaagtgaacctgaagatgtgactgaattgctgcaattttttgataaaacctgaacagatgaggagttgcttcttgtgagtaagcaaagaaagtggtttcttgagatagaattgactcctggtgaagaactgatgactttagaatattacataaacttagttgataaagcagcagcagggtttgagaggattgactccaattttgaaataagttctagtgtgggtaaaatgctgtcaaatagtatcatatgctacagagacatcttcagtgaaaggaagagtcagtcagtgtggcaaacttcgtcagtcttattttaagaaattgccacagctaccaccctgatcagtcagcagccatcaacatcgaggcaagatcctctgtcagcaaaaagattatgatttgctgcaggctcacatgattgttagcatttttagcaataaagcatttttaaattaagttatatacatattattagacataatgctattgcacacttaatagactttagtgctaacataacttttgtaggcactgggaaaccaaaaaattgatgccgcttgctttattgagatggtctggaacctaacctgtagtatctccgaggtatgcctgtatcttcatttgtaatatgtccttcacatcttttgcccttttttattattttatttgttgatcttcttttatggagttgtcagagctctttattattctgtttaccagtcctttctcagatgtatgtattatagttatttttttcccagtctggcctgccttttaattttctcaatggtgtctttcaaagaacagaagtttttaatttttccgaagttcagtttatccatttttcttcatgtttatccactgtgtggtattaaagaagaaagcaatgtgtataagaatagctggttcttccgtaattaatgtttaataaccccattattctccgaaggcatctgtctttgcacacctgacctgctgttccaccaagaaagttccacaaacacttagcagcagccagcctaacctgtttttctccttgctttccacagggtgccatgactcccggaatccctatctttagtccaatgatgccttatggcactggactgaccccacagcctattcagaacaccaatagtctgtctattttggaagagcaacaaaggcagcagcagcaacaacaacagcagcagcagcagcagcagcagcaacagcaacagcagcagcagcagcagcagcagcagcagcagcagcagcagcagcagcagcagcagcaacaggcagtggcagctgcagccgttcagcagtcaacgtcccagcaggcaacacagggaacctcaggccaggcaccacagctcttccactcacagactctcacaactgcacccttgccgggcaccactccactgtatccctcccccatgactcccatgacccccatcactcctgccacgccagcttcggagagttctgggattgtaccgcagctgcagtgagtacttcgtgttttatgtttcctcccacttaggagtccctttgagttatgttcctgctctgttttcagatggatccttttattaagggagggagtggcactaacggtaattgtgtatcaaaatttgctttatctcacatttgggaaagggaagcaaagctatcttagtcagtgtcctcagtaaaaggctcttaacaggtttagaaatgtggtcatttgtgtttacatacctgagccaataaaatttaatctgactttcactgtcgttattattatattatagacatttccctgtatctgatatcgctaaatcacaatgttaggtagtctctttcccttatgctattttaggtctttagtcacaatatcagtataatttctggtagttcttgttttttgtttttactatgggtgctgcatataaatctttgaaggtctgtgtccttcccacaaaatgaagacgactgtttttgtcataaatggatttttctacctaaatgaagtgggttctatatgtaacagtgtagtaggggtaggaaataatttcatcttcctgaaaaaccagcaaatatttccaaataattccagtcaataagaagtgtatagcttttcattttagaaagcttatgaccaaattaaaaggttacttgcagtctctgcatctcctcagttttcttgtacagataccttcctccttcatactccctttagatctagtatttcctatttgcatttattcaccttgttacatatatggttgttgtttataagctatctctcatcatttttggaactaagtggtgtgtaatcgtggatgctgactttcacccaaagacctaaatcttgcctccacaattttgtttgaccccacacacaattttaaaaacaaagtaattttagtgattttagagagagccctttttagctcacccttgtctataccactcccatgtgtccagcatgcttgtctgactcccaggaatatttaagtttgcatttctgatttaaataataaattataaacagtacagtcaggtgtttgtttcttgcgagtgcctttgctgttctgatactccccagagcatccagtcatccacattcctgaatttccactatctactaagaaccctcccgggtggtagttcagtgccctctccatcttgtaggcttaagagggattaaggtaaatatttaattaatgaaaatatataagaatacatttaacaattatgtgactaaagttgtgatagatatactaaaatctacttggtatagttcataagtggacaaatgctaaaggcaggtgtgtatacaagggtgattggaaggaaatagatgatatggaaatgaaaacattcattgtgtggatcaacctaattggctttacagttgtgtatcatagactgtacaagaaaaagaaccagaagcaacaatgagctgaaacctattgtatttgaacctatgtatttgaaatctggactcgatattcttgggatggtgatttccaggtccatgcgagacagttgttgagcagttaattgcattcaaagggcattgcccatttcaactatatatactttcataagcagaaaaatgtataatgaaaatgtgggtttgttgtttaaatttttattaaaatttctaatagagttgctttttagtatatctttatccttgtataagttattcgttaagtgatttaagaacactgagaaatgaaaagggtcagtggacccagatggctccatttatccttatttactgagagttaattagaagagaaagcagggttttgccttttttttttgctaaagacacttagctcttgtttttcaaaagatacttactttgagagaactgggcagttcatgcctgcttgttttcattataaatagttacttaggaatagggtggtggtggtagcttttcagagctcacagatgagaattgagtttgtctgtgagaaggctaagggcaggctctggagacagacagactcaaatcctggctcctccacttgggagccattgcgtcctgagcaagttgcactctacctttaagcctcagcttatttatccaaatgtgggaatactggtaacttctacctcagtgcgttatatgtattaaatggaataatctatataaaatgctcaacatgtgcatgatacttgttaaacaataaatgtgagcaattaaaaaaaagtaaagcctggttgaaataatcagatgtctgcataatttctaacgcctcatccaatgaaacttaagtaatttaaatagtcgtgttttctttttaaatctcttacagaaatattgtatccacagtgaatcttggttgtaaacttgacctaaagaccattgcacttcgtgcccgaaacgccgaatataatcccaaggttagatctattttaatgtatttcttttttttttcttttttgtctcctctgccgtgtctctatattttaatgtatttcacgctataaaacaaatgtctgtagatcaggccaggcacagtggctaatgcctgtaatcccagcactttgggaggctgaggaaggagaatttcttgaacctaggagttcaccaccagcccaggcaacatggcaagaccctgtctcttaaaaaaaaaaaaaaaattggccgggcttggtggctcacacgtgtaatcccagcactttgggaggccgaggtgggcggatcatctgaggtcaggagttcaagaccatcctggccaacatagtgaaaccccgtctctactaaaaatacaaaaatttgccgggagtggtggcatgcgcctgtaatcccggctacttgggaggctgaggcaggagaatcacttgatcctgggaggcagaggttgcagtgagcggagattgcgccattgcattccagcctggcaacagagcgagactccgcctcaaaaaaaaaatctgtatatcaaagagtttgtgttatgcttattccttgacaccaataaaatgaagatctaaagtaaaatgtgcattgttttgtatcttttattgagtgtctgtgatataagaatccctgggagtacagcagtctataaaataagctaagttatatatgtattgtattgggatcatgtgaagaattttgtatatgtatagggatgatgttagccagctatagtaggcaaagtaatttggataaacattagctgggttgagagaaatgttaagtaatggacttagggtgcattttaaaatccctgaaacataatgcctgagatctgaaagacagctaagggtctgaaaatcaccttttaaccactcataatgagtctgtatgacatgtagcattctaagaattaatctttcatctattataatcacatttagttgaatacataattttattactttacgttcttaagtgatatttaaccaataaaaatagtagaggaaattctggaaattcaaaatagctaggcttttcctgggacgtatataaactactatatactgctagcttttttagatgttgataaaatcacagggaagacatagagcaggttttaaactaaaattgttaaaagccaggcatggtgactcagacctgtaattccagcactttgggaggccaaggtgggaggatcacttgaggccaacagttcaagacgagcctgggcaacatagcaaggccttgtttcatcagaaaatttaaaaaattatctggggttggtggcacacacctataatcccagctacttgggaggccaagacagaaggatctcttgagctcaggaattcgaggctgcagtgagccatgattgcaccactgcactccagtctgggcaacaaagtgagactcttgtctctaaaaaaaaaaattaataaaataaaaaaataaaattgttaaagcaatctagtttgtcaaagagtcgtcttaattagaaacatgtaggtttttattgtataattaaatgtattaaaatatttaagttgtttcaaagtaattatttgctttttatcatgtacctaataactgaggccattaattcaacccacagttgaaatattttccccttgagttaccaccttagcaagaaaattttctgaaagaattaacatgtttcaagcataaaaagcagaaaataaaagttaaaactgtgtttttttcctaatttgcatttatgtgtttaatacattaatattgtttctaaagaccaattgaaagcatgattttacttcattacgtattgataggcttgtaatctgatttattaattccattaaggtagaaaaggtttattggtttatttgcctcaaaattcatattaataaaacaaaatgtatcagagaagctatagtcatgataagcagcaaatataaagtagaaacagaagcacttgtatttattgagaacataaccaaattttgcaaacatttctcttgatggaatgctcatgtgaaagaacatacagatttggtataacttagtcacaattgattattttctgctccttatgcaaaggaatatttgttacatgtggtgtatgcaaatcctttacagatatacagaaatacagaacaaatattttgataactagatgtactatgtccttcctaccagttgtgatttttttgtcaatgggtggttcgcctaacaacattgagcagtttggcatgacctcactaatgattctctctgaccattgtagcggtttgctgcggtaatcatgaggataagagagccacgaaccacggcactgattttcagttctgggaaaatggtgtgcacaggagccaagaggtagccgtaagaaattcattcttctggtctatgggttatgaatgaaaaggtgatatctcattgtttttaggttattaggttagcactttaacatgttattattgctttcttataaaaaccattttaatatgattctattaattatttttatttatttatttattatttgattctattaatgttagatagcagtgatttcattttcttaaaaattagatatgggcaggcgtggtgtctcaccaaggcgggcaaatcacttgaggccaggagttcgagaccagcctgaccaacatggtgaaactccatctctactaaaaatacaaaaattagccaggcgtggtagtggatgtctgtagtcccagctacttgggaggctgaagcacgagaatcgcttaaatccgggaggtggaggttgcagtgagctgagatcatgctactgtactccagcatgggagacagaacaagacactttctccagaaaaaagaaaaaaattaggtaagatgtaatacaacatcagaactattaataaaattccctttatgtgaaaaatgttgtaaataacacaaatacatcttgaaatggaagaaaaaattgatcaagaattaaaacacttctaagctaatggtgtaagggctttgcagaccttattgggcctggcagcgtgacagcatcacatgtgttggctgcagaaacctgccttctcactggaactagctttcattaatagtgtttgagttgtgcagatcttaaggaatgcacccttgttataaaatgtcattgcctatattctccatctgaagtgatcctgtctgaaggttagtactctgcggccctgactgttctaaacagagcttatatacttggtagaagtcaaaaactagggggaaaattagtgacattagcttcataaatgaactgaacaaataaactaaaactttttaaatgaaagagtattaaatgtacttggaggtatcaacacatagaagggggctgtggatatttttgcttattctgaagtttgaaattgtctttcagtgatgggaatgccattggtgtggacattctggctcctgatctccgaggtttttcagaatgcaggacaaggatgtgttcttgcctttcacttccccttggccacaacatgcagtagtaacctctttaattaagagcgtttttgtttgcttgttttcccctgcatggaacatcagaaacttttggtttatcaaggcaagcttttcatgcagcatttagcctttttgtcccagagcatctgaaaactgaatattgtatatgtagttggatgactatttcatcaagacaagaaaccaccaatacatttacctgaaatttaaaagcgtagcatatatatatatgcttgatttttgttcttcctgatcccctgcacctgatagtctctttatggtaatattttcacattcttttttgttgttgttgttgtttttgagatggagtctcgctctgcgcccaggctggagtgcagtggcatgatctcggctcactgcaagctccgcctcctgggttcacgccattctcttgcctcagcctcccgagtagcagagactacaggtgcccaccaccatgcctggctaatttttgtatttttagtagagatggggtttcactgtgttagccaggatggtctcaatctcctgacctcatgatccgcctgcctcagcctcccaaagtgttgggattacaggtgtgagccaccgtgcccgacctgcctgcctgcctttttctcttttattttttctttttttctcttctttctttctttccttttctttttttttttttttttttttttttttggtggagtcacctaggctggagtgcagtggcacaatcttggctcactgcaacctccacctcccaggttcaagtgattctcctgcctcagcctcccaagtagctgggattgcaggtgcctggcaccatgcccagctaatttttgtatttttagtagagatagggtttcaccatgttgaccaagctggtctcgaactcttgacctcaggtgagctatccgccttggcctcccaaagtgcttgggattagaggcgtgagccaccatgcctggcccacattctgcttttcttatgtaagctctgaactgctaagtcgtagtttattcaacaaatgacataggaatgtctattcatgatgagtcttggtataaaagaggatagaattagtgaatacattgttcaataataaatctcatcaacattttctgatcaaaatgaagtttgttagttttcctctcagtagaaatgcatgggctaaaatacagaaatagtgatgactgatgatggtgataattcacatccataaaatctagggctacaataatttggcggattgaaaggtcattttggcaggcctacagttttctgtcaaggatccaggaatactttataaggaattgtgaatgcctgtcagtcttttctcctattgcaagaaggctgaccagtttacactttattagtttactgttttggactttttataagttattagtctaaataagtattttagctggctctgagtatgaataactcacttttttcctttccctagtgaagaacagtccagactggcagcaagaaaatatgctagagttgtacagaagttgggttttccagctaagttcttggacttcaagattcagaatatggtggggagctgtgatgtgaagtttcctataaggttagaaggccttgtgctcacccaccaacaatttagtaggtaagtctgaaatgtattatgattgttattggcaacagttcatttataatctaaacattgttcagaataaaacacatgcaaaatattcagtatatgagaacagttgacatggttatagttgtatgtattcttgcattgtcttcctgatgttctcagtcatatttatcaccctcaccagcctctgcttcccttatcactttgcggtacccataactcccctttactggaatgaatttgattctacttctgtatgttttatcgttttattgctgaatacacttggaatgcatgaattgaccctaaccttgtatcaattttttttcccagtttggatcttctcttttagtcaacattgtgtcagatctaccagcaaagtgtgaagttgagcgataggaacaactttctaattatcttccctgctacttgcaggtgaagactcacaggcaggcagccctgcccacctcactgcttcatctcatggtcttctggtgtctgttcacaggcacattagttctgtgtgcccctggggctcacttggttcctcctgccctaggcctttgcacttgccacttttatgcctagtatgctcatttcccttttcacctaggaagctcccacttgagttccatatgtctacccattccactcttcctcagagaagcctgtcctgaattttgtcttaggtcagacacacagaaacagaggcatcctgttttcagtctctccgaactgagaaaaatgagattactaggcttagaagaatatgtaccaggcctggcctggtggctcacacctgtaatcccagcattttgggaggccgaggcaggcagatcagttgagttcaggagttcaagaccagcctggccaacatggtgaaacctcgtctttactaaaaatacaaaaattagctggacatggtggtgcatgcctgtaatcccagttacatgggaggctgaggcaggacaatcattcgaacccaggagatggaggttgcagtgagccaagatcgtgccactgtactccagcctgggcgacacagcaagactccgtctcaaaaaaaaaaagaatatataccaatagtccattcagtcagacagcttaatcaggtataggttaattctcaggctagtatataagtttgattaaatttcctgaccacaattgtcagctagagaatatttcaatttaaggaggtaagatatgattaaaagttaaactgtcagtattggatcttagaagtaaatgattattaggactgtaatagtaattattaggactgtaaaagtaaaggattattatctgcattagatatcattatatctaatgatatagagactgcagacataactacagggctctttttcttaaatcagaaaatccagattcaatagaaatagggtaaagtgataggaggacaaatagccttccatccagtggttatcaactgacgactacaagtcggcctcacttgctttaattattctattctatcctttgatgctgcttgaagaactgtgttttacctcttgactagtttgtttattcagtatttttccttgtacaggtcctcattttatctaaaagcacacaaagctcttgatttctaaactttttgcaattttccttctagttatgagccagagttatttcctggtttaatctacagaatgatcaaacccagaattgttctccttatttttgtttctggaaaagttgtattaacaggtaagttgtaacaggaagtagtatctgaaagtttgtaagtgttttgagtatggcattttctcagtgctgaaaagaaatttcagtgttcggacagtgggctagcttcttgtacaaaggcctcccacccaaagtctgatgagaaacgtgcccactaaaggcacagtgagagcagggaagtctgaccacagctctgcaagcagacttccatttacagtgaggaggtgagcattgcattgaacaaaagatggcgttttcacttggaattagttatctgaagctttaggattcctcagcaatatgattatgagacaagaaaggaagattcagaaatgagtctagttgaaggcagcaattcagagaagaagattcagttgttatcattgccgtcctgcttggtttatggcctggttcaggaccaaggagagaagtgtgaatacatgcctcttgagctatagaatgagacgctggagtcactaagatgattttttaaaagtattgttttataaacaaaaataagattgtgacaagggattccactattaatgttttcatgcctgtgccttaatctgactgggtatggtgagaattgtgcttgcagctttaaggtaagaattttaccatcttaatatgttaagaagtgccatttcagtctctcatctctactccaacttgtcttcttaggtgctaaagtcagagcagaaatttatgaagcatttgaaaacatctaccctattctaaagggattcaggaagacgacgtaatggctctcatgtacccttgcctcccccacccccttctttttttttttttaaacaaatcagtttgttttggtacctttaaatggtggtgttgtgagaagatggatgttgagttgcagggtgtggcaccaggtgatgcccttctgtaagtgcccaccgcgggatgccgggaaggggcattatttgtgcactgagaacaccgcgcagcgtgactgtgagttgctcataccgtgctgctatctgggcagcgctgcccatttatttatatgtagattttaaacactgctgttgacaagttggtttgagggagaaaactttaagtgttaaagccacctctataattgattggactttttaattttaatgtttttccccatgaaccacagtttttatatttctaccagaaaagtaaaaatcttttttaaaagtgttgtttttctaatttataactcctaggggttatttctgtgccagacacattccacctctccagtattgcaggacagaatatatgtgttaatgaaaatgaatggctgtacatatttttttctttcttcagagtactctgtacaataaatgcagtttataaaagtgttagattgttgtta

SEQ ID NO: 1980 - DNA, 18539 bp, Homo sapiens; identical to SEQ ID NO: 1979

SEQ ID NO: 1981 - DNA, 9122 bp, Homo sapiens
ctaaaggcaacttgcttaatgcattttttaatttaaattttttatgttgtacagtttattttaaatatagttgctattttttaacacagatgccaagtcggtgctgtgagattttctttctggtgatttggaccagtttgtctccctcttgatatatccatcccaaatggaaaggccctgtaaactgttacgatcatctccagaggttaactggaatatacaccaatgacagcttgcctgggtatgccaaaatacctgcaagaatgtccacatcatctggtgatgtccccaaataacagtttttaccatagaaagatcgttaacatgtttgctttaaaagtcattagcagtcataacgtacttacagattctgcctataaggaataatacataattttagatataaaggccccactagtccaggtttccttatgccactgtgcttcctactaagtgttgcgaccagctcttgtcactagttgatgacaacttactccagtagccacagggctgtgacaccatagttataggtgattttcatagatttagccatcccaggttcgaaactagtatcctctagctcttaagtagctgataacctccccatgggagaaactccatactgcagtttcccatatggtgctatgtataactatcttatacaattaatacaaattgcatatgtatacttatataatatggactactaggacagaactttttaaattacaaataaaatagccaagtagacaattacattagcaagtgatgttacctatgaaaacgtgaggatttatggtggcaatgcatttcagttaacagggatgtgttaggggacaatgtgagccaatgtagattaaggaaataagcctgagaaatttatcagaattagccgtcagtattcaagcactgatcaacagcaatgtgtcttaagggcaggcatcactggtgctgagagaactgggaattgtcaactgtgagctgctaggggatggaagaaaccttagtgtagtcttaggagccgcttgcttaaacagatgtatcagaaacataataggccaagggtcagccctttgaaaactgacttcagggccttcctttcctcaggctgctgcctcctaggccagacccttattttggcttacattccataacccttgtatgtgcgatagggaacctgtatacaatgctgacacggaaagggaagaccatcgccttttgcctttcagtgtctcatctgtaagcagggccgctggctgaccaagatcagttctgaaggtccagcctctttaaattccagttctgtgatcacaaagccactgttgttcctcatcctgccaactgtgatactgctgcttcagaattactgggtttcctgttcatcatactcaccaacctgaggtttggtatttctcaaatattctgggcttccagtacatactagagcctgtgataatcagctaatgatcagacaagtttgttgggagttttacctaagtatttttgtgttttaaaaacctagggtgggaaatgctcagagtgagatggtttgacttcattaggcatataacccatttttattataaaaagaaatgcacatataagtaaaaagaccattttagttagtcccaccattcgttggtaaccagttcactaagtgtacatctttgcagatttctgtgcatacatacaaatatttttacaagaataggatcataccatgaataccacctataatggtatgtctgttgtcaatataggtgttataattaagactgtgtagccttcctctgtggatgtaccaaaatttatttaattccctgtcactggacacttttgtttcactaataagtagacactgtgtaagcaatctgtcaacatctctgcacctctatttttggtataagtatttccttaggataaaatcccagaaatggaattgcaaggtataaaagattattaacatttttcaaggctttaagatgcctttacggtgtatctgttacatcctgcttccacacaaattcttctgtatagccagtacccaagctgcagctctcagcacaggtgaagacagccaggatgccccagtcaatgctcttgcccagtctgtcagccttcaggtagtttaggagctgaggcatgacctgagaagagggtgacacacagttagaaagctgcttcacagcagggagcacgagaccttctcagccaggatgattatagggatcttggtctttcaatcctcatactacaaagcaggattatagacattatacaattaacatgtttaacaatctaaaacttccttatgacttcaaagcccctctcaccttctgtttggtcttttccatttgagaaagaagttcacaagtggctgttaatgaattattttcattactaatatgccactcaaaagggctgaggcttctatttgggcaacttttactttgtatcattgcagatgttgttactcttgactcaagaaacactaattactagtaatgaatacagaaaggacatctatcaatgtagttatagagaccagagaggaatcttagaagtagtctaactcaaagagtgaataggcagaatagccacctgatatggaatcactttatacaaatcctgtcacctcaatttggacattgagagctttggcactaagaaccaagcagagttttgtgtatggtcctcataattccttttttacccaaagaaacaaaccaatattagctatgactttggtaaggttagtgaatccatagctcaagagcatttccaccctacccaaatggattttgatgctaacaaatccttttgggcagggaaggacatttatctttaatgcttatatccattttttctaacaaatccacaaaccaagattaaacagtaaagactcctctcataaagtatatagtcaaagactttaattactagaacaagaaaggaaggtatacattatttaaaataacaaaagttaacagaggcactaataataatgacataaccacactggaggtggagagcagtgtagatatcctcattgtcacagaagtcagtcaatagaccgtgtctgaaaactaggaaacagaaaaaaacaagacagttccttccagggaactagccccaaggtgaggcaggaaactgatgattttcattatagggtacccttccatactgccatgttgacccatgtgcacaaattaccttggtgaagtttttaatgtttaaaaacaatcatggtgattacacactaaatggtccttatttaaggtcatacctggaattccaatattctcttggcaccacaggggcaatctggaatatccttttcttgaggaatattttcaccagaaatccagatgggggcaatacctctgccatatctaagaatctaaaatcaatgaagatcatgttcaaataatcaataccttacctataagttgccaatggtaacatgctatctactccatgaatgttcctactcttgatgtagcactgacccaaaaggcatgtcacagttcccccatcagacctggctgtaccagtgtgccactaatgccttctcaatcacctcaaagtgattatttcagtttatctgactcagagggcatcaaaatatatctcccagatgatgcttttactacctaatgttggcaacttaatcctatgaatatattgtgaagggactaagaatgagcctctgctctaattgcagaattctgcccagagtctgtgcctaccttcatagttaaaaaattttaggagggacaaataccaagtgaaacatagtgttttgaaaactactacaaacataagtaaatttcactgtaataagcttcctacagcaactgagtggttttctgtattttgtctaaaagcatatgcattgctaaaaactgccttagtgtttaagacctagatctattcttcctgtgtatttatttgaaccagtgactggtttatgggagtttagttttctttcgtgatttacgtttatggtaggggaggttaaggagaaaaatgttaacatgtcacattttacaagccaaagttacctgttggaaatgggcaaaaataaccttttttctttctggcgggggggccaatggtgcctaaacctcatgtaccttaggcaacatctcattcatctcccatccctgatgcttgctttagaaaatgaaccctgtatgataaacagtataacctttagtcttttagtaactattaaatggatcagcactgcaaaacacctttctacatggcccatctgtgtgaggaactcctctaacaagataacaaaagcctgcttttataggctcctaaggaacagactaatgttactatgaagttatttcttacagattatactcataaaacatggcctgaagagaacacgatgaggagctatgagctccactttacctgttctggttcaagggctatctgagttttaaacttctgaaaaattttatcttccctggattcatgttttgccatggaatccagttcttcctcaagtgcttcacctgaaaaatcaacgtaactattatgaaaaacaggagtaatccccacaacttgacaattcacacatggagaggggacccacttttaatcagatagctttccctatttattcactcattcaagttggaccatctgaatttccaggtactccatccaactctattatatggacttccatttagtgcatctccttaaagcttcaaaataacagaatggtcaagggcttaggactgcccagcacatcacaggacacccaacaaatgtgagcccttatcattagtatcctcagctggtaggctcactcactcagtcatcaagtgttcatttctggcctggagcagtggctcacgcctgtaatcccagtactttgggaggccgaggcgggcagatcacctgaggtcaggagttcaagaccagcctggccaacatggtgaaatcccgtatctactaaaaatataaaaattagccagacgtggtggtaggtgcctgtaatcccagctactcgggaggctgaggcaggagagtcacttgaacctgggaggcagaggctgcagtgaaccgagatggtgacattgcactccagcctgggcgacagagtgagactccgtctcaaaaaaaaaaatgttcatttccttctccacattccttcctgggattacagccaccctaagccactgctgtccccaacagacccgtgtctctaagtataaccattagtctttgtaatgtacgttaaaatagaactgatataccttgggtcagagaagctaaaataactgctttgatgaaactggaaaggcactgatggtgttcacttgcaccatcaggtctgatggaggaagtgtaggatgccttcagattgatgttccatcaagtatacgtggaaagtttcagtataaccgttaggacactgtaaatgctgttccctcaggccctactgcctcctgccaagtctcaggtaagacacagctacctccaggaagcatttttctattcaattctccttttattttagaaaattttggacatacagaaaagtggaaatactataatgaaccgccacatatcattaatcagtttcaacactatcaagtccagtgtttcctttctctgccacttccacctccattactctgaagtaaattccacacatatcacttcattcataattaagttatgtacccctcgaaggcaaactctttccttttatttaccaatttgaaaatgagtctgttcccaagtatcctataaagatgattactgagtttttttaaagtatcattttgaacccattaaacatatctgatgcagttagcgtccttgtggatgttcaaactgtccatcttttgcaagcaggagccttttcatgttgcttgagttctgacatggccctagtaatccttatccttaatctttgatatgaccatgttcccacattatatgaacgtttcctgacctagttctggaatcaaccacctctccaaagagcctggagttccttttagagagaaatggtacgtagacacaatcaacattatcttcctcctacgcccaacatctcagttctcagtaacaccaacataattactcgtttcctttccccccaatacacacacaaccatctcaaaataaaagcaacagtctagtaataacatgtttattcaaaatactaacactgttacattcttttcattctcagggcatattctactagagatgtactgtcctatgttttgaagtcacctggaagagttcttagtgtggttatatgactacatcaagagttttttacttttgatgattagggactgctttttaaaacttactttactccataatcttaaaatactcatacagttccacagtcacatttacactaacaaggcatatttgaagtccagctttcatccttgatcctgctactctaggctctcctttctcctaaagataagcattttcattatgtatcatgtttatcgtataggcatgaacacacgcgcggccccttccaggcagtcttcagtgatgtcacgtgttcccatggcacctgtattgtactcttatcagtcattatatggactttaacttccccagatattatttgggctcctccataagactgtgagcatctgaccactggagtgttgcttcccattatatccctgttatcaagcacaaggtcaggcacagagtaagactcaaaacatgttttggaatgtatgactggtatgaactacaaaccagtaagctgatgttttcattttgagtctataaatctaattttgtggtggttttgtgtatggctcaaggctcaaattgtaaaatttaatattatgtgaccaaagaaagttatacccagaacctcaatttcctcaccttcaaaatggggcagtttctcactcattggtctgctgtcacgattttaatgagctcatgcacaaacagccctttatataaggtaagtgctggataaatgttggctactataataaaataagcctctaagatacttggtcagcacaagtactacccaagagtatgcactgtaagtaaactgacaaaattgtgtatctaaaactggccagatgaaagagaaacttttaaggggcccttctgcgtgcccgacactgtgctaggcactcacactatcccgacccgagaaaccgatctgcgacccagaggaacttaccaagcctccagcatcttgtgcagccctactcatgggaccatctggatacccacccttgtctttacagggagcagaacacacctcttatgtgtcagaaaacaaagtccaggaagtatatttttacctgaggcaatatctgaaaattgtatgctacagcctccaaagtgagtcttcctctcagtacctctcttctaggcacatggagccctttcttccaagtattatgtttaaccacttaatgaatgaagtcctgaaactgcttacccatgctccctataatctctgagtaatcttccttttccacaacctcaggcataatctcatcttctgtttctattacaatttcaaattctggaaaaaggaagttgtggtctggaattatatggtccagatgatctgaaacaaaaaggacagcactattagtaatcatttagttttgaagacagtctaataatttgctgtctctaaagtactatattccctatagttctggcattttagataaagggtcataaattaaatgcctatatggtgacattattcagtgattcagacttcacagccttttttttttttttacaaaggtgttccaggcatgaaaaattttaaagtactatacctttcctaattttacctttaaagttgtcctggaaatatctgggttgacaaaggcgatgaaactgaactgagacttaaaaaaaagattacccacctggttgtgcacaagcctgcttatgtcccaatctccagtctagggtctgatgctccttgctgcagtaatatgctttgtggcatctggagcacgttttggggcctaaacagccacaaaccctgcagagatgagcaccagacttaagctggagacacactgattctcctgtttctgggggaggattctcagaaggtggctcatatgagtaaaaatcgtttttcctgggtagttgattcctaaaaactaaaaaagaatacagagaaaagttttatcttcaaacaaaacagcaattcacatattttatcctctgcacgtaaaactgaaaataacaacaacaaaaaagaaatgaaagtttttgctttcaggaataagcttttaaaatccagaaactagatttcgtccggtacacgcaactgagttgcctcctagaggtggtttgagttaatcaaattaataagactgatcgttaagaacgactgccaaaaatacgaaaaagctactgggatccatctttccaagacaatttctattatctgaattaacaccatacctggtacccactgattaaaagctgggggttaccaatgcgcgtgggcacagttagaagcttatgtagcaaaaatgagcacatcctggaagggcccgggagaaggtgctcctggggcagcgcggagagggagctctgaggctggggcggcagcggtgcttgccgccgtccccctggtcgctcccggaattaacgccgcgcacgcgtcggaggcatggccccgtcccgaccccgtttggcggctcacctcgcaggccggcacagcacggctgctcgcggcagcagaagaggaagatgcagcggtggaaggcgtccgggcggccaggcagcggcgcatacacctgcagcaggaaggagagcgggcggccgcacagctcgcaggccagggcctggggccccggcagcccggccgcgcccagccatgccggccgcccgcccaccttgctggggaactgctcgctgcgcagtcgccacgccggcgccgactcggcgaagcccagctccacaggcctggccccggcggcagccatgcggggcgcgggctggcgtggggcgcagcccacagctgggtcggaaggcggaaatcgggcgccgggccggaaggcaagaggcgggcacctttccggaggacaggaggcgga

SEQ ID NO: 1982 - DNA, 2947 bp, Homo sapiens
ctagtaataacatgtttattcaaaatactaacactgttacattcttttcattctcagggcatattctactagagatgtactgtcctatgttttgaagtcacctggaagagttcttagtgtggttatatgactacatcaagagttttttacttttgatgattagggactgctttttaaaacttactttactccataatcttaaaatactcatacagttccacagtcacatttacactaacaaggcatatttgaagtccagctttcatccttgatcctgctactctaggctctcctttctcctaaagataagcattttcattatgtatcatgtttatcgtataggcatgaacacacgcgcggccccttccaggcagtcttcagtgatgtcacgtgttcccatggcacctgtattgtactcttatcagtcattatatggactttaacttccccagatattatttgggctcctccataagactgtgagcatctgaccactggagtgttgcttcccattatatccctgttatcaagcacaaggtcaggcacagagtaagactcaaaacatgttttggaatgtatgactggtatgaactacaaaccagtaagctgatgttttcattttgagtctataaatctaattttgtggtggttttgtgtatggctcaaggctcaaattgtaaaatttaatattatgtgaccaaagaaagttatacccagaacctcaatttcctcaccttcaaaatggggcagtttctcactcattggtctgctgtcacgattttaatgagctcatgcacaaacagccctttatataaggtaagtgctggataaatgttggctactataataaaataagcctctaagatacttggtcagcacaagtactacccaagagtatgcactgtaagtaaactgacaaaattgtgtatctaaaactggccagatgaaagagaaacttttaaggggcccttctgcgtgcccgacactgtgctaggcactcacactatcccgacccgagaaaccgatctgcgacccagaggaacttaccaagcctccagcatcttgtgcagccctactcatgggaccatctggatacccacccttgtctttacagggagcagaacacacctcttatgtgtcagaaaacaaagtccaggaagtatatttttacctgaggcaatatctgaaaattgtatgctacagcctccaaagtgagtcttcctctcagtacctctcttctaggcacatggagccctttcttccaagtattatgtttaaccacttaatgaatgaagtcctgaaactgcttacccatgctccctataatctctgagtaatcttccttttccacaacctcaggcataatctcatcttctgtttctattacaatttcaaattctggaaaaaggaagttgtggtctggaattatatggtccagatgatctgaaacaaaaaggacagcactattagtaatcatttagttttgaagacagtctaataatttgctgtctctaaagtactatattccctatagttctggcattttagataaagggtcataaattaaatgcctatatggtgacattattcagtgattcagacttcacagccttttttttttttttacaaaggtgttccaggcatgaaaaattttaaagtactatacctttcctaattttacctttaaagttgtcctggaaatatctgggttgacaaaggcgatgaaactgaactgagacttaaaaaaaagattacccacctggttgtgcacaagcctgcttatgtcccaatctccagtctagggtctgatgctccttgctgcagtaatatgctttgtggcatctggagcacgttttggggcctaaacagccacaaaccctgcagagatgagcaccagacttaagctggagacacactgattctcctgtttctgggggaggattctcagaaggtggctcatatgagtaaaaatcgtttttcctgggtagttgattcctaaaaactaaaaaagaatacagagaaaagttttatcttcaaacaaaacagcaattcacatattttatcctctgcacgtaaaactgaaaataacaacaacaaaaaagaaatgaaagtttttgctttcaggaataagcttttaaaatccagaaactagatttcgtccggtacacgcaactgagttgcctcctagaggtggtttgagttaatcaaattaataagactgatcgttaagaacgactgccaaaaatacgaaaaagctactgggatccatctttccaagacaatttctattatctgaattaacaccatacctggtacccactgattaaaagctgggggttaccaatgcgcgtgggcacagttagaagcttatgtagcaaaaatgagcacatcctggaagggcccgggagaaggtgctcctggggcagcgcggagagggagctctgaggctggggcggcagcggtgcttgccgccgtccccctggtcgctcccggaattaacgccgcgcacgcgtcggaggcatggccccgtcccgaccccgtttggcggctcacctcgcaggccggcacagcacggctgctcgcggcagcagaagaggaagatgcagcggtggaaggcgtccgggcggccaggcagcggcgcatacacctgcagcaggaaggagagcgggcggccgcacagctcgcaggccagggcctggggccccggcagcccggccgcgcccagccatgccggccgcccgcccaccttgctggggaactgctcgctgcgcagtcgccacgccggcgccgactcggcgaagcccagctccacaggcctggccccggcggcagccatgcggggcgcgggctggcgtggggcgcagcccacagctgggtcggaaggcggaaatcgggcgccgggccggaaggcaagaggcgggcacctttccggaggacaggaggcgga

SEQ ID NO: 1983 - DNA, 2947 bp, Homo sapiens; identical to SEQ ID NO: 1982

SEQ ID NO: 1984 - DNA, 6454 bp, Homo sapiens
tatgatttcacgtacatgaaactttagtaaagacaagtctaatccatagtgacagaaagcaaatgagtaactgctgacagggccaaatgaggagatgatcccaagggaaccttctggggtaagacggtgttctgtatctcaatcgtattggtggtcacacaagtgaagacatgttagaactcatcaaaccatacacttagaatgtgtaatataaacctcaataaagcaaaatttaaaaaaaaaaacacctttaattttctcttacaaaaaaaaaaaggaaaaccacttaactttaatttttctccaacaactgattctggtacatagtataccttactgcctgcatccatggcctcacatcatgctgtttacatgaacgtaaagcttcaccgaagagtggaataagacagtcctgccagagaaaaaccaaaattactcaacgtaaaacaggctgttgatacgtttgcagatatatagcaagtcttaagtcaaagactgcaatatagtttggctacttcagattgattgcagtagttttatctattacactatacccttacatcatttatcttctactcacaagaggcaagcacacagtaagagaaagccttttgttttgaagggaaatcttcttcagaatattaagtctaatttatcaatatacttaataaagcacattacaaaaaaaaagtcacagcacatttactataaagcagactgcagaaaaacattacaactaatgctttataatgaagttctcgaagatcatcattcattcagaagcccccatctctggttgaactttaccccatttaggatgaagaggagagatctttgtttgcagcaaatctaaaatttacgtaatctgcctaaaggaactgtctttacatacaccacctcccactccaaaaatagaagaaaaaactgagcaatttgccatccttgcgattatctcaggttcttccatctgccccatgtacttcccaaatgaaagactgcctgaaaacagcatgttagatttctggatttaccagcttgcccaactacaaatcctatttcaaaaaactcaaaaaataaggtctttgttctacagtaatgaccattaatagtcataagaatgtgcttgtaaaaatatacagacctctgtttaaagtctgttagaaactgtgttctccaaagcaggtgagcaatacagctgcaaggtacttagaactggcaaagactgtgaaactgttaaagtagaaagtctcagaggtccaacagcgatgcgggatgtttgcttcaagtactttaccacatttctgaaacaaaatatttactgtcaattaataaaaattacaattcataaccactcaaagaataaagcaattgataagatgctatcaaactgacatccaaagttagggggcagtaagaggagcagcctgctctataataaaatgatattagcaagtcaagacatttgcttttggggatttttacattttatttcatttcaacctcagtttttgttggcaagcagcattcatatatcatatgacttctacaactaaaatgaagctattagcactagtatttagtaatctagtaactctccttccagccctcttcaccccatgtatgtttatcacatgatatacacaatgtacatttatctccgtaagagtaacttactcagttatagactgccacttctgatcttgttctatcgggtttaaagcagttgccaaacaaacagaacttcttaacaattgaacttcaatggatttctgaggttcccttggatctggacttaacatgttacgaagcaggtttttcatgtctacagaagttaaatgaaatgtcattaattaatgtgcttttattataaattttgatttatgtttggcattattaaaaactaatcaccaatgaacagctcctttaatatttaaggcagttaaacactataagcattactgagagctatataaaaatcatacttcatacaaaattactgtacctcagacccctaaaaagcagttgccttcaaaggctcaaaaatcagtaagtcgaggccaggcgtggtggctcacgcctgtaatcccagcactttgggaggccaaggtgggtggatcacgaagtcaggagttcaagaccagcctggccaagatgatgaaaccccgtctctactaaaaatacaaaaaattagctgggcacagtggcagacacctgtaatcccagctactcaggaggctgaggcaggagaattgcttgaactcagaggacggaggttgcagtgagccaaaatcccgccactgcactccagcctgggcaacagagtgagactctgtctcaacaaaaaagaaaatcagtaagtcaatctactatttaagggaacaaatctagacctgcattagcaaatcttgctcaatccagaatactcattaaactttttaataacattttataaagtgttccatttgtgataaagaacttaatgagccacatcaagatgaaaatcaagaaaaatatttagctgaaacactactttgtcctttatcaaacaaaatggctagataaatctcaaagcattaaggtggtcatttttttatttgacttaattttaagtgcttttcatttcccaaatcaaacttaaatagggcagccctaaatttgttgcttcacatgggattctgccccccaaaaatgtaaaatgacttccagattttccagtaaaatatactaagccaaacattttgagcaacttgtccactaaaataactttaaaactattttctcaaatacctacctattttttcttttgatcctccagcaagtagattgatattttctcctggtaacaattctaattgctcagtacattcaacaaattttccagactcgaagctgcttaatgatctgtaattaaaatattggttagcttgtattcctacgcagcctgtggaaccattaaaaaaaaacaaacaaacaaaaacagaacaaatcctaggaagacagcaaagtacacagcatttttctgacaaaattccttccacgaggatgtcattattttggtttttatgttgaagatgtgactaccacttaattagtactcaaattggagtggcaaaccagaaagtcacagctacagactttcagtagagctgactcgcccctgtgtctccttcctgttttcatgtgttgcagcctgttctcttcagagcctaacacactgacagtagacctctgcaggacaactttgacacccagttctctccaagctgccagtgagctccttgtgcagcctcactcctcacctacagcatgagcccttgcagctctcccagcatcataatcttgtatctcagtcctggcttctttcactgctggcatccctccatctctccctttttcacctacttttcttttttcaaagaattcttctctttcatctgcttttatgaaaaataatgacacctctgaaattctttcctgtagtcctgcagcatcaatgccaggaagacaggcctcatcctcccagcttctatgctgctcctttcagatcccttaccctgtccccattttcatgacacgggctctccagccaggaagaagacactgtttctcactctctctcttttccatctttgcctgtccctctcgctgtgtaacttcccttataactcagcctgaggccagtgctagaaaggcacatcacctgacttattctgtgcctgattctacctagatcagtgcaaccactggcttctcagggggacccttgagtactgggcactgatgaactgctgccaacacattcgtcatttctgccattaaaaggtcctaagtcctctccagtgacaggttcctcaagtccccactatgctctataatgccctatgctttcagctaatgactcagtcctcagaaaaacaaacaaataaaaaaacacaggctttaatttcctctacccctacccccaatccaccatacactgccaaaattctgtctataccaactttgactgctttccttgaggcagagaaaaggtgagggccagttaatctatcaatgttctttctcctgtttcttcaacctctgctttctagtggctccttccccttggccaaaagaacataatctctccaacatttaaaataaacatctcatatctccctccagcaatagcttcctatcctcgacttcaagaaaaactcactgaccaaataacttacctcaagcttttcattttcaaatgtctctaccactcaatagtattcaatctagcttcttctgtctctctacaaaactctttttccttataatccctagagcatctgacaaggctgactactcccatctggatgtcctatatctaggacacttcccttctcaatgtccctgtatttttttgaatggcttcctcttctatactttcacaaaaatgctaaactaggattctgacccaggccttccttcctcttcactcactattctccagaggcttctctctggtttggttgcttacaaaggctctagagtatagagactgaaaaggaaacagggccttttctgtgtactaatgatgtgcaaatctctcaagcttagactttctccttagttcaaaatccaattttttttttttaattgatcattcttgggtgtttctcgcagagggggatttggcagggtcataggacaatagtggagggaaggtcagcagataaacaagtgaacaaaggtctctggttttcctaggcagagtgtgtgtgtccctgggtacttgagattagggaatggtgatgactcttaacgagcatgctgccttcaagcatctgtttaacaaagcacatcttgcaccgcccttaatccatttaaccctgagtggacacagcacatgtttcagagagcacagggttggggataaggtcatagatcaacaggatcccaaggcagaagaatttttcttagtacagaacaaaatgaaaagtctcccatgtctacttctttctacacagacacggcaaccatccgatttctcaatcttttccccacctttcccccttttctattccacaaaaccgccattgtcatcatggcccgttctcaatgagctgttgggtacacctcccagacggggtggtggccgggcagaggggctcctcacttcccagtaggggcggccgggcagaggcgcccctcacctcctggacggggcggctggccgggcggggggctgacccccctacctccctcccagacagggcggctggccaggcagaggggctcctcacctcccagacggggcggcggggcagaggcgctcccatctcagacgatgggcggccgggcagagacgctcctcacttcctagatgggatggcggccgggcagagacactcctcactttccagactgggcagccaggcagaggggctcctcacatcccagacgatgggcggccaggcagagacgctcctcacttcccagacggggtagcggccgggcagaggctgcaatctcggcactttggggggccaagacaggcggctgggaagtggaggttgtagccgagatcacgccactgcactccagcctgggcaccattgagcactgagttaacaagactccgtctgcaatcccggcacctcgggaggccgaggctggcggatcactcacggttaggagctggagaccagcccggccaacacagcgaaaccccgtctccaccaaaaaagtacgaaaacccatcaggtgtggcggcgcacgcctgcaatcgcaggcactcggcaggctgaggcaggagaatcaggcagggaggttgcagtgagccgagatggcagcagcacagtccagcttcggcttggcatgagagggagaccgtggaaagagagggagagggagaccgtggaaaccgtggaaagagagggagagggagaccgtggaaagagagggagagggagaggagggagagggagagggagaggagggagagggagagggagagggagaggagggagagggagagggagagccaaaatccaattcttaacagcttacccaacaatctcatctgcacatttcattagaaatcttaaaacatagcttgttctctgtgtgctcctactccagttaatagcattgtttctcttccctctaccattgcccccacaaattaatggtctccatgcttccatacttgcccctcacctccagtctcttcaccatagcagaatgaaccaccaagtcagatcacaacacatctctgttcaaatcccacctgaaattttcagtcttactagaataacagccaaagttcttttctcagttcccagctacttctctgcccttatatcctactgtttaaggtgctcctaaacacacaggcctcccagctatttccagaacactccaagcccatcattctcacatcaggtctaggcccaaagggcatcctgatgggcatgccttg

SEQ ID NO: 1985 - DNA, 47657 bp, Homo sapiens
tcagtgatgagttctagaaggaaagaaaaggctgatgtgacagtgaggaagggatgagtggagacttctctgagacttcagtgattcctcttcctctgagctgagccaagctgagaagctgagaagagtaagatagggccgggaactcaggtccgttagtccgtcctccgaggtggggcgggccagcagaatggatttccgatctactctgtgagagcctcgcccaagaaagcccagagccacttccaagatccgcgctcccacggcgatgagaagcgttttcccccgggactgcttggcttaggactggggacccactggctttggagtaagccctggcacgggcctcgagggaagaaagaactcccgcgctccccacactccacagggcctgcgatcatctcagatgttccggttccacgtgcagaaaccccgccggtccgaggccccggttctaaaacggccctaagagtcaaggcttccacagctcgcctctgagggtggcaaagaggccgcgggggcggtgcctcgcgagacccaaacaagcccacgtggcaggggcggggctccgcgaaggcgtcacggcgcgctcgtgcgctgctgaggtcacgcgccggcagtacccttgcccgggggccgtaaagcgcggaaggtcgcggtctcggcttccccggaactttttgctcgcttcgccccgcccccttcccatccccgaaccccgctttccggcccgcggcgaccccaggcaactgttgtggctgccgcattgctcccgccgggctgtagctgagcgcggagcccgtggggaccggtgaggtaaggagatagcttcggggcaactctggcctccccgtccgcgcgggcctaagcgccccgggacccctgggttcccctctttctcctttggtttcgcccgggggtggtccccgctagctcacgcttccagtgggttccgcctggcctctcgcgaagtcgcgtccgggcgccagtactcgtccccgtaaggttgtccgctcgtgccttggcttgtgttctcggctacccctgggcgtgcgcaccgctcctccaggagcctgcacttcagccccgatgccagggcggccggggtgacctcgggctcccccgtctcgggcttgcacacccctgcggcgcagagccaactccagcttgtctagcccggtcctccatccctgcagatggaactgttttcccgcgttgagacgtgcggtccgcttgtgcttttagaactaaagactgctgcagagtccggaggaagaagtcacctagaaaaatctgggacagggcagtaagcttccttcttaatgtttgacctttgggggccgatgtgtgatacctcggatttgaatcaagaatctccaagcccattttccgcatgcatgtaaacgtgatgtaccgggatggggtctggtggtggaggaggagccagcctgacggataagcttttccagtggcagggacttgtgttaatttcttttttctttttttttcttttttccgagacagagtttcactctgtcgcccaggcgggagtgcagtggcgcgatctcggctcactgcaacctctgcctcctgggttcaagcaattctcctgcctcagcctcccaagtagctgggaatacaggtgtgcgccaccacgcccggctaatttttgtgtttttagtagagacggggtttcactatgttggccaggctggtctcgaactcctgacctcgtgattctcccgcctcagcctcccaaagtgctgggattacaggcgtgagccactgcgctcggccaacttgtgttaatttcttaaacttgcgtgatcacctggtgtacttgttgaaaaatacagctccctggagtggcaggatcagaatctgccgaggtggaccgtgggaatctgtcatttttaaacaagtgtcccaggtggttcttttgctgaggcaagtgtgggaaatgttgtgtgaacccacgctcatccagtcttccttgtgaccggcagtccactgtgcgcaacgctgcagccatacagagggacaactcgaagttagaactagcaccttggtcttgttggaataagcagatctgagtagagccagctgcagtcttatggttgtttagcagaagttattcttcttagcagagaatattatacggtcattttccagaactgtaaaaactctatcatttgttttaaaccagatgatgtgcttcatttctgtctttgacgtcttcagtttcttctcccctggctttacctcctttgttatcagtttgtgctttggttttgctgccaaccttataggtttaggtttggcggcaaaggcactagactctggtgccttcttttccttcgttgtcttaagcccttcttttcctctgccctcatgccctcaccacttcactcttttgaaggtcataatgaacacaaggtcagagatcccttttttggcgccaagcaccctgggcttttttgagatggagtctcactgtgtcacccaggcagtggcgcgaatctgcccactgcagcctccatctccctggttgaagcaattttcctgtctcagcctcctgagtagctgggactacaggtgcaagccacgacacctggctaatttttctgtttttagtagagacggggtttcaccatgctgatcaggctggtctcaaactcctgacctcaaataatccacccaccttggcctcccaaagtgctaggattacaggtgtgagcccctgcgcctggcctttctttgttttgttttgtttaagacagagtctcactgtgtcacccaggcaggagtgcagtagcataatctcggctcactgcaacctctgtctcccaggctcaagcgatcctcctacctcaggagttcaggaccagcctgggcaacatagtgagcccctctctacaaaaaaaaaaaaaaaattaaaaaaattaataaaacacaagattggcctgtgtggtgagagagtattgaatccaacaaacgggaactggttagtgaggcccaagatgcaatggtggccgcaccatgagtacctgggaccacaggtgcgtgccaccacacccagctaattttttgtatctttggtagagacggggtttcaccatgtttgccaggctggtctccaacttccgacctcaaatgatctacccgcctcggcctcccaaagtgctgagataacaggcgtgagacatggcgcccggcctaaagttttttttttaattccaccttaaaactcatctgttactgtgtttgttctgccacctttgcaattccctttctctgttaggggaatgtgcttaatggttcagtcctcacagctgtcctttccttaccatctgcttttatttgaaaggtagcgtggagtcatgattaaatagccggccactaatgccaaattggcagggttctgctactcaacagtttggtaggaccttgggtgagtcacttccacttatctgtgcctgtttcctcaagtgtagaatagaaatgctagtatctacctcataaggttgtgaggattaaattagttatatatataggcagtatctggtgcattgtaactacttataaaaatattagctttaaaaattatttgccggtcacagtggctcatgcctgtaatcccagcactttgggaggccaaggcaggcggatcacgaggtcgggagattgagaccatcctggctaacatggtgaaaccccgtctctcctaaaaattaaaaaaaaaaattagccaggcatggtggtgggtgcctgtagtcccagctactcaggaggctgaggcaggagaatggcatcaacccaggaggcagagcttgcagtgagctgagatcgcaccactgcactccagcctgggcgacagagcgagactccatctcaaaaaaaataaataagatgtcaaagaggctgtgacctgaggagattacctgtatttgggggagaggtggcaggaaccatgccaggagggaacagcatgcacagaacctggagccgaatagaacactcacgcctcacctgatatgtttgacgaattacaggttgttcagtctggtttggtcagagtgtgaggaaaggagaaatgagaccacagataagaaccagagtgtgaaggatcttgcacttgatatgaaaagagttttgcctttttcctgagggcatcagaaagtcattaaggtgggtgtggtggttcacgcctataatcccagcactttgggaggccaaggccagtggatcacctgaggtcaggagttcaagaccagcctaatcaacatggtgaaaccctgtctgtactaaaaatacaaaaagtaactgggcgtggtggcgcgtgcttgtagttccagctgttcaggaggccgaggcaggagaattgcttgaacctgggatgcagaggttgcagtgagccgagatcacaccgctgcactcccagctgggcgacagagtgagactctgtctcaaaaaaaaaaaaaaaattgctgaggaaaagcagcaaaaagggagggaaacgttgcaggtacatgaaagagagatagcagttgatggagctagggtcaagagaagagaggaggaagtgggatccagggcccttgggggagattaactttccagtggataaaagaaggaaggaagagatggttgcagatgcaagtgggtctataggaagggtttcagggaatgagatgagccaggttatctgcttagaatgagggaagaaaggaggtgaaattgaaggttgagagaggaatagctgggctctgaacctgaatacagacagaggtctgcctgtggcttaacatgtgctagcctaagccaccaaggagcaggacagttttcaagtataaccgagtggtcacgggtcagaagccaggaggttgacagtgaggtcaatgggacggggctggccatttggcagcagcagttccccaggagagctgtgttgccattgggacagagggtagagagaatgtcagcaaaggggtgggtgtttacctttgggaaaggtattctggagggtgcagtagaggggcttgaaggagaggaaagcaaagagagcttgggccacgggaaataaattggtcacgtggagatgagattatggaaagactagccgggtagagaagcttctgttttgagatggtgcttaacagggaccagggatgagaggcatggtggcaaccacaaggtggccaagacaatttgtctccagttggatgggatgtctgcctggacacagtctgtgcttgcattggttgcaattctgagagtcatctctgatggatggacatagataccttggccttggacaatttgtgctgactgtggagcatctgtgggtcctgtggctggcagtggaggcggtaaggagatgactagcagtgagctaccctaaggcccccttgtctaccgcctctcgtctcaaagtcctcatcctcctgtacacatgactgcatggacagccagtaggtgctttcttcttcagtttcttgaaacttgaacagtcatctgttttgctgatagattaagtttgttaaaaccctgccttgtccaagggcagtggttcatgcctgtaatctcaacactttgggagaccaaggtgggaggatcacttgagcctaggaagtcaactctgtttttcttataattctaccatccgctctccaccatggagccagactgacctttggaaaacatcccccaaccccccaccgccaaaaaaaacaaagaaaagaaaaacatcccagatcatttcattcccctgctagtgatactcccgcatgagtgattttcctttgtactttgaataaaattccaactcctgctgatggcacccaagggctgtgtgtaactggcttccgcctgcctctccagcattgtcttagatcatctccccacactccccgtgtcgtgtacatgccggcctcctttttgttcttggtctgtcttacctcagggcttttgcacatgctcgtctcagtgtctgccaaatgtatagctcgttccttatccttcaggtctgtttccaaatgtcacttccttggaggctgtttctgaccatcctgttttaaatatgcccctagttactctatcatgttagctttatttactgttttatttgtatgtttatttgtatattgattggtgttctcctcattcacacacgcaaactctcaaatgtaaatttcataaagacagggacttccccattcttgttcactgctagcagaatatctgaaactcagaatgccctcaaatatttctttttttgttttttttttgtttgtttgtttgttttttttttgagacggagtctcgctctgtcgcccaggctggagtgcggtggcgcgatctctgctcgctgcagcctccgcctcccgggttcaagcaattctcctgcctcagcctcctgagtagctgggattacaggcacctgccaccatgcccagctaatttttgtgtttttagtagagacagggtttcaccatgttggtaagactggtctcgaacccctgacctcgttatccactcgccgcggcctcccaaagtgctgggattacaggtgtgagccactgcgcccagcctaagtttttgaatttttagtagagacggggtttcactgtgttagccaggatggtctcgatctcctgacctcgtgatccgcccgccttggcctcccagagtgctgggattacaggtgtgaggcaccatgcccagccaccctcaaatatttgctgaatgaatggctatcgttctttgtcaaatccctttctcattaatcccatgcactgagtagaatggcatgaaatatgtttggtttctctgtctagtttgagttcctgagatctagttggtgagagacatgatgttctaccggttgctgtcgattgttggaagacaaagagccagcccaggatggcagaactggtcctctgcaagaaacagcacgtcagctgccgaggcgcgttccatggccctgcccacccaggcacaggtggtcatctgtggaggtggaatcacgggcacttctgtggcctatcacctctccaaaatggggtggaaggatattgtccttttggagcagggcaggtaaggatcagactgcatttggctcatggctgtgctgcactaatcgtataagattccctctcctttcagagatactgccccaccagtagctaatctaaatgttgctaagtagcatgagaagaagcaaggtggaatctcctgaattttgtttaaggatgactaataatgctcatgttctctggtttttagagagttggcaaatttcgttttccttttttttttttttttttttttttttggtggtggtgttttggtagacaggatctcgctttcttacccaggctgagcttgaattcctggcctcaagcagtcctcccaccttggcctcccaaagtgctgggactacaggcatgacccactgtacccagcaacattttagactttgacaaaaatttgcgtttgtaaataatgtggattgcatttaagcaaagtagacaactgcttgtgtttgcttaattgctaggttcttaatattgttctcattccccaagagaaatatgctctataggcttagtttctctgtgctcgccttcttttaggtcaagtattttctgctttattggcttgtaagctaagtccctttatattaatttgtaatagttacagagattacagaatggattcttataatccatcattaattaatattataccactatacaagtaatgttagattcatacaacaatattggccgggcatggtggctcacacttgtaatcccagcactctgggaggctgaggtgggcagatcacctcaggtcaggagttctagaccagcctggccaacatggtgaaaacctgtctctgctaaacatacaaaaattagctgggcgtggtggtgtgcacctgtaatcccagctactcagcaggctgaggcaggagaatcgcttgaatccgtgaggcggaggtggcagtgagcagagatcatgccactgcacgctagcctgggtgacagagcgagactgtctcaaaaaaaaaaaaaaagaatacaggcctttgactctgataattctcaacctgtgtttagctaatgttttcttattcccttttttttttttttttaagatggggtcttgctgtgtcacccaagctggagtgcagtcacactatcacagctgactgtagccttgacctcgtggattcaagcagtccttctgccatagccttccaagtagctgggactactgacatgcaccaccacatctggctggttgttgtatttttctgtagagatgggatctccctgtgttgcctaggctgttttcttttctttcttttttttttgaaatggagtctggctctgtcacccaggctggagtgcagtggtgcaatttctgctcactgcaacctccgcctcctgggttcaagcaattctcctgcctcagcctcccgagttgctgggattacaggcacccaccaccatgcccggctaatttctgtttttttagtagagacaggatttcaccgtgttagccaggctggtcttggactcctgacctccagtgatctacccaccttggcctcccaaagtactgggattacaggcgcgagccaccacacctggcctaggctgttgtcttgtgatcagacttgggttagagacttttataaccatcactgtattgagatacaatttgcataccatgccactcatccttgttaagtgctgaaatctgtttacagagttgtgcatccatcatcataaccaggtcatacatttttggcagtaagaccacagaaattaggctggactctcagcagtgcaccacatcaggaggtgtatggctgtcctgtctcacttctggtggtgataaacctggtcactcagttacattggtgtcctccaagcatctctagcacagagaccctgttttctccccttgtaatgggccagtgccctttgaggagagatggattctgagattatgccaatatcctgttcatatgagacctccacctaccgggcttagcatccattgacaactgttgcctgagtcagccaccaccgtgatggttgacaaatggtgattttttgatcatacttctacatttattatagttggcatattactgtcaggaagagatttccttctcccccatttatttactcagttatatatctgtatacacacatacacacacacacaccagtttagactcatggatttctattttatgcagtggatagttttttttttgagacagagtcttgctttgtcacccaggctggagtgcagtgacgtgatctcggctcactgcaacctgtgcctcccggattccagtgattctcctgccccaggctcccaagtagctgggattaatagttgcatgccaccacacctggctaattcttgtatttttagtatagatggggtttcaccatgttggccaggcaggtcttgaactcctgacctcagctgatccacccgcctcagcctcccaaagtgctgggattacaggcatgagccaccgtgcccggcccgcagtggatacttttaagagcaaaagtgggttttgtttttgttaatgtttttgagacagagtctcacgctgtcactcaggctggagtgcagtggttcaatctcagctcactacaacctctgcctcctgggctcaagtgatcctcccaccacagcctcctgagtagctgggactacaggcatgcactaccatgcctggctaattttttgtttttttggtagagacgtgatttcaccttgttgtccaggctggcctcaaactcctgggctcaagtgatccgcccacctcaacctcccaaagtactggggttacaggtgtgggccgccacacttggcctcataatgcttccttgatgtcaaagtctttctcctattttttgaaatccttttaaatttaattatcaggtatttccacaaaaagtgataaactaatcgcagtgtaaatgtttctaagtgggagaccctagggaggttcatttttggtttaatttgttgcttcaagattatataataccttagaattgatataaggcagactatttaaacctcacacttaaaaataattacgccagccaggcacgatcgctcacacctgtaatcccaggactttgggaggccaaggtgagtggatcaccggagatcaggagttcgagaccagcttggccaacatggtgaaacgccgtctctactaaaaaatacagaaattaactgggagtggttattcgcgtctgttaatctcagctactcgggaggctgaggtaggaaaatcacttgaatccaggaggcggaggatgcagtgagccaagatcgcaccattgcaccccagcctgggcgacagagcaagactcagtctcaaaaaaaaaaaaaaaaattatgcctcggccaagtgcagtggctcatgcctgttatcccacgactttgggaggccaaggtgggtggatcacctgaggtcgggagttcaagaccagcctgcccaacatggggaaaccccgtctctactaaaaatgcaaaaattagctgggcgtggtggcataagcctgtaattgtagctactcaggaggctgaggcaggagaattgcttgaacctgggaggcagagattgcagtgagccaagtttgtgccactgccctccagcctgggcaacagagtgagactgtctcaaaaaataatagttattattatgccttatccgtggcttgtgaaatggttttatactgccctttatgtataattattcctcttgtccatcttcactattgttctcatagatcaatgggtcttaaatctgtctgcacattagaatcagctggggagcttttaacaattaccagtgcccagacctctccccagaacaaaccagaatctctaggggtgaggccaggcatcaatatttttaaaagcttccccggggactctaatgtacctccaagggcgagagccactgtcaaagctgctcaaggagtgctatcccagcagagacgtcaccagagctataggtgctgaccaccagccagttaatggaactcccacctggggtggagctccacacagttacaaagatgatagaaaaatctctttagggagctgacaatcttatgtggaaaatataattattagagtaaatacagtaaactcaagtgacaggcatgctgacacagatgttagtttatttactgagtgataaataatttggggaaaatgaccttagaaccccccacctgctttcttgacatatgggtcccttgcaaaactgggtctttgggccctagcattactgtagcctttatattctgttgctaccacaaattagagaacatttttttcaatgtaaagtttatgtacttttgaataggcaatgtatttatatgattcaaaattgaaaatatgtaaaagaagctgggtgcagtggcttatgccggtaatcccagcactttgggaggctgaggcgggtggatcatctaaggtcaggaattcgaaaccagcctggccaacatggcaaaaccccatctctactaaaaatacaaatttagccaggcatggtggtgcacacctgtaatcctagctacttgggaggttgaggcaagagaattgcttgaacctgggaggtggaggttgcggtgagccgagattgtgccattgcactccaatctgagtgacgagcaaaactccgtctctaaaaaaacaaacaaacaaaaaaacaaaaattagctgggcatggtgacacacacctgtaatccctgctactcgggagactgaggcaggagaatagcttgaacccaggaggcagaggttgcagtaagccgagattgtgccattgcactccagcctgggtgacaagggaaactgcgtctcaaaaaaaaaaaaaaaaaaaaaagtatatatatatatatgtaaaagagtatacaggaaaaagactccccaatgttctttccttttctttctttttttttttaagatggagtcttgctctgtcacccaggctgtagtgcagtggtgcagcctcagctcctgcaacctctgcctcctgggttcaggcgatcctcctgcctcagccttctgaatagctgggattacagacgcctgccaccatgcccggctgatttttgtatttttagtagagatggggtttcgccatgttggccaggctggtctcgaacgcctgacctcaagtgatctgcctgcctcagcctcccaaagtgctgggattatagatgtgaaccactgcacccagccctcaatcttcacttctaacaaaaagctttctctctggagggaagttaagttctagttatattctctacttctataagcaattatgtgttggtaggtttgtgtatatgtgtatggatattcatttattatattttttctcttttttatataagtgggagcataccttacacactgttcttcaccttgctttttcattatgattgttccattttggtacataaagaccttttcattcttttttatagctgcataatattccattgtatagatgaattccaaaattttattttattttagagatggggtcttgctctattgcttagtctgaagtgtagtggcacaatgctagctcactgcagccgcaaacttttgggatcaagggatcttcttgcctcagcttcccaagtagcctggctaacttttatctttattttttttacttttttttgaggcggagtctcgctctgtcacccaggctggaacgccgtggcacagtcttgactcactgcaagctccacctcccgggttcatgccattctccttcctcagcctcccgagtagctgggactacaggcgcctgccacaatgcctggctaattttttgtattttttgtagagacggggtttcactgtgttagccaagatggtttcgatctcctgaccttgtgatccgcccacctcagcctcccaaagtgctgggattacaggcgtgagccaccgcactcagcctttatttttatttgtttatttatttttatttttatctttttttggtagagacacagtctggctatgttgcccaggccagtcttgaactcctggcctccagtgaacctgctacctcagcctgtcaaagtgctgggattacaggcatgagccactgtgcctggcctaaactatccagaattttaaatctgtcccatgtcattgaacatttttctcaccctgttgcccaagctggagtgcagagatgtgatcacagctcactgcaacctctaccttttgaactcaagcgctcctctggccttagcctcccaagtagctgggactgcaggcatgtgctaccatgcctggctaattttgttgttgttgttggtagagatgggttctccctgtgttgaccaggctggtcgtaaacccctgtcctcaagcagtcctcagtcctcctaccttggcctcctaaagtgctgggattataagtgtgagccactgtgcccagcttgtttccatcttttggtgttagaaacagtattaaatgagaaaccctgacctcgtattcacagatgacgtcaatctacctaatagcattttgcatccatcctgcaggctggctgctggctctaccaggttctgtgctggcatcctgagcactgccaggcacttgaccattgagcagaagatggcagactactcaaacaaactctactatcagttagagcaagaaacagggatccaaacaggtaagcaagtgtcttccatttattgctttgcctgtccctgagattgttatattcatttctgtatttggtcctctgccaggtgtgcctgctgctttggtaattaaaacttgggttggccgggcatggtggctcacgcctgtaatcccagcactttgggaggccgaggcaggcggatcacgaggtcaggagatcgagaccatcctggctaacatggtgaaaccccgtctctactaagaaattaagaaaatatgtaaattatccttactgtacttcttttgaaaataagataccaaattgcttcaactctttcttcataagaattaagagtcattgcattttaggagaattgtcattggcccaagtgtaattatggttctatatcaggtgtgttgattacagacaacaggaattggctctggccaacttggagcttgttgggaggagcttgggcctgtggagttggcaggaggctgccagctggaggcagcctggaagccaggatgtggggactgcaccgcaggcagtccctcagcgagaacaggagcagcctggcgtggctgatgctgcccttgagatggtgacctctagtcattcacctacgtgctcaagactgactcttccaggagggtctgattggataagcttaggtcacatgcccactgtttggctatactggggaagaagaagggagaatccgacccttggtagctgatgttattgtgagtggcctttgccagggattacactcccccaagactaggaggagaaagggtgaaactgcctaaaaggtgggaagaatagggatggtcgaatccctgcccaaaactgtcttttttttttttcttttttttaaagacaaagtctcactctgttacccaggctagagtgcagtggtgcaattttgacccactgcaacctccacctcctgggttcaagcaattctcctgcctcagccttcccggtagctgggattacaggcgtgcaccaccacacctggctaatttttatatttttagtagagacagggtttcaccatgctggccaggctggtctcaaactactgacctcagatgatccgcccccctcagcctcccaaagtgctgcgattacaagcatgagccactacacctggcctagaatctcatttgatcctcacaacctcacaaaactgtgagctgagaatgtttggtcagggcatggagccttagtgcatctgaagttcttaaaattttgcatagaagctcagagaagctgatttacctgcccaaggatattgagtggcagtcccaggattcatcacaggtcttctaacctataatctagtggattttccactctcctgtcctacatttggtctgatctgtctcatttgggctcatttttcttacaggttacacaaggacaggctcaatctttctggcccaaactcaggaccgactgatctccctgaagcgcatcaacgcagggctgaagtacgtaagagtctagaagcgtgtcctgactttaccacactggcctctgccaaagagcctgtgaatgtcattgtcccttgtgttctgtggcagtgttataggtatcccttctgagatcatctcccccaagaaagtggccgagcttcaccatctcctcaacgtgcacgacctggtgggggccatgcatgttcccgaggatgcagtggtgtcttccgctgacgtggctcttgccctggcaagtgctgcctcccaaaatggtgagcaggtttttgcattttcttaagataggttagcagggaagacattacctaaggaagtgtctcacaataggaagtgacaccaactcaagtttggaaagattatcctctttggggtactcagcctccattttgaacacttataattttatttatctgttaatgagtgttttccctcagggccacatttttaaagttctaaagaactgcttttagtgctaattaatgccccttttttggagacagagcttcactcttttcgcccaggctggagtgcaatggcacaatcttggctcactgcaaccttcgcctcctgggttcatgtgatcctcctgcttcagcctcccgagtaggtgggactacaggcgtgccccactacacccggctaatttttttgtgtatttttagtagagacggggtttcgccatattggccaggctggtcttgaactcctgacctcagatgatccacctgcctcggcctccctaagtgctgggattacaggcgtgagccactgtgccctgccaattaatgccctttggacttaaggtaatattttccgccacaggacttgagaagctcaaggtgaaaacacaccttggaagtttaatccacacctgaaatcatgagcccagttgcattgaatgaggggaagacttaactagcgtccagggtatcatatccatggtatgagcaggttagcacttaaggcgcactatttacatcctctcctctctgctccatagtttatgattccaggaatttaattattgtgttccaaagtctgtttttaaactgagttgctattttcaatcttgaacaaggcccatttacatagtctcaggatgtgattctagggttttgtgttttttttaaatgaaagcattgagccgggcgtggtgtctcatgcctgtaatcccagcactttgggaggccaaggcaggcggatcacctgaggccaggagttcaagaccaggctgaccaacatggtaaaaccccatctctattaaaaatactaaaattagccgggcatggtggtgcatgcctgtaatcccagctacttgagaggctgaggcaggagaattgcttgaacccaggaggcagagagcgagccaagatcgcacgactacactccacccttggcgacaaagcaagactccatctcaaaaataaaataaaaaaataaattaaagcattgacttgactttgtcagtgtttcttctgggtggagaacctgctgcacatgccttcattctggaacatcagatgaaacaccaactctttctttaccttggaacaggtgttcagatctatgaccggacatctgttcttcatgtaatggtcaaaaaaggtcaagttactggagtggagaccgataaaggacagattgaatgccagtattttgtcaactgtgctggccaggtaggtcagcaccaacactgctgttcttatttaacgtttgtctccaagatttttttggtgtagagaagtaagattagtattgtgattggttatacagatatcagtaactacgctgtttcttgtagggtattctaaatcagaaacctacacttagtctgcaaatagaagcctgtgtgaccttgtccttcctccacactgggttgatgggtgctatcctggtcaggaaggccagcaaatggtcaggcattgacgtgaatccttggcactgggtcttgatgttacatttcattctataacctagcaaataacatattaggctattttattgtgtcaggaatgtggacactaatttccaggacactgcttcttttaaagcagattggctcttgccttccatgctatgatcccgaagtgaactaagaaatacttttgccatgtgaagttcatttagtgattgctatttggggtttgtagctgagcccaggcgttttatcaaaaggacctcctttggttcccatgagctcctttgactagctggtaaatatctcttcctttgatctcaaagtaatttttatgtcttaaaaaatgtagtattgctccccatccaaataattgaactaaagcaggctgacttcccacacctgacactgtagcaagagcacacataagccacttggaattaatctcaagaggctgaacttgctcatttttatttctgttcctcttcccacccacaaatcaacctgtccatttgtagtgggcatacgagctgggtctgtccaacgaggagccggttagtatcccgctacatgcctgcgaacacttctacctcctgactcgccccttggagacccctctgcagagcagcacaccaagtgaggacttgcacttttttaaaaaatcttgtttctttgccagtatcctgtcctctgaaaaggaaaactttctgctaaggacagcctgtgtctgaaagagtctttcatttctagagcatgttacagggaggtggacccaattctgacttttctttattaactctttatgaaaggatggccaaaatttccattaatacatttttttgtttttgtttgttttgcaagctaattttagtcctaaacagaggtcattgagaatatttggactgtcttgttgactttttaacttgaatgctatggatagtagaaatgtcataggtaaacaatagacttaggtgggttcgtggttccaagcactgtaggagagggttctcacatccttttgacggtcttcatgcctagaatgggctctgcaacccccctctctgttaaactttcgcttggcacagtgggagttacgtggtttgcttgtggggactagtcaaagcttctaggtaagggataatcagagaaacagtctccactgaaaggctaaatgggaggatcttcccccgtgacctcaaaaggtattttaaagctaatgaatgcctgtgttcattgaatgttctttcattaataaagccattaatgggtgtttttgtttggttgttctgtccatttagaaagctgacttgcctctaaacccttgttttttcttccactccccactccatgtcatttctccacctcagctattgtggatgctgatggaagaatttatattcggaactggcagggtggcatcctgtctgggggctttgagaagaacccgaaaccaattttcactgagggcaagaaccagctggagattcagaatctacaggaagactgggatcactttggtatgtgaactgcattataaccgtagtgccttatatttgtttaagatgttatatttttcaaagtattttgaagaatagttccttgtttaatgtttataacatcgccatgaggtacaacagtggttacagagggtgagtttgcctggtctgaggatggagttactaggtagcagattcaggggactaaaatcttagttaatagacatttgccttattcttttttaattttattcttagttttacttttttttttttatttcttgagacggagccttgctccgtgctcagactggagtgcagttgcacaattatagctcactgcagccccgaactcctggtctcatagctttttttttttcttctttttggtagagacatggtctcgccatgttgcccaggttgatctcgaactccaaggctcaagtgatccctttcaccttggcctcccaaagtgctaagattacagatgtgagccactgtacctagccctttgtgtgtgtttagtcatctctatcattttgtgtgtgtgtgagatggcgtcttgccctgtcacctaggctggagtgcagtggcatgatcatagctcactgtagcctcaaattcgtgagctcaagcaatcctgccacatcagcctcccaagtagctgggattacaggtgcttgccaccatgcctagctaatgtttaaattttttgttgagatggggtctcgctgtgttgcccaggctggtctcgaactcttgggctcagtcaatcctgcctcagcttcccaaagtgctgtgattacgggcatgagccatgatacccagctgctttttttttttttttttttttgagatgaagtctcgctctgttgcccaggctggagtgcagtggtgtgatctcggctcactgcaacctctgcctccccggttcaagtgattctcctgcctcagcctccagagtaggtggtaggtgggattacaagcgcctgccaccactcccgactaatttttgtgtttttagtagagacagggtttcaccatgttgatcaggctggtcttgaactcctgacctcaggtgatccgcctgcctcagcctcccaaagtgctgggattacaggcatgagccactgcgtctggcctttttttttttttgagataagagtcttgctctgtcgcccagactggagtgcagtggcacaatctcggctcactccaacctccacctcctaggttcaagtgattctcatgcctcagcctcctgagtagctgggattacaggcatgcatcaacatgtccagctagtttatgtatttttagtagagacaggattttaccacgttggccaggctggtcttgaaatcctggcctcaagtgatctgcctgccttggtctcccaaagtgctgggagtaaaggtgtgagccactgtgcccagctctgcttcttttttttgtttttttgtttttttttgagatggagtttcactcttgttgcccaggctcaagtgcaatggtgcgatctcggctcaccgcaacgtctgcctcccgggttcaagtgattctcctgcctcagcctcctgagtagctgggattacagacatgcgccaccacgcctggctaattttgtatttttagtagagacagggtttctccatgttggtcaggctggtttcgaactcctgacctcaggagatctgcccgccttggcctcccaaagtgctgggattacagacgtgagccaccatgcccggcccctgcttattctttattcacctaaaattattgctcagattttaggttttaggaggagacttctttcagtaggacttcatataaaattgaagagttctttagaaaacagaattgttttgttttgttttgtttttcagaattgttttgttagtgtagtattttattaaattttaaaataattttatttatttatgtatccattcattcattttgagatggagtcttgctctgttgcccaggctggagtgcagtggtgcgatcttagctcactgcatcctccgcctcctggattcaagcaattctcctgcctcagcctcccaggtagctggaattacaggcgcccaccacaacgcagagccagtttttgtgtttttagtagagatggggtttcactatttggccaggctggtcttgaactcctgacctcaagcgatccacccgcctcggcctcccaaagtgctgggattaccggtatgagccaccgcacctggcctttaaggcctgtaatcccagcactttgggaggccaaggcgggcagatcgcctgaggtcaggagttcaagaccagcctggccaacatggcaaaaacccgtctaaatataaaaattagctggatgtggtggcgcacacctgtaacgccagctacgtgggaggctgaggcaggagaattgctggaacccgggaggcagaggctgcagtgggctgagatcgcaccactgcactccagcctgggtgacagagcgagactccatctcaaaaaaaaaaaaaataataataataatatagttacctagttccaaatttaaaaagatgaaagagtctctaatgaagaatttccctctgacccttgatgggctttctttttttaataaattcttacggaaaatttcaaacttttaaaagtggatagaagctgggcacagtggcttacacctgtaattccatcattttgggaggccaagatgggaggatcactggagcccaggaagtgaagaccagcctgggcaacatggcgagactggagactatgtgtctactaaacaaacctggcgagagtagtatgatgagcccccatgtacccattatccagctctggtctggtttcatctttttctgctgtccactggattatgtcctgatggtagatttcctttaaagcagggtgaaagtctgtcttttgcagctattccaatgcagaacattgcctttttttttttttttcctgagatggagtttcactctattgcccaggctggagtgcagtgtcacgatctctgctcacttcaacctccgcctctcagattcaagcgatttttctgcctcagcctcccgagtagctggggttacaggcttccaccatcacgactggctaatttttgtatttttagtagagacgaggcttcgccattttggccataatgctcttgaactcctgacctcaggtgatccgcccaccttggcctcccaaagtgccggggttacaaatgcaagccaccatgcccagctcagaacatcaccttttattaaaatctctgtggccgccatttaagagcttttccactcacactggtcccttcaagattattatctgtagatacgttttacttgctgttctctgctgctttcctttctaaccaatatcttttttcctcagtctttataccaagtattttgcagctatatcctgtaattctaccaaggtttctgctttgtgataaatggcccagttggctcgtctttaaaaaaatctcttccagccggacgcagtggttcacacctataatcctagcactttgggaggccgaggcaggcagatcacttgaggtcaagagttcgaaactagtgtggccatcatggtgaaaccccatctctactaaaaatacaaaaaattagctgggcatggtggtgcacgcctgtaatccgagctaattggcaggctgaggtgagagagtagcttgaacctgggaggcagaggttgcagtgagccgagatcgtgccaccacactccagccggggcgacagagtgagactccatctcaaaaaaaaaaaaaaaaaaaatcaagaggttttctgaaaggggagagtgtaaaaaagtagaggggttgaaagtggtttaattccttaaaggtgagaactctatttggttttgttgtcattgctcagagcctctgttgagttcccttctgaggaggatgccagaattagagactctggagatcatgaagttggtgaactgcccagagaccttcacaccagacatgaggtgcatcatgggcgagtctcctgcagtgcagggctactttgtcctggcaggaatgaactctgctggcctttcatttggtggaggagccggaaagtaagtctttctcactcaaagtcagctgtgaacataagtcaacttgctgggtctcttcccttctagaattacttgttattaacatggcgtgtggtatatttaatctagtatgttaagactaataagaagatacatgtaattttggagttgtccccttctaagtatgagaggctccccatgttccagaaatgtcatcgggcaaaatgtttttgcaactcatcttttggagttagccacagatcctgtgggatattcttttatattttttcagttataacaaatattggtcatttgagtgtgtatttgagtttggtagccaagtatgttgattgaggtaggtatttgaactaggtaatacacggtttgtttgtttttttagacagtcttgctctgtcacccaggctggaatgcagtgacatgatctcaggtcactgcaacctccacctcctgggttcaggctattctcctacctcagcctcccgagtagctgggattagaggtgtgtgccaagacatctggctaatttttctatttttagtagagacagggtttcaccatgttagccaggctggtcttgaactcctgacttcaagtgatccacccaccttggcctcccaaagtgctaggattacaggatgagccactgtgcccggccacaagtttttatttaaaaattagacactaggccgggcgcagtggctcacgcttgtaatcccagcactttgggaggccgaggtgggcggatcacaaggtcatgagatcgagaccactctggctaacacagtgaaaccccatctctactaaaaatacacaaacaaaattagccgggcgttgtggcgggtgcttgtggtcccagctactcgggaggctgagacaggagaatggcgtgaacccaggaggcagagcttgcagtgagccgagattgcgccactgcactccagcctgggcaacagagcgagactctatctcaataaaaataataataataaaataaaataagacactaatgaacattaaataagccagtcacaaaaggacaaataccgtgtggttccacttatatgaagttgctagagttgtcacatcatagagacagaaagtacaatggtggttgccagaggcgggggaggggagctattcttgaatgagcacagagttccagaaatgcaagaggaaaagagttctaggatggatggtggtgaaggttacaccgcagtgtgaatgtacccactgccactgaactgaatacttacaaatgggtaagatggtagccacgatgaaaagtttattttaaatttatgagaccagttctcttgagtgatttgtagaatggctctgaaaacagttacagaagaggagttagaaaaatgtttggagcaaaggagatgtggtcacgtaactgtataatctttaggtgacagaaaaaaacccattggatatttagagtatatttgtatgtgttttagtcttatttcttcatagatgaggcttataacttttttgaaacaagatcttactctcacccaggctggagtgcagtggcaccatcatagctcactgcagccgcaagttcctgggctcaagggatcatcccgcatcagactccagaagagctagaactaactgcaggcgtgtgccaccatacccagctcttttttttttttttttttttgaaacgaagttttgctcttgttgcccaggctggagtgcaatggcacaatctcggctcaccacaacctctgcctcccgggttcaggtgattctcctgcctcagcctcccgagtagctgggattacaggcatgtgccaccacgccggctaattttttttttttttttttttttttttttgagttggggtttcgctcttgttgcccaggctggagtgcaatggcgtgatctaggcttactgcaacctctgcctcccaggttcaagcaattctccttcctcagcctccgtagtagctgggattacaggcgtgtgccaccacactggctaattttgtatttttaatagagacagggtttctccacattggtcaggcttgtttcgaactcctgacctcaagtgatccgtctgcctcggcctcccaaagtgctgggattacaggtgtgagccacctggctcactttgaaacttttttttttctgtagagacggggtcttactatgttgcccaggctggtctcaaactcctgacttcaagcaatctcctgcctcagcctcccaaagttctgggattacaggcatcagccaatgtgtctggctggcttctatgttaaatacctcctagggaatcttatcatctggggtaaaatcctcatagtagtcttttgagagcagtacacagacccatgttcgtttcttccagaaaagttaaggaaagtgcccaaaactattcagctggtctatggcaatttaggatcttttgattctgtttgttctcgatttgtagaatattaattttctcaaatctcacacctgagccccaacacgtgccctctgtctatataggtaccttgccgaatggatggtacatggttatccctcagaaaacgtttgggaattggacctgaaacgttttggagccctccagagcagccgcacctttctgcgccaccgggtcatggaagtcatgcgtaagtgaagctttatcgcagttgctcctagttgcaggtatcttctcggtggcccgtgttgtcattcagaaggagcaaagttttcctcagttctttaacaagtgctttgagttgggcatttgatttgactgtttcaggcctgagttaaggggctttatgctcctcatgatatatacgtaacattttctttagtgcatcggaccttgtttcattctgagaacaagaaaatagaataggagttacagttggtacatagcagcttcataaatattctaagcaatgccttcttcccggtctgccttgagagaccgtatgtcgaagtgcgtgctttctgcagtctgccttgagagaccctgtgtcgaagtgaatgctttctcactcccacttagtttttgagaaaatgctttctcactccccacttagttttttctttccaagtcagagaatttgccgagttattctcagagcttcaggcttccgtgagtgactttcaccattaatccaccctacagcagcaagattgggagccacttcccatataaatacaaaacatacattcctgctctcactcccgtgttctcgccctgcttcaactttgaaggattggccacttcatcttaatttgttattctaccttgatctctgatttattttctaggaagcccttagaaagcttttgtatcaggaattgaaccaaaccacgtgggttcaagttgtaatttcattttcctgtactgaggagctgttctcagactttgccaaatggtatctaaatattttgggcatacttatgctcaggactaagtttctgtgttggctctgaccaccattcttggttgcaagtaaactgttagtttggtagttgaacaacattgttggtgaggactctggatggcctttaatgcctgagtgctcacttttggcctgggaagaggatgtacatccatggagatgaaggacctaacagcaatatgtttaactgctaaggttctttaattttagcaaatattttggttaaaatgttgaacttggctgggtgtggtggctcatgcctgtaatcccagcactttgggacgttgagggaggtaggtcacttgaggtcaggagtttgagaccagcctaggcaacgtagcgaaaccctgtctctactaaaaccaaaaccaaaaaattagccatgcctagtggcacacacctgaagtcccagctacttgggaggctgaggtaggcgaatcacctgagctggggaagttgaggctgcagtgagccatgatggtgccactgtgtactccagcctgggcagtgggactgagaccctgtctcaaaaaaataaaatacaaaatcaaagttttttgttttaaagttgaactattataagcctaaatttccctacccatagttactttggaacctgtacaaatcataattgagcttgagcttctgcttggtgatatgacacttttggtagccaattctcatgaaatagaagtggcaggcacatagaaaatggggaaggcgccaggcgcagtggctcaagcctgtaatcccagcatgttgggaggctgaggcaggcggatcacttgaggtcaggaggtctggcctgaccaacatggcgaaaccctgtctctactaaaaatacaaaaatttagccagatgtggtggtacgtgcctgtgatcccagctacttggcaggctgaggcaggacaatcacttgaacccgggagatggaggttgcagtgagccaagatctcaccactgcactctagcctgggtgatagagagggattccatctcaacaaaaaataaaaaaaaaatagaaaagaaaatgggggaggggatgatagaaccgaaagtactaggagatggagagattgtcaccatgcagagaaccccacctggcttccttctcctgtctcccaacctccccaagccttgatgtgccttttgtttgggatggtgtgagatcagggaccacagatcacactcttctggctttttttacttattgctgttgaagattagaccttaagggaaatgaattttttttttttccgagacagtcttgctctattgcccaggctggagtgccgtggcgtgatttcggctcactgcaacctctgcctcctgggttcaaacaattctcctgcctcagcctcccgagtagctgggattacaggcgcctgccaccatgcctggctaatttatgtatttttagtagagacagggtttcaccacattggtcaggctgatcttgaactcctgacctcgtgatccgcccacctcgacctctcagtgctgggtttacagacgtgagccaccacacccggcctaagagaaatgaattctgaccctagctttgttgtgtgaataatgtcattggtacaatacaatataacttctcagatttcagagccacctaatcaagctgcaatatgtaccctttcacttcagaagtgagttaattatcagggaggaaatgtctgtaacaggtctgagatcctaacacaggcacaatgaagaatcgaatgccattttttcacattttgttaccacctgtgtcccacttagtaaccttcttctctgctatgaagcttggtaaggtttaggaccctgacctttctgccatcatttctacctactaatgtggaatgctgaatgtgaatacaggccgagtcatgccgtgacacgtagctccagggagggacgatagcagcttggcaggattgtcttttccttctggagcatgcctgatacactgggtaattttgaaaattagactacattagcctggaaattgggccgggcagagtggctcacgcctgtaatcccagcacttcgggaggctggggcgggcagatcacctgaggtcaggagtttgagaccagcctgaccaacatggagaaaccctgtctctactaaaaatacaaaaattagtgtggcacggtgacacgtgcctgtaatcccagctactcgggaggctgaggcaggagaatcgcttaaacccaggaggcagaggttgcagtaagccgagattgtgccactgcactccagcctggacaacaagagcaaaactccgtcttaaaaaaaaaaaaaaactacgttagcctggaaagctcttttgaatagaaacaactccagagtctagtggacatgggctactcaggtctagaatctgtgtcttgggctttgatagactactcgtgtcttttctagctttgatgtatgatctgaaggttccccgctgggacttccagaccggtaggcagttacgcacctctcctctctacgaccggctggatgcacagggagccaggtggatggagaaacatggatttgagaggccaaagtactttgttccccccgacaagggtaagaagtcacattctcatttttgcttcttttttttttttttgtcctgggaattaataaaacatattttcaaatgcataggctagaatgtgttcacagaagaaaaagaaccacgtggactacactaaactctacagggccttgtgatttttccattccgtagacctcctggcattggagcagagcaagactttctataagccagattggtttgacatcgtggagtctgaagtcaagtgctgtaaggaagctgtgtgtgtcattgacatgtcctctttcacaaagtttgagataacagtaagtatttgggaaccaaaaagtaatagattaggaaactttacatatttattgaatgccttttgtttttcatcttcaaaactgattcctgactgggtgcagtgggtcatgcctgtattcccagcactttgggaggccaagggggcgtggatcacctgaggtcagagttccagaccagcctggccaagatggtgaaaccccgtttctactaaaaatacaaaaattaaggccaggagtggtggctcatgcctgtaatcccagcagtttgggaggccgagacgggtggatcacctgagatcaggagttcaagaccagcctggccaacatggcgaaaccgtctctaccaaaaatacaaaaaattaaccaggcatggtggcgggcacttgtaatcccagctactcgggaggcaggagaatcgcgtgaactcatgaggtggaggttgcagtgagctgagattgcgccactgcactcagcctgggcaacagagtgagactccatctcaaaaaaaaaaacaaaaaacaaaaacaaaacactgatttcttaagaattctggtatattttagtgtttcatctgtattgtaacatttttctgaaattttagctccttgtttcaggtttttaatttgctagagaggcctgtttatcataagaatcaatagctagcgttccctggagcttcttgcagtggagtaggtctgcaaatgttgtcacatgggaattggctgattgaattttctcaatgaggttcattgctggtggggccatgtggcccagccaggtgctctcacgctcactctctctgtttcattccctaaccctgcagtccactggggatcaggcattagaagttctacagtacctcttctccaatgacctggatgtgcctgtgggccacattgtgcatactggcatgctcaacgagggtggagggtatgaaaatgactgcagcatagcacgactgaacaagcgcaggtgagatgagctgccgtcccgctctgctccctccaacatgttgattccttaggggtgctgtagcagaggctctcaggcgcttctccgggaaccataaatcccagagtctaagaatcattacatgaaatcaaagccagtttattagcagtcctaaacaaaagaaatcaccaggaggaaaagaaaaaaaagcccaccagattatgtaccctactgggagaagatgccttgtcttttttcttttttttttttttgagacagggtctcactttgttacccaggctggagtgcagtgatgcgatcatggatccctgcagcctggacctcctgggctcaagtgatcctcccacctcagctttccaggtagctgggaccacaggtacacgccaccacacccagccagtttttgtatattttgtagagatagggttttgccacattgcccaggctgatcttgaacacctgagctcaagcaatctgcccaccttggcctccaaagtgctgggattacaggtgtgagccactgtgcccagccgatgtcttaacgttagtaaatctgtataatttcttggcattaacaggaagccagaattttgttttgttgttaggtggtgtatcctagaatggtgctactggccttctgtgaaagctaagaaatcatttcctagtatttgcctcattgctttgaaaccaaataagatttgattgcttcctgatccttttgctgctacctggttttgattattttggggtctcacttttcagtttcttcatgatctctccaaccgaccagcaggtccactgttgggcctggcttaagaaacacatgccgaaagacagcaacctgctcctggaggacgtcacctggaagtacacaggtacgggggttcgggctctgccacgtcgaaaaggccagcagatgcagatgtgtccacgtttgccttctttacatttgactctcaaaaatgaacattagagttagcataaaagaggctctctggtcatagaaaattgatctctaggggatgcggtggctgacacctgtaatcccagcacttttggaggccgaggttggaggatcactaggtcaggagttcgagaccaacctggactatatggtgaaaccccgtctctactagaaatacaaaaattagctgggcgtggtggcacacacctgtaatcccagctacttgggaggctgaggcaggagaatcacttgaacccaggaggcagaggttgcagtgagccccagattgcaccactgcactccagcctaggcgagtgagactccatctcaaaaaaaaaaagaaaattgagggctggacacagtggcttacacctgtaatcccagcactttgggaggctgaggcgggcggatcatgaggtcaggaatttgagaccagcctggccaacatggtgaaaccccatctctactaaaaatacaaaaattagctggacatggtggtgcatgcctgtagtcccagctactcatgaggctgaagcaggagaatcgcttgaatctgggaggcagaggttgcagtgagccaagatcatgccattgcacctccacctcccgggttcaagcgattcttctgcctcagcctcccaagtagctgggattataggcgcccgccaccacgccgggctaatttctgtatttttagtagagatggggtttcaccatgttggccaggctggtcttgaactcttgacctcgtgatccacctgcttcggcctcccaaagtgctgggattacaggcatgagccaccacgcccagtcccagagagtacctaatttttaaggatgacttggttccctgattttctcactctcagcagtctcggcttaacccctcccaccttcccacctaactgatcttgccccttggccccaccagcgtttgctctcccaggctctcattctcaattccttgtagtagcaaatatgatatacgtcctgctcctggattgggatactacagaatgttactgaacaaaagtcatgttctagcctgtcttaggatggatgacatgtaattagcacaagctgatgtcacaaacactggtgtccagaataatgctttccttatctagtaagcattaggatatgtttgaagtggatttagcttctctgaatttaaagtctgtatactttttggttgggcagatctccaccgggtactgatttggggttggggcttcttccatcacatagccttgctgggaaaaggaggagaacgggaattgtgtggggtggttatggccagccctgctgcgttcagcaggccctgttggcagaggtgtattcgccagaatcggggtgcttagcatccatccttggagtgtctaagcaaagggacatattcctggtctctgcacccaggcctggctatagctgagcaagtctacagtagacctttcccattggctcagctgttcagaaggagagctggacatctcttgttcttttccatttagccctcaatctgattggccctcgagctgtggatgtgctgtctgagttgtcctatgcccctatgactccagaccacttcccaagcctcttttgcaaggtaagtgctgataaagttctgtttcttaaatgggcagagaatgtgtctttcatagcggtggcaggtacatattcttactatggtgttagcacccacaaagagtgtcttggctgggtgaggtggcacatgcctgtaatcctagcactttgggaggccgaggcaggtggatcacccaaagtcaggagtttgagaccagcctggccaacatggtgagaccctgtctctgttaaaaatacaaaaattagctgggtatggtctcacgcacctataatcccagctacttgggaggctgaggcacaggaatcgcttgaactctggaggcagaggtcgcagtgagccgagaacacgccactgcactccacctgggtgacagagtgagactctgtctcaaataaaagagtgtgctggccaggtgcagtggctcacgcctataatcccagcactttgggattacatcttatatttataaataaatataaaaatacaaaaattagccgggtgtggtggcgcatgcctgtggtcccagctactcgggaggctgaggcaggagaatgacttgaacctgggaggcagatgttgcagtgagccgagattgcgccattgcactccaggctggcaacagagcaagactgtctcaaaaaaaaaaaaaaaaatgtgctgcccttcattagcaaagaagtgactaagtatatttatttatttatttatttatttatttattttgagacagagtttcactcttgttgcacaggctggcgtgcaatggtgcgatctcggctcactgcaacctccacttcccgggttcaggcgattctcctgtttcagcctcccgagtagctgggattacaagcgcccgccaccatgcccagctaactttttgtatttttagtagagacagggtttcaccatgtttgccaggctggtcttgaactcctgacctcaggtgaaccacccacctcagcctcccaaagtgctgggattacaggtgtgagccactgcgcccggccttatttgtttattttttacactccaagcttgctttatttaataagcattaggatatctttgaagtggatttagcttctctaaatgtaaagtctttatgctttttggtttctgtagcactggattaaaatttgaagttacaggattatgacacacacaaaaatgcctttcgaagttaggtcccttctctccatgcagtgtggcctcttttctgtacacagagtaacttctgtgtctgtggcatcttcagggaagaaatggcgtaggtgaatctctgaacttcctacataattttctttcctataagtggcaaccacagctgagtgaaacaaactgtaaccgaatgaaagcaatgacaacggaatcctccccaggaagctgctgattagagagggccaaacggacagacatcttggccacctgtaacgagcaacttccaggtggttactgatggagactctttgaagttcacccaaagtgggatccacctacaaattgtttcacagttttccttcttctccgaggcaaagtgaaagcaacagaaaactctccactgttagctatcagtggacccctcccagcgtttgctctgctgcttggaggagtgacccatacgctcaacacctggcgagtgctgcatcctgtcagcctcctgtggaagcggttcacttcggtgctgtccaggactttccactttcctttataggaacggtgattgcgtcagtggccgctgttagggaactgagctgctatgtaacgtgttctgagaatcagaagcccatctttgaccccaggatagcagattaattatgtctgtgggcatcgggcatcatcttttgtatggcaggcggccagggtttgtctgctgattcccccagagaagacactcgccttgtcctcattgtgcctgctaccctcgactaacacaaggacctggcaaagaggaatattttgtgcttgtcaaggactttcctccactctctaccatcagcttggctaaaactcctgagatggtaacagtagcaagcagagatgtcacataggcagtgctccattctctgtgcctcaggacctggaagttaaccactttcgggatgaaattcttgccttgacgtctgtctccctcaacagtaaacagagggtgcagcactaatgaaaggtttccccaggcgtccctcccttgacaagtaatgtgagtgcccaggctgactgctgcctttgtccctgcaggagatgagtgtgggctatgcaaatgggatccgggtgatgagcatgacgcacacaggagagccaggattcatgctctacatccccatagaggtgagagggcacccttcccttcccttcccttcacttcccttcccttcccttcccttcccttcccacaaccactgtggggtgccagtgctcccagcagcgcgttcaccagcactggcaggtttggagagctgtatctgattgggccttgggagctgaggtaggctgcattgaagagatttgaccatttttaactaagttatataagtttttttgaataggtgatacatttaaaaagtatttggcgccgtctgatctgttctcaccaactgtcaccaataatattagtattacttttatatgtcatttcagatttgtatgcatattgcaagcaaattcataattaatttttttttttttttgagacagggtctcactcttttgcccagggtggagtgcaatggcatgaccgtggctcactgcagcctcgacctcttgggctcaagccaccctcccacctccgcctcccgagtagctgggactgtaggcatgtgccaccatgcctggctaatttttgtatttttttgtagagacaggttttgccatgtcgctcaagctggtctcaaactcctgacctcaggtgatacacccaccttgtcctcccaaagtgctgggattataggtgtgagccaccatacccagccaagccccctttttaaaaacagaaatggaagcatactgctattcttcatcctgtttttttttttttcacttcacaattttttttttaattgaggcagagtctcactctgtcacctagggtggaatgtagtggcataatctcagttcactgcaaccttcgcctcccaggttcaagtgattgtcctgcttcagcctcccgagtagctgggattacaggtgcacgccaccacgcctggctaatttttgtatttttagtacagacggggcttcaccatgttgcccaggcttgtttccaactcctgacctcaagtggtccacacacctcagcctcccaaagtgctgggattacaggcatgagctaccatgcccggcctcacttcacaatttctcttagagctctttctttgttggtacctaaagcaaaagagcttccttgttctttttttctttattttttaacagtggcgtagcattccattgtggtacatcattccgatactaatagacatttatgttatttctagtcttttgctgttataaaaaggtctgcaggctgagttcagtctaatcatatgcaaatagtaatagtttcttccttctccagaaccttttttttgagacggagtctcactctgtcgcccaggctggagtgcagtggcgcaatctcggctcactgcaagctccgcctcccgggttcacgccattctcctgcctcagcctcctgagtagctgggactacaggcgcctgccaccacgcccggctaattttttgtatttttcatagagacggggtttcaccgggttaaccagaatggtctcgatctcctacctcgtgatctgccagccttggcctcccaaagtgctgggattagaagcgtgagccaccgcacccggccggcttttttttttttttttcttttttttttttgagatgaagtctcacacttgtcccccaggctggagtgcgatgacatgatctaggctcaccgcaacctctgcctcccgggttcaagtgattctcctgcctcagcctcccgagtagctgggattacaggcgcctgccaccacacccgactaatttttgtatttttagtagagacaggatttcaccatgttggccagcttggtctcgaactcctgaccttaggtgatccacccacctcggcctcccaaagtgctggaattacaggcgtgagccaccgcacccgggcccatagtctttcttcctataatttccttcctttgttctattgtgacaggtagcaatcaatgattgtaggcatgcttgttttcttcttgatgttagtcatactacttgtagtgataggttttctcttaattttttttttttttgtgagacagggcattgctctgtcacccaggctggcttactgcagcttgacctccgaggctgaagtgatccccctgcctcagcctcctgaatagctgggactacaagcatgtgccaacatccccagctaattttttaattttatttttgtagaggcagggtcttgctatgttgcctaggctggtctcagactcctggactctagtgatcctctcacgtcagcctcccaaagtattgggattacatgtgtgagccactaccccgaccttatttattactattttttagtgcagtgggatgatcatagctcactgtagccttgaacttctgggcttaagcagtcatcccacttcagcttcctgagtagataggaccacagatgcccagctatcttttatttttttgtttttagacggagcctcccactgtcgcccaggctggagtgtagtggcatgatctcggctcactgcaagccccacctcctgggttcaagcgattctcctgcctcagcctcctgagtagctgggactacaggcacacgccaccacactcggctaattttttgtatttttcatagagacagggtttcaccgtgttggccaggatggtctcaatcgcctgacctcgtgagccgcctgcctcagcctcccaaagtgctgggattacaggcatgagccaccgcacccggcctatttttttattttttgtagctttgagagtctcaatatgttgcccaggctggactctaactccagcctcaaatgatcctctcatctcagcctcccaaagtgttgggattaccggcgtgagccactgtgtctggccctgttttaactatttgagccactgtgcccaaccctttttaaatgattaaagcacagataatatcagcgcatgaaatttcatctgcttttccacactcagaagtattacaacaatatgaagatgaagagattgttcaagacttgggaagaatttaaacagatgcagctgccatggttggcctgtgcaggcaggttgattctgaagtgccacccagtggttcaggtgttgtcacctgggtgcttgtggtcaaacctcatcaggaaggggaggctctgtggctctagcagcttcatccttgcttggaggccttggtttcagctttctgatttccctgggctgttcccattcttatgatttttcaagagtctaagagattatttgtgccacgcttgggttctttataagctggcttttgtccaggaagcttatgtttgtctctctgagaagaggtcttccaaaacatgggggcagatggcagattctcgttttgttcacactaaatctctggtattttgtgagaaaaacgagtaaatggtggggaactactctttgagtaaatggtggggacccactcttctctttgattttcccagcattagtcacgtagttggatctggcccaacactagtcacctggttacatcgttcttccttggtcatcctcttacctaaaggaccgggcattgagcttgaggtgggagagtaccacattccctggagatgccagctgtgtattctcctcgtcctgccgcattctgtgggtctcctgcacccaccttggctgattcaggtgtttcccttacacacataccacaggcgagtgttgcatgcaatagcttggattccttttttccacatttaaagttgtcttcccggcacggtggctcatgtctgtaatcccagcaatttgggaggccaaggtgagtgaatcatctgaggtcaggagttcgagagcagcctggtcaacatggcgaaacctcgtctctactaaaaatacaaaaattagctgggtgtggcggcagccacctatagtaccagctactcgggaggctgaggcaggagattcacttgaacccgggagtggagatggcagtgagccgagatcgcgccacttcactctagcctgggcaaaagagcaaaactctgtctcaaaaataaataagtaaataaagttgtcttgatcatagtggtctgtttggtagatgcctgttcagctacagtggtgcagttcatagaaacatactgtgctaggataaagaactgcagtaccactgaagctggttctttgctacgtcttgctttggatttcattttacagttttaaaagcaaacagtgtagtctcatttttgttggactttaaacttaacagcgtatgttcagacagggattgaatatttgctttcagtttggaaaaccttctgttcactgatctgataacgtacatgtttctgaaaccaagaaaagagcagcttgagagcctgaatgctgtgggacatgagcaggcgagccctgccttcctggctcccccgccgtcatccgatgtgtgcacacgtctcgagtaacgtgtgagagctgggcctcacagcttgggccagtacgtgagggagtaacagtggttgggaaattggagcaaaagaacaaagccagaatcagatgaagaccatggagggttggtgggctgttttagaaatgatgatgagattggccatttaccaaatggtgagagagcttctataaattattatttaagaattgctgtaagctagaatcaccacacaagacattttagagaggtgaaaagacatggatcctgttgtcatggagcttaagtccaggctggggtgaccccagctcatcactcctgggctgtgccctgagcgtgtcaaggatgagacatcctgggagttttatacgcctcctctcttgtccatgttaatagtgtgagccatcagcgcttccagacatgctccatgcttaattctgaaggtctgctgcttatgaactttctgtctcttcctatagtacgccctgcatgtatacaatgaagtgatgagtgttggccagaaatacggaatccggaatgctgggtattacgctcttcgcagtctccgaattgagaagttttttgccttctggggtcaggatataaataacctcaccacgcccctggaatgtggacgagagtctcgggtgaaattagagaaggtactgtgtttacccagactccactttcactcagcatcccgagtagtgaatctgcactagactaggaagaagaactgatgtgacaggaaaagggggaaaagattgaggccttgatgttagcatcaggtaaatgaggacaagagtgccctgagaatgaaaactttataggataaaatatcttcaaatgaaaacataataatggtggctcacgcctgaatcccagcactttgggaggctgaggcgggtggatcacctgaggtcaggagttcgagaccagcctggccaacatggcaaaacccgtctctactaaaaatacaaaaagtaggccgggcacggtggctcacacctgtaatcccaacactttgggaggccaaggcgggcggatcacaagttcaggagatcgagatcatcctagctaacacagtgaaaccccgtctctactaaaaatacaaaaaattagccgggtgtggttgcgggcgcctatagtcaggagaatggcgtgaacccaggaggcagaggttgcagtgagccgagatcacgccactgcactccagcctgggcgacagagcgagactccgtctcaaaaaaaaaaaaatttacaaaaagtagctgggcgtggtggccagcacctgtagttccagctactcgggaggctgaggcaggagaatcacttgaacctaacaggcagaggttgcagtgagccaaaatcgcaccactgcactccagcctgtgtgacagggcaagactccgtctcagaaaaaagaaaacatagtaaatagatgacacttggtcaggtgcggtggctcacaactgtaatcctagcactttgggaggccaaggcaggaggatcacttgagctcagcctgggcaatacagcaagaccttgtctctgaattacaattgaaaaacaaacaaaaaaacccacttatttctagtgttctgctgtctaaaagactgagtgctttctgggaagctattctgagttaattatggtgatgcattaacatgccacgaatatttgtacaaactagtcgtcctatagtcagctgcctaatttttgtggtttttttcttttgtttttgattttgaggtggggtctcattctgtcacccaggttggagtgcagtggcgcgatgttggctcactgcaatgccctctcatgctcaagtgatcctcccacttcagcctcccaagtggctgggaccacagatgcacaaccatgcccagctaatttttttgtattttggtaaagacagagtttcaccacattggccagggtggtctcgaactcctgagctcaggtgatccgccctcctcggcctcccagagtgctgggattacaggcgtgagacagcacacccggcctaatttttttggtttttttgttttgggcggatcacctgagttcacaagttcgagaccagcccggccaacatggtgaaaccccgtatctgctaaaaatataaaaattagctgggcatggtggcaggcacctgtaatcccagctactcggtaggctgaggcaggagaattgcctgaacctgggaggcagaggttgcagtgagccgagatcataccattgtactcccacctgggtgacagagcaaggctccatctccaaaaaaaaaaaaggtaataacccattttggaaaatataaagaaggaaattaaaatcacccatattttgtctatttaatggtagtaactattttttttttctttcttgagacggagtttcgttcttgttgtccaggctggagtgcagtggcgcgatctcagctcactgcaatctctgcctcctggcttcaagcgattctcctgcctcagtctcccgagtagctgtaagccatccagctaattttgtattttttgtctttaccaaaatacaaaaaattaggtgggtgtggtggcgcatctgtgggcccagctacttgggaggctgaagtgggagaatcacttgagcatgagaaggcatttttgtattttttctttttttagtagagatggggtttctccaggttggtcaggctggtctcgaactcctgacctcaggagatccccccgccttagcctcccaaagtgctgggattacaggcgtgagccaccgtgcctggccataatcaccgttaatagtttattctagtcttatttgttgtacatatgtgtatatatgtgtgtatgcattgaatatagatgtgcatggtcttgttgggattatataaaaaagtctttttttttttttttttgagacagagttttgctgtgtcaaccgaggctggactgcagtggtgcaatcttggctcactgcagcctctgccacccaggttcaaacgattttcctgtctcagtctccctagaattataggcacactccaccagaatcttggctcactgcagcctctgcctcccaggttcaagtgattttcctgtctcagcctcccaagtagctagaactataggcacactccaccacacccagcttatttttgtatttttagtagagatgaggtttgcctcatctctgttcaaggcgtgagccaccacgactggccaatataaaaacatttttctaaagtactggactgataaggtattttattaagtgagtgagttttcttcctaaacgtttttgttctatctggtcttgtgactttatgtttataaaataggaaacaaaatgcgtacctctgttgttacaaaaattaccgcggcgtcttttatatttcacatgcagtttttcacatggtagaaatcgcacagtttcccaaaagctggcagggttgtgggaggaggcggctgtgccccattgcagtgacaccaggggacccttcccacggtgctgctctctgtgccgagggtctgagtgtcgctggatgactcggcgtttcctttctttcttagggcatggatttcattggtcgcgacgccctcctgcagcagaagcagaatggagtgtataaacgcctcaccatgttcatcctggacgaccatgattcagacctagacctttggccttggtggggagagcccatttaccggaatgggcagtatgttggcaagaccaccagcagtgcctacagctacagcctggagcgccacgtttgcctgggctttgtgcacaatttttctgaggacacgggggaagagcaagtggtgacagcagatttcatcaaccggggagagtatgagattgacatcgcgggataccgcttccaggccaaggccaagctctaccctgtcgcctccctcttcacccagaagcgccgaaaggatgacatggagctgagtgacttacatgggaagtgatgccaccagggcagcctcacctcctccccatcatcttgtcctagagtgggcgtcaccttggagcttctcttccttccgcctctgttcctcttctggagcctttgcctcccatctcttatctccttgatataattttgaacttgacctactttaaacttttttgctctgcagccttccttgcccttccacctcctcctcctaatattcactctgggctcttcttcccttcccacccctcactcagcttctcgtggtggcaggaggtatgtctgacaggacagaagcaagctccactgtggacatgagtgatggtgacagctgctttcaaattctgcatctcaaggcagggcaagccggggtggtgcaggtctcagggcacgagtccctctcccttgggttccattttcttggagcagcctattagttctggtggggttgccgtgtgtcggatgcagccctgaggggcagctcgtgcctgcagcccggcagctcgttctcctgttctgctgtgctgtgggctggcactcgatacctctggcaagaggatgattatctacctcactgataagaggcatcgcatggacgttctctggtctgtagtggagacaagcagttaacctagcaccatcctcatcctccctgcagaagccattagcagacctttgggccagggcagcctccctataattttcttcatctcttgctaatctctataataaggttgctttttctttcttagttgagtaaacaagtaagccacagtgtttgaaagggaaaaaccatattgccttgtgtgttgcttttcccagtcaaaagggtctgaccttagaaagtccccaccagtgatgctgagtgttctgctatggaaacaatgctgcttttctctcagctgtccaaagttcagccgttcctccttccccttctcccagtgcgtttgactttgtcaggtcagcctcacttgtccctttcacagttggcccataaagtcatgtttctctccctttagaatagggaggggaagggatcaggtgtgttgtcctgggcctttcaaccttgcgggctgtgctgagttccagagagctgccggaattccaggtttgactctccagcacagagcagagctacacagaggtgacccacgttagtccactgagagttctgagtccaaagggtgtacgttgcataaggctagagaccgcttttcctcctttccccccaggctctttgtttccctccacccacccttccatatcctctggagcaggagacaatgtgggtgcccagaagtgccctgcgctttcaggcagtgtctctgttttcccaaggtgaaacttagatatcatggactgttgtccagcctcaatgcttcattttccccttgcatatcaactgccctaatctgactttttttaagtgcaaataaactgctataagacattttggttagtaaaactctagcctttggcgtgttggtatcttggaagcattagctctgataggtctataagtgtattaagggacatccttccatttcattagagcagcttaaaatgctcaggtgtctgccttctctggtgtttctttgggatctctgtttacccacttacgctggctccttctagacatttcttgccacttccccaactagaccactcctagtgattactgactttagtgcctaaacctttttggaaggttctggttggcttgttagaggagcatatgattagaattctgtttgggggtctagttgtcttggagcaagtatgtacttaactagccgagagatgctgcctctaggcagagaggaggagaggtgttgccggctggagggccaaccagtgaacaccagctgtgaaggccttgggagaggaggaacaggcccttgggcagatgcaggcattaccagcagggagcagacttacctccgaagatggagacaggtgactgagagctgcaggcctcctctgctcttccaaacacgtagcatttgcacccctccaaagccatctttgtaaaggaaaacgtatttgtaattgaatccagaagaatttagttacacatagacataactcttcaaccttaactatggcaatacatttgtgctttaactgttacatagcagtatcaccacttaccaggatccaaatcgaaataataaaagctgtctccatagtttaaaatcgaatagtgccatcatcacagtatattagtcaaatagaagcttcatcagaaatgtatcccacatagagttttaagacttggattctcttctgcccttgttaatctccaactaattactacagattgacacgtttttaattagctgtcctttgtaagaagtcaggaaatctgatgctgtgtccaaaattatgcactgtttgttgaagtagaaccagaaatcctgacctcctgttaaatgacatcagtttccccctctgagcaacagactgcttgtcttgctaggagaggaggatggggggctgagcactcaggctgtccattgaaaccccttgtccatgaatagggtcatactcctaagactgatggggtgttgatcttctaggacatcacttgtttattcagtgccccaaacacagatttctcttctagcactttagagttgatccttgaagtctctcctggttcattcaaatacaagctgtgtgagtctggtggttttctgtgattggtctaatgtgagctctttgaacagacagatctgacagtgaatgactctcccctgcttctggcataactgctttgcctctgtctagtgtccaagcatcttagctgttcaagaggagagggcagcataacttcctgaccaccggtgtcagatatcagagcattctggactcctgagaggcagtggcctcttgagtgaacaggggaggccagtagatgccccagatccagagccgtggctgcaaatccagcaggaataaggagggacaaccacagcctcctcatccatgtgtcatttccaagggtttgccttgtgtctcagctcattctgggcagcacgtttgtcttctgtccctagagatttgaaggattttggactcttgtgaatgggtgactggacttggctttacagagttgggtgcttttttctctctgcaattacctgtcatagcattttgtgctcaccacgaaggatggtctctgccttctcttgtcggtgtatgccatctgaacctaggaacacaaagtatattggcctcaaacggagacccagggttgccagttttccgtgggccttcccctcccttgaaatgtctttaattacctccccttcatcgtcaggccacgtgtgacttctgttcttagcactgccagggtcattgacttccatctaagcttgcatcaggaagatgttccttctgtgatcattggtactgaagccagaaaagctctcattcaggaactctgaagagcaaaaagggacaaacactaactgctgagctgggccatttgatctcctttcaccttgcattgctgtcacagcaccttgtatgatggcaggacaggctccagcagagagaactgcacagtgaccactgtatttttcacgctcttccagggatccctgtcccccgacattgaagagatctcattcaggccagagacacagagaccacatagcccagtgattaaaccccggtttcactctggccccaggagtggagcctggccactcctgtttggttctcactgggaggcccactggccttggatcatctcctcatgcacacccggagttttacctgcttgcttgctttcctggactgctgtttgcaagaaagtaactaaaacatgaaaagtaaacctccagcttccacagtatattacctgccgttgcatgcatttgaaagttagcctcctcccttgccaccgtcttggtggcagtagcgatgcaagaatgatgggagctttccgagagcgttcagtgtttcactgaagacaggacccatagccttcatttctggctctgtgtctcctctggcatatggacacatttcctggcatttgcctgagtctacaccactttttgagaacctgaaatagaagggaatcttctgtggcccacagtctccatattggcactagaagactggcctggcggaggaatttgcgttggcttgctttcaggggttagctacaagattcagctttatatctctgttgcttcttggccagtgtagtcaataagggtcttctttaacatctaagatagaggtttggttggccgggcgtggtcgcttactcctgtaatcccagcactttgggaggcccagtgaggtgggagaattgcttgaacccaggaggcagaggttgcagtgagctgagattgcaccactgcactccagcctgggtaacagagtgagactcttgtctc

SEQ ID NO: 1986 - DNA, 12872 bp, Homo sapiens
ctctgcctgctgtcgggggcgggctggccaggccgaggccggagcaggcaggcatcccccggagttgtctcttttcatgccagcgccaacaggaggctgtctggacacactgattactcactcaccagcctccctcttttgtccaccagcccagcctgactcctggagattgtgaatagctccatccagcctgagaaacaagccgggtggctgagccaggctgtgcacggagtgcctgacgggcccaacagacccatgctgcatccagagacctcccctggccgggggcatctcctggctgtgctcctggccctccttggcaccgcctgggcagaggtgtggccaccccagctgcaggagcaggctccgatggccggaggtaagggacacctggtgaggaggtaggtggaggcaccattatgagctctgaggagtgggtgctaggagacttctggaagcccggtcccaggcctgagccccaggccgtgcgggtggtttaatgaggaagccctgggacagcccgggggcggtgaggggtggatgctggactggggaggaaggaggaggaaggaggaccagggctggggtcaaggaggaacgccgaggagcgctgtggctggggcctggagaaatccgtggcccggaggagccccagacaggggcctgcgggagccagggctggcccctacacccagcccgcaccgctgttccctcccgccaccccaaccccagcactcagcccacgcctgctgtacctggtctctctctcagcctcgctccattgctatgccccacgtcccctgcacccaccacactcctctcccatcttgttttccaagggcagggacacatgcttattctgccgtgtgttgggttcaggtccccccatcctcgggctgcctgaccttctctctccaccccagccctgaacaggaaggagagtttcttgctcctctccctgcacaaccgcctgcgcagctgggtccagccccctgcggctgacatgcggaggctggtgagtacccgacccagctgggctctgccaggggggtggccggaggcgcggaccccagagggcggctcaggaggccacgcctgtccaggtgcccttccacttgaccagggtgggcaggcacagccagccaccttgcccctgagggacggaggccctggttgctgggggtctctgcagtttcttaaccccccaccctcagttcaggaggtcgggccccttggctcccactcgcctgaagggcaggaccttgggccttccctggcatcttgttgccacagagaccaggagccacaggaggagccggatcccctcctccagggaaggggagcttcacgaggagccctgcaggatgggcggccgggccagggagggagaaggtcgtgctgggctggggaggggcttctgtgcggcaaggacccagcgcctcctcctgagcttatctgagccacgaggacgggccttgcccatgttctctgctcactcactcgtccacattttccacattttcagcaggggccgggggtcgggggtatagagttccccaccagcccggctggggctgcggggttgggactgtcatctggaggctcagaaacgctgccctccattgtctgggaccccagcagccccagcccatgttagcaggccagggagccagggcagggtggtgggggcgggagggttccccatggctgcttcccatgaactcctccaaggcaggtggccacagtggcgaccttgagcactctagggtcagtttcccaggaggtgggggtggggtggctaaatgcggggggtcgcttctcccccattcccagccctgagtggctctgcctctcctcaggctcagaccctgggcaaccaggggtgctcccagctgtgacctccgtggttgggtactcctgcctgggaccccaggaggggctgcggtggtcgttggctggcagctggcaccctttccagggcccttttgtcaaagtcttagaaaacttcatttccataaaggtgcaaatggagctccatggctcagcctccctcgtggcccggccccgagcaccctccgggcctctagggctccagggcaccccttctttggacacagtggagactgaaggtcttgtgggggtggagggctgctgagggaccccggggagcccccagctcctggccccagccttcatcagaggtaaaaccccgatggacattagtgcaggatgaagttggcttggggtgcagccccgaggggcccccctccctgcatccactcagtgcttgtgagtcctatcctgcaggcacctccctgctccgtttacagatgagctcagggagtctcgggagatcaggggactgcaccaagtcacccaggggtggtgattgccaggcccacttgtttaagaagagggagggggctgggcacggtggctcacacctgtaatcccagcactctgggaggctgacacaagcagatcacctaaggtcagcagtttgagaccagcaatggccaacatggtgaaaccccgtctctactaaaaatacaaaaattagccaggtgtggtgtcacatggctgtaatcccagctgcttgggaggctgaggcaggagaattgcttgaacctgggaggcggaggttgcagtaagccgggatttctccactgcactccagcctgggcgacagggtgagactctgtctcaaaaaaaaaaagaagagggagggggcggggtcagctgtgcgtggtggggagcatatgaggccaggctcctgggggcaggagactagggcagagaggcgtggctgtagggctttttgcatcacaggagggcagcatggccgggtgggagcagtggagcctttctgacaatggccagggcccaaacacagaaccagtctgcaacgcgtgggcactgctcacatgaccagatgggagaaagacagcaggagcgggtcccactgcctgggcagggccgaaggatgcccacgacaggatttggagatggaggctcagtcgtgagaggagctgggctcctcctggagggacatcagacaacaccagtgcttcctccagcaggactcctcatccagtgctctctttgccacctgacctggcacccggtggatgctcagagatggcaggggagttgaatctttgaggcctggcccagcagtcaaaggcctcccacagatgtctgtttgtgctgcccccaggactggagtgacagcctggcccaactggctcaagccagggcagccctctgtggaatcccaaccccgagcctggcgtccggcctgtggcgcaccctgcaagtgggctggaacatgcagctgctgcccgcgggcttggcgtcctttgttgaagtggtcagcctatggtttgcagaggggcagcggtacagccacgcggcaggagagtgtgctcgcaacgccacctgcacccactacacgcaggtgagtgtgctgcaggtgaggccagcgtgccagctcccagatacagacttccactggtccatctcagaagaggctacagtttgtcctaaatgttgggattccttttcctccaattggtttagttttactttttttttttttgatacggagtcttgctgtgttgcgcaggctagagtgcagtggcgtgatctcggctcactgcaacctccgcctcctggactcaagtgattcttgtacttcagcctcctgactagctgggactacaggcatgtgccaccaggcctggctaatggctttatacttttagtagagatagggttttaccatgttggccaggttggtcttgaactcctggcctcaagtgatccacccacctcagcctcccaaagtgctgggattacaggcgtgagccactgtgccccgccacattttttctttttttggagacatggtctcagtctgtcaccccaggctggagtgcagtggcgtgatctcagcttactgcaacctccgtctcctagattcaagcgattcttgtgcctcagcctcacaagtagctgggattacaggtgtgcgcctctacacccagctcatttttttgtatttttagtagagacagggtttcaccatgttggccaggctggtctcgaactcctgacctcaaatgatctgcctgcctcagcctcccaaagtgctggggttacaggcgtgagccaccatgcctggcctaagccactttttttcaatctgaaatataaataatttcaaacataaacgtatttatttatttatttgagacgaagtcttgttctgtcacccaggatggagtgcaatggcttgatctcggttcactagaacctctgcctcccagattcaggtgactgtcctgcctcagcctcccaagtagctaggactacaggcacgagccaccacaccccactaatttttgtatttttagtagagatagggtttcaccatgttggccaggctgggtctcaaactcctgacctcaagtgatccacctgcgtgggcctcccaaagtgctgggattacacgtgtgagacaccgcacccagcctcaaacgtaaatttaaaacggccccactcttacccactacctaggtttagaagatgctactaaactaaagccctgctcctccccttttcccgctgtccctccctggagggaatcttcccaaagttcaggagcatcactgccaagcaagtttccattttttctcttcattcaacaaatatttgttgagggtcttctacacacacctggtgctcttcagatgcactgaaaaacacaagcaaaatcccaggaaatatttaatacctccactacctgtgcaagtgggttgtgcatgtttaaatattacacaaggctgggtgcggtggctcacgcccgtaatcccagcactttgggaggccaaggtggcaggattgcctgagcccgggagttcgagaccagcctgggccacatggaaaaaacctgcctctacaaaaaaatacataaattacccaggtgtgatggtgtgcgcctgtagttccagctacttgggaggctgaggtaggagaattgctggagcctgggaggtgaagattgcagtgagctgagactgcgccattgcactccagcctgggcagcaggagtaaaaccctggcttagtaaaaagaagaacatgtgcccctacaactaggtgctgccaaagtgcttacgccaactgtgcagaccagcaaaccagttcccacttcccgaagatcttctggctccttaatttttttttttttttttgagacggagtcttgctctgtcgcgcaggctactgtgcagtggcgcgatctcggctcactgcaagctccgcctcctgggttcacaccattctcctgcctcagcctccctagtagctgggactgcaggcacacgccaccacacccggttatttttttgtattttgtttagtagagacagggtttcaccgtattagccagggtggtcttgatctcctgacctcatgatccgcctgcctcggcctcccagagtgctgggattacaggtgtgagccactgtgcccagccttggctccttaagttttgtcagactcaaaggtgtgaaaaacctaactctgttttgttgttggtggttgttttttgtttgttttgtttttgtttttgttttttcgattcagagtcttgctctgttgcccaggccagagtgcagtggtgcgatcacagctcactacaacctccgcctccccagttcaagagattctcctgcgtcagcctcctgagtagctgggattacaggcgcctgccaccacacctggctaatttttgtatttttagtactcctgacgtcaggtaatccacctgcctcggcctcccaaactgttgggattacaggcttgagccaccacgcccagcctctattattgtttctaattttcttgatgtgaatgtttagatcattaattttaaatcattttttgtttctactatatacatttaaagctataaatttccctttaaacgatttcagctgcatccaataagttttgatgttttttctatttccaatcatgatgttgtttttgtttgttttgagacatggtctggctctgtcgcccaggctggagtgcagtggtgcaatctcagctcactgcagcctcaatttcctgggctcaggtgatcttctcacctcaggtccggagtagctgggactacaggtgtgtgccaccatgcctggctaattttttgtatttgtaatagagatggggttttgccatgttggccaggctgatcttgaacttctgaactcacatgatccacccaactcagcctcccaaagtgctgggattacagatgtgaaccaccacacctggccatgatgttgttttagattttgaagtgtatctttaagtttctaaactatgttatcttctctatttacttgtaaattatttactttaaatttcattgcattgaattcatagaatgtgggctgtaggatgtgctgattctttgctatttgttgaaacttgcttagtggtctaatgtatggtcctcctttctggtttgcaaaagtcccatgcattcctaaaaacgatacatattctttaagtgttggatacatgtatatgatcacatgttcacatctgcctgctacaagccagtcttgtacatgtcatttttagtctctactggagagtttgtttcactcttcttatatattgcccatttgtgctatttccaagctgttgctgattctaagactttaaactggtttgcagacctgtatccattaggttttattgcatgacatactaccccaaaatttagcagcttacgattctgcaggtcagccacttgggttgggctcagcagggaggttttctggtcttggctgggcccactcatacacctgcaatcaactagggggccggctgggagctggctgtgcaaaaaggcctctaatggttcatctctgttccatgaggccttccaaactcctatactgagtttgttcatgtggtgactgagcatggttctatgagaatgagtggaaatggcaaggtctcttaaggcctaggttcaaaatcggctcagtatcacttctgtggcattctggtggccaaaccagttacagagccagccagattcaaggagcaaggaaagagacacctctctttgctgcaaaaagctgcagagtcacatttaaaggagtggcctggtgcaagaaatgaatggttgtggtcaccatgcagtcacaaggcccttgatgttccagtctttttttggctactcccctccacccatcaacaatctcccctcatttcaggtacctcccctctccatccccctctcaactaagaaagccttcctaggccgggcacggtggctcacacctataatcccagcactttgggaggccgaggcaagcagttcacctgaggttgggagttcaagaccagcctgaccaacatggagaagccctgtcgctactaaaaatacaaaaaaattaaccgggcctgtaatcctagctactcgggaggctgaggcaggagaatcacatgaacccaggaggtagaggttgtggtgagccaagatcaggccattgcactccagcctgggcaacaagagcaaaactccatctcaaaaataaataaataaataaataaataaataaataaataagccttcctgaactattcccacccatgcttctacccctgcccaggacagctgctgctcctgagccctcgaggaggtaagggagccctctgttcacctggatgatagcgaaagctgtgtccccctccccaggggtggttcacaatagggtttctgatcccctgtgtctcctgtagctcgtgtgggccacctcaagccagctgggctgtgggcggcacctgtgctctgcaggccaggcagcgatagaagcctttgtctgtgcctactcccccaggtaagccctgctacaccctctgctgggatgtctgggagacagggaggggtgctttcaccgagggtgagattcccacacatccacccgaaagtagagtccctgatgccttgctctgcacccttggtgggagaggggaggagaggaaaggcagagggtgctaaagattctggccacgcagaaggtgctgctctgcggatgtcccttcctggatactggtcctggtatcagggagtttgtccaggattggtttggaggccatctcttctctcccagggaatctccctatctcacccagctccctgactccctggcctggccgcaggagctgaaggggccaggggggcaggcagcagggccctgcctctgccttgcccaaggccaggccctcccacaccctgtggtgcctgctcgtcctcacagaggcaactgggaggtcaacgggaagacaatcgtcccctataagaagggtgcctggtgttcgctctgcacagccagtgtctcaggctgcttcaaagcctgggaccatgcaggggggctctgtggtgagtgcatgagggctcagtctggtgaccctggggtgggggtggtagcatcctactgggctgtcccagaagccctggcccttagcacccagggaggctcctgcccggcctgctgggaggagacccttttctcagagtcccctcctcctctgaccagaggtccccaggaatccttgtcgcatgagctgccagaaccatggacgtctcaacatcagcacctgccactgccactgtccccctggctacacgggcagatactgccaaggtgagggcactggagcctgggtgtgcccagccctgctctcgtggcaggtcctagggctgctacacttcctgagagtctcaagggtgtcagaggtgctgactgtgtactccctgagtctgcccactgcatacattctttcaacaagcattcactgagcactagctgtttgccagaccctgagctgtgcaggagattcaaagtgaaatcaggttcagccccttaggctctgggaggaggacagaattaggacccagaagtggattcttgccctactgcccctctaccctaacccactctgtgaccatgggcaggtcacctcccaaactccaatatgcctcactctgcaatggggaccaaaccaaagacaccaggcgtgccagcaatcggaagccttggtgggttctgtctatgggaggggtattcttgctgtggttggcattccctggatgttcgaggcctctggggggcagcgtggggtccagaaggctgggggctgagcctctgccccactgccctgccctggcagtgaggtgcagcctgcagtgtgtgcacggccggttccgggaggaggagtgctcgtgcgtctgtgacatcggctacgggggagcccagtgtgccagtgagtcctgccccagggcccccaaagagccagctcctctcaagaccccccttcaatggggcatcagctcccaggagcccgctgtgtgcctctctttccaactcattcagtgacaacacgttgagatcttgaaactggccacagcatggatatttacaccaaagaaattggcaaatgctataaaccatggatttttttttttcttttgagagagagcaagctcaatattccaacttaccagctcgctcctgaccctcaccacccactcttttggagcaggtggccagaggaaggggcaccctgagcttagctccccggcagggcaggaaagggcagggattctgaagtccacacacaaactcaggctcccctaccccagccaaggtgcattttcccttccacacctgtgacctgaggatcgacggagactgcttcatggtgtcttcagaggcagacacctattacagagccaggatgaaatgtcaggtgacagtcacccctagcttcctaggaaccccctagggcctcaagtgagggtcttaatgcagggaccctggagtgagaggtggttccttccacgtctctgacctcaccctattcatcagcataaagcaggggtcgtggactccaaggctcatagaagccaggaggtcacttattgacctgaggggccaaggtcaagaccaacctccatctaagggagttccagccactggttgccttgcaggaatgcaaggtcagggtggccagagctcggggttgttcaagaaaaccagcaacccagacttccactggcaactctcgaaaccacaattaattactggggttggcaatcaacttggatatatttaagacactgtgcaggtgaaacagaacctcctcaggggccagaccttgcctgggcttgtgggctgctggtcgcgcccccgtgcacagggagaagagaagcagacgggagcagaagggacccctgctcttggaagggaggctgtgcgggctgggggtgatgatagcccggccagcacacacacgtggcatcttaggccatgggcaggggtggcaggaaggggcagcctgggctctgggagccttgcctgtgtgacccagggtggggttacagaggaaaggcggggtgctggcccagatcaagagccagaaagtgcaggacatcctcgccttctatctgggccgcctggagaccaccaacgaggtgattgacagtgacttcgagaccaggaacttctggatcggtgagtgcccagctgattgggggtatggcgagtaaggggttgtgatgccccaccctgctgcaggaaccctgggccatggcggctgccagcagatggcaagggtgtgttgagggcctggagcccagagcggggccagctgctcaccccctttcccgggaagggcccaggtagggagcacatgggggctgccagcgctgggaagaggggccagaaaggcagctggcagcagactccagggtctgagtgggccaaccttgactaccccggcccagggctcacctacaagaccgccaaggactccttccgctgggccacaggggagcaccaggccttcaccagttttgcctttgggcagcctgacaaccacgggtaagtgtggggtgcctccctcccctgggcctccttctcacttgggcctgcctggtggagccccccatcccgctgcctggctgggccctttgagggtctgatccttccctggtgcctgcccaggtgccagagagttgtgggcacagctggtgtgggccggtggtggggtgagggagatgcaagccggaaggcacgtcacgtgggggagagagggacccaggaagcctccatccatctgtccatccccagtgtcccctggtgtgactccatccctccaattctcatccactcacccctccgtctgcatgccctctgcctgcatcagttacactgatgccagcattccttagctgtcacccacctgcactcattcacaatacaaccctgcacctgcagacccaccagccatcctgtagcaagaaccctctggtcacgtggccccaccctgctcttcaaagcccagcaatgcccagggccagggtggaggtggtccggctgcgaggccaccaagggctccagcgatttcagccagccctccttgccaacagccggcctgtgcccctggcctcttgcctggaggaagtctgggccttgttgggttcccaggtgtacctctcaagtgggctgtctattccagtccccaccatccccacaggctggtgtggctgagtgctgccatggggtaggcagagctgttaccccaggaaggggcttccctgagaagtggagcagggctgggggcttggggacgggcctggctcccggcagccccgtcggcaggtgggggcactggagcccctgagatgcagggtcctgatgggtggagggcttaggcctctcccggatccctgacttcactcttgcctcctgaccaccacaccatggcctgcaggtttggcaactgcgtggagctgcaggcttcagctgccttcaactggaacaaccagcgctgcaaaacccgaaaccgttacatctgccagtttggtgagggacttcctgaggctccccttctctgatctctgaccctgggggtgctgctgacccggtccagcctgcaagggtatctaggtggcaggttcagagtgggtctgggcacacggggccatagaggatgccctgttgatggccttgtacctgtgggctcctgagcccagaggggcaacgacgggcccagcttcatacagcaaggccacgcaggaaggactagagctacagctctgcaggggatttctccaaggaccctctcctgtcatgaaagctgctgcctgggaacctgttgggttccttggtgttcccgggagccccatgaactgtggtggaggcggaggtgaaacctagcatggcaccagctcccagcagcctctgctaggaaggcctggagcgccacagggaccacggccatgggcacttccagaccgagtgcaacagggctgccatcttgggactgcctgggctgccatcgagccctgctctcttctgcttccttccagcccaggagcacatctcccggtggggcccagggtcctgaggcctgaccacatggctccctcgcctgccctgggagcaccggctctgcttacctgtccgcccacctgtctggaacaagggccaggttaagaccacatgcctcatgtccaaagaggtctcagaccttgcacaatgccagaagttgggcagagagaggcagggaggccagtgagggccagggagtgagtgttagaagaagctggggcccttcgcctgcttttgattgggaagatgggcttcaattagatggcaaaggagaggacaccgccagtggtccaaaaaggctgctctcttccacctggcccagaccctgtggggcagcggagcttccctgtggcatgaaccccacagggtattaaattatgaatcagctgaa

SEQ ID NO: 1987 - DNA, 1701 bp, Homo sapiens
accatctctacattttttttactcaatcgaccctgaatgctacagcattatccagggccgcagaaaacacacataatactttattcctgataaacaattcgatgtccttaagtccgccaatatcaccgtacattctgtgcaatcaagaaatttactcagctgggcacagtggctcacacctgtaattccagcactttgggaggccaaggcgggtggatcacctgaggtcaggcattcgagaacagcctggcccacatggcgaaaccccatctctactaaaaatacaaaaattagcccggtatggaggcatgtgcctgtaatcccagctacttgggaggctgaggcaggagaatggattgaacccaggaggcagaggttgcagtgagccaagattgcaccattgcactccagcctgggcaacagaacaagactccatcaaaaaaaaaaaaaaaaaaaaaagaaagaaagaagaaaagaaaattagccaggtgtggttgcatgcacctgtagtcccagcactttgggaggccaaggcaggaggatcaatcaaggctaggagtttgagactgcagaaagaaaccctgtctctaaaaaaaaggtccaggtaatttcagggtccagctccaccacaagcgcagctccaggggctgttgagttttgcctttatcattccaagtagtccctgctccagaccaagtcccaccatctggcagtcaggtcagtccaaccacagtcatatcagggcccttccaggaattctcgacgcaaactggaggccgatggcgcgggtcttttcgtggacggcggcagcacggtcctcggcttgcgtccgtagttgctcaggcttctggttcagggctgggcggcggcgcccctgcggcgggcggcccgcaccaggctctgctgcagcacggggtagaggcgctggcagccctcgaggcccaggcgtacggcctccgcccagctctctgtcaggccgccctcgccgctgcccagcagcccggccacctgattcagcacaggcatgagcgccacggtgaggccggcggcggcgcgctcttcctcgagccgcgtggggtccaggagccaggtgggcgcgggccccggcgcgaggctgaggccgcagcccaccaccaggtcgtacatctccacgcccgcgtcggccagggcgagcgcggcggcggtgagcgcggcggccagggccgagccaccgtcctccagcagcagcgccgacacctcgagctgcgcgcgcgggtagcggcccaggcgcacagccggctccagcgcctcctgcagcgccagcgccagctcacgctcctcgcagccgcccgggggagcgcggcgccggcggcccgcgaagggtgcgcggcggaagtcgcagagcaggcgaccgcgcagcgcggccggggcctcgccgcctgctccggccgggccgccgccgcgctcgccgccctcggcctgtcgcgggcccgacacggcacacagcaccttggtgcctcccgcctccaggtaggccgagcccttggcctggctcagcagcccggcgcgcgcgtacacgggccgtagccgcgttgggtcgcgggtgccgggcgcctcctcctcgtcggccgcgtacagctgcggcggctgcgattcttcagggccgcggatgcggcggtgatccccaggcatggcggttcttggcgtgcgaaccccttccgc

SEQ ID NO: 1988 - DNA, 37117 bp, Homo sapiens
tgcacgtggtccttttattctctgcagcaaaaacgattcctacttgctgacgcggaaagctcaggtctggagagccgttatctatagatgcgagcgtgacgatcaacagcaatgcggggttagtggttctagaccgatggcactgacgtggagggctcagggcagaaatttaaggggcactgagacataggactgctcccaagtgtgttccagttactgctgggttaggaggggctctttaaaggtcccaagattcaaatgttcttgtagcagatgaagagctcttggctggacggatggatccagtgggagcctcctccttccccactcagttctttacatccccgaggcgcagctgggcgaaggaagtggccagctgcagcgcctcctgcaggcagccaacgttcttgcctgtggcctgtgcagacacatccttgccaccacctttaccgtccatcaagcctgacacctgctgcacccactcgctggcttttaagccccgattggctgcattctagaagacaggaagggaagggggagtcagcacagaagatgggattgagggaggaatgcagggaaagaaaggatggaggagccatcacccactccttgccctgggtgatactgctggaggccgagacagactttacggctggtacagggggcggccatggccactgccaggacaggacagagtggcaaagccaggtatcaaccagatgtcttcaccaataagaaggcctgggtaaggggtactggcaaaggtaaccaaccggtgggcagaaaggctgtttcgaatgcaggctgtacacacacaggcctcagccaacaaccttaagacctaacacttcccactggtgcgaggtggtgctgacctggggaacttgacacaggcacgtgatcttgccagcctcattgtccaccgtgaagagcatggcagaagtctgaggggagtgcatcttgaagagcttcaaggcttcattcagggcctgtggggaggacctggctcaggccacggtgctggagcagggaccctcactagtgtgagcatttgcagccctcagaaggcctgccacccacccctaccccttcccagagcaggggctgtgcccagggcctgtggggaggaccccagcgccgggccctgcccctaccctggcccaggtatgcctcccacatgcagggagctgctgctcctcccaatctcaatcccagaccgtgggcccttaggcaaccacttcgctcagagccacagaggccacatgtcagccaccagagagctgatgagccctaggggaggggaccctggcccctgggttgccttggctgaggcgccgctctccatctccaggatgacaagaggctggttggggttgctgtcgatgaactgcttcgtcttctctaacacctgcaagaaaaaagtccagaacagcagctcagaccaaaagcccaggccccgaacccctggctgttctgccagcctttgcctaggaaacactctggccactggtgctgccaggactcactcgtttctggacatcggctttgctggctcggtccaagtcatccatgaccttctttagggatttgagagtctcccgcaattcatccttctgccactgggggatgactgcagtggccagggcctggaaccaatagacgaccatctcaatctgggccacaacttgctgggatgtcagggtccagcccaccccacccgaacccaagtcctccctgactagtgtcctggaaaggaaagcaaggaaagctttgagaccagtccctttaggagcagctgtggcaggtgaaacaagcagggctagagagaaaggagcagcagaaagctgggctcccaaatcaggcccggtccttaccaggctgggaacagcctgtgataagcttcctggcagcttgaaatgcaaataaataccaggcaggcttggaagcaggggccagccttagcccattccccaaatccctccaccccagtgcccatacatgcttgggaagagctctcctgctagcagcactgggagcagcagggaatgtccagggtccaaggacaggatccatggggtccctgctacaaggctacaggacaacagaagtcagcccaaaggcccattccaccaagaaccagggcctgactgactacagatgatttcctgaagacggggcatgtttcatgcaccaggccctgaggacggagggagggaagccgcccctacctctccaaggtcagcgatctccctctgcacatccttgtttggagcagtctgagccttcactttggcttccatgacagagagacatttcttcaagctctctgctttcctgagggcctgggaggggacaccgggtcaaccccaagcaggaggtctgagtcagactcactatcctgtgtctgagcagctgcggaagccccggcggtaggccttgcagcaacataccccaacaccccaaaagtgtctgtggggagtaggtgctggcagccccaggccccagcaaggagcacagtgctcacaggcccattggcaaaggctgcacccaactcagactcaggggtgatcaagctcgagaatcaggagccccttcccccaggaagtggccacccctggggctttagcacaagtcagacacaccagttcccatgaaagagcacccatcctctactgcacggcctcagactaagcacgcccctaggagtacatggatcagcgctgggggccccgatgccacagcgaatctatgtcttaccctcctccacatggagacaggagggggtagatggccagattcacattttttttttttttttttttttggagacggagtctcgccccgtcacccaagctggaacgcagtggtgcgatctcggctcactgcaacctctgcctcccaggttcaagtgattctcctgccccagcctcccaagtagctgggattacagacgcgcgccactacacccagctaatttttgtatttttagtagagacagggtttcagtatgttggtcaggctggtctcgaactcttgacctagtgatccacccgcctcggcctcccaaagtgctgggattacaggcgtgagccactgcgtccggcctgattcacatatattttaaaagactaaacataggaaagctaggagatcttgtgtggtggcaggtttcttctgccactcaggggtaggacactggggcagggggagtggcccagcctgtactttcactctgactgcagcagccacgcagagcagtgtttgctctatggattcgcagactgggctcctcttgccttcttcagataagccacaaaccagcctgacctgctcaccttctgggcctcggcacctgtgacagccacaatcctccggatacccttggcaatggcttcttccgtcacgatcacaaaagctcctgcatgactcgagttccgcaggtgcctgaatggcagaacacaaagtccatagtgaaagaggccctggcagcccttggctggggggtcacactagcggacaagagaagcaggaatgggttgacagtcagggaaagcctgggcttgagagtattctgacaccaagcgggacaccagctcgctgagcctgagtgttctcagttctcaaatggggatgattctccccacacagttgctgtgaaaatcaaatgaggtaaacatgaaagtgctttgtggtccctaatatccaatacagtcttacccttaggctctacgtgacagttttggtcttgtagtggaacttaagctccatttttgtattctgctcactaggtgacaattttggaggattacttttaaaatcttaccacaaccccttaaacaggctttatttctcagttcagagaacctcaaatgttcattaattcatcctcattctttgaagatagtatagttttttttgtttgtttgttttgagacagagtcctgttctgttgttcaggctggagtgcaatggtgtgatcttggctcaccacaacctctgcctcccagtttcaaatgattctcttgcctcagccacccaagtagcttggatacaggtgcccgccaccactcctaatttttgtatttttagtacagacaggttttcaccatgttgcacaggctggtcttgaactcctgacctcaagtgatctgcctgcctcagcctccctaagtgctgggattaaaggcatgaggcaacatacccaacccttggtataaagtttttgaaagctgtttcctgtagtctaaagggtatgagcaaacaggtaatcaggcaaagtgggactcgtttgaaggcccaattcagctgggcagaaaagccttgaactcaatcccccaggcccctatcctactctctgcacatcctacttgctccctgcctgccagaggcctgcaggagaccctggagggtctcaaccatgacattaagaatgttcttttcagccgggcgtggtggctcacacctgtaatctcagcactttgggaggctgaggcgggtgggtcacctgagatcaggagttcaagaccagcctgaccaacgtggagaaaccccctctctactaaaaatacaaaattaggccaggcacggtggctcacacctgtaatcccagcactttgggaggctgaggtgggtggctcacgaggtcagaagatggagaccatcctggctaacagggtgaaaccccatctctactaaaaatacaaaaaattagctgggcgtggtggtgtgtgcctgtagtcccagctactcaggaggctgaggcaggagactcgcttgaaccctggaggtggaggttgcagttagccaagattgcgccattgcactccagcctgggcaatgaaactccgtctcaaaaaaaaaaaaagaatgttctcttcatggctgggcatgggggcacatgcctatagtcccagctacttgggaggctgaggcatgagaatcgaagccaggaggtagaggttgcaatgagccgagactgtgccactacactccaccctgcgggacagagcaagactccacttcaaaaaaacaaacaaaaaaaaccacaattcttttcacaaggcttcatttggaagcagaaactttccaggccaccatgaccttcccaaaaaggcccagagagatacagaggaatccaaattggcagaagtggctatcccaagccaaactgagctgagtcaaccacgtggcctgctcgggggctctgagacaatggagctacattccccagatgccgcccaagctgtcaaaggaaattaggtgagataccaggaatgggaagggctaggcccacatcaagagctcaacaagcactccaggccttgctgaatcccaaattcacacaagccttcttgctagtttcagcccagcaaacaacagcaagcaactgtgtggtaatgtgaatacaatgttttcccccttttcctcctgggaatgtttcgtcaggaaatgttaccttcagatacagggatctaatgagcatgctaggatgctgagattcttgggaacgctatttagcaacggcatttctgaggacttcacttcaaccttagacagacaagagttggtccagcctaagacctacatcctcagaggatgaaggtagatgacctgtctactctgcccctctgcagtactcacgttcccccacagaactcaacagaagtcagggagccagcaggcccagaggggtcatccagcaactcggacaccgggaccccaatggagacgactcgcacagggtcaggataggtctcatcaaacacagcccgtaggccctggatggctttcgctgctgccagggggcaatcctgggtatagacggcctgccagaccaagaagacagaaaagagctggaagagatccctggaggtgcggtacgacgaggcaggaaagcatggtcctgcaggcaggactcgggttccaacctggcttggcctagcacgtgccatgagcttcctcaatcacacgccacgtgcaaagtcaagggcatcagtatgggaatttccaactattttgttaaactgtggaccaaatctcatatgtgaacagacttaactagaacagctctggttctcccaaggtggggtgggacaaatgcctctccctctcccctccaccaaccaccaccactgcccccggcaaaagcacagatggagaatcactgctttaaacaaactttttttttttttgagacggagtctcgctctgtttcccaggctagagtgcaatggcgcaatctcggctcactgcaagctccacctcccgggttcacaccattctcctgcctcagcctcctgagtagctgggactacaggtgcccgccaccacgcccggctaattttttctatttttagtagagacagggttagccaggatggtctcaatctcctgacctcgtgatccgcccgcctcggcctcccaaagtgctgggattacaggcgtgagctaccgtgcccagcctgctttaagcaaatctacgtgcaggacgaatctgatacaacagagtgagagcaccgcactgctaagactgtggacagacagtgacggtgtggggagggggggcattcagccgtcgcccatcctaccttggctgcctcaatcatctcattagcaatctcttcagccttcttgatctgttgggtggacatggctcccttggcagtaaagtcaaatctgaggcggtcaggagcaaccaatgagcctttctggtcagcttccccaagcactgagcgcagggcgaagttcagaatgtgcgtagctgtgtggttgctcatgatgggtcttcgtcggggctggaaagggcagaggggctcatggagaggtctgtaatagactgctagttatctcctcgttatctgctcccccgagtgctacaatttttagttggaaatatggctgtgcagaataaaggttacatttcccagcttccctatggctaagtgtgtccatgtgactaagttcgggtcaaaaggttttgaacagaagtgatgtctaccattaaagggatggggcaggtcctcccatttcttttccaccgcctagaacaggaattgccaaatgacggccgatggctaaatctagcctgtcatctgtcttttcatttttagagacagggtcttgctctgtcacccaggatagagtacagcggcgcgattgtagctcagtgccacctcaaactcctgggctcaagtgatcctcttgcctcagcctcccaagtagctgggactacaggcacacaccactacccccaactaatattttttatttttttgtagagatggggtctcatgttgttgcccaggctgggtctcaaactcttggcctcaagcaatcctcccacctcagcctccccaaatgtatgtgtttataaatttttataaacagttttttttttttataaggagtttcgctcttgttgcccagtctggagtgctatggcatgatctcggctcactgcagcctccatctcccgagttcaagcgattctcctgcctcagcctcctgagtagctgggattacaggcatgcaccaccacacccggctaattttgtatttttagtagagacagggtttctccatgttggtcaggctggtctcgaactcccgacctcaggtgatctgctcgcctcggcctcccaaagtgccgggattacaggcatgagccactgtgcccagccataaacaggtttattggaacacagccacacctgttcatttacatatggtcaatggctgcttgaacactccaactatagagctgagtactcatcaccaggaacatgtggtcagcaaagccaaaaatatttagtatccagttatttacacaaagtttgccaacccctggcctagacaatggatctgatagctatcctctgaaccaggaaatcaaaggcaatgccccaggaaagaaggtggagtgacaggtgaggagaaaccaggccctctgactgtggggcagagcctccgtatcagcttgagctttttagaacatacactgctatcctggttttaagctactcttactctggagctctgtcacatgccagagcctacctcttcattcttcagcatccttggctcccaaagaagtaggtgacgttagaaaagcaatccgtgaaaacaagtccacgggatcttaactgaaatcactggtgaaatcactgacttgggaacatatagattaactcttagttgcatccctcacaatccaccaaatgcacctaaattaacccctgcggtctacttacactagggagtgataacagtgacaggacaattttttttttgaggcggagtctcgctctgttgcccaggctggtgtgcagtggcgggatcttggctcactgcaagctccccctcccgggttcacgccattctcctgcctcagcctcccgagtagctgggactataggcgcctgccaccacgcccagctcattttttatatttttagtagagacggggtttcaccgtgttagccaggatggtctcgatctcctgacctcatgatccacccgcctcggcctcccaaagtgctgggattacaagtgtgagccaccacacccggcccaacagtgacaggacaatttaaagccagaggagaagataattactaaccagatccaatgggggccacagtaacccaactcacctcatcaataaacagccagacctgatcccccactttcaggtcaccgtagatggttccaatgtgtagcacataccctcctcggacctgagcattcttcactgtaaactctgttttctaagaggggtcaaggaagagaccaataaataaatccttaaaaacatacaaattttcttatattttcaatataaactcgtgtatataacttctctttacatatgtaaattgcacacacacacatactcccttaatatcattaaatatgattaaataggccaggtgcagtggctcatgactgtaatcccagcactttgggaggctcaggtgagtagatcacctgaggccaggagttcgagaccagcttggccaacatggtgaaatcccatctctactaaaaaaatacaaaaattagccaggcgtgaaggcaagtgcctataattccacctactcaggaggcagaggcaggagaatcgcttgaacccggaaggcagaggttacagtgagccaagatcatgccactgcactccagccttggctacagagcgagactccatctcaaaaaaaaaaaaaaaaaattaaatatatttgtgcacacacacagacataaccaatattaaggagcatcttagaattttttttttttttttgagacagagtctcgctcagccacccaagctggagtgcagtggcgcaatctcggctcactgcaaccaccctctcctgggttcaagcgattctcccctctcagcttcccgagcaggtgggattacaggcatccaccaccatacctggctaatttttgtatgtcagtagagacagggtttcaccatgttggccaggctggtcttgaactcctgacctcaggcgatccacccgccttggcctcccaaagtgctaggattatagtcatgagccaccacacccagccgcatctttgagtatctaaaagcctccataaggaacctgaagcctagggagacaaagtaactcattcagcagcggcagagctcgaggctgagttttctacaaggacatctccccttcagagagctgcctctcctttttaatgtgcaaagcttgtaggaaacttgtaccctggctgcaaaaatactcctacgagggtacccgatggccaggaaagcaacaggtacaagcaacagctccctcggcttcagaaataccatggaacccaacccaaaggtgtgtcaggtctgctcccaaggcctggagcactgtggggcaaaagcagctccccggctccacgcctggccctcctcggctaacaaggaagaactgttggctcacatcttcactgctgtcatccaccttcaccaggtagccttcgtcatagatctggcctccttgctcagcatagaaacaggtcttgtccagcaccactccacactcctggcctgtggacacctcttccacgaacatcttctccctgcgcagagccatcaccgtagccactgtgttctcaaatactgctcaagggaaatgcatagaaaggggacagtggggtcaatgaccttttcactccttcttggctgacttttgctggattctctttcgcaaactcttcttagctcctaattgtccaattgtattttggaagcaaactcattagacaatatgaaagggcttcgcggccgggcgcggtggctccccctataatcccagcactttgggaggtcgaggcaggcggatcacggggtcaagagatcgagaccatcctggctaacacgctgaaaccctgtctctaccaaaaatacaaaacattagccgggtgtggtggcgggcacctgtagtcccagctactcaggaggctgaggcagaagaatggcgtgaacccaggaggcggagcttgcagtgagccgagattgtgccactccactccagcctgggtgacaaagcaagactcggtctcaaaaaaaaaaaaaaaaaaaaaaaaaaaaaaacaacaacaacaaagggcttcgcatgctggctttccatcaaagaatgcaacactctgtcgggtgaccaactgtcccaatttttaggactgaggggtttcctgggatgcaggcttcagtgttaaaactgggacaatgggttaccctaactctgagctactgaacagaaacttggtgcatcagattagtagatctttaagagtagtaataaattccctagtccaaggtcaactcacaaagaatgtactcattttgtaggcttgcttgaatagatttaggtgtaagattgttctcagccgggcacggtggctcacacctgtcatcctggcactttgtgaggctgagacgggtggataacctgagctcagcagtttgagaccagcctggccaacacggtgaaaccccgtgtccactacaatacaaaaattagccaggtgtggtggcacatgcctgtaatcccagttaattgggaggctgaggcaggagaatcacttcaagctgggaggcagaagttgcagtgagccgagaatgcgccactgcactccagcctgggtgacagagcgaaactccatctcaaaaaaaaaaaaaagattgttctctaccagggcaaaaaagctgcaaaaacatgtattgccaatttatttttatgttttttttgagacagggtctcactctgtagcccaggctggagtgcagtggcacaaatatggctgactgcagcctctcaatctcccaggctcaagtgatcctcctgcctcagccccacaaatagctgggactacaggcatgcgccaccacacctagctaatttttgtatttctggtagagacagggtttcgccatgttgcccagactggtctcaaacaccagagctcaactgatcagcccaccctggcatcccgaagtgctgggattacaggcatgagtcattgcactggctttgtttcttaactttagaatactattatccggtcgggcgagatggcttacgcctgtaatcccagcactttgggaggccaaggcaggcagatcatgaggtcaggagtttgagacctgcctggcaaacatggtgaaaccctgtctctactaaaaacacaaaaatcagccgggtgtggtggtgcgtggctgtaatcccagctacttgggaggctgaggccggagaatcgcttgaacccaggaggtggaggttgcagtgagccgagatcacactattgcactccagcctgggcaacagagggagattccatctcagaaaaaaaaaagaatgctattaggataatagcattctaacagcattaggataatagaatcctaatagcattctttttctttttccccgagacggaatttcactcttgttgtccaggctggagtgcaatggcatgatcttggctcactgcaacctctgcctcccaggttcaggcgattctcctgcctcagcctcccgagtagctgggattacaggggcacgccaccacgcccggctaatttccgtatttttagtagagatggggtttcatcatgttggtcaggctggtctcaaactcctgaccttaggtgatccacctgccccggcctcccaaagtgttgggattacaggtgtgaggcacagcgccaggcccctaatagcattctgatagtcactgtggattgtatcaatgtcaattgcccagtttcctgcatgatgttacaattaggggaaactggataaaagggtgtgagacccttcctacaaattttttttttttacaacttcctgtgacaataattatttcaaaatagagttaagaaaacctccagccaagggtgcctatgtgtataaaagtgcatagcgtgactgtacggcactccaggagaggctgtcagcagtctgctggagagctaatcttgagaaacaatctttcaaataccccccagatacggggcagaatgctcagatgtggaaggagcacagcaacataccatagctaccactggagtccaaatggtaattgtactttggggaatcatctgtgacctccagaccccgtgcccggagctcttcgatagcgtaaatgtccagcataatgaggtcttccccaccagctcccttgccctgtgatttcagctgtcagcaagagaaacaagcataagttaccgtaaagtaggagaaaagggactccaaaggactggaacttgctaaactatgcccagcataaactgccagaacagggtttttcaatcctggcactactgacatttggggccagatcattctctgttgtggaaacttctcttgcagtgtgggatgctgaggggcaccctggcctctaccaagtacgtgacagcaggatctgcccctagttgtgaaaatcaaaaatgtcttcagacattatcgccaattactccctggaaggcagactcgcccccacttgagaaccactgatctaggggaaaaagcacttcaaagactttaatggaaggaaactcatgctcagtctgcagccaagtggtgctgggttggaaggtgttgggtttcctgttcactctccaagttctttacctgggccagtttcctctcctcttcaaagccatccatgtctaccaccaggcccttctcttcagcaatcagtccagtcagatccactggaaacccataggtgtcatagaggagccaagcagtgtctcctacacagcacaaaggaggtgtgtcaaaaaaaacagacagccccttttccatgccaagccctccaaaaggatgctgggactggcagaaggaattaaagacacaaggctatcagtatcggccctgtgtgcccatcagaaaatccagcacatctttttcagttaacctgggggaagcacaatggatgtcctgatacaattctgttttgttttgttttgttttttaaacctcacctgggctgggcaccgtggctcgcgcctgtaatcccagcactttgagaggccgaggcgggcggatcatgaggtcaggagattgagaccatcctgactaacatggtgaaaccccgtctctaggaaaaatacaaaaaatttggccaggcgctgtggctcacgcctgtaatcccagcactttgggaggccgaggcgggcggatcaggaggtcaggagatcgagaccatcttggccaatacggtgaaaccctgtctctactaaaaatacaaaaaaattagccgggcatggtggcgggcgcctgtagtcccagctactcgggaggctgaggcaggagaatggcgtgaacccgggaggtggagcttgcagtgagccgagatagcgccactgcactccagcctgggcgacagagcaagactctgtctcaaaaataaaaaataaaaaaaaataaataaaaaaattgccaggcgcggtggcggacacctgtagtcccagctactagagaggctgaggcaggagaatggcatgaccctgggaggcggagcttgcagtgagctgagatcacaccactgcactccagcctgggcaacagagtgagactccatctcaaaaacaaaaacaacctcacctggacaattttctatttctttttttttgagagtctcactctgttgcccaggctggagtgtactggtgtgatctcggctcattgcactctccagctccaggattcaagcgattctcctgcttcagtctcccgagtagctgggattatgggtgcccgccatcatgcatggctaatttttgcatttttagtagagatggggttttaccatgttggccaggctggtctcaaattcctgacctcaggtgatctgcctgcctcagcctcccaaagtgatgggattaaaggtgtgagccactgtgcccagccttacacatctatttctttttctttttctttttgagatggtgtttcgctcttgttgcccaggctggagtgcagtggcatgattttggctcaatgcaacctccgcctccccggttcaagcaattctcctgtctcagcctcccaagtagctgggattacaggcgcatgccaccacacccagctaattttttgtatttttagtagagacggggttttgccatgttgggcaggctggtcttgaactcatgacctcgtgatccgcccgcctcggcatcccaaagtgctaggattacaggtgtgagccaccacacccagctgacaaatctatttcttgatctgaatgtgtgttcaatttgtgaaaattcatcaagcttttcccttgttcattatacttcaataaagaatctttggaaactggggagaaaatctttggaattaattttccccaaattgcaaaacagtacataccaaatattcccacttttgcttgaaaaatacacacacacaaatatctacatgtatttgcatgcaaacagagaagaatcctgaagagttctacaccaaaccattaagagttgttccctctgagaaatgagtgtggaaaagaggattttcattttctgaacacttttgtattctgtattgtttgaatactttggccacaatgatgcattacttttaccattttactataaattccagtttgcaccaaaagcaattcaatcaagctatgttcagcctcagagacatgagagcccacagtcagtctgtcagaaagggcttgtctttcccagaaagatcaaacggccaggatggagaagggcaaaaactggtacctaccgggaatggtcttgctgtctcccaggctctgaattttcctgtccaggatgcgacgccctctgctgagagtcttgagaaactgcacctcttcttcattaatgatgtccttcaccatgtctgggtccttcttcagctcaggaaatgcatctccctgacaaaggggaagcaagatgaggggctggatgaagccagagactgttccctgccccgtcttaaaaaagctccttagctgggtgcagtggctcacgcctgtaatcctaccactttgggaagccgaggcaggtggattgcctgagctcaggagttcaagaccagcctgggcaacacggtgaaaccctgtctctactaaaacagaaaagattagccaggcttggcggtgtgcacctgtaatcccagctattcggaaggctgagacaggagaatcgcttgaacccaggagacagaggttgcagtgagccaagatcactctattgcactccagcgtgggtgacagagtgagactccgtctcaaaaaacagcaacaaaaagctgcttaacagtatgccctctcccactccatccctcttaacggactgctttagcacagaagggtaagcagagaaataaacctaccagggactggacgacaacatccactaacgtagcaaagaagcccctgctggcattgagcttttcatgggcgtatcggacagctcggcggagaatccgtctcaacacatatctgtaagaggcaaaaactagtccccaacgttcccagctgagggttttgtcttgagtcccttggaatcctacccaaagcaacacctctttcaggaactttcttttatcctaagcctgcttctttcgcattccccaaggtcattaattttagcacaagactcagtaacatacccacaaatacccgtcaaggcttccctagggtaaacgctggtttgttttcctttcacattcagttacccatagagggaggaaagatggacagaccagatgtgtacttgatgcctgtgatcccaggtcctgcctgtcagtaagagagattcccagggctggtcaatacctaccctcaccctgcccctgccaatctcctatcaggcaactttgaatacaatccttatcatctgtactcagcagcagagatttaatatagtggcaactctgtgacactagctgaaactcccttcatcccttaaaaaaggggtgggggattcttccacctgcccaagacaaggaaacaataacgaaagatggctttaagtttcataaagaggccgggcatggtggctcacacctgtaatcccatcactttgggaggtcgtagcaggtggatcatctgaggtcaggagttcgagaccagcctggccaacatggcaaaaccccacctctggccgggcacggtggctcacgcctgtaatcccagcactgtgggaggccgaggcgggcggatcacctgaggttgggagtttgagaccagcctgaccaacatggaaggaaccccatctttactaaaaatacaaaactaggcatggtggctcatgcctgtaatcccatctattcgggaggctgagggaaaagaattgcttgaactcaggaggtggaggttgcggtgagccaagatcgggccattgcactctagcccgggcaacaaaagcaaaattctgtctcagaaaaaaaaaaaaaaaaaaaaaaaaaaaaaaaaaaaaaacaaccgtctctactaaaagtacaaaaattagccaggcgtggtggtgtgcacctataatcccagctacgtgggaggctgaggcagaatcacttgaacccagcaggcagaggttgcagtgaggcaagatcacgccattgtactccagcctgggcaacagagcaacactcaatctcacacacaaagaaaagtttcataaagagtcacacatagcacacgtggtgccgctccaaacaccacccagtgtgcagcatacttacccacgccctgtgttgtcaggccggccaccatcagccagtgccacagtgatggtccgagcgtggtcagccagcacccggtaggccatgtcaatcccatcggcatcctcagcaccaactttcccagtgtatggtcgggcacctgtgccctatagataagaatcaggaggcagccctttaggaagcagactttctggcgctaccttgcccaaggaggttcctggaggattgaggagcattagcagaaaggatgccggtcttgccagatcctataaccccaagaacgtgacattggggaagtagagagactccagccagcccctacactcaaaaattatactgtctcaggtctagagcctcacattattattttttttttgtagtcagctatttaattaggttcttaagacatttagaacaccaatttgtggagcctcacattattaacaatgaagtaggcagatggaaatgggtacccttggctggcaaagcatatggtcattttttctttgacagcactgttaagagtacagcctggaaaactccacagaagtttacaatgtttgcaatagcaccagtaccttctgaatggcttcaaagtaagggacaaaaaggtcagtgtcatagttggacatcttattctgcagcacagataccagtcgttccaggcccatccctgtgtcaatgcttttcttgggaagaggtttcagaatgccatcagcttccctgtatgatccagaagaagaggaggttgaagcagagactcaagctgccacctctccagtccctgctggttaaaattcatttacagaacagtttgcaggctgtgaccatctgccatttgcccggtttggtgggaagagggaagtggagggagaaaggaaggagaaaggaagagttcattcttaaatgaactctggggttcatttaagagtgaggaaaggccaggcgcagtggctcatgcctgtaatcccagcactttgggaggccgaggtggtggaccatctgaggtcaggagctcgagaccagcctgctcaacatgaagaaaccccatctctactaaaaatacaaaattagccgagcatggtggcacatgcctgtaatcccagctactcgggaggctgaagcaggagaatcgcttgaacccaggaggcggaggttgtggtgagctgagatttcaccattgcactacagcctgggcaacaagagcaaaactccatctcaaaaaaaaaaaaaaaaaagaaaagaaaaagactgggcatggtggctcacgcctgtaataccagcattttgggaggccgaggcgggggaatcacttgaggtcaggagttcgagaccagcctggccaacatgatgaaaccccatccctgccaaaaatattttaaaaattagcctggcatggtggcatgcacctgtaaccctagctactcaggaggctgaggcaggagaactcagcaggctgaggcaggagaatcgcttgaacccagcaggcaaaggttgcagtgggctgagatcttgccactgcactccagcctgggtgacagagcaagactccatctccaaaaacaaaaacaaaaacaaaaacaaaactgaggcaagcttcaaggaaataggctttaaaacagcagtccagttctggcacggtggctcacacctataatcccagcactttgggaggctgaggcgggcggatcacctgaggttgggagttcgagaccagcctgaccaacatggagaaaccccgtctccactaaaaatacaaaattagccgggcgtggtggcacatgcctgtaatcccagctactcggaaggctgaggcaggagaatcgcttgaacccagggcacagatgttgcagtaagccaagatcacaccattgcactccagcctgggtaacaagaggaaaactctgtctcaaaaaaacaaaaaaaaaaaacagcagcccgaagtacagcaagcatgacattataggaatagctcgcaagaagctattatgtgcgataaggtttagttcatgaaagaataggcccatccttgttccagagatcagacaggtaatctgagaaataaagaaatgagcttttagctgagaagagagctacacagctccgagttcctcctcccctgctcagctcaaggaaaggaatggagtaggaacccaaggctacctgttatactggatgaacacaaggttccagatctccagcacattagggtcgtcctggttgacaagatgtgcggcgtcccgaccaccaatccggtcgtagtggatctcactgcaaggaccacaggggcccgtgtcacccatctcccagaagttatccttcatgttgcctgggaggattttggtgtcatccagcctgacaaaggagtaaagataagtccagttacagcccctgacaagagttctgcccagacttgcaaccaccgcaaaagaaattcttaggattggccgggcacagtggctcatgttactgcactccagcctagacaacagagcgagactctgtctcaaaaaagaaaaaaaaaaaattcttagaatttttaatgaagaagttccaaccttcagcaagtactaatgctaagcctgcacattaaacctgctaaagaagctgggcgtggtggctcatgcctgtaatcccagcattttgggaggccgaggcgggcggatcacctgaggttgggagtttgagaccagcctcatcaacatggagaaaccttgtctctactaaaaatacaaaaaattagctgggtgtggtggcgcatgcctgtaatcccagctactcgggaggctgaggcaggagaatcactagaacccaggaggcagaggctgcgatgagccgggatcgcgccattgcactccagcctgggcaacgagagcaaaactccatctcaaaaaaaaaaaaaaaaaaaaaaaaaaaaaacccgctaaagaaacagcacatgactcttctcaagagtgcctacaatagaagacagtacaaaatatacacatgatatgctcgaaactcaatgaaaatacacaaggacatgagtaaggcctagaaaggaacacataataatgaaaacgctggccacgcgcattgcttgagctcaggagttcgagaccagcctgggcaacattgcgaaaccccgactctctaaaaaatacaaaaaaaaattagctgggggggtgatgcatacctgtagtcccagctactcgggagaggatcacttgagcccaggaagttgaggctgcagtgagctgtgatcatgccactgcactccagcctgggtgacacacacacacacacacacacacacacacacacaaaagattgtgcttgcttatcttttaaaagctacacttttaaagtgtagatatacagtacatgaagtcaaggtaaaagaggattttaaaaaccagcgtcaagattaatatttaatttttacaggtgtcactacccaaaattccaactacacttagactacagagtcaaccgaataggagttttagatcaagtaaaaggggaagttgggttggaataatatatctagagtaaaagtaattaaaaaaagagaagcagccctgtttccaagtatagtaaaaagctatgcactaaaggatgaaagaattaagtaaaaggaacaagaaaatgaggcaaacacatcatggacagcccagctgtctacagagggcacacaccccatgttcagattctccttgatgcagcacttcacaaattcgaccaagttcacagcacagaacacatatagctcacctactgtcttagcttttatactatgtgattatactttagaattacattatgccaaaaaaactggctaggcacagtggctcatatctgtaatcccagcaatttgaaaggtcaaggcaggtagatcgcttgagctcaggagttcaagatcagcctgggcaacatagcaaaaccctgtccctacaaaaaatacaaaaattagccagacagggccgggcgcagtggctcacgcctgtaatcccagcactttgggaggccaaggcaggccgatcatgaggtcatgagatcgagaccatcctggctgacacggtgaaaccccgtctctactaaaaaatacaaaaaattagccgggcgtggtggtgggcgcctgtagtcccagctactcaggaggctgaggcaggagaatggcatgaacccgggaggcggagcttgcagtgagccaagatcgcgccactgcactccagcatgggcgacagagcgggactccgtctccaaaaaaaaaaaaaaaaaaaaaaaaattagccaggcaggtggcgaatgcttctagtcctagttactcgggaggctgaggtgggacgatcgcctgagctcaggcagtaaactatgattatgccactgcactccagcctgggtgagagtgagaccctgtctcaaaaaaacgaaacaaaaaaattcctttttccagcttggtgtggtggctcatgcctgtaatcccagcactttgggaggccgaggtgggtgaatcacctgaggtcaggagttcgagaccagcctgaccaacatggagaaacccgtctctactaagaaaaaaaaaaaaaaaattagctgggtgtggtggcacgtgcctgtaatcccagctactcgggaggctgagacaggagaattgcttgaatccgggagacggaggttgcggtgagccaagatcgcaccatcacactccagcctgggcaacaagagcgaaactccatctcaaaaaaagaaaaaaaaatttcctttctcctagtctatttcatttccataagaaacaaactgtttcatatgaagaatacaactctgttgaaaaagacagacatggctgggcacggtggctcacacctgtaatcccagcactttgggaggccgaggcgtgtggatcaccaggtcaggagttcaagaccagcctggccaacatgatgaaaccccatctctactaaaaatacaaaaattagccaggcgtggtagtgtgtgcctataatcccaggtactcgggaggctgaggcaggagaattgcttgaacccaggaggcagaggttgcagtgagctgagatcgcgtcattgcactccagctctgggcgacagagcgagattccatctcggcgggggtgggggagtggagtgggggtggggaaggaaaagatacacacatacacacaaggttacagaactatgaacaaggccaggaagactagatatgggatattaaactattaatgatgattgagggaacttccactttctattttctacatttctataaggtttgaatttttacaacacacgtgtaacttttaaaactatataaagtaaaaaaaaaaagacttgttttggctttcaacaacagaatgattggctgggcacagtggctcacatctgtaatcctagcactttgggaggccaaagcgggtggatcacctgaagtcaggagtttgagactagcctggctaacatggtgaaatcccatctctactaaaaatacaaaaattagccaggtgtggtggcgcgcacctgtagtcccagctactcaggaggctgaggcagaagaatcgccttaacccgggaggcagaggttacagtgagccaagatcgcaccagtgcactccagcctaggtgacagactgagactctgtctcaaaaacaaacaaacaaacataaacaacagaattattgaacatattaagaagcaacgaatggatctaaagatatgggccaggcgtggtgactcatgcctgtaatcccagcactttgggaggccacggcgggcagatcacgaggtcaggagatcgagatcatcctggctaacacggtgaaacccagtctctactaaaaaatatatatatataaaaaaacaattggccgggcatggttcctcacgcctgtaatcccagcactttgggaggccgaggcaggcggatcacgaggtcaggagatcgagaccaccctggctaacacggtgaaaccccgtctctactaaaaaatacaaaaaattagccgggcgtggtggtgggcgcctgtagtcccagctactcgggaggctgaggcaggagaatggcgtgaacctgggaggcggagcttgcagtgagctgagatcgcgccactgcactccagcctgggtgacagagcgagactccaacaacaacaacaacaaaaatatatatatattagctgggtgtggtggcaggcatctgcagtcccagctactcaggaggctgaggaaggagaatggcatgaacccaggaagcagagtttgcagtgaactgagatcacgccactgcactccagtctgggagacagagcaagactccatctcaaaaaaaaaaaaaaaaaaaaaaaaaccatatgaatgcggccgggcacggtggattacctgaggtcaggagttcgagaccagcctggccaacatgatgaaaccccgtctctactaaaaaaaatacaaaagttagctgggcatggtggcacacgcctgtaatcccagctacttgggaggctgaggcaggagaattgcttaagcccaggagacagaggttgcagtgagccgaggtcgtgccactgcactccagcctagctgacagagcaagctctgtctcaaaaaaataaataaataaataaataaagatattaatgcatctaaagataattactctgtcgcccaggctggagtgcagtggagtgatctcaggtcactgcaacctccacctcctgggttcaagcgattctctagcctcactcctccccatgtgcatctcaaaaggaaccctgagatgcaaaatgaccacatattccaggtcataaaaccccactctggcactgagtgtcatttcactcctccatactctcaagaagtgatgtgcattcttaccccaaattttgccagatctgtttgcattccagatctgcttctaagccagctgcttcatccccgccaaagtaagtaacataaagtctttcaatgggaatgccaaactcttgggtgaggagttccagagccatcttacatgccaattcctacaaaaagaacagagagaaagatatggaacattgccaaaccaaaatctatttagtatgagaccagatgctaggaacacagatacaaaatcacaacatgttcactctaaattcaaattcaagatcagtttatgtaagaaatccaaatatatactgaaatcaccaaattataggtactacttccaggaagtcttagaattaataaatgccattcattcctgaatcacctagatgatatttcatattttaaaacatgcaaaattagaacccagttcccagtgtggaaaagaccattttcctcaaaaccctagtggttcttctgctctgaacttaccttaaagtaatctccaaaagaccaagagcccagcatctcgaagaaggtgtgatgatagacatccttgcccacatcgtccaggtcattatgtttgcccccagcccggatgcacttctgggtattggcagctctgctcagctttgccatggggtgagatgggtcaattgtgttcaggaaaatgggtttaaactaaaagagaaggacagcagttcaacttttaaagggtgcaagtgatgtcaggtggccacacactagcaggaagagacgaccacacactaactgtgcagttcatgattaacatgcctggaatatagacacttgtcagaacaggtggcctggtggagccaaagcagagggtagcctctcatggagcagtttctccttgaacctagctccctaacagtccccaccaccacgagtgacaccacctgcagaggggaaaggcctgccagatctaacagccacaggttgatgtggtaaaacgtgggcttcttcaccagtctctgaagttcagggcttataccatctttctggaagaacttatcctgaaaattggtatgttcacttggcagtaaatgtgaggaagaagaaaaaaaaactgacacatattaagggaataatatcagcacactgatgaatgattggatgtatcagtcgtctagctgggacggccttgctctgaggatgtatcaggtcatgctttgatgtatcattgttatttgttaactttgttttatttttcccactagatctgttcaattcactgctatccaatttggtagccactagacactttttttttttttttttgagatgggtcactgtcgcccaggctggagtacagtggcacaatctcaggtcactgcaacctccatctcccgggttcaagcgattctcttgcctcagcctcccaagtagctgagattacaggcacgtacaggtacacctggctaatttttgtatttttagtagagacagggtttcgtcatgttggccaggctggtctcgaacacctaaccccaagtgatttgcccgcctcagcctcctaaagtgctgggattacaggcatgaatgactgcgccaggtcttaccattagacacttgtgaccatgtaaaactgaattaaaattaggctgggcaaggtggctcacacctgtaatcccaccactttgggaggccaagaagggaggattccttcgagcccagagttcaagaccagcctgggaaacataaggagaccccttctctatttttataaaaataaaaaactaaaattaaataattagtaattaatatttttaaaaattagaaattctcagctgggcgcagtggctcatgcctgtaatccccagcacttcaggaggctgaggtgggcggatcacctgaggtcgggagttcgagaccagcctgaccaacatggagaaaccctgtctccactaaaaatgcaaaattagccagccatggtggtgcacgcctgtaattccagctactcaggaggctgaggcaagagaatcacttgaacccgggaggcagaggttgcagtgagccaagatcgtgccactctactccagcctgggctacagagtgagactctgtctccaaaaaaaaaaaaaagcaagagagaaagaaaaaaattagaaattctgttcctcagtcacactagctcaataatcacacgactgacggctgccatgttgaggagaacatttctgtcactgcagaaaattctactggacagtcccgtattagatcacaaactccttaaaagcaaacactctctcactcatctctgtatcttcggcacctagctgggtgcctaatatcatttcaaattgggggaaaaaaaaaaggcaaggtatttgctgatcaagaggcaatatggcacaaaggttaaggaagtgactatctgggttcaagtccacactggcacttaccgactatgtgagcatggacaactgacttgagatctcagtgcctcagtagggatggcaacagagttcggcgtaaatgagttattgtacgcgaaggacacagagcagcgcctggcacacagtaagtgctgcatgcaggctgacagctactgtcaataagaaaatgtttacaaggccgggcgtggtggctcacgcctgtaatcccagcactttgtggggccgaaccaggcagatcacaaggtcaggagttcgagaccagcctggctaagatggtgaaaccccatctctactaaaaatataaaaattagacaggcatggtgggggggtgcctgtagtcccagctacttgggaggctgaggcaggagaactgcttgaacctgggaggcagaggttgcagtgagctgagattgcgtcactgaattccagctggggtgacagggcaaaacttcatctcaaaaaaaaaaaaaaaaaaaaaaaaaagggccaggtgcggtggctcacacctgtaatcccagcactttgggaggccgagatgtgcggatcacctgaggccaggagttccagaccagcctggccaacgtggcgaaaccctgtctctactaaaaatataaaaattagccaggtgtggtggcagacacctataatcctagccactcgggagggtgaagcaggagaatcgcttgaatccaggaggcgtaggctgcagtgagccgagatttcaccattgcactccagcctgggcaacaagagcaaaactctgtctcaaaaaaaaacaaaaaaaaaaaaaaaaagaaaagtttacaaacactgtactccctggttcttgttcaggcggctcatgtggaaggtgacaaagcttgcacccaggtatgtctgaatagaaacagtagctttccagtgttccaaaagcctatcccgttgaatgagaccacctaaaattaatgcctccaattctaggtatatgcataggactcacacataactgaaaatatttttcttttttttccattttgagacagggtcttgctctgtcaccctgcctggagtccagtggcacgatcacggctcacctcaactcctgggctcaagcaatactcccacctcagcctcccaagaggctggaactacaggtgtgagccaccaccagctaatttttcaatttttcttttgctttaatttttctttaatttttctcttttcctttcagacagggtcttcctatgttgcccaggctcctctccaactcttgggctcaagcaatcctcttactttggcctcccaaaatgctggaattacaggcatgaaccactgtgcctggcccataattttctcttttttgagacggagtctcactctgttgcccaggctggagtgcagtggcgtgatctcggctcactgcaacctctgcctcccaggttccagcgattctcctgcctcagcctcccaagtagcataatttttttgggagaccagtctcactgtgttgcccaagctggtttgtaattccaggatcaagtgatcctcccgtctcagcctcctgagtagatgtaattacaggcgcactgtgccccatgtttcataattttatagttaatattataagaggcagaatatgtccccattgtttctaactttccatgccagaaaagacacctaagagaaaagaaaatgtcaactcatcccagagtgagaagcatcctaagggctgcagatgccccgggggagcagggctccaagagaaccatcacaggaaagcgctgagagcaccatctaacctgaacccccttcagccacgaccagcctgggaagtactgtttagtgtcacagacatgctgacaaactcctcttaaactcctttataaacttgtcatgctttcatcattttaagagttaacccttttctctcacgataaacctttcaaatgtctttttcttttctttccttttttgagacagggtctcactctgttgtgcaggctgaagtgcagtggtatgatcagggatcaccatagccttgacctcccaggctcaagcaatcgtcccgcctcagcctccccagaagctgggactacaggcatgcaccaccacacctggctaattttttgtatttttaataagagacagggtttcaccatgttgcctaggctggtctcgaacttctggattcaagtgacctatctgcctcggcctcccagagtgttgggattacaagtgtgagccactgcgcccagcctcaaatatatttttaattcaacttccccaaataaaccgtactaactaataaattttcttcagcaatggatccaaaatggcactggtggcaataatttcaagaaaggcattaggtgggctgggcgtggtagctcacacctgtaatcacaccactttgggcagctaaggcaggaggattacttgaggccatgagctcgagaccagcctgaacaacttggtgagacccccatctctgcatataaataaataaatttaggccaggcaaggtggctcacgtctataatcccagcactttgggaggctgaggtgggtggatcacctgaggtcaggagttcgagaacaacctggccaacatggtgaaaccccgtctctactaaaaatacaacaattagccaggtgtggtggcgcacgcttgtagttccagctacttcggaggccaaggcaggagaatcgcttgaactcgggaggcagagattgcagtgagccaagatcgtgccactgcactccagtctggacgacagcgagactctgtctcaaaacaataaataaattaaaaaataaataaaataattttaaaagctgacatggtagagcatgcctgtagtcctagctacttggaaggctgacataagaggatcacttaagcccaggagtctgaggctacagcatgctaggatcatgccactgcactccagcaagggtgacagagtgagaccctctctctaaaaaataataatagctggccgggcgtggtggctcatgcctgtaatcccagcgctttgagaggccgaggcggatggatcacaaggtcaggagattgagaccatcctggctaacacggtgaaaccccatctctactaaaaatacaaaaaaattagctgtacttggtggtgggcacctgtagtcccagctacttgggaggctgaggcaggagaatggcatgaacctggggggcggagcttgcagtgagcacagatcacgccactgcactccagcctgggcgacagagcaagactccgtctcaaaaaaaaataatgataatacaaaaaaatttgccaggcatggtggcgggcacctgtagtcccagctactcgggaggctggggcaggagaatggcgtgaatccagaaggcagaacttgcagtgagccgagattgcaccactgcactccagcctggatgacagagcgagactccgtctcaggaaaaaaaaaaaaaaaaaaaagctaatgtttgagtacctacgtactatgtgcgaaataccgtgctaaacattttgtatgtgttatcttattcgcttctcactaatacctacaggcccgcaatattattcctcattttgcaaagaaactgaggcccatcacataaagtttcacaagatcacacagggagtgacagaaccagaatcggtctgaccccagggctgtgcttttatctgggctctgctgcctcttatgtgaaccaaaagccaagaaaaaaggaaaaacccttacctggttcatgcctgcattggcaaagagcaaagtggggtcatccaatgggatggtggcagacgagtgaacatacgtatgctcgttcctcttgaagaaatctataaatcgctgccggatttcacttgctgttagagtagagtccatcttgaaagtcaccccaaagaactaatcaaagaaaaaaaaatgaaggaaaattaagggaattgaaagtcaaagtacacattacacaagacttctggcttctcaagccaagtcaaagcacgactcaggtgagctgtttgatcctaaaacctctatgttgtaatgtccaaggctaaaatcatcatcaccagcagacagcagccccatctgttcttccttcccatgccaacctcaagaggttcaacaccccagcacaccaagcacactgctgctggatgtttgttcattaaacaaatatgtatcgagcatctgctctgtgtcaggcccgagactaggaattagaaaaaaagagggacagccaggcacgatggctcacgcctgtaatcccaacactttgggagggcaaggtgggcagatcacaaggtcaggagttcaagaccagcctggccaacatggtgaaatcccatctctactaaaaatacaaaaagtaactgggcatggtggtgcgtgcctgtaatcccagctacttgcgagactgaggcaggagaatcgcttgaacccaggaggtggaggttgcagtgagccaagaccacaccactgcactccagcctggcgacagagagagactccgtctcaaaaaaacaaaaaaagaaggaaaaaaaaaaagaaaaaaagggggagaaaaaccctcagtttagtccaactggggaagagggagagaggctcaggagaccggggtttgagttctagcttcaagtcctgagggagtcacttcaccaaaaaaaggaggggtccatatgagattatctctaaagatcccttcagctctgtgttaatgtacacgcctagaactgcaaagttccactagccccaaagtcagggtctctaggtttggcctgatgtcatggtgaggcggctgtcagcagcaatagtcctggggatgggcctatctgtacaagggaccacctgtatgtagcaggaatgtacctacctctatgtagcctacatcccccaagaaccctaacagcaaacggctgccttccagccattagattaccagggagtggggatgctgtagccccactttggaggcacagcttactgaaagtgaaagtacaagggaactggtggagagagaaaaaactttatgacttcaaagctctttcacaagttgggcgcggtggctcacgcctgtaatcccagcactttgggagaccgaggtggcagaattgcttgagccctggagtttgagaccaccctgggcaacatagcaagatcttgtcagtacaaatagtaaaaaaattagccaggtgggtggatcacgaggtcaggagatccagaacatcctggctaacatggtgaaactctgtctctactagaaaaaaaatacaaaaaattagccgggcgtggtggcaggcgcctgtagtcccagctactcacaaggctgaggcaggagaatggcacgaacccaggaggtggaggttgcagtcagccgagatcgcgccactgcactccagcctgggtgacagagcaagactccgtctcaaaaaaaacaaaaatggccgggcgcggtggctcacgcctgtaatcccagcactttgagaggccgaggcaggcggatcacgaggtcaggagatcaagactatcttggctaacatggtgaaaccccgtctctactaaaaatacaaaaaataatccgggcatggtggcaggcgcctgtagtcccagttactcggaaagctgaggcaggagaatggcgtgaacccaggaggcggagcttgcagtgagccaagatcatgccactgcactccagcctgggcgacagagaccttgtgtcaacaaacaaacaaaaacaaaaacagctctttcacagatattacgatttccctgagaggtaggctggggagaagtgacaggctttggtgagagtgctgatcactggcatggtgctgtagtgccacaaactgctgtgtctagaaaaatgagaaccatcttattcacaatattatcattattatcaaaaagtctctggaattccagacccaaccgtaaccttaattcacttttgcctgagttcagttccttttctgtaaaaaagcagtatctaccctgcctactcaactgaggtgttgtgaggatcaaaagctatactgtatttggaagcaatctataaaatggaaaacgttacgccacgtgcggtggctcacacctgtaatcccagcactttgggaggccaaggtgggtggatcacctgaggtcaggagttgaagaccagcctggccaatatggtgaaaccccatctctactaaaatacaaaaattagccgggaatgatggcgagtgcctgtaatcccagctactcagaaggctgagatgggagaatcgcttgaacctgggaaatagtggttgcagtaagccgaaattgcgccactgcactccagcctgggtggctgagggagactccgtctaaaaaaaaaaaaaaaggaaaaccttgaaggaacagaatggataatattacttttaagttgtttagctgaaagttttcttctttttttctggttctgtccagactggagtgcagtgggacaatcacttaagcagccttaaactccgaggctcaagtaatcctcctgcctcagcctcccaagtaactgggactacagttgcacaccagcatgcccagttaatttctttttttttcttttttgagacagagtctcactctgtcgcccaggctggagcgctgtggcgcaatctcagctcactgcagcttccacctcccaagttcctgcaattctcctgcctcagcctcctgggtaacctggattacaggtaagtgccaccacacccagctaatgtttgtatttttaatagagacagggtttcaccatgttcctcagcctggtctcgaactcctgacctcaggtgatctgccagcctcagcctcccaaagtgctaggattacaggcatgagccaccgcgcccagctaatttctgtttttgttataaatggagtattgccatgctgcccacgctggtctcgaactcctggcctcaatctcccaaggtgttgggatggcatgagccaccatgcccagccaaagttttctccttatgaggaaaatacaatagagatgtacaaagtgaacaggagatcctgactccagctactttccaaaagacacatgaatttcccatttttgcttactaattcaccataatgaatgcatactatgtgccaagaatcaaaatgaatgacagcctatgtccttcctgaggagactatcatatgcagaattaactgcagtattgtgtaaaaggactgaatatattaactatgagtctatgaaggctgaaactattaaaagctgtatccccacattcatttgtttacccccatttatttattcaatctaaatttatatttattcgatataaattcaatatatttattcaacataaactcattgatttattcactggagggctatatgggatacagaggtagcacaaaggcagaacctcaggtttcacttactaacaggagctgtaaaggtcttgggtgccttaaatcacgctgtggctccagccactccacaggaattttttttttttttttttttttttgagacagggtctccctctctgtcacccaggctggagcgcaggcaatggtgcaatcacttggccttccaggctcaggtgttcctcccacctcagcctccggagtagctaggactacaggcatgtgccaccaaacccgactaatttttttgtatttaaaaaaaatttttgaggccgggtagggtggctcacgcctataatcccagtactttgggaggtcgaggcgggtggatcacaaggtcaggagatcaagaccatcctggctaacacggtgaaaccctgtctctactaaaaatacaacacaacaaaaaattagcggggtgtggtggcacgcacctataatcccagctacttgggaggctgaggcaggagaatcgcttgaacctgggaggcagaggttgcaatgagccaagatcaactgcactccagcctgggcaacagaaaattttcagccgggtacagtggctcacgcctgtaatcccagcactttggggggccgaggcgggtggatcacctgaggtcaggagttcgagaacagcctggccaacatggtgaaaccccatctctactaaaaatacaaaaattaggccgggcgcggtggctcacgcctgtaatcccagcactttgggaggccgaggcgggcggatcacgaggtcaggagatcgagaccatcctggctaacacggtgaaaccccgtctctactaaaaatacaaaaaattagccgggcgtggtagcgggcgcctgtagtcccagctagctactcgggaggctgaggcaggagaatggcgtgaacccgggaggcggagcttgcagtgagccgagatcgcgccactgcactccagcctgggcgacagagcgagactccgtctcaaaaaaaaaaaaaaaaaaaaaaaattagctgggcatggtagcgggcgcctgtaatcccagctacttgggaggctgagtcaggagaattgcttgaacctgggaggcggtggctgcagcgagccgagatcatgccattgcactccagcctgggtgacaaagcgagacctgtttcaactttttttttgaggcaggtctcgctctgtcacccaggctttacacacaggtctcgctctgtcactttgggaggctgaaacaggaggattgcttgaggccaggaattcaagaccagcctgggcaacatgggaacacctgagcctgggaggtcaattttttttttaattggccaggtgtggtggtgtgcacctgcagacccagctactcgggaggctgagtccaaagggtcgcttgagcacataagtttgaggctgcagtgagctatggtcacaccaaaacattccagcctaggtaacagggtgagaccctgactcaaacaacaacaaacgtaaagacactttttcttttttttgagacggtgtttcgctcttgtagcccaggctggagtgcaatggtgcgcaacctcggctcaccgcaatctccacctcccggcttcaagcgattctcctgcctcagcctcctgagtagctgggaatacaggcatgtgccaccacacctagctaattttgtatttttagtagagacggggtttctccatgttggtcaggctggtctcgacctcctgacctcaggcgatctgcccgcctcggcctcccaaagtgctgggattacaggggtgagctaccgcgcccggccaagacacttatttaagacagccttccccttcttcttttttttttttttttttttttgagacggagtctcgctctgttgcgcaggctggagtgcagtggcgcgatctcagctcactgcaagctccgcctcccgggttcacgccattctcctgcctcagcctcccgagtagctgggactactgggactacgggcgccagtcaccacgcccggctatttttgtatatttggtagagatggggtttcaccgtgttagccaggatggtctcaatctcctgacctcgtgatctgcccacctcggcctccccaagtgctgggattacaggcgtgagccaccgcgcccggccgccttccccttcttgataaggctccccctcttttactgtctcacagcctcaagtgtttcccttcataatttccatacgcgcttcatggattgtttaatgtgcgcctcccccatcaggctgtcagttccatcccagcagcaacgactgttctgggctctttttttttttttttttttgaaacggagtctccctctgtcacccaggctggagtgcaatggtgtgatctcagctcactgcaacctccgcctgccgggttcaagcgattctcatgcctcagcctccggagtggctgagagtacaggcgcgcgccgccacgctcggctaatttttgtatttttagtaaagacggggtttcaccatgttggccaggctagtctcgaacccctgacctcaggtgatccgcccgcctcgacctcccaaagcgctgggattacaggcgtgagcctccgcgcctggccctgggctattacagcacatcctcagcatctagtacagtggctgctaaatacgtatttcgtgatcaggtatactaatcctttaacaccaagttcggaattaactcacatgcttcaaagcacaccgagaaatacaaactgttttacagaacagcttaagatgacggtctcggtgcgcctggaccggcatcagctgtttagttaattttaagaaatcaaggaatggctggcttacagcaggattgcacccagctggcccatccttcctcccgtgcccccacccgcccctaggggattaaaaccaagggagctaaaaccccaggttggcaaccgtgaggtattggtgctcagcaaatccacccgaggccgcgacactcgcagcgctcccgggggcgaacgcaaggccacactgtccagctcccgctccagcccagactgggcttctccaggccacgcggggcctgatcctggggcccactgcggctgcggagctttccccccagtctgcgggcccagccgctctcctagcaccgcagagctctccgagggcggcctacctctcctagggtcgccgtccccagctcctccctcagagtcccccgccaagggcccgctgcacctattcccgcagacgcgcagctgtacc

SEQ ID NO: 1989 - DNA, 121147 bp, Homo sapiens
cacggggcggacctcgcgcggacggacggacggagacggcgccgccacattcctatgcccgggagcggcggcggcggcggcggcggctcccgcgggaggcggcaggcgcgcggcgcggacagctgagcttctcctccgtcggcgcccgggcggacatcgcccgggccccgatggtttgagcttgcttctccctccctcccgacccccgtggtggcgaggccacgccatgtgaaggttagggccgggacatcccgaggagccgcggtgaaagatgggggatgctgcagaccccagggagatgagaaagacgttcattgttccagccatcaagccttttgaccactatgatttctccagggccaaaatcgcctgcaatctggcctggctggtggccaaagcctttgggacaggttagtggtgtcaccctttccctcccctcttcctcctgatgtggtccacatctcggtttttgttcccgattctcgaatccctccctccccgtgcctgtcttctcgtacaggttaagggagatgatgggaggctaggaagagaaagaaaggagaaataaggaaagcaggtttggtcttcaatgaagggcacgtgaatggtcaggtgggatttggccagattccttttattggatggcaaaatgtcccccccatcccccagtgagcaattttatgtttttacatagagtggttttgatttgtggtattttcttcattgtgttgcgtacatttctgcctcagtcataattgtgattacaccaccaagaaatctgagttggtttctttattattgcaagaaggtggatggtgcatagtactatattgattttgacatttgtaatgatggctgctattcaggctccgttggatgtaaggtggcctgtgtcgagtgcagtattaatttttgttgtcattctttaaggctgtatcagccttctgcacgcatgttaagttcttattaaatcagttatttaaaaccagcgttcagtttgctgactgtagggtgcagttttcatttcatattatcagtgaggcatattcttttttccaaatgtattttggcttcataaattaaaagaaacaaaaactccctactttgggaagttttttaatagatgagtttttcgaaggcgtgtgctgttgacacagaaattgtatagtacagtagcagttaaacactccctccataacccagtctttgcaaaataacaggaaaagggcctcccgttatgattctttagtgttgctttaggagcccatgttgtgaaatgttaaaaaaattagagagctgcttttcattggaagatgcttctgtaatttggtaacttttaagagtaattttacaagatttctgttccctagttaatgaagtttagatatatgaaatatttgttgaaaagttccctagtactcacaaatttccacatgttaaatatagggtttttcagggggagggtgactaatttccaattttaggactatgtaatgttttggtaaatggtttagttcagttttactgcttaaacttacacagctgagtattttcaggacttacacatcctacttaaatagcagattaatctcagtgtttggaaaatgatttgaatttgtttttggggaaacttgacattgatgtgattttatgtttatggcagccttaattttacttgaatttttatgctttgatattaagctggcatcaggaataaatatagtaaatccttttcaaattatttaaattttaaacatctctttgaaattgaatgtctagcgtaactcataggaagaaacacaaagtgttactgcctttatataaaaacattctggcaccactgatataagcagtgagaataatagatgtattttggttttaacttaagcagcacactgaagccggtatctatttggatggcaaatcaaggctatttaagtgcttagaaaacatggaaagagggaaatttacatagtcacctatgtggaaaagtagtatgtataaagtggaaggcaaagggaataagagaaatattttctttccatctggaactgagaggatacttataggatacagatatcaaaattttgccatgcatacacaaaagcttccagctagaaaatggcctactttctgggtatgtgtcaggcaggttcgtagattctagaccacttgaacatattgaacacacctgaagaagaaaggaaatgaagggaatctagtatcagtggaatctgatgtctgccaggcactctgctggatgctttgcagtaagttgtacgttagagattgataacaagtctctgatgtaggtagtgtgttccccatttaaaaaataggaggaaatcagtgcatagagaggttaactttcctactatcacagtgttagtaagtggcagaagtgagttttgatttgaggtctgactcaaaagggtaaaggtattggtggaggtggaacactgctgttagatacccagcactctgaatacattacttcatttattcctgcagcaaccctgtagatactgttctcattttgcagataaggtaactggctcacagattaatttgcacaagattaaacatctggcaagtgatgtgttctgcatgtctgactctgaagcctttgcttattactctataccgttctgcagagtaaccgttttatctgcaggtgtgaaaaatgtgcacatagtacatattgaagtctaattttttctttaaaaattgtacaaatcttaattcattttcagatagatgatattgttggctattacatttgccttggcagcagttggaatggatgaaaagaccatattcaaatgggatgaaaaacaagtttagaagaccttgagtgacttagtaacaatatattaatacattattaagaatgttatgtttgtacattttgtttattctttatcaacagtctttcaaaacaaatttatatggagtgaatagaaaaaaattaggaatttttttgatgtaaatattctttatttgctgcagatacacttatgcaggaaaggttaatagatagcatatttcaaaggtattacctaattatatttagttgttcaaaaaatcagcccagctttcaatatgatttactaaaatcactcctttaacaatgacttacagggtcttcaggcactgatttggtgttttctattagaaactttctaacttttgatgtactgaaaaagtagtcaattttataaccatatgttgtaaaagtcatttaaaatgatagctagaaatgtgagcatagaatgaagtaattgaacttaaaaaaaaaacactgatgttgtaatacctagaaagcaaatatggaatatttacttaatttgaagtcttaggagccttgaatcattttcttctctttacagtagtattacaaaagtattacaaatagcccaaattttaatagtttattttgtggaagatgcagatacaggtttgattaaatgaagaatacatttttatagatgaatttgaaacactaaatcgataatccaaattccaaaggaggaagtagttcaactatctgtgccttttctatatttgaagagcttaacccatttaagcaaagattttacagaattttctttaaatgttctgttctcttaaatcctttgggggaaatggtagatgcaaaacctcttgtgacactcttactaaactcttgaatttggaattcaaggcccacttcctagtgtcagtttatcacttcaatcttctcaactattattctcctttttatcccatttagtttagtgatataaaatatttcctatcataaatataccttgttacatttctttgtctgtcttaacaaatcttgctgtcaaagtcctgtataaggtctgactcttgtgcatatatgaagatagttgagagcagtgggtagcattgtggttaagagagacccgtagcagaggggccagtttgggacattattgcaagagtctgggcaaaagataaggtcctgtgtctttgactttgtagtcaacagaaaatttaccaataagaaaaaaaaaaaagaagttcatgaggtcttgaagtggtagggggcgggtatgataataaagctgctaatataggctgggcatggtggctcatgcctgtaatcccagcactttgggagaccaaggcgggtggatcacctgaggtcagaagttcaagaccagcgtgaccaacatggtgaaaccccgtctctactaaaaatagaaaaattagctgggcatggtggcgagtgcctgtaatcccaactactcaggaggctgaggcaggataatcgcttgaacccaggaagtggaggttgcagtgagccgagatggtgccattgcattccagcctgggcaacagagcaagactctgtctcaataaataaataaataaataaataaataaataaataaataaagctgctaatacttattgagctcctacactgtgtgtcaagcactttacacatactgtatcatttaaatcctcatgacagccttttgaggtggaaaggttacttattccaattttactgatgaggaaagtgtccggggacttaggaactcttccagagttacccaactaatggagctgggatctgaacccagggaatttgacttcagcctgtacttgtaactactgttctctatgggtagaagtcaaaaaatggaaaggaggcaaatgatagaaaaaatgttgcagagatttaatctctagtatttctaagtgggtacatgggaaatggtttgaatgaaaagggaatgtgtaagagggtgaggtcgcctgaggttttaagaaggatgaggttacctgagattttgagatttggtgactgacaggctgaattgagatgccattgacagagaagaaagtatagtaacactgaagccctggaaggagaaaatttcaaggagaatggtctgattcaacagtgtcaaatcctatgtgtttaagctatgcctttcttttaagagtttatgctttgctaggggaggtatgataaatgtataaccacagtagagttcagaaataagctaagagtcatataattggaaatatgacattcagagggagactggtggcgttaggatgcggtggggtggcaggggagaggccatttccagcctcatcagtggtctgtgaaggaagacctctctagtggaggtggtatttaagctataggctgaattgaaagtaggcatggtagatggaggaaatggtttgtgtgtagacatggagttgtgaaacccaggtagtgctaatgaaacaacatagaccagattgatgggatgaggtttatgtaatgaagcagtgagagagccagcttgaaagacaaacggacagaattatgtgaagggtgaggtgaaggaatttggtatttatttagtagttaaattatcctaagcacattggattaaaaaaaaaagaaaaaatactattaagtatattaaacatgtaatttgtgctcattattcttgtaagcgttttatatgcattatttattttaattctgagaatgagcctattaagtagatattattttattctaagactctaaaacagggtttctcaactgcagaactattggccagataattctttgttgttgggggctgtcctgtgcattctaggattttagcggcatctgtggcctctacccacctgatgccagtagtgttccctaccactacccctactcctaccccagttgtgacaacccaaaatgtccccagacatctccagatgtctcctggggaacaaaaggagcccaggttgagaatcactgctataaatattataagacacactattgtgatctaaaaaggtttttttttttgtatgttgaagtacaaattaattataagacatactgatttcacaaatattcaatttgaaaataagaatttaggaaatattatatgatagttcaccctttttaaaataaacaatgagacagatttagaggagttaactaacttgcccttgatcatacaacttgtaagaggtggaaacaaaattagagtctaagcctttgtgatactgaaatttgtatcttaacctctgagttacagtcttcctggatttttagtagagattggggttttgccatgttggcctggctggtctcaaactttggggtcaagtgatccgcctgcctcggcctcccaaagtgctgggattacaggcatgagcctttgtgcctggttgatgatgatgttaaaatagattgttgaccatgtgaacttattttctaatttacgttttatagaattttgtctcgtaacagattttgaaacagcagaaatattttctattatctaccctttaaaaaatagatgctagaggtctttatttatataggttcttgaaaatttattgacagttaaaaagtttttaaaaataggtatacaggtacagattcaaaactcaaaggtataaaagagtagatcttgtgagaagtcttcttcccacgtggaccctgagctagtcagtttctgttttaagcgagatgaaatcatcagaagatttgtttttagaaaatctcttggaatacacttaaaaatggttaaaatagtaaagtttatgtaatgtatattttaccacaatttttaaaaagatgtcttggaaacagtagaaaatgaattggaggagggccaagagttatgaaggaggaaaccacagggaagttattatgtttcaggtgagagatgatggcatcttgaatgtggatggtagtggtgggtatggaaagaagtggatgaatgtaaaggataaggcttggtgattgattggatatgtggaagaaaagatgagatcttgggaagtgttaagattgattctattttgtgagaaagggaacaatggaagagggccagtgtatgtgtttaagagcgggttggggggaaagaaccatgttgagtttgaggaatataaaatggtggtgtgtgcattaggcctgtggaaattcatgtatggagcttagaagacttcagggatgagagctataagtggtaattaaaatttaaaaagtaggtgactaccagtcactagtcacattttttttttttttttgagacggagtcttgccctgtcgcccaggctggagtgcagtggcgtgatctcggctcactgcaagctccgcctcccgggttctcgccattctcctgcctcagcctcccgagtagctgggactacaggagcccaccaccacgcccagctaattttttgtatttttagtagagacggggtttcaccgtgttagccaggatggtcttgatctcccgacctcgtgatctgcccccctcggcctcccaaaatgctgggattacaggcgtgagtcaactgcgcccggcctagtcacattttttttaaggtctcactgtcacccaggctgagtgcagtcatgtgatcaaagctcattgcagcttcaaatttctgggctcaggtgatcctcctgcctcagccttttgagtagctgggactacatgcctggctaatttttttgaaaatgttttgtagagatagggtctcactgtgttgcccaagctggtcttgaactcctgtattcaagcacttttcctgcctcggcttcccaaagtgttgggattacctgcgtgagccaccccacccagctgactgccagtcactttgagggagcgtatggagaaagaaaggacccaagacaggcgagccagcaaaggagctaggcatagggtaattagaaagaaaaccaagggaatgtggaggctcagaagactagggaagagaacattgaggatgaaggaatatgaggtgtagctgagaaagattaatcgaggactctcaaaaagatccattagatttagctacaaggaagttattgatgattttgctgagaacattttgaggggaatgtagagacagaagcatgactaggttgaaagtaaatgggagattgtatcaattatgccgtcctcacttgtagtaacaaaaagtccacctcaaattggctaatagtaaagaggatttattgtttctgaaaaagtcctcaagtgggatgggctttggttttgatttgatcagggctgtagcgtcatttctctgtgattcttttagctgtgcccttgttgatgtgtggatttcattctcaggctgtctagtctcatggtagaaaatggctgtagcggccgggcgcggtggctcacgcctgtaatcccagcactctgggaggccgaggcaggcggatcacgaggtcaggagatcgagaccatcccggtactaaaaatacaaaaaattagccgggcgtagtggcgggcgcctgtagtcccagctacttgggaggctgaggcaggagaatggcgtgaacccgggaggcggagcttgcagtgagccgagatcctgccactgcactccagcctgggcgacagagcgagactccgtctcaaaaaaaaaaaaaaaaaaagaaaatggctgtagcagttctaggtctcacatctatgtaccacaccattcagagctcttctctaatcactgaaagttctacactcttctcttgcttttttcttgctcttcaaacggaaggattgattatagaaaatctcaaatatatacaataacaataatctttcatgtacccatcatccagcccctgctgtcatcaacttatggccaatcttgattcatctctaaacactccccaccactgccaattatttgaaacaaattccaaacatcatgtcatcccatctatacgtgtatcagtatgtatttctgtaagtccactccctttttaaaatgtaattgtggcacagccatcacagcactgttgtcacagaattccatatcatcaaatcaatatgaacatttctgattgtctcataaatgttttttatttttattttacagttttatttgttctagttaggatccatctaaaggccatactttgtaattcgttgatatctctttatattgttgtgtttttttttctttttcaggtatatatgaccagaagattttttttcttaatgtataggctccttctccatctcattttaatcttccttgcagtttatttgttggagaaaccagagtatttgtcctataaagtctcctacagtttggagctccatgatattaacaagtttctctttgtcctctgtattcgttataaattgatagttagatctagaggattgattgcattcaggtttgatttttttttttttttggtatactttatacgtggtgtatagttctaccacaagatacttaatatctagttgtctctctatcatgacttctctatttattagctgaaatgctgttttaaaaataaatttccctttattatttggttaccctgagtgctgtgtgggaaattaccttgatccaatggtagcctctaagtgcgtgccatacaaaaactagcctagaggtcacagaacagaaagctcacagaacaacttaaaatgcccaaattatgtgatttgttaaatcagtttttagtgagaagcaagaggaaagagataggatgagttaaaacacttaggataggatgcaaacagggaggaaggaccacactccctgaatgctgcagtatatacatttcatgtgtcctgtctctactgcattagccttctctgctgatagtgtggtcaccaggaccagagctgaggtttgaacaaagaggcccacacagacataggccagtgccacacacttgctctattagacatgggacaaggaagcctgccacagctgtagcttgccacaagcctgatgatagccatgggcattgtgttccttgggcagaggacacatgggccagactgggcatcatcaatgggtagctgaattaaggactcatgaatatcatgctcatgtgttcattgactcttgtttagtgtcatgcatatttactctgtcatgaatatttagtacttagtatatttagtgtatcatgaatatttaatacataggtgcctcataaatattaggtatcttgttttttccatccctttctatgtttaatatatgtgtgctattaactgcttacctttatttaacatgttctatcaattatatgtttaacaaacttttaaaactagctccttatctatacttaaaatatctttgaacatttcatctacattttacaaactttttcatctttatttataatagaattgaatagtctcaaaagtaaaattttattacattgagatacagggaaagcaggataaatgctatattctttctctttatgggggggaaattggaccagactgaatggatcactggcccctgagaatctgaaaggaggtaaagaatagggagaacattccagagaatgtgaaaaggctccggagtggaagagagcatggtttccaggaactgaatgtgactggcagggataggatcattccattcttgtaggccagaggaaggattttaatccttagagaagtgggaagtcattggaaacccttggggatggggtggtgtgtgtgacatgaccaaatttgcttatgggaaataagcaaattctggctacagtagagaatggtttggagcggggagcagagtgaatgtgggaagacaaaatttggagtaaatatagtaattaagataaaaagtgctggttgcctgaactagggagaaccagaacctggagtctgagattgtgagaagggggaagactttagcctggattctgtaatggattttatttatggttgaaggagagggaggcattaacgatgactcctaggtttctgacttgttcggctcgatggattgtggtgtactttattgatataaggaacactgaaagatcatcaagtttgggagaaaagattggtttggggcattttgaagttttgtagctttttcaacataatttcaaatgtgtaagaatagtataaagaattcccaaatactctttacccagatttaccaattattttgtcccatttgttttattattctgtctcattccttcttcctacctcccacacaaatgcctgtatgtgtgtgtgtgtgtgtgtgtgtagagagaaagagatagatagatagatacatcttttttttttttttgagacagagtttcgctcttgttgcccaggttggagtgcaatggcgcaatctcagctcactgcaacctctgcctcccgggttcaagtgattctcctgcctcagtctcgcgagtagctgggattacaggtgactgccaccacacccagctaattttttttgtatttttggtagagaccgggtttcatgatgttggtcaggtgatccatctgcctcggccttccaaaatgctgggattataggcatgagccaccgcgcctgcctttttttttttttttttttgagacaggagttttgctttgtcaccaggctggaatgcagtggcacgatctcggctcactgcaatctccaactcccgggttcaagggattctcatgcctcagccacccaagtagctgggattacaggcacgtgccaccacgcccagctaatttttgtatttttagtagagatagggtttcaccatgttggccaggctgatcttgaactcctgacctcaagtgatctgcctgcctcagcctcccgaagtgctgggattataggcatgagccgccatacccagcaatgtatatataacgtgtgtgtgtgtgtgcttgcatatatataggatataaataaatatatataatatttctggaccatttgagaatatgtaaagagatattgtaccctacactccttcagtgtatatctcctataaaatgaaggatagttcctgaacataatctcatttaaaaattgggaaattttagctgggtgtggtggtgggcacctgtgatcctggctacttgggaggctgagacaggagaagcacttgaatcaggaggcggaggttgcagtgagccatgatcgcaccattgcactccagcctgggtgacaagagtgagactccatctcaaaaaaaaaaaaaaaaaaaaaaaagctacaagctacaatatgaggctatggtaaaggcagggaccagactaccagattagtcagttctctctaaatcataacagaatatttaacaaaccctaggagcaatggaaggtcactggtgtgtcaaaagctttccctggctaatagtaaggatgaaaagatggtgagagcacagaagtgttgctggaagtcacgcaagaggtatgggacctggaatgaggtaattaagatggagagacacagaggtgttcacagtctgtgtgggaatctgtgttggaaatagagcttggttataaattagatggagaatagggttgggctgtgggtgtaacaggtgcaaaactgagcctcagttgactcatttggaaatagcagagttgtggtttactgacgtggaagcactggattggggcagacttattgtgtgcaacatgggccacattaacttggaaatgcctgtaaagcatacaagggaagatatcacaaacataatctgtggctcaaaggggaggtctgggctacaaatccaaatgtatttttttaattttatctttcactttaaattaaacattaatgcatgaccgttgggggaaaaaaagcattaaaaatgaccatagagttctttctctacatgtgtacacataattattatttacaaaagaattatattatttttaatctgatttttaacattttgagcacagtttcttcaggtaaatatagattccttctgtgatatgtaactttactgagcatataatattgcttaatgtatctatactgtaaattattaacctggttcttattttaatatatatagatggtttctaatattttgctacaataagcagcactacaattaacactcttatatgtctttgtgtaatcacttagtaaaattcataattcataagaaaaaaaattgggaaatttaaccttgacgtgatactcttatctgattcacagcccgtattcagatttgccaattatgttgattttcattattgctattttatttcccaattcaggatcatgctttgcatttagttgtcatgtctcctttttttttttttgctgagatggagtctcgctctgtcgcccaggctggagtgcagtggcgccatctcagctcactgcaagctccacctcccaggttcacacattctcctgcctcagcctcccaagtagctgggactacaggtgcccgccaccacgcacggctaattttttgtattttatagtagagacggggttttgccgtgttagccaggatggtctcgatctcctgaccttgtgatccacccgcctcggcctctcaaagtgctgggattacaggcgtgagccaccgtgcctggcctagttgtcatgtctcttaagtctcctttaacctggaatagttcttcagtctgcctttgtctttaatgatattaacacttctgaagatagagcaccagcctgggtgtggtggctcacccctgtaatcccagcactttggaagattgaggtgggcggatcacttgaggtcaggagtttgagaccaccctggcaaacaaggtgaaaacccatctctactaagtggtgtgtgcctgtagttccagttacttggtccgtgcttgtggttccagctactcggtaggccgaggcaggagaattgcttgaacctgggaggcagaggttttagtgagctgggattgtgccactgcactccagcctgggcaacagaggcaaaactccatctcaaaaaaaaaaaaaaaaaaagatagagcacccttagctgtgtgctggctggatatcaagccccttccttaggcattgtcttagctcttgccaaacttttgcctgtgtgtctggtacaagcagccagttctctgcaggagctgactgggtgcctccttctttgtgttcctctttactctggagtgctgggccctggtttagcagatgtccccctccacccttggttcaaatgactgggacaatgatgagatccttacatgggtgctggtattgataggaatacctagacagtaggaaaaaaacaaattacacagagtcctgccctcaaacaagagctgatggagacccaggaactggagaccatctcctaaacccctactacttctgccctctggtgcaccctatcttttggctttcttccctctttcgtacttcccttcttccctctcttccattcactcttccctgctcccctctggcagacccactctgtactcctcttgcttgtcactgccactaccacgaccaccagttgtctctctgtcagcagatgtgccgtgttgcctctctgcacagtaccatccctgcattccacagaagacttgggcaagggtgcctgagaggtacccagagacaaatcacgtggcagccaggcagccccagagcaaagatattcagacagatgaaagtctccttacccccatttcttccaagatcagaacagcttgacatactccttcatacacagtgatgccaggaaggcaggggaggcgtgggaagtcttccttcccagtacctgcaaaatgtctgagcattatgttgatttttttcctttattaaaatgtactgtttaatcttataagaacaatatgcctgttattttatagaatgtctctaaatttggatttgtttaaggtttctttattcaagtttgataaggttcaagttatagaagcctggtagactactgcagaagagatgttgtagtctcagtaaatcatatcaggggacacataatgtttgttccagtataggtgatgttaactttgatcacctggtcaaagtggtatctgtagttttctccattataaaattatttttccactttaaattaattagtaatttatagggaggtaattcaaaatatcctgttcattaaactgttacccaccattttagaatccagtaatgatcttgcctgaaccgattattgctgttgattactatcctttttttccatttgtttgttggtattattctaccacaagaaagagctccttttttttttttttttttttttttttgagacgaagtctggctctgtcgcccaggctggagtgcagtggcccgacctcggctcagtgcaagctctgcctcccgggttcatgccattctcctgcctcagcctcctgagtagctgggactacaggcacccgccaccaggcccggctaattttttgtatgtttagtagagacggggtttcaccgtgttagtcaggacggtctctatctcctgaccttgtgatctgcctgcctcggcctcccaaagtgctgggattacaggcgtgagccaccgcgcctggccgaaagagcttttttaatgtattatttatttgtgtcaggatagactcattgatgcgtgttttattcagtgggttataattctttattatgtattctgatgttggtgttttcccagttttagccaatggcatccccttccatctggatcctgtgttcttttgacatggctccattatttgttagcatttccttactttctggcacataccacaacaaagatgttctaagcatatcttatactttccctgctccagacctggaaacatttcttcaaggagcagtgttgcttttggtggggaaggtattagaaaccaagatacaggtgctaggcttattgctaacagtgttatttagcagacagatagtaaacacacacatatatacatagtgtatagctaaatctatttcttttgctatccatataaataaagagatatatatctgaagcatcatgtatttataatgacacttcccatttcaaccagcaccacagagtttattctagtttttcctttttccatatttgtaactcccctggtcactgagaaacctggctcccattttgagttaggtttctttgtgacacccaagtgaagagctgagtaggctgatggcttataaggatctggagctcagaagaggtgctttggccttatagggtaatgggaggagtagaggtgataatttaagctcaggaatgctgtaccacacttaccatgttaggtaataatgtagagggcaggagggagctaacttttaattggtaccttcttggaaggcaaggctctatgtgtaggtaccgtacagtcttggtaaatatttgagtgcgtactgtgtttcagacgcagttccaggtactagtgacacaggacagataagtatcttgctctccttcaggtaccttatagtgagaggaggtagaaataaaatattatgggatagtaatagttgttatctagagaattaaactacaatgagtgactgggtggtcagggaaagtgtgtttgaggaggttacatttaactgagatctgaatggaaagagccaaccattcattcggttaaggggaggaacattagaggcagaaggcctctagtgcatgggccaaaaggtctgaacctggcatattctagcaacaggaagagttgggtgtttggaacatagcggcctggggaaagtggaggaagttgaggtcagagtaggagtaggcagtacatttgtggaatatggagaaactaaaactcagagaagttaattactgaactcaagatcccatcaagtaaatggctgggccgggcatggtggctggtgcctgtaatcccagcactttgggaggccaaggcgggcagatcatctgaggtcaggagtccaagatcagtctggccaacatagtgaaaccccatctctacgaaaaatacaaaaattagctgggtgtggtggcacatacctgtagtcccagctactcggaaggctgaggcacaagaattgcccgaacccaggaggtggaggttgcagtgagtcgagatcacgtcactgcactccagcctgggcgacagagtgagactctttctcaaagaaaaaaagaaaaaaaaaagaaaaaaaagtaagtggtgaaattaggactcaaccgattcttttaaaatctaaagcctatactttctcaaagcccaaatttttccaaattttggaatggatgcaggtagtgaatgtaggtaaactgaaaacctatgtggttttgagagggattgctgtcacagaaattaagtgtggcccagagaaaactaaagtttctcaaagcgtgtacaaggagtaaataatgattactagcacagaatcaggtagtaaacttgagggggaaatttgaaacctgggagtactttcaggaaaaggctagtgactagaattttttttaataacatttttatttattcatcaaatctttccttaccacgtaccaggcgctgagttaggccctagagattcatatcatggtaaatgaggaagacatgatccttgccctttggtcatatattagggtattcatatcggtacacccttgtcaacagtgggtttaaactttttttttgtttgtttgccattttgataactttaattactggtactatgaagttttaaatgttattgatcatctttatgtcttttggttaatttcaagttcagattctgtggcttacttttaattggagttctttgaaacttagaagttctataatagttattaccttagaaactattttttagatttggaaaataaggtggcattcctatgatttagtgtgatgatatttctaaaatgtactcccctcctgcttcctgcccctttattgcttttaataaatctgtgtcacttgctggaatgtggatgcaactggtagctaacccagttttatagaaaattgccttgagcagtactgtctctgctccctctacctgtacctcaagcatttcaggtggatgttactttcaaaacttaggtctagtcaggacttatagtagcatgattaaattatgttctgcttaagtcatggtatacaagaaaaactcatctcatatcctttgcaattctagcagtggtatttcattcagctgttctgtctgtattaatttcttactttttgtgttctggaggttagggagagagtgaaaccccttatctttgattttgctgtttattttctaatatgctgtttcagttcatttttttttaatgtggtacaattccaaactttaaaaaaaataatagttttataccattggtaaaatgatagacacatttgaagtcttctcttaagtatatttagctcttgaagacttgtttttaaaatgacctattttatattcagtatgaagttttacattctcttgagggctgaaaaatctatttttgttgtattcttgaaacagtctttgattagctgtggatcctttcccttttccttgcattggggtctttttaaaacttacactttcacaacttaggttagtggatatgctttaatgaaatggaagcaacccctggactcttgtcttccaccttccacccttttgatcttggcaaatcattattatgtttgagcctgtttagcaagatggtgtagagctataattctgtgcttatcagctatgtgcccctgggcaagatgtcctttcttgagttctttatctgtaaaataaggtaagagggttgtcagaattaaatgacagaatgcatgtttaggactgtgtctgacaagatgttataaaggtcatatatgaaaatggatgtaaaagcagtaagtaaatgctaggtggatatataggtatgatagataaatttgtaatcctgataatgagcatttacttttcacagctaatatttagatgccaaataacttatattagccattttttactgatacaggaaataaaaatccattgtttatacatttgataagttatcttaaaatcaaataattttccttttacagctgttctactaatagtttctgtttatttcctacaatactaaagtgtaaatgaataccagcactatattctgcaatttaaaactgaacttcaccatcacgctgaggcagctatattaaatttaaagctggctcactactgggtagtgcatctacgaagaaaggaaagtgttttcaattattaaatgaggatgatatttttagatgtcaccaaaatcccaaattgatacatccactcttgacctctttccagagtcctatatctccagctgcttattggatatttccacttggatatttttgctattgtttcaaactcaatatgtctaaaactgagtttttgatcttgcttttagaattggtgctgcctctgattttcatttttctattaatgatatcactgtttccctcataacgtaggcttattattgatttccatcttgaccctctttctttgctttattcctgggtactttttgtttgtctttagcagttagtctcttatgtcctatactttctgttttcactactgcctttgaacttcatttccttatatctatatggtaatcttctatctctgatttttatggccatcaatattaaataccagattgttccaaaacgtcagtcttaatgtgacactgtcctgtaaaactgtcagcacctccttgttagctaatatacaaagtcctcgtgtttaaaagatgaatatttctttcaagtcctcatcacgaacctctcccattccagctttgcctcttactgctttcccacatgaactcttctctccacccagattgttcaatttggtgtctcttcacatcttttttccctactctttctctcctccctctccttacgtttagaaaggctcttttttttctgactaaaattctgccgattcctgctattctattttttttttttttttgagatagagtttcactcttgttgcccaagctggagtgcaatggcgcgatctcactctctgcaacctctgcctcctaggttcaagcaattctactgtctcaacctcccaagtagctgggattacaggcacctgtcaccatgcctagctaattttgtgtttttagtagagaggggtttcatcatattggtcaggcaggtctggaactcctgacctcaggtgatctgcccacttcgacctcccaaagtgctgggattacgggcgtgagccaccgcgcccagctgcagatttttcgaagtaccagttttggttagtattgtggcattattgagcttatattaaagctgcctattcaggaaacagctaagatcagtgatgggatggctggcttcagaacctcactttctagagagaaggcaggtgagggactggctaggtctcaggacagagctatcaggttctataattgcagctccatgttaacctctaactcagaagccctacctctgggggacatacctcatccttgtcctgcttcgatgagaggtatagagcccaggtaagaaatggagaggaggaggaagagatacagggtagaataggcaagaaaacttgtaaaacaatgagaagtattttgtttctctcgtttgttttggtaattttgctgctgtcaaatacaaatgcctttgcttaagttgatttgggagcagacattgggagagtgggagtggacattggaagagtaggacttggcattcttaaagggtagtggctagcaggaaagagaaacttcggaggagattttggttttcttcccatctcccatttctaaactactacttatgttttagtcgaacttgtcagttgggtgcccaggaagtctttttcaggtaggatggggagtggtcagtggtaatgtggcaatatcagtggtttactagtgtaagggatttttaagagtagttctctcctaaacaattgctataattctttttcagtagtgtcagcaagctaagcatgaagggagagacggcagaggtcttgaggcaaagagatagaataagttaggcagtctctattctgcagctcattagctgtaaaactgggcagatgattttgtattctcaggtggcaaggactagcagtctcctgaaatacctattgtgcatttccatgttgacagcttgcctgtgaggagcgtcattgaaattagtttttaggaatcttatagttcattctgtagatttgactatgaatgtgggaatactttcccaagagccactagactcagaaagcttttctccttgtcttgtagtccctttttggaatatactcagaaagtatcttctgtaaaggaaatttgtatctttgtctcattccagagtatatgtcaaagtttaatgaatcatcttttcagttaaagggttattgctatatttttagagggaatcttaaattctatgacataaataataattattaattaaattctatgtttcttttataaaaatcttgtaagagaattttttccattaatctttatagaaaatgtgccagaggaacttcaagaaccattttacacagatcagtatgaccaggaacacatcaaaccacctgttgttaatttgcttctatcggctgaactatactgtcgtgctgggagtctcattctcaagagtgatgctgcaaaaccccttttgggccatgatgctgtaatccaggctttagcacagaaaggtctttatgtcactgaccaggaaaaattggtaactgaacgagatctccacaagaaacccatacagatggtgagtctttatatacccaagattattttaagtttgaagtgtgtacttttgagtgtgaatgatatactgtaaaacagagggaaatgttttgaaattggattgtatttttgcctagagtttacaactcatctttttcttaaccttgtttccaaatgaaggaagattttaacgattttggaatgtttggtgccatctaataccttggagaaacaactacataatttccaactaccttaatgtaattttaattgaaaacttttattttttccgttgtagagactggctagaagagatggaaaatgcatccttgactttatcattaggaaagagttgagattaataagtgctgatttatggccgggcgcggtggctcacgcctgtaatcccagcactttgggaggccgaggcgggcagatcacctgaggtcaggagttcaagaccagtcttaccaacatggagaaaccctgtctctactaaaaatgcaaaattagccgggcatggtggtgcatgcctgtaatcccagttacttgggaggctgaggcaggagaatcgcttgaacccaggaggtggaggttgcggtaagctgagatcatgccactgcactccagcctgggcaacaagagcaaaactctgtctcaaaaaaaaaaaaaaaagctcatttatgtacttgaataacttcttggtaaatttctgcatatcagatattttcgtttatttgatagctttgaactcattcttgtagacaacacacacagaaggcctctaagctggcctggggccatcatgcaggaactctctcataggcagtctcaggaaacataaatctaaatgtttaagttcattgtatgctggttcagtccattgtactgctttagcttgagtttcacaaaatgtggacatcatcaaggatggtattagaaagaaaagtggtttttccatactcgattaaatcaaagagtagtagttttgcttgggaggaaggtaaggtgtatatgtagaaaagtatattataaaatttatgaagttatgtaatttaggaagaatgaacaaaaaaattagtttataaaatctattactaaatgaggtgatgacctgttttgttttctggtttttttccttctttaaagtaactcttttaatatttctaagtaatggaaaataatgtattgattagttaatggaatttatagatttacaatatagttattaacaataactagaatattgattatccagtatgagattgtcatctttcattgatggctccaaaatcaccttatagttaccctctgactttggcatacctgctttgcatacatatcatatgtgaacagtttgcccataccagggacaagcagaatctacttaggtccttatcagtgtctcatattcatctcccccagaatcattcccctagctggacactccagcttgtgattacttctgcttccgttgtttgaaggctaagtggatagttagaaagcacatccatgactttgtgaagcagtgtttgtttagttgctgttctttcagatacagatatatatgtcatagataacctacttatccttagagtgtctatttcagatcctctaataagaatgaaacaaatttaacatgttttctacatttttttccagtgtagtttgtatgtgtgaaatacttggacaattaattttaaaatgaggggtttggtagactgctgattgtgttactcatgtttctttcacactttattgatcctgctgatagctttgaatgtattttaataatatttaaggaatggagtttaaatgacttagaatctttttttttttcttagttggagtctcactctgttgcccaggctggagtgcagtggtgcgatcttggctcacagcaacctcagccttctggtttcaagcaattcttgtgcctcagcctcccaagtagctgagattataggcgtgcatcaccatgcccagctaatttttgtacttttagtagaggctgggtttcaccatgttggccaggctggtcttgaactctagacttcaagtgatcctcccacctcagcctctcaatatgctgagattacaggtgcacggcatgggcaacatagaatctttatctctggttctaacttctatttgtggattgttagaacttgagaacttcaggctgggtgtggtagctcacgcctgtaatcccagcactttgggagacaaaggctggcggatcacctgaggtcaggagtttgagactagcctggctaacatggcgaaaccccatctctactgaaaatacaaaaattagccagatgtggtagtgcgcgcctgtagtcccagttactcgggaggctgaggcaggagaatctcttgaacccaggaggtggaagttgcagttagccgagattccgctactgcactccagccagactgggcgacagagtgagactttgtcttaaaaaccaaccaaccaaagaacttgagaacttcatatttgacctacatcatcttaaccctttgcagtgtcacatttaccaacctgtgttttaattgtttactttcaacttttatcacaatttgatttaaagttttccagttgctgtggcattttgattgatgatatttaatgtaactattttcctgaaacctgcgtgagaaaatttctcagattactagtaaaaagttgttccttaagaaactatgtttttggctgggcgtggtggctcgcgcctgtaatcccagcactttaggaggccaaggagggtggatcatgaggctaggagtttgagaccagcctagccaacatggcgaaaccccatctctactaaaaatacaaaaattagccaggtgtggtggcaggcacctgtaacccgaggtcgggaggctgaggcaggagaatcgcttgaacctgggaggcggaggttgcagtgagccgagattgcgccactgcactccagcccaggtgacaagagcaagactccgtctcaaaaaaaaagaaagaaactatttttttaaagagtaaagtaagagttaatgtaaattaacagtttttttttcctgctttttgggaagtatcatgaaaaatagtgtgtttaattgcactgaatatattgccccccacttccacttctaaattatttttaatttgggatattttatttctgtatgccagccttttggggggaaaaaaagtgtggtggtagcaaaagtatcatcctaatttttcaagaaataatgttagtactaattctttttcttcaaagtctcagtataaaaatttcctgtgaaataatatatatgaagacagaaatctttagaagaatttacaccagactgttaactttggtttcttctgtgaaatgggattaaataggattggagaaataaatggtaactttcatatcttatttgatgtatttctgcactattaacatttttatatgattttactgttttaaaatttaaaatgtagagaagaaatttaaattcaaatagaaattatcattatctgaaataacatgccttgtatgcatactaaatatttctgatagttaaattgttaaagagaaataagtatcctgcatttagcctttaagcagacataggaaataagaataaatattgaagacctctctaaatggttaaattccaaatatcccgtaaatggcaattcaaacctttaagatatcttttctgtagttccttttagtaatcaatctttaaaaagaaaagatgtggctgggctcagtggcacatacctgtaatcccagcactttgggaggccaaggcgggtggttcacctgaggtgaggagtttgagaccagcctggccaacatagtgaaaccccatctctactaaaaatacagaaattagctgggcgtgatggcaggcacctgtaatcccagctacatgggaggttgaggcaggagaatcacttgaaaccgggagaaggagattgcagtcagccaagattgcaccattgcactctggtctgggcaacagagtgagattccatctcaaaaaaaacaaaaaaacaaaaaaactcaacgtaacttctcaaaacaaaaacatttctctcaatctccaccccaaaattaatactacaatctgcttatcagtcaaacttgccttagtcatacttctttatttatttattttttcgagactgaattttgctcttgtcacccaagctggagtgcagtgacacaatttcagctcattgcaacctccacctcccaagttcaagcaattctcctgcctcagcctcccgagtagctgggtaaattacaggtgcgccaccatgcccagctaatttttgtatttttagtagagatggggtttcaccatgttggccaggctggtctcgagctcctgaccttgtgatccactcacctcggcctcccaaagtgctgggattacaggtgtgagccaccgcacccggccatatgttatgttctatgtatccagctgaccactgacatctccgcttgaatgatgtttgaactaaaaatctaatgaggaagaaaactgggaaaaaaaactagacagtatgaaataagtgttctaactttaagcaatagatactgagatcttagaggtggatgtgatcatctctattagggaggatcagggaaggcatcacagggtagaatgataaatgggatttcagtagttgggaaaagggatgggatgagagtagtaactgggttgaaggaattgtttgactcaagattgaactgtgaaggtatgttaagtattataaattaaaatattgactgcatggagggataaatgtcagatgaggctaaaaaataatttagagctagatcatgaagagtctgtaagttagataatgaggaggctgtaagtctgagttaaggatttttaactttctgtgggttacagaatcatggaatagattttcatactatattacaaaacacttggaagcattgcaaactgaaccgctatactgtcagcttagtttaaataattattgcagtctgttaattctcagattttatctattgtttatttatgagactatcaagtagctcttttttttttttttttcctgagacaggatctcactctgttgcccaggctggagtgcagtggcgcaatcacaactcactgtagcctcgacctgcagggctcaggtgaccctcccacctcagcctcctgggtagctgggtctgcagacgtgcaccaccccacctggctaatatttttttattattttttttgtagagacagggtctccctatgttgcccaggctgatctcaaactcctgggctatgctgggattacaggtgtgagctgggattacacctggtctatcaggtagctcttttcatttagtttactgtgtgccatgcagtgtgcttacactttaacactctatcttacgtaatttaattcttacaacaactccaagaggaaaggatcatcccttttctattgatgaagaaactgaggctttgagaatataaggtcacagagcaagtatagttaagtagtgaaggcaggattctgaacatctctgctttaactataaatcctatattctttttcggttttttttcttattttacttctcttttacatgataacaggataaatcctatgttcttaaccactaaattgtattttcgtctttgcctagggaataggtagatgggaagtagtaaggtggaaggaaatagaaatggtgtgccacctggaactctgcctggtggtttgtttgaaatcttggtaatttgcctaggtttctttccaaagtaatttcccctctctgttccatttacccactctgttcctgtattaaaggttatgttaattccatgtaccttaggagtaattatagcagttaagtagaatgactgctgacaggggatgaagtagagttgtgacagagtctaggtggacatgagttaattgatacagtatttaagaatatgcaggcagggcgtggtggctcacacctgtaattccagcactttgggaggccaaggcaggtggatcacctgaggtcaggagttcgagaccagcctggccaacatggtgaaaccccatctctactaaaaatacaaaaaaaaattagctgggcatggtggcgcactcctgtaatatcagctacttggcacatgcctgtaataccagctacttgggaggctgaggtgagagaatcgcttgaacctgggaggcagaggttgcagtgagctgagattgcgccactgcactccagcctgggcaacagagtgagactccatctcaaaaaaaaaaaaaaaagaatatgctgaataattctctagttaccattatttttgctggatacacaaaatgtattgagaacagagaagctgatcccaggaactttgtgttgtccctcttttttttttttttttttaaacatattggtcttatttggcaactatgcttaggaatttccattgtgtcaccatctgttggaactcaagtgtaatttacttgtgtagaggcttgttaaaaaaaatcctttccctgtttaagaacaggattatataaatgtagtattgtaatagtaggtgagaagacattaatttctggtcacccttgtatatgagtggcttgcaaatttataagccaaacctgtctttgaaaaattaattacattctcatagatgttgttgaacagggttttcttcttcatgcacagtgctagaactcaattttctgtttactactcatgtacctaataatgttccattatttctaggtaacatctatacctctgttacaaattcacaatatcttttgataccttacaaccatgtttatcatgttagagtaactctttatttgtgatcatttatttggagctccaagtttactttctcatagaaataacttgatgaatggtacttactttactaggtgatctcacaaagactctttttaataaaactgaattgtcagaccatttattaatttatttaaggagcttctgcattgtcctttgtattttctaccatgattacaaagagtttcatgttcttcagtgtctcactttctagcggtggcttatagaaaactgtccaatgttttaggagtgtaaaggcaccaaactctgtactacacttcaactgagttttgaaggatgcggaggaatttaccacatagagaaatgaaggctgtgttgtacggtattgtatttgggagtataatgggatgttaaaagggagtgtgagagcatggtgaccctcaggtcaaaggaagcagcttagttgtggcgttagcactagctgccttttgaggggtgataagaaacgagatcacagagttagatagggttagggcatgaatgatgttttgtgctatgccaagtgtttacgttatcctggaagtgatgggaaccctagtgtagggttttaagccagagagggtatcatcagatttgtgtttcagaaagtcactgtggtgtattgtagaagagataccacttaggaggctgttgaaatagctggaggcctgaactaaggtgcaggccatgaagatttattagtagggttgagtgggagagactttttttttgttgttgttgttttgagatggagtcttgctctgtcaccaggctggagtgcagtggcgcgatctcggctcactgcaacctccatctcccaggttcaagcgattctcctgcctcagcctcccaagtagctgggactacaggcgtgtgccaccacgcctggctaatttttgtatttttagtagagacagggtttcaccatgttagccaggatggtctcgacctcctgacctcgtgatccacccaccctggcctctcaaagtgcaggggattacaggcatgagccactgtgcctggctggagagacctcgttaaggtaggattgagatgataccttgatttatcaagaattgggagattaggaagagaaaccagaacagggctggcaaaaaatattttatcccttatgtcaactctaattaattaattagtagttaactactggaaggtgggaaaaactagctccttggttttcactctgttcctttgagagcctcggggtctagatgttcccttccccatcctttgttcctcctagtgcttttgaactcttgtattttttacctaatagtggtaaatgacaaaaacaagtaaaggaacagctttataagtttgaagtcttgagctgatattgctaaacttactatttttgatgagaaagataaaggctgttctgtaagactcatactaagtttctcttttcttcttagaaaaagagttgaaaagagtttttcccaacacaccaagcaacggacaccagtggggtgtcctctaattcagttccaacattatctacctggagatagtatcagatcagtgtcagatcccacaggttgagggcttagtccccaagactaccccaccaccacaccagtcacaagtccaggcctccggtacttctcactgaccggcttcaagttggggttcccatgaccccctctttgggttcagttaatttgctggagcaactcacagaactcagggaaactcttacttacatttactggtttattataagggatattgcaaaggatacaaatgaagacacgtttagggcaaggtatgggagaaagggtgcaccaccctccaggaacctcactgtgcttagctgtccagaagctccctgaatcctcttctcagttttttgaagctttataatcttggcatcccttttcccagggtatagggtgggactgtctcatagagggtcttaagacccacagtcagaaaggcaggagaagattagattcctgccttggggcaggtgaaaggagggcaggagattctgtttcctgaggcctaacacacccaagattataatgaaagactataacaagggctttagaagttatgaaccaggaactgtagatggaaagcaatatatatcataacaccacagtgatcaagtagatagatgattctcccctatcatgtcttggaagatgtgaggtgtgggattaaaaaagtgagtgtggaaacgggataggaccgaaggtacagaattgtagggatgacatgagggatgaggaaaattgagtacactttacaaatattatgaatgtaatgtatgatataggtggtgccctattgatgaggaaattgatctataactgactccaaaaggtgagttaacttgcccaaagtcaaacaggtaataaacgataatgttaggatttaaacttgcatctgctgattccaaagcccatgcttattctgtttacaccatgaggccttcccaaaccaaaacaaaatgtccccctactatttcttttttttttttttgagacggagtctctgtctcccaagctggagtgcagtggcgccatcttggctcactgcaagctctgcctcctgggttcatgccattctcttgcctcagtctcctgaatagctgggactacaggtgcccgccaccacacccagctaatttttttgtatttttagtagagatggtgtttcattgtgttagccaggatggtctcagtctcctgaccttgtgatccacccacctcggcctcccaaagtgctgggattacaggcgtgagccaccgcacctggcctactatttctatagtacttaatagtttgtaaaacatgtatacgttattattattattttctgataataaccagagaaggcaaatagggcagttattaccatctcttttttcacaagtaaggaaactttacggatgggtttatttagtagatactcggttcttagtggaaagaggtgtagaaagaaaaaatgcatagatcatgatcacatggctaggctagttagtaacagagcagagatagatcccaatcttcttacttctaacccagtgcttattctacaaatgcatcctgcagccatcctttttcctgtccttgtggattataccatgtattgattccggaaagactaacagagaatatgagcatggagtaggatgtcaaacactgagaggcgatagcaaagaaggggagaggggaacagggcaggaatcccaagaataggaatagaagggagaaaaggggattgttttgctcacctgactaaagcattattttctcatataagagatatatcttgtttagtgaccaccgacaggaagatttagatctacaaaaataatttactttgcaaagtaattttttatttaaaaaatgtttagaattaattttacattgttttagaaaaatagaacttgaagtaacaagttttcaagaacacatgtgaaatgaaaaataccatattcattataatgtttaatataatgttgattatattaaaaattatctcgttcttaagtaaaatatacattctcctttactgataacatattttatattttttatattgtaccacatatcatgcctggtacataagggcttgataaacaaagtgttaatttctggtcataaagagatattttagacaaattggggaggtggataattccttatttttccagagaccatgtctatgcctctcactttgcttttggccattgctgattgatctcaggattaagaaatcagatgtaagatgggctgactagattgttttctggaaaactggaaacccaaagggagggagaatgactgtacagtgatggaaggtggttggaaccaccctgtcttatagaagcagtgccctagggagaaatctgtgagctcctgctgctgaaataccggtgctgctcaatttccatgctttctgagcttagtgttttggctcttccttagattctgtgaactactttagtgttccctcagtaaattacagctaatttaacagggttagattctgttgcctgccattaaaagaactgtagctaaacaataaataaataaaaagccacccattgaccatttttactcacttgaggacagatttcattacagaagtatagttttagagctgaaagagatcctagcaatcatctggtctcgagttttgaaattctcttaactatgactcacagttaggaatgcattttacttcaagatacccacctggtttacctagttacacatgtattacagaaacaaaagtacttatccttgtaactttatttttttaagattctatttgaaaaaaaaatatgggttgtgaccaactaaattgactttatgcatgacccatgaatgggttataaacccacatttaaaaaatactaatgtaggctgggcacagtgactcacacctataatcccagcactttgggaggctgagatgggtggatcacttgaggccaagagtttgagaccagcctggacaacatggcgaaaccccgtctttactaaacatacaaaaactagccaagtgtggtggcatacgcctgtaatcccagctacttgggaggctgaggcatgggaattgcttgaacccaggaggcagaggttgcagtgagccaaggtcatgccactgcactccagcctgtgcgacagagggagactatgtctcaaaaaaataaataaaaataaataaattaattaaaaatacaaatgtagttaaattgctttatcttatagagaagagtggtaaaatgacagtgttactagaaactaaataccatacccatgtttttctttaaaaatgtattttcattttcaaattaccaatagcatctatttgtttgaaaagagctatggaaataatttgttgtacatactcttacttccttgaagtttgtctaatctctatggtatactgctgccagattaattttcctgaaatatcactttgatatctagcttatttcctaattcaaaacttttaattattttatttgacttaaaatgccatatatattttggtttcagatgtatgtccttttaaatttgtcagattttcagagctagcaactgtaagtatgagggaagaagttgctgcaaactttgtccataaattagataattcacttttgaatagtggaagttttatattcctttgtttgtaatcttatgtacataagagacaattcaaagtaacaaaagctaagatacttaaggagttgtctgatattacagacctgccagcaataatttttatgaatatagaagatgaattaagcatatattaaccatgacttttcattttttatttttatttatttatttatttattttgagacagtctccctctgttgcccaggctggagtgcagtggtgtgatctcggcttactgcaacctctgcctcccaggttcaggtgattctcttgcctcaccctcccaagtagctgggactacaagtgcacaccaccatgcctggctagttttttttgtatttttagtagagacggcgtttcgccatgttagccaggctggtctcgaactcctgacctcacatgatccgcctgcctcagcctcccaaagtgctgggactacaggtgtgagctaccatgtccggcctcatcttttaaaaagataaaaagatttctatgcattcactgcagattaataaatttaaatagatggtatattgtaagttagcgtcagtgtctgggacctggcctattgtggagtaataatgttctcctagtttaaatatctaaaaaactaatagtagacacacacatataaataattggagtggcttggtgcggtggctcaggcctgtaatctcagtactttgggagactgaggtgggcggattgctggagctcaggaagtcaaggctacagtgagccatgattgtgccactgcacttcagcctgggcaacagagcaagactctgtctcaaaaaataaaataaaataaaataaaataaaataaaataaaataaaataaaataaaataaaataaaataaattattggagcacaaggttgagatgttttagtaggtttggtattaaaactacatatttttctgatttgcagaatacagtatagtgctatagaacagtggacagtcatggcagttgtctgtggccatccataccccagtgtgtgttgagcagattgatgctccaacactgccatgatatggaaccatttttgcaatttgttaggttatagcagtgaagcagattgtttttaattaatgtcagtgatgtgatttagtggaataaaataggtggtcattaaaacaaaaactttagtaactgttattttgttgcttgcttgttttccggtaactgcataaatgagcttctgtaatagaaaaaaaaaaaatctttacaatgctcagattccttctcagcctgtactgttccatgtttgaaacagtgttagaatgagctgtgttacaaagtgcactatgttagaagctgtcccaggggcccgtcttttcaggaagttcttttgctatacttggaggattgtgagaatactgattattgttttcctgaagctaaaactgttagtttgtggttagcaaacaagtaaacaaatattaaaaacgtaactagagagtggtgaaagctgtgaagaaagtaaaagcaggataatacaagtgatctgaaggaatcatgtgttattatagttagagtggctaggagcagtcttatacaggagattatatttgagcagagatttgaaagatgaggagccatttaggcaaagatcagaggctatcgcattgccgacagagggaataaatacgaagaccctgagttagtatataattcacaaaataaataaacttcatggctggatgataaaggtcctactaagaatttcctggagggaacatcttcaggaatttgaaagtgtagagtcacatttatttaccatataatatgtgtgataggaagtacttgactcattcaataagtactttttggttacgggatgtagtaatgagaagacagaccaagcccctgctttcatggagctactattttagtagtaaagttgaccagtaaacaattagacaaattgtaacaattgcaggaaatggtaaatgctgtgaaaaaaataaattagtaaggagctacaaggagtggaacaggctcttttcataggaggctttcagggaaggcctgtcaactgagttgatatttgaactgagacctaaatacctgaaggaactggcagatgatctggaaaaagaacattccaggcaaaagaaatagtaagcttactggctctgatgtaagaggagtttggtatgtttcaggaactgaaagaaggccactgattttggtagtgagcaagattgatatggagagtgataagagatctggttgagaaaaagattgtagccaaagcaagtgaagctctataagccagattttattgtgaatgtgcaaggatgtctctggaggattttaaggaggacaatgagttgatctggtttatttttttttcagaatcattaaatgccataataataattttggtaaaatagaaaagcttcctttttcatgaatatccgaggcttttttgttgtttgttttttgagatggagtctcactctgttgcccaggctggagtgcagtggcgcaatctcagctcactgcaacctctgccttccaggttcaagcagttttcctgcctcagtctcccaagtagctgggactacaggcacacgccaccacacctggccaatttttggatttttagtagagatgaggtttcaccatgttgacccaggctggtctcgaactcctgacctcaggtgatccacccccctcggcctcccaaagtgctgggattatgggcatgagccactgtgcctggccagaatgtttgtattttaatgtagtaacattatagtaaaacaaaataatttgggaaaagacttgatggcaagtatataactttagtaagtacagagtgctatgccaatataaaatcactgtttcatcaaggcaaaagctttcaaggatctttaaaaacaaaaaaaaaaagaaaagaaaaatcactgtttcttgcatggtgaagtagggagtcaacatgagtaataatcagataagaactttcagaagcttcttttttataccaaaacattttgccaatcttattatttttttaaaaatttgtttttggtgttgaaaatgcatagctttagatgttgtaatcatagtatttggtcagggagcttggaaacattttaattgttcttccatccagccttcaggttgctttgtggagaaatacttgagagaactaggcacagaaaaggcaaagcaagaccaagaaaacattttagcattagctcaggttaggttccaacccctgatgcagaaatctggtaggtgaaactggaccaagtaaaagggctgtttttgtcctgagccagattggcctagaaccaagtgtagtcataaatgtcctttattttcctacgacaaccaaacatggaactcattcttccaaaaatagggtcaatgttcatcctgcctgttttagaggaagaagaacttgagggtaagagagagagagaaacctgggcaggcttgtgcacaggaagggcaggaaagagagttgactgggtgtgttgttgggtgcctgtaatcccagtacttgggagacggaggcaggagaaccacttgaacctgggaggtggaggttgcagtgagccgagattgtgccactgcactccagcctgggcaacagagtgagactccgtcttaaaaaaacaaaacaaaacaacaacaacaaaaaacccagacattcatgaaaaaggaagctttttattttaccaaaattattattatggcatttaatgcttctgaaaaaaagtaaaccattggtggaagacttgggagaagagtgagagaaaaggaggaaggagagacaatgagaaaggaaggaaaagaaggagctggaatggggaggagacagtttccagacaggtgcttgcctcaaggccccttatgtggaaaatcttcaaaggagagagaaggacaaaacacctttctcagagctcctcttaataccttatttaataatcataaggaagagagaatgagagaaggatgaccaacctttctcctgagggagtaggtcctgggctcatcaacactgcagccatatgggaagaggcaaagaaaaggccatgactcagtgctgacctttgactcctttgaatatactaacctacaaaatgtggggcccagtctgtgttttggagtcatttattctctatcctagatatagaataaagggatgggcccctttattcctcatggtgctttgaagagagaaattatttccttccccttgagccaactttgtaatgaaaaggatttagactttttcattttttgtctgtatagtaaagttgcttcagaaaaacacaatgagaagaagcatggtagaacatcttgtgaataacctcaaaagaaagaatattgcatgtatctctaattgcctttttttcctccctgataaatgaggagagataaatcgtattgaacaaagtactaaaaagtgctcaacaacacttttatctctttaagtttgtctttttctaacttctaggagtcatttttaggaaagatggatgcctgtagatttcagcttatttttatataatggagccaaagtgaaattcttcaagttcttaataggaaaaaaaggtatactttacagttgtgccacccagccaaggctaacatatattctctatatatgctatatgtgcatatattctgtaatataatctatattaaaaagtgtgattttggaaataaaaaattagccgggcatggtggcaagtgcctgtagtcccagctactcgggaggctgagatgagaggatggcttgtgcctgggaggtaaaggctgcaatgagctgtgattatgccactgcacccagcccaggttacagagcgagaacctgactccagaaaaaaacttgtgaggccaggcacagtggctcacacttataatcccagcactttgggaggctaaggccagaggatcacttgagctcaggagttcgagaccagcctgggcaacatagtgagaacttgttaaagtgtgctttttacagaatcaaaaaacaattttatatagaatctttttatacagaatcaactccacaaagagggggccataattgtcatcgtattcccagtgcctagtctagagaagatgttgaatcattgaataaataagaggtattagcgaatgttttaattaagaattaaatatattttttaagaaaagaaagtcattcagaattattactaagagagtggtggaggttctttgttttgttcctcccccttgacatttgaatagagtaagcagtaattattgaaatacgtatttattgagttgtgagaattaagtgttttgggggaggctcctgaatgcctggagtttatacgagaatctaaccaagtgattagatggtttgttttctgctttatcattttaatataacaagtacctttataatttcaaatactcatagggaaaagagtgttgactttttgtttcagttaaccagtgatcatttgactttcctctctacctttgctttttgtgtctagctgtgttgtttaaaatttaacaaataattaatcatgtttaatatataatacctgcatttttaccagtttttttcatgaagtgaagcatgattgagatataaatactgtagatctatttaataccaatgatatattttagaaactaaatccggctacagtagatttaggttgttcctcattttttttcattatatattaatagttggattgtattgatctagaaatcttttaattatatgttaatttggaattttattgggttgggtccaagccattttttttgcaagagcagataaaatccaaagaatagctatgacctacggctcttggcgtggggcctggcacaagacaatgaatgaggccaatcagattctttgcctcagagacctgaacaaatcgtggaaggaatttgcttgttagcaaattgggaaattaagcagagtcatgaggtagagttagggctggaggagctgtgagaaaccatggagttaacgctggggagggtgcctggaaaagcctcataaccatttttccctattaatgaatataggtctataccatgatttttgaaggctgcacaatattctgtggtatgaaaagtaccacaatttatttgccccaatcccttgttgatgaatgtgtaggacctccccacaccaaagggtttttaatcacaacaatgacaccatcagagttcgatttttaaaagatagaaaagactatgtaacctagactaagcaaactaggtatatattgtagtgacttttactgacataggaaaaagaggagagaaaggaattggagtgggggaaatggccatggtagagtgcagagataatacattcagtttgggacaggtttaggatgccttcaggacacccaggaaaagataaccagggagatatgggcttgagatagagatttgggaatcagctgagagtagtggttattgacgtcatggaaattgtgatgcccagggagggcatgtttcgaagtgaaaagagaaggtcagagatagaactgttagaagacaaatattcaactaatgtgcagaaaatactgtggagggtagtcaaaggtgtaggatatagaattgaacaactctggctaacatctgaatcttcttgttctatgaaatgcctatttttttttctgattttttttccattttgctggttgatcatgtttttggtcttatatctcagattgggaattttaacaatgtgtttaataactatagaatatcaggatatgttaagagtgatcttatagatttttcataattttgaaataaaaatggaaaattctttaaactttttttaaataatgaggcagacaggttcagaaattatttggctattttgacattttatcatttgcaataaatactatgcataggtaccatgtgtctataataagccttttcttcttattaatagagtttatgccataccattagtttccttgtcactaaaagaatataagaatattattcaagaaagcctgaaaacgcaaggaaactagttttttgtctttattttgttaaaaagcattatttattgaattgttaatgtttagaatttagatttaagtaatgtctgtgatttattacaaattagtgttttaaaggatccttatgtgacatggtctaccaaaattacagaggtcgatgttttatgtgggcagtacttgtcaactctttgaaaagctgatgctggtaaggtgttgtcagctgatacagttaaaaaaacttaacagtcttttgtaaccctttagcagtaaagattgacaattttatgtaggtaggagcatttagtgagaattatgacaccctgtcatttttgcttaatttgggggcaaggaaattctagcatacttgttcatatattcaaacttatttcaagtaagtataagttctggtacccaccagatctacaattcctgatagttacactttctgtgctctggccatatgtatttgtagaggcagtgaggtgtgggttaggtaatgtttggtctcttagttccacctctaaggcatgctaatatggtagttgcttgccagcagcattggtctggaaatgggtgacttctagatacctggtaggttggaggaaaggtgttactacttcttactgtgctgtttgagtatctgccatagatatttatgtgcaaatcttgtgaaaccccctgctgtttctcagctgtaagttgtctttgtagtttataaaaacctgggatggctacttaacgaggtggatatcatgactttttcttttctgtttctcacagtgcttgggaagtgaagcctgactgagtggtagaggtaaattggggaacagttacgattatgtcaaaaccttgtgtggttcagtttcgttttcttctaataaaactagcgccatgaggcactttttttatacacacccagctgaaagaaatgtgctgacaaactttttttcagggaattttttgagtgttaattggagctgttactgatggttatttttatatgataaagtgtatttcagtgaatttaatgtaacttgttttagatttttagatttgaagcacagtttttggctcaggaccaaatatgcctggaaaactttcaaatctggaaagctataaaacacaaacatactttgaagtacggcatatgtgactgtttaaaatatactaggaatgtctttattggttagcaaatgaaagaacatagctatcatttttatattgttggcatagggtagcagcaattatgttgagtggtggtggacaggcctgagctgccttatataaattatcataaaaataagtttgcccaggtcactatggttaggacatttgaaaaatacgtatgttctgtacttaaatcttgatttattgaatataatcgtctagtgggttttttcataaagcctatgttgtatactgtttttttgttgtatgtttgtttttgttttttttgagacagggtctccctctgttgctcagcttgaagtgcagtggcatcatctcggctcactgtatcctcaacctcccgggctcaggtgatcctcctacctcagcctcccaagtagctgggattacagggatgctcactatacccggctaattttttttgtattttttgtagagacagggttttgccatgttgccctggctggtttcgaactcttgggctcaagcgatcctcctgcctcggcctcccaaattaagaggattacaggtgtaaaccactgcctgtaatctcatgattacatcatgtgtactcttgatagttactgtttttttcctgcttacatgtctttgatggctcattggcaactccattattagtgaaccaggcacatgaagaaatttcctaatttatttcctttaagtgttaattgatataacattttggggggaaaacataaaaataaatgattacagtgaagtttgaagattatcttcagattttattcattattgtaataaaatgattctgtaggctaatctgatggccatacagtgactgtataatgccttaagtaataaaaacactaaaaatctttagagcattgggaaatttttagagcagtttgatatacatctcatttgatgccgtgtgtggtaagaaatgaagtattatcccacatttaacagatgaagaagatgaggctgagtgaagtccattgatgtcctaaggtcagaacttactttttaaaaaatcaactttactaaggcataatttacataaaatgtacccatttaaagtaatttgaacagttttgacaaaggtatgcactcttgtagataccactacagttgagatatagaacataataaccccccaaaattcccttgtgcctttttgcagtcagcccgcagccccaccccacttcaggcatccattaatctcagttctgtcgttgtagattaatttttgcctgttctagaatttcatatagatgaaagcaaactgcacgaactctttttttactagattcttttgctcatatttttgagattcatctatgttgctatgtgtagtttattcctttttattgctgaatattccattctgtgaataccacaatttgcttattcatttacctgctgatggactttgatgctgtttccagttttgatgtgttagaaataacgcagctatgatttgtatttagacatgtattttcatttctctcttttttttttttttttttttttttttgagacagggtcttactctgtcatccaggctagagtacagtggcagtggcttgatcacgggctcaacctcctgggctcaggtgattctcccacctctgcctcccaagtagcgtgcactaccacacccagctaattttttgtagacatagggtttcactgtgttgcccagcctggtctggaactattggaatcaagcaattcgcctgcctcggcctcccaaagtactggattacaggcctgagccactgcacccgaccttattttcatttctcttggtgggccatatgtatgtttgactattaagctatcaagcaattttccaaagtggttgtactttctatttcaccaccagcaatgtctgagcgttccagttgctccacttctttgccaatacttttggtattgtcagtcttaattgtagacattctagtgtaaattagattctccttgtggttttattttgcatttccctgaggactaatagaatttaatgttttttgtatgcttactggtcattcatacatcttttatgaaatgtctgttcaaatctttttctcagtgtcttattggggtttttattttcttattactgtaggagttatttatactgaatacaagtcctttgacaaatacatgcattgcagatagtttctcctaatctgtggttcacattttcttttcttttcttcttttgagacaaggccttgctctgttgtccaggctggagtgcagtggcatgatcacggctcactgcagcctcgacttcctagcctctatcaatcctccctcttcagcctcctaagtagctgggactataggcgattgccaccatacctggctaattaaaaaaaaaatttttttttgtagaaacagggcctcactgtgttgcccagatagttttgaactcctgggctcaagtagtcctcctgccttggcctcccaaagtgccgggattacaggaatgaccaccatgcccagcctgcgtttcattttcttcgtggtgtctttcaaggaattttaaattttgatgaagaccagtttacaatttttttcttttttagttagtgcttttatgtcctaagaaatcttttcttgcctatattatggttgtaaagatttttttcccctatgttttcttctcgaagtttacagttttagctttttcatttagaactatgattcattttggatcagtttttttgtatagtgtggtcgaggttcattttaccctttttttttaacaagattatctagttgttccagtagtatttattgaagactgttgtctcctcattgactgacgtcgacacctgtgtctcttccattgatttagatgtctgttaggctgtgccacacagtcttgactaatgtagcttcataataagtcttgaaacttgttagtgtaagccatccggctttgttgttttttatcaaaattgttttcgttattctaggttctttgcatttccatataaattttagaatcaacttgtcaatttctattaaaaaaaaagcttgctaggatttagattggaattgtgttgaatctatagaccattttgggaagaattaatagtttaacaatttgtgtcttccagtgaaaacatggtttctcttctcatttaagtattctttaatttatttcagtagtgttttatagtttttagcatatgagattcatatgcactttgttgaatctttcatatttttgatttggaattgcatttcagatttaattcttaaattatttattgctaatatatagaaatacaattgaattttgaacattttttttatcctgtgaccttgctatatacatttattcctagtatgtttttgtggatttgtcagaactttcaacgtaaacaatcatgttgtctgtgaataaacacagttttacttcttcctttccactatgtatgtggtctgctccccgcttcttattgcactgccaaacactaacagttaatgttgagtaaaagtggtgagaccagacatttttgtcttattcctcatcttatcaggaatctgttgagttcccattgttaaatgtgatattatctgtaggatttttgaagatgttctttttcgggttaagggagtgcctttctgttccacgtttgctaagaaatatatgtatgtttatgtttttaaaatcatgaataactgctgtatttttcaaatgctttttctgcctctattaagataatcatatggctgttctcatttatcctgttaataggtgagttacgttgatttcaaatattaaactggtcttgaattcctggagttaaactcagttggtcacggtaaattatctcttttatatattgttaggtttaatttgttaatattttctcaagggtgtttacagccatgttcgtgagagatatttttcttctcatttctttgtcttgtgttagcatcagggtaatactgtttttatataatgagttgcaaagtgttccctactccactgttttctgaaagacttcacttaggatttctgtaatttcttccttaaatgtggggcagaattcactaggtatgccaccggggcttgatgttttctttttttttcttttgttttttttttttttgaggtggagtctcactctgtgcccaggctggagtgcagtggcctgatcttggctcactgcaacctctgcctcccaggttcaagcgattctcctatctcagcctccgaagtagctgggattacaggtgtccccccaccacacctgggtaatttttgtatttttagtagagacagggtttcgccatgtttgccaggccggtctcgaactcgtgacctcaagcagtccatctgccttggcctcccaaagtgctgggattataggcgtgagccatgtgcctggctgatattttcttttttttgagacagagtcttgctccgttgtccaggctggagtgcagtggcgtgatcttggctcactgcaacctctgcctcccaggttcaagtgattcttgtgcctcagcttcccaagtagctgagattaaaggcatgtgccactactcctggctaattttttgtatttttagtagagaaggggcttcatccatgttggtcaggctggtctcaaactcctgatctcaaatgatccacctgccttggcctcccaaagtgctgggattacaggcgtgagccacggcacccagccaattttggttattttatatcttttaagacatttgtccatttcatctaaatatgtcaatttattgtcattaagttggttataatactcccttattatctttttaatatctatagaacctgtggtgatatccctttttactttcctggtgttattaatatatatggaggtttatcaattctgttaatcttttctaaaaaccagctctttgtttcagttttttaaactaatttttgcttgttttctgtttcattgatttctgttctttattatttcttttctttttcttattttggctttttaaaaaaatctagcttcttaagatgtactcttaggtcattaattttaaagctttcttcttttctgatacaagcacttaaagccataaattgctttcttttttttttttttctttgagatggagtcttgctctgtcgcccaggctggagtgcagtggcgcaatctcagctcgctgcagcctccgcctcccgggttcaagcgtttctccatcctcagcctcctgagtagctggaattataggcgcccaccaccatgcccagctaatgtttgtatttttagtagagacgaggttttgccatgttggccaggctggtctggaactcgacctcaggtgatccaccaacctcagccttttaaagtgctgggattacaggcatgagccactgcacccagcctaagcaagattttcgatgtagatgaaatagccttcctttagaagaggatgccatataggacttgcatagctagagaggagaagtcagtgactggcttcagtgcttcaaaggacaggttgactgttttgttatgggctatgtgggctaatgtagctggtgactttagatcgaagccagtgctcatttaccattctgaaaatcctagggcacttaagaactatgctaaattgactatgcctgtgctctataagtagaaaaacaaagcctggatgacagcacatctatttatagcatggtttactggatattttaagcccttattgagacctgctcagaaaaaaaaaaaaaagattcctttcaaaatatcactgctcgttgacaatgcgcgtggtcacccaagagctgtgatggagagggacaagggcatgaatgttttcatgcctgctaacacagcttctgttctgtggcccatggatcagggagtaatattgaatttcaagtctttttatttaagaaataacattttctaagtatatatctgctatagatagtgattcctctgttggatctgggcaaagtaaatttaaaaccttctgaaaaggatttaccaatctagatgccattcatgattcgtgggaggagatcaaaatatcaacatgaacaggagttgggaagaagttgatttccaacttttagggatgactttaaggggttcagtacttcagtggcagaagtatctgcagatgtggtagaaataggaagagaactataattagaagtgaagcccggagataggactgaattgctgtaatctcattatcaaaattgtctggatgaggagttgcttcttacagatgagcaaagtggtttcttgtgatggatctattcctggtggggatgctgtgaacattgttgaaatgacaacaaacaatggatttacagtattatatatcaagttagttggtgaagcagcggcagagtttgataggactgactccacgtttgaaagaagttctactgtgggtaaaatgctatcaaatggcatcacatattatagagaaatttttggtgaaagaagagccaatcagcacgcaagttttgttgtctcaagaaattgccacagccatcccctccttcagcaatcaccactctgatcgaacaacatggaaccaagaccctccaccatcaaaaatactgtgtttcattgaaggcttgggtgattgttagcattttttagcaatacaatatttttaaattaagttaggtacattggttttttagacataatgatattgcactcaatagattacagtataagcataacttttatatgcctggggatattaaaaaattgtgtgacccggtttattatgctacttgctttattgcaatggaatggaatggaacctgcaatatatccaaggagtgcctgtagttggaatcataaagaatgtagccttttcacattgactttttatttaataatgtgcacttaaatttcctcccatgtatttttataacttgattgctcacatctttttagcactgagtaatattttgttgtctgaatgtgctacagttttaaaaattcatatatcaactgaagaatgtcttggttgcttccaagttttggcaattatgaataaagcttacataatcatctgtgtttaggtttttatgtggacataagttttcagctcctataggtatataccatggagtgtgattgctggatcatagagtaataatatgtttagttttgtaagaaatcaccaaactctcttccaaagtggctgtatcattttggattcccactagcagtgaatgaaagttcctgttgttccacaggaactttccagtccagtatttggtgttgtcagtgttgtggatttagacgttctaataggttttaatttgcatttccctgataatatatgacttagaacatcttttctttttttctttttttttttttttgagacggagtctcaccctgttgcccagactggaagtgcaatggcacaatctcggctcattgcaacctccgcctcctgggttcaagcaattctcctgcctcagctacccaagtagctgggattacaggtgcctgccaccatgcctggctgacttttgtatttttttttttttttagtagagacggagtttcactatgctggccaggctggtctcgaaatcctgacctcgggtgatccgcccacctcagcctcccaaagtgctggaaatacagtcatgagctactgtgcccggccagaacatcttttcatatgcttacttgccatctttatatcttctttggtgaggtgtttgttaaggttgttggcctgttttttaattgggttgttttctgagttttaagagttttttgtatattttggataacagtcctttatcagagatgtcttttgcaattgttttctcccagtctgtggcttatgtttttcattctcttgacacccttccgcagtgcaaaattttttattttaataaagtccagcttatcaattattttttcatggattgtgcatttggttttgtatctaagaagtcattgccaagcccaatattatctagtttttcttctgttatcttctagaagttttatagttttgttgtacatttaggtctgtgattcattttgagttaatttttatgaaggctgtaaagtctgtctagagtcttttttttttcatgtggatgtctggttgttctagcaccatttgttaaaaagactgtctttctccactgcattgccttatttgcttctttgtcagagatcagttgactttgttcgtgtgctctatattctgttccggtgatctatttgttcttttgccagtaccacattgtgttgattactgaatctctgtagtgagctttgaaggtgggtagcatcagttctctaactttattcttctccttcaatattatttgctattctaggtcttttgcctctccatgtaaactttagatcaattcatcaatatctacaaaataacttgctggaatttttactgggattgcattgaatctgtagatcaagttgggaaaaaccggtatcttgatgatactgagtctttttatccatgaacatggactctccatttatttagttctttgattttgttaatcagttttatagctttcctcacatagatcttatgcatttttttagatttatacttagtatttataatttgggggtgctaatgaaaatggtattttgtttttaatttcaaataccacttgttcattgttggtatataggaatgtgtttggcttttgtatgttaaccttgtatcctgcaaccttgctataatatggtggtaaggtgtgggggagaggagaagcattctatagtcctataattaggtctcaggcttttagtgagcctatgcctctggactgtggacttcataaatgtttctcaggtttttttctccttctttaggtgggtcaggaaggctagaggggacaggatttgaatgtttccctctcccaggtcagttaggctttgatagtaccttaacagattaagctctggtttaacctagtttcttctgagggcaggccttgttaagaagaatggagtgctctagtatatttagaaattctctctcccctcccactggaaccatgggggcagcggggctggggggaagggttggggacagtttctgatatttattgtgagaacctgttcaagccagagcctggttgagctcttgaaggtaaagctccctataacttgatcccttggagttttaactctcagacttgtttactctgaacctgcaacaattcatcagttacagtttagttttccttctccagcactggttcccttggctgtttctgtttgtgagtctttgctctggtaatctgtgacttccctttgcctgtctgtctctccatcctttgggctggtggtttgccttgtgttctcacctttctttcagatctacctagaattgttgatacttcattctgttcagctttgtgcttgttgttagaacagagtgactgctaaggtttttacatgcagaccagaaactaaagtcttctttcttttacatttttttgtagtgcacatttgctagtgacatctttagatcaataaacattgagaaaagttatctttattttacctccttttttttttgagacggagttttgctcttgttgcccaggctggagtgcaatggtgccatcttggctcactgtaacctccgcctctcaggttcaagtgattctccagcctcagcctcccaaatagctgggattacaggcacatgccaccatgcctggctaatttttgtatttttagtagggatggggtttcaccatgttggtcaggctggtctcgaatccctgacctcaggtgatccacctgcctcggcctcccaaagttctgggattacaggcgtgagccactgcatccggcctttacctccatttttgtaggttatttttgctgagtaagatgcattctgtgtcttatggcttgcattgtttctgagagaagtcagatgttattcttatcagatttcctctgtatgtaatgtgtaatttgattttcttcagctgcttttaagatttctttctttttttttcggaatttggttatggtgtgccttaatggatttttctttgtatttaccccgttggggatttttaaagctactcatatccttgagtttatagttttcatcaaaattggaaaaatttcagccattatttctctgaatattatcccccaccatgttttttagactccatttgtataactgcttgctattgtcccacacacaggtcaccgatgaggctctgaggctttgttcatttttttaaggccttttttctttttatgctttagttggatagcttgaaatatcactggaagttgagaacaggaaaatctgttatatttacagtcttattcctgtggtccctttcaaagatgtattctgttgcagttagcacctgtgattgttattcttttcctttaagaccctcttagagatttactttttgtgcgagctagttagatatgttaaaaattaaataaatagtaaggccaatatggtgaagccctgtctccactaaaaatacaaaaattagctggatgtggtggcacgcgcctgtaatctcagttactcaggaggctgaggcagaagaatcgcttgaacccaggaggcagaggttgcagtgagccaagaacacgccactgcactccaccctgagtgacaaagcaagaccctgtctccaaaaaaaaaaatacttacccaaaataatttttttatttaactatgccatatgacctgagttcttctttttaagaatatgaactttaatttccttagaactttaaacattcctaagaaaggtaggttaaattgggaaaattaggccacccataatagtaagattagtacttccatttaatatatttgaggtaatcctaaaaacattaatgagatagttttgttgaatgttcaatgtgtaagtcaagctgatgtatttacatttacaaaagtgtttatatttcataatctgaaataattgttgtcttaagtagtttaccggaatactactcagcaataaaaagaaatgaactattgatacatataacagcttgtatgaatatgcatagacatgctaagtttaaaaaagccaatcccagccgggcgcagtggctcaagcctgtaatcccagcactttgagagtttgagatcgggagtttgagaccagcctggccaacatggtgaaaccctgtctctactaaaaatataaaaattagctggttgtggtggaaggcacctgtaatcccagctactcgggaggctgaggcaggaaaattgcttgaacccgggaggaggaggttgcagtgagccgagatggcaccactgcgctccagcctggatgacaaagcaagagactccgtctcgggcagtaggggtgggggagaagacaatcccaaaaagttacatactgtataaatcccatttatataaacattcttgaaatgacaaaattatagaaatggagaacagattagtgattgccaggggttggagagaagtagatgtgactgggaaagggcaacatgaaggatcctgtgttgtagtgttttgtggcttaattatatccatatcagtatcctggttgtgatattgtactatggttttgcaaggtgttaccattgggggaaactgggtctatggtaaatgggatgtttctgtgttctttctcacagttgtgtttgaacttacaatgagctcaaaataaaaagtttaataaaaagatgtatgaggaatgaatttttaagatgaaaagaaaatgctaccatgtggagcagaaatggtttcagtgtcatttctcactggtagtgagaaagtatggagtgatcgagtacattatctctgtagtggacagaccccaacaatgatcagcagtttgactttataacatttctaaaactctctgagcttcagttttcctcatctatagtaagcaatgataatattgtctgccttataaataggtgtgaggattaaatacaatagtggctgtgaagtatctaatgtggtgcttgacctatagtaagaaagatcagtaaacgttagcaatcatcgttggtttttattgacctacttctatttctagggtgtttttttaatggatattagtatatatgttaatttaaataacatgtataactgagttactaggaaaaatgtttacttatatatgggaaaacaaaatagtaacaactaaaagaaatacaattatttttcactttagatcataaaatttcttaagagtggatttgattttggaagggttgctgcagagaaagctgccttgtttggatattactgatggtaggacagtattctgagcttaaaacacttgtatcctgttgctctgcatatttatggtataattaaagtggcttatatttgctttgaaaacccacttgaaggcattttattcttaaggcttttttttttattttcatcttttatttctttttggcttattgatccctcttcagtttctgtaactaattgtagcaactggactcacaaacgttgtttaattagcactacattaaggttgtagactttcttataaccacctgatgacgtgtgtattaaacaaacaaacattttgaagtgcattctttataaggtaaggcttgggaggaaagctgcccacaattaacctaggaattaaaaaggtaagcagaaacaacttattctgtggatgtagtaacagctcctttttactccagatattacccaaagcttacttgtaaacatagttttctgggacaagaatattgagatctgtaaattcatcttcagaccttagctgacttagctatgacatatataatgatgcatgtataagatgtgcttactgatttctgtggaaaaaatacaagctttgtttgcttctaaattatattttcttctattcttaattttgccaaaagtttaaaaactaagataagataaacattttgccatacagttgacccttgaacaacatgagtttgaactgagcagacccactttatacacagttttttcagtaagtacaatagaccctgcaaatcagcgggtttggcataaccaaatatgacataaccaaatattccagactcactttcttctttccctatctctgacctggaaccagctgttttctgtgaagccttgggtttatattaatggggaatgttatttagaaaccatgatctggggatagatgtatttattgctgctgttttagtgttactgctaggcccttaactcatgacaatgccaggagaaatatgtaatcatgagttcttactgatatctccataggattcttccatatttgaatcttaaaatgagcatctgccccagggccccttcccagaggtacgcattcccagcacaatgcagttcttggctagggtcaagttgtattgcctcctgtgcctgccttaatctggctctgctggctgagatccatgtctatctggattcaccagcagcactcaccatccatgctctaattagagtcccatctgcatttccacattgtagttttgtgcatttttcagtatggcaacctccagccatgttgatgagtctgcctgggcagtcctcattgcctcctggttataaagttgtgtgacttttgagtgattcatcctaaccctattcttgacataaaccatgttatttttacagcatgaaatgccttgtactattattgtcactccattttatagttgaggtattgaagcacagagaagttaaggaatttgccaaagatcacctagttagtaagtggcagagttgggattaaacctaggtactctgcttaaatggtctttgctaacctatgctgctagactataggatttatgtggggaagtattagaagacctgaaaagagtgattattttaagatcttgaagaattttaatattatttaaataatcctggacttgttgggtaggccctgggaagtcactgaaggcttttgactgtagagtgatgtgattggcaatgtcctgtagaaaggttaatcacttgtagctgtgagggactgtgaaagcaagattcctgatagtatgctgttcttgggcttctctctagagatctaatgagtcagcctctaaggtttgatgccagggaatttatgatctttttgatgatcatccatatttggaacgactgctctaaactgtttcctttgtttactatattggtttgactactagtatgccattcctgtatgtgtccatccagtacagccacatttaaatgcccttaatttgccatttgaagctacatatagtccagatgaagtcgatgagtctgctcaggagacatatctttcatctgtctgggccttgcgtttcaatagatatttgagctatactctttcttatatatattaagtttgcaataaagcttaatatcagcttgttttaacattatcttggaaacacttcttcattgggtagtgtgattattaccaaatgtaagtgacaagatgtaaaccagatactcatctacttgtatataaacagatgaaagagaactctcaactacttccttgtctctaatatttgcttcctaaaaatttgggcagaattaaatagcagttaaatcagtatcattgtgctgatagtcgcatgctagtcatcatacttttttgacttgctctgcctacttcattgacatatctaaccagggaggtccaaataaaataaaaatagcagttttgtgcgatcagttgtttaagcatatgtcatattgttaagattttgaaactcttcagagaggtattttgaatctcatgaaagtcacccctcttgccagggctgccacatgcatagttccacctgggtatagcagagtagcagtggcacctttggtcctgactatgtttaatacagattgggtataacagcagtacgtctggaacaacaatgccataatcctcttgtaggttactacttaactatttgctgttcaatagttaaacaaaattttttgtgttaaaaaaaatcaattgaccatagacatatgggcttatttatggactctgttccattgatctctgtttttataccagtaccgtattgtgttgattattgttgctttgtagaaagttttaaaatcaggaagtataagtcctcctactttgttccctttcacgattgctttggctgtggtgagtcccttgagctttaatatgaattttaggatcagtttgtcagtttctataaagaagctacctgggattctgatagagatcacattactttgtataccaatttaggaaagtattgccatcctaggagtatgtagtcttccatccatcaatatgggatgtctttctgtttatctttaatttctttcaacaatgttttgtagttttcagagcataagtttttttttgtctttttttttttttatactttaagttttagggtacatgtgcacattgtgaaggttagttacatatgtatacatgtgccatgctggtgcactgcacccactaactcatcatctagcattaggtatatctcccaatgctatccctcccctctccccccaccccacaacagtccccagagtgtgatattccccttcctgtgtccatgtgatctcattgttcaattcccacctatgagtgagaatatgcggtgtttggttttttgttcttgtgatagtttactgagaatgatgatttccaatttcttccatgtccctacaaaggacatgaactcatcatttttatggctgcatagtattccatggcgtgtatgtgccacattttcttaatccagtctatcattgttggacatttgggttggttccaagtctttgctattgtgaataatgccgcaataaacatacgtgtgcatgtgtctttatagcagaatgatttatagtcctttgggtatatacccagtaatgggatggctgggtcaaatggtatttccagttctagatccctgaggaatcgccacactgacttccacaatggttgaactagtttacagtcccaccaacagtgtaaaagtgttcctatttctccacatcctctccagcacctgttatttcctgactttttaatgattgccattctaactggtgtgagatggtatctcattgtggttttgatttgcatttctctgatggccagcgatggtgagcattttttcatgtgttttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgtgaaaattttctcccattttgtaggttgcctgttcactctgatggtagtttcttttgctgtgcagaagctctttagtttaattagatcccatttgtcaattttggcttttgttgccattgcttttggtgttttagacatgaagtccttgcccatgcctatgtcctgaatggtaatgcctaggttttcttctagggtttttatggttttaggtctaacgtttaagtctttaatccatcttgaattgatttttgtataaggtgtaaggaagggatccagtttcagctttctacatatggctagccagttttcccagcaccatttattaaatagggaatcctttccccattgcatgtttttgtcaggtttgtcaaagatcagatagttgtaggtatgcggcgttatttctgagggctctgtcctgttccattgatctatatctctgttttggtaccagtaccatgctgttttggttactgtagccttgtagtatagtttgaagtcaggtagtgtgatgcctccagctttgttcttttggcttaggattgacttggcaatgcgggctcttttttggttccatatgaactttagttttttccaattctgtgaagaaagtcattggtagcttgatggggatggcattgaatctataaattaccttgggcagtatggccattttcacgatattgattcttcccacccatgagcatggaatgttcttccatttgtttgtatcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttgctggtgtataagaatgcttgtgatttttgtacattgattttgtatcctgagactttgctgaagttgcttatcagcttaaggagattttgggctgagacgatggggttttctagatatacaatcatgtcgtctgcaaacagggacaatttgacttcctcttttcctaattgaataccttttatttccttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgagatacatcccatcaatacctaatttattgagagtttttagcatgaagcgttgttgaattttgtcaaaggccttttctgcatctattgagataatcatgtggtttttgtctttggctctgtttatatgctggattacatttattgatttgcgtatattgaaccagccttgcatcccagggatgaagctgacttgatcgtggtggataagctttttgatgtggtgctggattcagtttgccagtgttttattgagggttttcacattgatgttcatcagggatattggcctgaaattttctttttttgttgtgtctttgccagattttggtatcaggatgatgctggcctcataaaaagagttatggagaagtccctctttttctgttgtttggaataatttcagaaggaatggtaccagctcctctttgtacccctggtagaatttggctgtgaatccgtctagtcctggggttttttttttggttggtagacttttaattactgcctcaatttcagaacttgttattggtctgttcagggattcgacttcttcctggtttagtcttgggagggagtatgtgtccaggaatttatccatttcttctagattttctagtttattcgcatagaggtgtttatagtattctctgatggcagtttgtatttctgtggtatcagtggtgatatcctctttatcattttttattgtatctatttgattcttctctctttccttctttattagtctggctagcagtctatctattttgttaatcttttcagaaaaccagctcctggattcattgatttttttgaaggctttttcatgtctctttctccttcagttctgctctgatcgtagttatttcttgtcttctgctaagttttgaatttgtttgttcttgcttctctagttcttttaaatgtgatgttagggtgtcgattttggatctttcctgctttctcttgtgggtatttagcactataaatttcactctaaacactgctttagctgtgttccagagattctagtacatgtgtctttgttctcattggtttcaaagaacttatttctgccttaattttgttatttacccagtagtcattcaggagcaggttgttcagtttccatgtagtttagcggttttgagtgagtttcttaaccttgagtcctaatttgattgcactgtggtctgagagactgtttgttatgatttccattcttttgcatttgctgaggagtgttttacttccaattatgtaatcaattttagaataagtgcaatgtggttctgagaagaatgtgtattctgttgatttgggatggcgaattctgtagatgtctattaggtctgcttggtccagagctgagttcaagtcctgaatatccttgttgattttctatctcgttgatctaatagtgacagtggggtgttcaagtctcccactattattgtgtgggagtctaagtctctttgtaggcctctaagaacttgctttatgaatctgggtgctcctgtattgggtgcatatatatttaggatagttagttcttcttgttgcattgatccctttaccattatggaatgcccttctttgtctttttttatctttgttggtttgacatctgttttatcagagactaggattgcaacccttgctttttttttgctttccatttgcttggtaaatcttcctccatccctttatttttagcctatgtgtgtctttgcacatgtgatgggtcttctgaatagagcacaccagtgggtcttgactctatccaatttgtcaatctttgtcttttaactggggcatttagcccatttacatttaaggttaatattgttatgtgtgaattttatcctgtcattatgatgctagctggttattttgcctgttagttgatgcagtttcttcatagtgtcgatggtctttacaatttggtatgtttttgcagtggctggtactggtttttcctatccacatttagtgcttccttcaggagctcttgtaaggcaggcctggtggtgacaaaaatctctcagtatttggttgtctgtaaaggattttatttctccttcgcttatgaagcttagtttgactggatatgaaattctgggatgaaaattcttttctttaagaaggttgaggcctgacgcagtggctcacacctgtaattgcagcactttgggaggccaagacgggcggatcacagggtcgagagattgagaccatcctggccaacattgtgaaaccccttctctactaaaaatacaaaaattagctgggcatggtggtgtgtgcctatagtcccagctacttgggaggctgaggcaggagaatctcttgaacccaggaggtggaggttgcggtgagctgagatcgcgccactgcactccagcctggagacagagcaagactccatctcaaagaaaaaaaaaaaaatagaatgttgaatattggcccccactctcttctggcttgtagggtttccacgtagagatccgctgttaatctgatgggcttccctttgtgggtaacctgaccttttgggtgaatctgatgattatgtgtcttggggttgcacttctcgaggagtatctttgtggtggtctctgtatttcgtgaatttgaatattggcctgtcttcctaggttaggaagttctcctggaaaatatcctgaagagtgttttccaacttggttccattctccccatcactttcaggtgtaccgatcaaacgtaggtttggtcttttcacatagtcccatatttcttggaggctttgtttgttccttttcgttgttttttctctaatcttgccttcatgctttattttattaagttgattttcaatctctgatatcctttctaaattatctgaaggttattaaagcttacaccatctaaattatatttagatgagttacctataagctaaaagctagagtcagatggcagtatctaagatgaactcttaagtgtaggtggtatccttgttttctttttcataatctctttaactcgtcttagtaccttatttatttatttgttctgggaaccacatttgagctttgagaggcaggaggacagtgcttgatgtgttggcagctagtaacccctagtttaactgagttgaggacagtagtaatactatggtggcaatagcaagatttttatctctgcagccttatagtacaactgtcttggtttaaaactggattttattttaactaaattctgttttaaaccaagatagttctatataagaatgtctttggattggaagccttggttttagtttattcttgaattgtcaatatcagaagtttagaaatagtaattcaatggcaaagtattattacataataacaaaagatttattgtgaaatactggggccaacatggaggaatggcaagtatacgagctttgaccatagacagaccaggattttgaatcctagttctaactcttactaactctgtgaccaaatgtagatactcatcctgagatttcctcattgataaaatgacatatcatctcagcggagttgcaagtggtgttttacttttatctccatgtaaattaaagataaatgaaacttatgaaaaagtgtttatatagataaatgatatgtaaaatattttctaagttggaataactttgaaaaactatagagtttaatatgaatatgcagtatgtaccattttagcagaataactagtacctcatgtttgtgattgattaaagtatttatttcctcttaaatacctgtgggcgtacttgggcatagtaggcagtctagccactttattagtccaaaaactaagttcattttaggatttttttttaagttctatgtctaaatctgatacaagaatagtaaaagccatgcagtagtagatcttttatcttaatttatgaggctaaaaatttcttataacactgaaaccctttcctttctttaataggtttaaccttcatttctaatacataaatgtaatttatttttgcttagactccactggttggagatgataaaaatataacccttgtaacacagatatagaacctaatggtggcctttggatgatacttcagctctcacccagtaaagtccctgggattccacattccccaaatccttttcttttcattgaaatgccaagtagccctcctgctttttcttccataaccagccttcctgctgctgctcttagatgtcatgctatgctctgccacctggtggttgcaatgtacactgctgtttctgttgctgccgcagttgcctcctacaaggtgcagaggttgggatttaagtctgcaggtgtgatgttcagtgttgtgggctctggaggcagatttctaagtttgaatccctacatcactgcctccttgctgtgtaaccttggacaggttatacagttttcttatctgtaaaataggtagagtaatagtgcttaccctcacagggttgtttcattaaattaatacaaatgctgagaacattacatactgaaaacagtacatgacagaaaacagtaaaatgccaaaaacagtatgtgacacttaacagtgttagttattgttattattctgatctgaatgctttaggtaagcaattaaacgtgtatattttatttggagctatcatagctccaaactgattgattttagccttgagtttattttttaatgttgatcttttctaaatccattgtgtatatactttctgttatacataatttttaattatcactatcatattgtaaagttaagaagtaaaaaaaaaaaatcacactaaaatgtaagagttcttaaagtgagtgaatatcatatggaaataaccacagcacagtagtggaatttttagaaatttgttttttaatttgggaagttaatcagtgaaatgagctttgttctgaaaatgtatcccaattttcgaagtaaactatagattttatttgtgtttttacatactataacaaggtaatttctaagttttacttttattcattcattttccctttctgttgtgtgtgcgtgtgtgtctgtggtattcaaacattattatggtatgatgttctgtttttctttttttttttctttgagacagagtcttgctctgttgcccaggctggagtgcagtggtgcgacctcggctcactgcaacctccacctcccgggttcatgccattctcctgcctcagcctcctgagtagctgagactacaggtgtccgccaccacgcctggctaattttttgtatttttagtagagacagggtttcaccgtgttagccaggatggtctcgatctcctgaccttgtgatctgcccacctcggcctcccaaagtgctgggattacaagcgtgagccaccgcgcctggccagatgttctgtttttcttgtttcttgtctgtttccttcctttttcatatttttatgtatatatataaaacagtattatagtgtggtattctgttttttccactcaattttatattgtacacatttcccttatttttaaatagtttaatatatcataaattactcattttggttggatattgttttctttctgttgtataatattataatggttattttttatttatacagcgtttttatcctctctcatgtgtttatagaacaaactgccaagaggagtcttaagagtacatgaatgattttgtggctcttgaaatattttcccacattttaatccaaaaatgccatgctttttaatgctgttaaacaggaatttactttcacccataaaacattgtctaggaacaaaagtgaaaaagacaggatccctgctctccagggatggagtataacggagaggatacatacagatgaatgactaagagaaaggctgcaatattctgagtgtgaaggaagaactgggatagttggacagtagcagtgtggaaaatacttcttagaggagattgaatatgaaaatgcggttttaatttgaaataattattgatcctactttttctttcttgcatattatgtttgtcatttctgaaacatatttttttgctttgcaacaaaatgacttaactcctgccaactgcatgatatggtagaaagagcacacaggtttggacaaattgcataattgtctaaacttcagtttctgcacatataaaacataaatgatacttcctttagagacttttgaggattatagaaagtgttttttatctattgtctccaggcttatttcaaaaaatatttgaaatgaaagagttaatatactaataaagtatttagcacagtatatggcacataagttagacttagtaagtaggagccactgttggttttatgattgccagtgttaagcattctgcttcttacaaagcgtcagctttcctataaatactgctcagttttctagaagctggaactgccacctcctaaacgatcagaattcacttcctcaacctccagagtaacccagctcttgagtctttatagtaaccaaaaggctagcttctttctttcctttcctttctttagcccctgctagttgccagataccacgttagatgtagggaataggaagataactgagataatatcctacaactgtctatctagagaaatagagtcatatgcaggtgactgtgcacatgtcagagaaatcagtggttctcaaccctggctgctcattagcatcacctggggaagctgtttaaaaataccagtgctgatgccgtactttagataatttagaaattaatgcaaacagaaacaatattctgtaggaacctgtactcattgataggttgagtgagtcattttgattggaaagagaactggaaaaatcttcacaatcagagtaacattcaaaccaacgacaaaacttagtctgtattgttaggaggacaacaagccagggcacaaaagcttgaaaactggtagcagattggagaaggaaatggtagattctaaggctagactaacaaagcagctaataagaaagaaagaaagaaactttacctcttttaaggagtttagacttcgttatgtagaaaatgaggtagactttatgagagaatgatatgatgcaatctccgatttggaaaaaacagccgctagtttataacattgtcaaaagtaaattccagatggaattaaagttatggaaaaaatagagaataatatttctatattttggggttggagaagacctttataaacatgttatcaactccaaagccataaaggaaaacactgagattaacagattttaccaagtaaatatttaaaactctgcaacaaaaggtaccctaaagttgaaagtctggagaaaaactaggggaaagtatttgctacctcaatgacagaaggttaaaaagtacttaatatataatgagctcttacaaatcagttaagaataggcaaaagatttgagcaggtagctttccaaagaagaaatgcaaatggttgctaaagcacataaaaggatgctcatcttcagtgataatcaggattgtaaagtcaaacaagagtggggtcttctaaactttcatgttgatacagatttttaaaagtgaataatatctaatgttgtcaaaaatgtggagaaacaggcaggctgataacgttggtgggagataagttggtgtaacctttctagagagtagattaatggttatctatcaaaacttaaattgtggttgcccttggacccagtggccacaactaagaattatccctggagaaatacaatgttgtaacattgttggtaatgccaagcagtgtaaatgtgtacatatttcataggcattaaacttttttgtaggaatatataccagactgaagaaactggtggagggaggggcacttcatatactactgtaatgttttttttagaacttccatataattgtgtgtgtgtgtgtgtgtgtgtatctatctatctatctatctatctatctatctatctatctatctatctatgccaaatctatctatctgtgccaaaggctagaagtcctgttctggatgaattagatgaggaagaagttggaggcaggaaaaccagttaaagaattttttaccttgttcaagtgtgagaaatgtttgggtctgaattggaactgtgacaatcagaatgaggaagagggaagatttgaaagatagagaatctataaacttgtactatgtgggtgagaagaatgaggaaagactgtcaaagatggttctgaagtcggtaagttatattgctgagtaaatgaccatgacattataaaaaataggaaaaacaagaaaagaagcatctttggagtagaagataatgagtatcttaaatatagatcctcaataagtatttgaacaataaattagtttgggtcagttagctcatctttagcatgtacaatttatgctttcttattaaggctggtcttctgtagttattctgctgcttgttaggagatgtcattaacatttcaaaatatgtaaaaagcaatttctaaatataatttttaaactatttgttcttgttttatattttcagagtgcacatttggccatgatcgataccctcatgatggcttatactgtagaaatggtcagtatagaaaaagtaattgcgtgtgctcagcagtattcagctttttttcaagccacagatctgccctatgatattgaggacgctgtcatgtactggataaataaggtaggattatactcacttgagtaaatcgcatctcatagccagaaaacgtgaaattctaaattatacattgccacttcattactctttttgtttcaaatcaaagtgcaaacttaagttgtaaaatacacttaaattttttagtaaaaaagcttaaaatgatgaaaatagttttctgtatacttagcaatatttatgattactctttttttttttttttttttgagaagtagtctcgctctgtcacccaggctggagtgaagtggcatgatctcggctcactgcaacctccgcccttcaggttctagcaattctcatgcctcggcctcccaagtagctgggattacaggcgtttgccaccacacccggctaatttttgtgtttttagtggagacgagttttcgccatgttggccaggctggtctggaactcctggcctcacggtgatctacccaccttggcctcccaaagtgctgcaattacaggcgtgagccaccacgcctggccaatatttataattactcttaatgattaatctggttcataccagattatgaaaaaattcagaacactcctaatagtgaactatacacagtgggtgttcagtaaatattttttgaattcatttcaagaatgaaataattttcttacatttccagttaggggattcttaggtttgcttgaccaagttgcacaagatcctattgattgtggattcctcttcttggaaatttttatggagctgtgatttgtgctttgaagatgcttaatttgtcagcttatcactccctttgccaatttgagtagttaatttgtcttgatccactttcatttacaactgccagccaaaagaaaattaaaccttatctgaagacaagcactaaacggatttaaaagaagttatatctccaggtatcctttcttgaaagctggcatgaagctcgtaataaaaagctaaatgtaaaaaacactattacagctatcttcattatccataatatcagtatcattgtagaaggactgcttaatactttgcctctggagttcctttatttcttcatctttagtaatctttccctgactcctcctcagctgtagaaaatcacagttacattctagacctattcatcttgagaaactatgcaaccttcacatcccattacagacttcccattcttgaacagtttctcctatcttcctaacccacttgctttaaataataatttttaaaatgttgaacctcattatgacttataaactattgagcctattaatttctcacaatcttattggacttcatatttgtccatcttgaacttagatttttataagtactctcagttcttatgtctccccttccctccctgttactcatttggtaacagctcagatggtttagcttagttacccattttatttctaacctgcatttgcagaggcaaatattgctggagaaatttacacaaggaagttggtttcactttaagttcataagcacaaacttccactgccagtccaacaaatgtgtccctaagtttgctttcccacgcttcatgacaactgtgttacccattttcctctaattctcggaccttctgtaaccctttccctactactgtcagctaaatttgccttatcttttcttgagaccagagatgggaaggctttaggtgggaattatcttccctttatactagcaaatctgtaaacagttttggatcgcactcattgcctttcttttgtcctactgttacaatgaagaatttcccccttcacatcaaacgtgagttttctactacttgctctagaactttcttcccttttttgtggtcattggtcctgtacttcagttcttactttttaatgtacataagaattacctggtgtattagtccattttcttcttgtaacagaatacctgagccgggctcagtggctcacgcctgtaatcccagcactttgggaggccaaggcaggtgggaggtcaggagttcaagaccagcctggccaacatggcgaaactccgtctctactaaaaatacaaacattagctgagcatggtggcagatgccagtaatcccagctactcaggaggctgaggcaggagaatcacttgaacctgggaggcggaggttgcagtgagccgagatcgcgccagtgcactccggcctgggtgacagagcgagatcctctcaaaataataataatgataataataataacagaatacctgaaactgggtgatttataatgaaaaggaatttatttcttatagctatggaggctaagagatcccaggtgaagaggccactggtgagagcttcctgctaagtggggactctgcagagtcctgaggcagcacagggcatcatcacatgtctgagcatgttagctcaggtctgtcttccccgtcttacaaagctgctagtgatagcccgttgatccattgatctgtgaattgggtctgctctcataacccagtcacctcttaaaggtcccacctttcagtactgccacagtggagattaagtttcaacatgaatttcagaggggggcaaatattcaaaccatagaacctgggaacgtgttaaaatggctgatctgaatgaggaggtgtctagggtgaagcaggagagtctgcatttctaacaagctccaggtgatactaatgctgctggtttgggaccacactgttatttgttcactcccacattgtctgactcttccggtctattggatcattcttataagaatacagatttgggccgggcgtggtggctcacacctgtaatcccagcactttgggaggcccaggcaggcggatcacctgaggttgagagttcaagactagcctggccaacatggtgaaaccccgttctgaaaatatagtaattagctgggtatggtggcgggtgcctgtaatcccagctacttgggaggctgaggcaggagaattgcttgaacctgggaggcggaggttgctgtgtgccgagatggcgccacggcactccagcctgggtgacagagcgagactccatctcaaaaaaaaaaaaaaaagaatacagacttggagactgggggcggtgactcacgtctgtaatcccactactttgggaggctgaggctgatggatcatttcaggtcaggagtcggagaccagcctgaccaacatggcgaaaccctgtctctactaaaaatacagaaattagctgggcgtggtggcacgcgcctgtagtcccagctacttgggaggctgagacaggagaaccacttgaacctggtaggtggaggttgcagcgactcgagattgcaccactgcacaccagcctgggcaacaaagcaaaactccatctcaaaaaaaaaccaaaaaacagacttgctctagtgtcttccatcctaagaaacaaaacttccccatccaaatacaaccctatttctccatacaacagactctctcaagagttgtttgctatttcgttagcctgctcttctctctctctcccatacccattcctaacccgaaattgttcctgagttggtcaaaaaggcaaatccaatcaatatttttctgtccttaatttaaactcaatctttacttctaaagcatgaaccatctttttgaagtttcagtggaaaacccaaggtgtttaccaagccctcctctacttggtgggatttgaacaacaaactctgtctcccctgtggtggcagtttctttggcttctcagcagttttttctccctgcacttcttagaatctttcctacacatgcacagtccagggctcagccaagagttgagggaagtttatatgcagattttgggcctcccccattacccttcctagaatattcctcctcagtatccagctactctagcagtgccagatttcccttgattcctcctgccaaccagactacagttttctccttgagttctagtcacagtgcactgttgaattgagggtaaggccatataaacatggatttcactcagtgtgtttctttctttccaaagttgaattctttcttgcttctacttgctcttggttgctcaccagtacctccaacagatgctttatatattttgtccagagtttataattgctctctgcggggattagtgtgatgcatgctattccactattaccagaaccagaattctacaagtatctttttatagtgcagcttggatcatgccattcttttgctcaaaactcttcagtgacttcactttacccttaaaataaaatgtaaaatttatcgtggcctgcaaggtaccacctaacctgaccctgtgtactccattgtaggctcatggccactgttcccctttctcacttctttgacttccttcccgctatatgccctttctcacctctgaaccgttgaacctcatgtttcctattcctgggcagctcagctcccagctttctgcatggcttagtgcttctgctctccgtcagcttggatagcactttttcctgacaaccttatctaaatgaagtgcctctatcaaccccttgttttctataccctaacactctactttttttctttcatagcacttttcagactaattacttttcttaatcatttaattttttaaaatctgtcttcctcactagaatagtctatgtgaggataggtacaatgaactttttatttctagtgcctacgatgaccttcttcttttcagttttagtatctagaccagcacagtgtttgacaaagagattatatttaataaacactaaactaataaagagaaggatagtttaagccattgaattaagctaggcactttagaactttggaaatctacacaaaattaaggaaatcacttaactaggaatgttcagcacctttatgcagtcatatccacctcattccattttcaaattaggtttaaaacaatttgattcaacctgaactgcagtgtattttttttccttgatccattctaccagccccagcattattttttattctcgcattatgactttacccttgcctctcagatttagtatatgttttctccttctggctcttgttttggctcgtcctaacccagttgccttttttcctggataatgcatccacaagtataaaaaaacctaccaaagaaaaatggcaataacatggctaaaataattatcagcatagtggctaaaatgagtttaaacttaaaaaagcaaaatcacagaagacaagattatattgaatgattgaatcatgcagaggtacacaaaaatcatgaatatattaaccttatattatttggctctacctctgtttcctatctcattttgtgacttctttgggttcactatgtcattctgttacttaaacacgcaagtatttttcctaccacagggcttttgcttatgtttttcattctctctctggaatgctctttcctctacttttcccatagccagcttgttctctttaagatctcagcttaaagttacttcttaaagaaattgtcttagtctgtttgggttgttataacaaaatgccttagcctaggtaatttataaacagcagaaattcattgctcatagttctgaaagctgggaattcccagatcaaggtgccagcagattcagtttttggtcaggacttgctctctgcttcagaatggcagcttcttgttgtgtcctcacgtggccgaaagggccactgtgctccttcaaccccctttataaaggaaccaaccccatatgcaagggcagagcctcatgacttaatcatgccccgaaaggctacacctcttaatattaacacattggggattaagtttcaaatatgaactctggggggcaaacatttagaccaaagcgaaggccttgtctgatataaccatcttttctaaaatagatcttcctgctcccattattttctactcacattttaatgtatttatagcatttacaaatggtttttgttgttgttctatctcccctgcttcatgaggacaggaatcactttggctttgtagtccattgtatacctagcctcttaatacagtatctggcacataactggcattcagtagatatctgttgaatgtgcacatacatgagtgaatggtggtttaaaatgttaatttgtgaccactttgctttttggacagaatcagataaaaacctctttaaaaatgaaggtatttcctcagtggggaaaaaaataaaaacaaggatatttccaaactggcagatcaattacgactacctgacaatgaattagaaagtgtttgttttttaacttaaagggaatgaggctgggtctggtggctcatgtctgtaatcccaacactttcggaggctgaggcaggtggattgcttgagtccaggagtttaagaccaatctgggaaacaaggtgaaacttgtctctaccaaaaacaaaacaaaaaacaaaaattagctaggcatggtggtacacgcctgtggtcccagctattcgagaggccgagacaggaggattgcttgagcccaggagacaaaggttgtagtaagtcgagatcacgccactgcactccagcctggctgacagagtgagactgtgtttccaaaaaaaaaaaaaaaaaggtggcggggggaggggtgggcgggtggggaatgaaaatactacaaaacaaacaaatagaaaacattataaactttcccaggatttggtcctgtcttcttcccctccccgaattggtaaagagaccaaaatgcttaaagatacatgggtgttataaaactgctttgtaacacaatgtattaccatgatagaaaatatggggctgggcatggtggctcatgcctttaatcccagcactttgggaggccgaggtgggtggatcacctgaggtcaggagtttgagaccagcctggtcaacattgtgaaaccccatctctactagaaatatttaaaaaattagccgggcatgatggcgggcgcctgtaatcccagttactcaggaggttgaggcaggagaattgcttgaacccaggagacggaggctgcagtgagctgacacagtgccactgcactccagcctgggcgacagtgtgagattgcatcccaaaaaaaaaaaaaaaaaaaaaaaaacaagaagaagatatgaatgattttgtcaacatgtcacactaaaactacaactcttcctgttaggaacacctaaaaatgcttgataaatataattagaaaagtttatactgcagagttgagtttaaaggaagaaaagggaattcttaggtgccagaaacaaagtggggactgaaagttttggtggctaatggcattaatattttctacagtgccatgattaataaatttgaacttttattgattgttactagagtgaccttaaaatcattaactcaaaaccaaaaattatctaaagtcttctcaagaaataatttatgcaccatgtagacttttttttttttaaactgtttttggattatggactgcttgaataatctgatgagaaagaaattaagctctctcctcaaaaagttttcatatgcagaaattttgcatgtgttttaactgtggcattatgactgccctaaactcccccatgatcatggatatgtctgaaatcataccttaagaacttgattcacagtgttatttattgataacaacaacattaattttagggaaaataactttcatttactagttctaaaatagattgtaaaatttttacttgatattagtttgcttcctaagcattaaaactgacattaccaagtaccttttttcccttagcgctccaaccagttcctgacatacagtgtctgctcaacaactatttgataaattaatgaattctagaatatcaaataagtacccataaactatttttttctgattgtgaagctgaaattttctttatttgagtgagactgatatttgacatcagggctctgactataggcatcttaatgtgtgttattttattgttatatttgaatgtaaattcaaaaaaagaataaaaattcaaactgatatttttatattttaaggtaaatgaacatttgaaagacataatggaacaagaacaaaaactgaaagaacatcacacagttgaagctccaggaggtcaaaaggtatttatttcaaaaacaaaaaggtgcctttatgagactgtatatatgttcacatatttgtattattttgggaaatgttaattgtgtttattaaattattttttagtggtgttaactgtaccctagaaagccatactgtaaacactaagtaaatagaagtacaaaatgaaggttaattggatgatggtgtttgtaaaaaaatatattaatgactagaactcaagttctgaggttcttttgtcaaaaataacagtttgcctttctttggtaaaatgtgtaaaacaacaaggaaacaattttaaatgttcaggctttataatgacatgcaatgcagcaagaccaacatttaaaacaaaattcccagaatttcactgggtgcgatggctcacgcctgtaataccagcactttgggaggccaaggcaggcagatcatgaggttaggagttcaagaccagcctgacaaacatgatgaagccccatctctgctaaaaatacaaaaattagctgggcatagtggcgtgtacctgtaatcccagccactcaggaggcaggagaatcgcttaaactcaggaggcagaggttgcagtgagccgagatcatgccactgcactccagcctgggggacagagcgagactccatctcaaacaaaaaaaatatatatatagggccaggcgtggtggctcacacctgtaatcccagcactttgggaggctgagacgggcggatcacctgaggtcaggagtttgagaccagcctgcccaacatagtaaaaccccgtctctactaaaactacaaaaaattagccaggcgtggtggccggtgcttgtagtcccagctactcgggagacagaggcaggagaatcgcttgaacccaggaggcggaggttgcagtgagccaagatcatgccactgcactccagcctgggcaataagagcaaaacttcatctcaaaaaaaaaaaatatatatatatatatatatgtatatatatacacacacatatatatgcacacacatacacatgtgtatatgtgtgtatatgtacatgcacacatatatgtgtatatatacacacgcacatatatgtgtgtacacacacacgcgtgtatatatgtgtgtacacacacacgcgtgtatatatgtgtgtacacacacacgcgtgtatatatgtgtgtacacacacacgcgtgtgtatgtgtgtacacacacacgcgtgtgtatgtgtgtacacacacacgcgtgtgtatgtgtgtacacacacacgcgtgtgtatgtgtgtacacacacacgcgtgtgtatgtgtgtacacacacacgcgtgtgtatgtgtatatatctacacatatatacatatatgtgtacccacatacacacgtatatatgtgtatacccacatacacacgtgtatgtgtatacacacacgtatatatgtgtatacacacacacgtatatatgtatacacacacgtgtgtgtatatacacgtatatatgtgtatatatacacatacacacatacacacacgtgtgtgtatatacacacacacacatgtgtgtgtgtatacacacatacacacatatgtgtgtgtatatacacacatacacacatatgtgtgtgtatatacacacatatatatatattttcccagaattccaaaatgtacagtatggttgttctgtgaagaaagaagaaacattaacatggatttattcttttaaaaatctcaaacagacttttagaattttcttctctgaaaatttagttgtgtgtttgtcatatgctaagaccaaaagcatattttctatgatatagtatatcttacgtcttttaaaatgtattgtaattggaaccctttaaacatgttgtatagtattagaattgaggtataagaaattgtaatcattcagaaactttaatctccatttggtttaaagtttcttcattattacacagtacttctattattttgagcttattcttattccactattcactgatctctccataaaaagagaaagaagggaaaaaggaaggaaaagcgaagctgttctgtctcttatcaacttcaatagaaaaatcttgtggaggaccacgtacaattttgtctgattttgatgttttgggatcacaatgctttcccccatttggttaactgactggctcctgaaaatacgatttgtgcttaatccttcattctaactctgttgaggtcctttaccctaaaggtagattggaatggaattctcctttttccccatcaccccagattatgtttcatttccctgcttccagccaatttctgtccttgcctcttccctgttacgtcccacagtcttttcttgtcagcttccttccctttctctttttcataatcataggagctgaaacttttgccttggagatatgtgtaatcctgcccctcaattttgctcctggctttttatcagtaataaggttgaagtggcatcattctaaattataacactaatgaaatttctctatagaaatcttgtgtattatatataatggttaaattctgtagtattgcatacacattatgaaccaaatggggattttatatgatgacagagggcccaagaaacatttttttaatgaaaaaaatgccatttgtatttcaaacaatcaaataaagtgatcttgaagaaaaactgtatggaatctagacattgttgtattacatggcttttactttttcacagcacttagctccatgcagttgcacgtattaactgtacaactagtatttggtgaatgggtgactgagtgaataaagaaatgattgtgcaattcatttttaaatatttgattagtatacacttgtagtttagcacatacatagcatttaccccttcattttcaaatgaattttatccttttccccccattgtttttgaaaattgaatctttgtgaaaataagggttaatttaacataatcttactgtaggttcaggtgttgtcattatgaagaaacacacaatcacagaataaactagggaaaggaatcttggtctgttacctaacaatgggatttttggcatttgaactgtgtacttggtttgactggaaatattatcattccattcttggtttttaattctgtaaaagcaaaattcatgctccttttcttcttttacaaatgagagagaaaatgacttgctctttttattgctatacagttggtaagaagttgccactctttccatctacttcagtcagcttttctagtgaggcgtactcaggagcctagccctgttgcctattgcttgtccagctatagacagagcccgtggtattgaataataacatatcttaccttttgtccttgcccaactactcttaactcagatgtccagtagaatttgttttatgaaatatctttttataaccatattcttggtaaaatatatgcacatgttgaaggatacttgtactatatattattagggttggactgaaatgaaagatttcaaaggtatttgtttagggtattagatcctccagtgatgtatttctgatcattggattgggtggtgtcctaagagaaaggcattttaaatagtgtcatgtcctaggaaaatgttttgtttaaacagtttactaatgttattttctcttttttttccaagttgctcattttgcttctaatacttcttttgattgtaaattagggtgcctaattaaatttgaatgccagagaaacaacaaataatttttttataagttgcacaggtgtcttgtattgtgtgagcatcttgtatttatttgctaaatctggaagccgtacttgaacgatttctgaagtttatagccaagatgacattaagtccaacattcattctcttgaagagtttgtataaagtactatggtaaaatgagtattgcacataaagtcaggctagttctgccactaaatagcttcatgacctttacaaaggcacttgacctctctgggccttgggtttgtttttttttaatctgtaaaaattagaaggttggattaaatggtttctaaattctgtaattaaaaagatgctcagtttttcccttctcgatatgttagtaaacatgagacaaaaacaaaaggttggcaaaaatagtaaatagttatcatagacttttctatatgtatattactagtagatttatgctaactgtatgcatgaaatatctaggagtaccttctagaggatgtgggactttaacagggccttagtagatttcatgatactaggtcataaggaacaatataagtagtgacactaagtcacaagtgaagtcacatgtgggaattactgagtggatgaatttggcagaatcagttttgaaagagctatgaattcatgagtttgtattctaatactaactatatagagaatgaagtttaatgtttctcaaaaaattttttttttttttttgagacggagttttgctccgtcacccaggctggagggcagaggcatgatctcggctcattgcaactttggcctcctgggttcaagcaattctcgtgcctcagcctccctagtagctgggattacaggtgtgcaccgccatgcccacctaattttttgtgtatttttagtggagatggggtttcgccatgtgctggtcttgagctcccgacttcaggtgatcccccagtttggcctcccaaagtgctgggattataggtatgagacaccaccccagccaatgtttctcaaagtattaaagatacatgtttacttaatgtggcatttgctactttttaaaaagaaatatttgtgaggtattttgcaagggagtaggaattaggtgaaggaattacctttggagaaaagacatccacagagctctaattgcttttcactttaaggtgtatctcaatatagactacactttccccctgtgagagagtaggtaaatgcttatacctctttgcctgattacttcagcccttatgaatttctcccttgactaaaattccttaacagttacaaactataacccacttttttctccctcaaatgctgtttcttcaaatagtactatttgagagaagggctccgaagtaaaatacatttgggaaatgctgcctagtctatgcccctttaagaatgttgcaatccatttcagtacattaaagtcccagtcaaagagactgtttagccattttccaaacatttttgatctttgaactgttttataaatgacttttactagcatcccatagaattagtgttcttcagtgcacaatttagaaaacggtaatttttaacgtataattttgtacttaagttgtctatttaatatgtatataaatatataaaacatttaatgttcaaatatagcgcatcattctcagatacatcatttcatttgactcttagatttacctcgatttcttttataccattattttagttaactgtgaagacatagcctgtctaaattagataatttttgttttgaatcctacccttaagattctgttttataattataaatctatccatatgtagcctgcttcttcttcttcttttttttttttccttttggagacagggtctcactctattgcccaggctggaatgaagtagcgagatcatggctcactgcagccttgatctcctgggctcaagcaatcttcccacctcagcctcccaactacttgggactacaggcatgtgccaccatgcctatctaatttttttactttttgtagagtcagggtctcaccatgttgcccaggctgatctcaagctcctgagctcaagcagtccgcctgccttgacctccaaagtgctgggattacaggcctttggccaatgtgtagtcttctgtggtcaatgctaattcatttcttcttcttcttttttttaaaatgttttttacattaatagggatggggtttcgccatgttggccaggctggtctcaaactcttggcctccagcgatccacccgcctcggcctcccagagtgctgggattacaggcgtaagccaccacacgtggccatttcttttttttatccctaatatcaacataccttttctctttcataataatttacttgcccttacaggaaacacaacaacctagagtacgtccctgttctattattaactcatttattatagttaagagaacttggcattttaaacatttttttgaattcagagatggtaccatggttttaatctttacctaagagtatgataaccattagatttctctaacagttttataaattaataatcttgtgcatttggacacaagaccctataaagacttggattggtatagatctaatataacttttaaagaacttttattttattttgaaataattacacccttacaaaaagttgcaggaatagtaaaaagaattctcaaactctgttcagattcatcagtttttcaacagattcatcagtttttcaaactgaaaatttcctttatcattctgtctccctctctctctctctctcgctctacacacacacacacacacacacacacacacacacacgtaaattgttctaccacatttcaaagaaggttgcatatatcatgcccctttaccccttaatacttcaatatatatttcctaagaacaaggcaattcatttccataacgacagtacaggtaatttaatgtcagtataatactgtatcatttatgttcccattttatcattaatttatttcgctgtcatatccctagtcttctttaaactgaagcagttctttagcttttcttttctttgtggccttgacatttttaaagaatcgggctattttaatagaatacttctcaatttggctttttctaatatttcctcattattagatgaaggttgtgcttttcaggctagaatgctttgtaaattgtgtccttatcacaatgtaatatccagaggcacatgatatccatttacccctgctagataatgttcattttgatcagttggttaagatattctctggtttcttgactacagggttacattagtcctcttttatcctcagaggatatgttccaagacccccagtgcatacctgaaacctcagatagtactgtatctacactttgttttttcctatacagcaatgggcaggtagcatatacagcatggaatgctggacagaggtatgattcccttcccagactggatggaataggacagcatgtggtttcatcacactcctcagaacagcatgcaatttaaaacttatgagttgtttatttctggaatttttcattcattttcagacagtgactgtgaataactgcagatacaaaactatgggtaagggggggacagctatattatgtttccgtttgtaataggtaatttgagaggagttactctaccactgtaaatagcctatctttcttgaaagcttcccctcatcctagatttagcattcattgaatatacctacctgaattaattttactatgatagtcacaaatttataattttctaaccccttcatttattccatatttattagttagcattctgttataagcaagtttttcttcttccacccatctacctgtctatataatatttctctactatctgaatgagcttatggatatgtaatgggttataatcagtttttgtccttatgtatttacttttaaaattattacagaattattttagatttacaggaaagtttcaaagatagtacaacttcacccagttttctctaatgttaacatcttacgtaattggagcccatttgtgaacagtaagaaagtaacattggtacattattattgagtacactacagactttatttagattctactggttttccactgatgtcctttttaaatatttgtcaggtgttttgtagtgttcttcaatttgggtttgtctgatatttctcatggttagactggagttacaggttttttgagaagactaccagagaggtcatatatcatatcatatattgtatcacggggtacatgataagaacatgatttaacactagtgatattaaccatgatcccttggttaaggtagtgtttgtcaggtttctccattataaatttactggttttcccttcttatttttggaagtgggtcaccacctccatcctgcactccaaaggagggaaattaagctcactccctgaaagggagaatacttgcatatactattggggattcttctgtaaggaagatttgtgtcttcttccccatttattttttatattcaatcatttatttatatcagtatggactcatgtatacttaatattttatgctttgagttacaatctaatactgcgttgtttattttgttgctcaaaattttacagcatcagccactgagagctttttggggttggctttggtatctcttggatatgccccaatccttttgttttttgagcacttccttactttctggcactacagaatgctccaggctcatcttgttctttccttgacctaaaattagctatttctttattttgatgctcaaatggtcttagatttggccaacgggagtcccttcagactgactcctgtgcttttgatatgcccccattcatccatctcttttttttttttttgcccctccttatttaatttctagctcaacaagatgtttcagattcattttgtagtttccttgccataatcctaaaatcagccatttcttcagtaagtcttaattcttttttatggaaaacagtatttagcaactgtaaaatctgggcactaagtggctcattgctacaggaatatcattacttctaggccctatttcagtagacagagttcagaaataaaattttaaaaatacacaaacatgagttcatatataaacctccaattccaatcaaactccacagagttcttcctggcttcccctattccatgcaggacttccccttccacagtgagaactcaggcttccaacagcattaatatattttacttatttgctcagtcctacaatacatatacagtagtttcagaattgctatactcataccaatatgaaaaataaacctactggccgggcatggtggctcaagcctataatccccgcactttgggaggccgaggcgggtggatcacttgaggtcagaagtttgagaccagcctggccaacatggtgaaaccccgtctctaccaaaaatacaaaaattagccaggtgtgttggcatgcgcccgtaatcccagctacttgggaggctgaggcaggagaattgcttgagcccgggaggcggaggttgcagtgagccgagatcgtgccagtgtactccagcctaggtgacagagtgagactctgtctcaaataaataaataaataaataaatttaaaaacctactaagaagaatttaagatttgtttgcaatttttttttagactaatagtatatagtcaaagtacagtgttcttaagttgtttccctctgcccccgccttcactgtggttatattattcctttgaaatacatttgtgttaattggtttctgtattctttccattttagcgatcttttttgacaccatccttgttaacttttgttttttgaatatgtagaacattgacataattccaaaaatcagaactatataaatggtatactcagagaagtatcaatccctcccctatctcttctaccccttacttattccacatgtactccctcccagcccttctaaatggaccaagcacgtatgtgcatgtttgtttctcctcctttctagcacaaaacataacatatttattcttttgcagtttgctcttttcagtaactgtatatcctggaaattactccatacggtccctagagatcattctttctttctttctttcttcctttttttttttttttgagacagagtcttgctctgccacccaggctggagtgcaatggtgcgatctcggctcactgcaacctctgcctcccaggttcaagcgattcttctgcctcagcctcccaagtaactggtactacaggcgagcgccaccacacctggctaatctttgcattttttagtagacacggggtttcgccatgttggccaggctggtctcgacctcctgacctcgtgatctacccgccttggcctcccaaagtgctgggattacaggtgtgagctactgtgcccggccaatcattatttcttaaagcagcatagtgctgccttgtgaatatgtgccatagtttcttcaactatgtacctatgtgtaggcatttaagtagtttccagtatcttgctattgcaaattgtgctgcacagaatactgttatatgtggccttttgtattttggatatgtattttcaaggtaaatttcctagaagttggactgctagattgaagggtaaatgcatactgtatgtagttttgttaaatgttgacgaaatcccctccaaaagagcttgtaccattttatattccatcagcgattcggcataacttttggatctgcaacagctaggagattaagtctaatggctgggcgtggtggctcacacttgtaatcccagcactttgggaggcctaggtgggaggttcacttgaggtcaggagctcaagaccagcctggccaacatggtgaaaccccgtctctaccaaaaaatacaaaaattagccaagcatggtggtgcatgcctgttgtcccagctactagggaggctgaggtgggagaattgcttgaacctgggaggcagaggttgcagtgagctgagatagctccgctgccctctaccctgggtgacagagggagactgtctcaaaaaaaaaaaaaaagattaaatctaacaagttaacaagtcatgcagtaacaagtcacagccatgattaactccctgaaggaccccaactctttgaggtctccaataaagaccacaccaaaccaatatcctcctggaacggcctgagagcacctagaagtagttcaggaattatcctaccttgccagaatgttgtagatacccagaggaagagtattatttggagagtattaatggcaagtcctaaaacaactagccaaaattcagggtgagccaaacatgtattataaagacaattgaaaggaatatttgaaattagaactattccagaaaatctggactgcctaggttggcccctttgtcggtagaaacttaataaaagttttttcacctgttatccatgggttttaaaaaaccctttgtttcttgcctggtggtcctgataaaaagaaaaaaaaaatcaaaaaacctttgtcctcgtggttatttacatcttaaaacaggatttgatgttgcagtttgcctaattcttccctgaaaaccaaaaggatagttgctgatcacttcagaaatggcgttattcttcagcaaggaacttatgctatgtatttgagctttttgaagcatacgtatataagtatgcatagtatatttatttgttcttttagtacatttactctttagttaaatttccttcacacagccaatctgtgggtttcctttttccgccaagaagattgctgttaccagtttagatcaatggagggccaagagaaaggccagagcagtctgaattagtaacaaaatccaattattgcatattttacaagaaatatggaataactttaaccgttaagagacttctttgtacacctgctgttaggaatagtccacaataatttcttgttatcaccattttctatttaatgggttcttctagtctagaaaacaaaaaaatccttgtttttaaaatttctgttacaaattggaaaccctgacacgttttcagtggcttcctgctctttggtcctgctcttgtactttttgtggctattataactgcagctgccaaaaacgttcagttaaatgggagattaaaatacattccacaaaattattgaggctattcttcctggtgctataagaaaaatttattggaaatgttgtttatatgtaggaagctggtatgtttctgattcttcaggtgacatttttctaattcttaaagttcttgaaaataccttatttatattatttttctgtttatacggaaaaactttctacataaaaattttggatatgaattttaattttggatatgaattttaactcagattctatttactttggttcacttcaacaaacatttattcagagccagaagctgttttagcagatacaaagataaacaaacacaaatgattaattcatgttatctgaaattatgggtttattatattcatttttttaaagaagaaaattagattctttgggacagccctagatagtaaatttaataacatttatattctctttgtgtgagtagttacttgctttagacacttacaaaaatcttaactggtaacaattgccaactaggtttttttccattaattaaaagaaactttttatatagtgaaggaaatgatcatcttgatatattctactatattattatttgctttatacttgtttttattgaaattatctttctactttgctttttggggaatattgccttgtcagacacagtctactaatacctaagaattatgattgcaaacctagctgtagaatatttttacttcccttttgtgatatagatttattttttaatatgacatatgattccaaaactcagaaataaaattttttgctgctaaagtatacagcatattctaggtatcctacaatgaatatctgtatggggagaggagagagacaggagaagatagtggtctttagcattaggaacttatgtatttttaactaaaatatttattaacatatgaaatgttatgagaactataaacttggaactccactatcagaagctttactataatttgttaattgaagataattctgatgaattttccctttaccttttgctttccccttttttcccgctgcttcctctgaagtctccttccaaatggttttggaaactggttccagtaagtttgctcagctacttcagtttgctctccagaattgtaattgtagaatggtattgtttatgtcttgctgttaaagtcatttcatgtaattctgttagtcattgaatagagattggattttaaggtcatgtaaaatggaaagataaaagatacagccaaggtttagatcagaagttctaaaaataatttaaagggtaaacatcctgttgctaatcttgtcagtattcacagactatcagtaagtaggttaaaaaaaaaaaacttatgggccaggtgcggtggctcacacctgtaatcccagcactttgggaggccaaggtgggcagatcatgaggtcaggaggtcgagaccagcctgaccaacatggaaaaaccccatctctactaaaaatacaaaattagctgggcgtggtggcgcatgcctgtaatcccagctactcgggaggctgaggcaggagaatcgcttgaaccagggaggcagaggttgcagtgagccgagatcgcgccattgcactccagcctgggcaacaagagtgaaaccgtctcaaaaacaaaaacaaaaacaaaaatcttactatgtagcttctcattaatttaaataattttagtaaatattaatttgaattgcatgaataaattgcctgcatttaaaaatcatctttgtggctgagcatggtggctcacgcttataatcctagtactttgagaggccaaggtgggaggactgcttgagcccaggagttcaagaccatcttggacaacatattgaacccccatctctatttttaaaaaattatctttttgacagacctagttccttttcagcttgaattatagatgacacttcactttttgtgtgattaagaaagcagaaggttttctgtgacctcaccagtagcggaccaaaaccatattaaattctgatttgacttaaagattgatctttcagatttaaatatggggatgggtgtgttaaaccacttaagaactattttacatcctcgataataaaactctaatttagaaatataccataatggccgggtgcggtggctcacgcgcataatcccacactttgagaggccaaggcaggtggatcctttgatcccaggagtttgagaccagcctgggcaacttggcaaaacctcatctctacaaaaaatagaaaaatgaggcaggcataatggtacacatttgtggtttcacctactcaaaaggctgaggtgggagaatcacctgagaccaggaggtcgaggctgcagtgagccatgattgtgccactgcactccagcctgggtaacagagtgagacgctatctccaaaaaaaataataataataaaataaaaataaaacaaacaacaaaaaaaaggagaagaaaataaatataccataatgttgaaatataaaaatatagggggttctttctaaatgccaaacttcttagtttgcagaaagaaagggcatgtttccatgcaataagtttataaagcaaatagcatgttcaagtacaaaagactctttcatgaactgcggatgaaccttctgagtgctggacataatctcaagatttaaagttggtttacttaatatatcttctagaatacaatctttaggaaaatgttttggcatcccattcataattctctgtctagtctaaaccatagatacttattgctaatgtcatataaagctgtgtgtgtgtgtgtgtgtgtgcacgtgcacatacatgtgcctgtttgcacataccttgtacaaaagtgctactttgcaggagggagtagaacaaatcacataattcaattctttgttgcatgaccctgggtgcttggcttagtccaattcaggtcataggctgaaaacaaactactagtcccagcccaattttgaggatgtccaagaggcagactgtttttatcccagataaccaaagaaaagcatgtaaggatctggaacagatactaattgtgagaacggtagcttaagcctagaagataccgctgtactggttgatttcttttttctttcttccttcctcttccctccccatggttgattttaagctgtttcttagctgcaaagtgaggaattttctaagaattatgttaaaatcagaatcaattaaagaatccatatagtacctgcaagtaatttttttctgaatatagttaccccctgaattagggatgtactcttaaatacggagtctattatgcactaattaacaagaaccttcagaaatctttaagaggaaaacatgttccatgaattttgtccttgggtagccagtgagagaaatccaggaataagtatctccttcttcattaatgctgatgcttttctgagagatagcattgaaaagaaatctaacttcactaccaaatgttgtgttctctttcagtaaatttttatttttctatttttattctcacaaaagtgttttatcttataattatattttaattctaaactatagagatgaccaatttagatggaattagaagaaaaaatagtttgataaccttaaaaaaactaccagtaatttatgttatatattttgctagcaaaatactttcgtgtgtacattcactaaatcttcagcattattttacttggctttagaagagttaacagctaataatagctaacctttattgattgcttgctgtgtgcccagcaggatgcatagcactttgtgtccatcatcttacttaatcttccagtggttctatgaagtgggtactattattacgccagtttacagatgggaaaatgagaaatgagagtttaagtaacttgtccaagatcacaaaactagtaagtggcagaaccaggatctgaaccaggatctgaatttgttctcttaactattacagcatgtctcattttttagagatctatttttaaaaattctatctagccacaccaaacaatctttaggaaacaaaggtttcttctctttttctgagggggagcaagaacccgtatacttgctcaattattaatgaaatctaagttggaagggtttttttttttttcactttcaaagttgttaactatttgtgtttcctcaacattcagataataacccagaatgtcttggtgatactattccagttcctcaaatttcttttaagaatagtatattcttttaccttccccctcattttgataactctttctgcttgaatagtattcttgctcttcccgtataagaattttcagtttaaattaagtctgaattaaagtagatgaattttattatcttcaaaagagcagaactgattatttggatacaaagtgttcaaaatctgttttgtgatgcttttatacttaaatatttaagccaaatgtcagttagtgtaaattagcagtatgttatattaagtattgagcttcaaaactatagctattgttgccgtgtatttaactttggtaatacctagcgttatttagaaaaaaagaaatattggtgagtggtctcatttctcatgatttattttattactggtacattagaatttacagtactgatttttttcctatgcgttatttggtacttatttattttcatgtattttttttatatcgtaggctcgttatcggaaagagcaaacattgcttaagcaactgccttgcattccattggtagaaaatttgttgaaggatgggacagatggctgtgcattagctgcccttattcatttttactgtcctgatgttgtcagattagagggtaagtgttccattgtaatacttctgaactgtagacagatagtaaccaatatttaagacagtattattttgcactccagcctaggtgactgagtgggaccctgtctcaaaaaaaagacaatattatttaataagtactgaagacttttttttaaaaataaagaacatttatatataattctgagggaggtagttcaaaaaaaaatagtgctcggtttctaagtcttaatgtataatgactactatatttataaatgtatgtttgttaaccagaattgtgtatttgtactaattacaagatggatatgaaatatttattatcaaattaatccaaagtcaccaccttgctcttttcttatttgaagatatttgtttgaaagaaactatgtctttggctgatagcctgtataatctgcagctgattcaagaattttgccaagaatacttgaaccagtgttgccatttcactctggaagatatgctctatgctgcttcatccataaaggtaaattaaattattctttttttccctttgctttgttaaaatatgtttttttaaaaaacaaacaaaaacaccgggaacagtggctcatgcctgtaatcccagtactttgggaggacaaggtgggaggattgcttaagcctgggaggttgaggcttcagtgagcgatgatcgtgccactgcactccagcctgggcaacagagcaagaccctgtctcacaaaataaataaataaaattttaaaaataaaaaataaaccatagaacaagatatataaatgacctagcaactttaagcttatagattaactatattagtcaaaagaacttttgaagaaagtttttaatttttttctccttattttgttttttaatatactataagctacaagtttcttttatagtgcaaagccaaacttaaagtcatgtacaaaattggccagttgtagtgactcgtgcctgtaatcccagcactttgggaggaggaggtgggcagatagcttgagctcaggagttcaagaccagactgggcaacatggtgaaaccccatccctacaataaatacaaaaattagctgggagtggtggcatgtgcctgtgttcccagctactcgaaggctgaggtaggaggattgcttgagtctggaaggcagaggttgcggtgagctgagatcgcgccactgcaccctagcctgggcagcagagccaggccctgtctcaaaaaaagaaaaaaaaaagtcatgtacaaaattgatctattgtcttaatgtttgcaaaatagagaataagccattaaatgtttcttacaaatagcaatgcttacaaatagtaagattctttataaataatgaagctttctttttcttaaagaatttttaatttttgaattaaaaaattaattgaaaagtaacattatgtactatttaactaccattatgcataaatatatgatatgtatagttaaatgatatggtatccttgcgtatttttatgtgtacaatgagtcattgagcattaaattgaaatttagtttgtttattctcactagattatatataattgttctgtagttaccagactgtttgaaatttgtcacgtttattgtcctttgactgtaggctaatgtatgctgtcagattgtgttaaaataataaaatttcacatgggtagtattattttcttaattttaagttgaatatattttatttacattgatgttaaatgttaaaaataataatcatggctgagcatggtggctcacacctgtaatctcagcactttgggaggctgaggtgggcagatcactgaggcgaggagttcgagaccagcctggccaacatggtgaaacctcacgtttactaaaaatacaaacactagccaggcgtagtggcacgcacctataatcccagctacttgggaggctgaggcaggagaatcacttgaacctgggaggcagaggttgcagtgagctgagatggcaccactgcattccagcctgggtgacagaataagactatgtctcaaaaaaaaaaaatcattattatcatcatcacgaatagatttttgaaaatcattccattccattcccaagtttgaaaattaagttgtgttatgaatactgttatttttaatacttcaagaattatgtcttatcctccagatgttattttagtaatgttagtgttgtactttatgtgagtcaataatataaagtcaattcagaaatcagaaatgttttctagttgagtcatattaatttatgaaatactgaactacaatataaaaacttcaggcctggtgcggtggctcatgcctataatcccagcactttgggaggacaaggcaggaggatcgcttcagtccaggagtttgagaccggcctgggcaacatagtgagacctttgtctttacagaaaataaagttagccaggcgtgatggcacacatgtgtagtaccagctactcaggaggttgatattggaggattgcttgaacctaggaggctgagactgcagtgagccctgattgcatgactgcactccaaacttagtgacaaaccaagaccctgtcaccaaaaacaaaacaaaaaccataggggctttctcttttaatttttaaaggttaaaaaagagtgtttaaaatagtaattatttgaagttcaagatttgctgttgttaaaaacatggtgggaatcatatacatgctatataaacacaggcaacccccatgtatgcagttttagttctggtaaaccatttggaagcagactggggaaacgaactgggtacacctttgcttttgaagaattttaggatttgtttgcagctactctaggttaccaagtgtcacatgtgcatcattagaacaaagccctaatttaagacactgaagaactacagaatgcaagtgtgtaaaagttattaagatgaaaagaaaggagcgttaaacaagtttgtcagcaaaatgtaaaatggcaaaatttggagattattataacttttagaacattgcaggacccacactaatgtttgaaaaatattttagcgagagactattatatgctagacactgtactgagcctggggatttggtcatttattcattcatcggcagatatttactgagtatctccatgtgccagacactattcttagctttggaggtaaagcagagaacgaaatggcagggtaaactataaagccagtggtaaagacatttctaaaataagccactgctcctgctgacccaaagttgtacccagtctcttgtgtctgacacatcaaaaaaaatttttttctaattgatgttgaaggtttacacccttgccattcatatcagaatgaaaggtaatatcatttccatatatatcttgtaatgctttttctggtattttcaggtaataacagaaatattaatttctgttagtaccagaaaaggcatcaacatgatatctacattgtcagctaaaaatttaaatgctacttctgtaatctcaaaggaaaaaaactgtctcactaaatacatggagatataagattgcatttgtttaagttggtataccttggacttccaatacataatatacagtcctgatgtttatatcaactttgtctgggtacgacccatataaagatattttcttaaattaggtatatttaaactatgattttctacagaaagggctttggtcactttctatgttctttacttattactaccacagctttgacttcatttgaatctttttttttttaattcaatcttattttaaacttttagcttaagctcaagggtacatatgcaggtttgttacataggtaaacttgtgtcatgggagtttgtggtacagatttttatttcgtcacccaggtattaaccttaatacccatcagttatttctcctgatcctctccctcctttcaccttccactcgtggatagtttgcagtttctgttgttctctttctgtccctgtgttttcgtcacataagtgagagcatgtggtgtgtggttttgtttctgcattagtttgctaaggataatgacctccagctccatctgtgttcctacaaaggacatgatcttgttcttttttatggctgcatagtattccatagtgtatatgtaccccattttctttatccagtctagcgtcaatgggcatttaggatgattccatgtcttggctattgttaatagtgctgcagtgaacatacacatgcatgtgtctttttggtggaatgatttatgttcctttgggatatacccagtaatgggattgctgggttcagtagtatttctgtttttaggtctttgaggaattaccacactgttttccacattggttgaactagtttacactcctaccaacagtgtgtaaatgttcctttttctctgcaactttgtcaacacctattattttttgactttttagtaagagccattctaaccggtgtgagatggtatctcattgtggttttgatttgcatttctctaatgatcagtgatattgggctttttttcatatgcttgttggccgcgtgtatgtctatgtcttttgaaaagtgtctgttcatgtcctttgcccacttcttaatgagattatttttatcttgtaaatatgtttaagtcccttatagatgctggatatgagaccttggtcagatgcatagtccgaaaaattttctcccattctataagctctctgttcacactgttgatagtttcttttgctgtgcagaagctttgtagtttaattagatcctatttgtcaatttttgcttttgttgcaacttcttttggcacctttgtcatgaaatctttgcccattcctatgtccagaatggtactgcctagattttcttccagggtttttatagttttgggtttatatttaattctttaatccatcttgagttaatttttttatatagtgtaaggaaagtgtctgttttccatcttctgagtatggctagaccgttatcccagcaccatttgttgaatagggagtccttccccattgtttgctttggtcagctttttcaaagatcagatggttgtagatatgtggccttatttctgggctctctgttctgttccatttttgtaccagtaccatgctgttttggttactgtagccctgtaatatagtttgcagtcaggtaacatgatgcctcctgctttgttctttttgcttaagattgccttgggtattcaggttcttttttggttcaatatgatttttaaaatagttttttttagttctatgaagaatatcattggtagtttaataagaatagcattgaatctatacattgatttgggcagtatggctattttaacaatattgattcttcctgtccatgagcatggaatgtttttccatttgtttgtatcatctctgatttctttgagcagtgtattgtagttctccttgtagagatctttcacttccctggttagctgtattcctaggtattttattctttttgtgccagttgtgaatgggattgcattcctgatttggctcttggcttaactgttgttggtgtataggaatgttagtgatttttgtacattaattttgtatcctgagactttgctgaagttgtttatcagcttaaggagcttttgggacaagagtatgtagccttatgaccatcttaactaaaagaaggaaagaagaagcttttaaatgaattaatctggcatcattcctgaaatatggtgacagatttattgctgtttaatcgtcatgaactcagaaagacataatcttcataagttttaattactgggaaaattatttcttactctactgacatcttgtggccaaatagtacaattaatgttattaggatggctatcttaccaaagtccttaaaatattaacttattttctgttcaacagataattattgagcacttaagcagtattttttcaaaatataatcagctttcagttaactaggctagtaaaatggaacctagcaccagtacttaaaaaccaattttatactttggctttagaaagtataccataaagataagtataaagaagaaatataaatcacaataatcttactaatcagaaatattgtgtcaatgttttgatgttttactgactgttttttttagtacgtagattcattcatttgtacattcatttaataaatatttattgagcacctatcatgtgccagacactgttttaaacactgaagatataatgatgagcataaactttgtctttttagactttatcatctggagggtaagatgaggaaacttggagaatgtagtaatagataaatctgggaagagaaaaagggactgtaccaagtagcctcttgtaagccatagtaagattccctttacctcaagagcaatggaaagagagttgcattttgaaaagtttgttttcttagcaagccaaagaaaaagctattgtgttccaaacaaggcaaaaatgtttgaatcagagcagttatgatggagagaagttggtgaattccagaaatatttaggatgcaaaatctgcatgctttggtgatgaattggacatgggagaaagaaggtgtcaaggatgactcctaggtttctggtttgcacactgggatagtggtgccattcagtgagataaggactgcagtaagatcacatttgtagggaaggtcactatttcaattttggacataggcctttgagatatccaaaagaaaatgctcggtaggccactgcatatataagtgcagtcagtacatttgagaatcatttagtagctgatggacgtaggcatggcagtgtttcaaagaggggcgagatcaggaatatcaaatgcagctgagaggtcaagtaagatgggaaatctgtttgatttagcaacatatgtacatcattggtgacttgagcagttgctgttaggggaatgatgtgactcagtgccaagactgaagtagattagagagtaaaagtgatgaaatggaaaatgtcagtagaggcctgctcctaaaagaagtttgtgaagaggtaaaaagatggtgggaatgaggagaaactagagaatagttattgagtaaaggttttgtttcatttattttgatgggagggatttgagcatgtttaaaagccaaataggaaggattctgttgacaggggaaggatacatatgtaggagagaaaagtaggattaagaatataatggcattcacagcaatttggatggaattggagaccattattctaagtgaagtaactcaggaatggaaaaccaaacatcatatgttctcactcataagtgggagctaagccataaggatgcaaaggcataagaatgatacagtggactttggggactcagggaaaaaagcaggagggaggtgagggataaaagaccacacattgggtacagtgtacactgcttgggtgatgggtgcaccagaatctcagaaattacttaaagaacttattcatgtaaccaaacaccacctgttcccctaaacacctattaaaataagaaataaattttttaaaactgtaaagtttctgagaagtcaagcagggatgagagccactgcatagcctttacggattataagcattcttattactttttttagtcacaaattttaatggctgcttcaattagtatgtatctgtatatcaacattctaaaattctgagaatttacagtaaaagcaaacatgaaggtaaagtagaaacctaccaaatgctcttcaccactgtgcattatcttctgtaatactccagactcttacactcagccacctacaagacaggtccacttaaatgtccagtgaacatctcaaacaatgactctagattcctttcattacctgtttctcccagtcctttctatctcactattagttgctcgagacaaaaacctaagagtcatcactcttgattcttctcttttcatcactttctttttatttttttttagagacagggtctcactctgtcacccaggctggagtgcagtggcacaatcagccaaatcctgggctcaagctgtattcctgccctagcctcccaagcagctaggatgacaggcacgtgccaccatgcatagctaatttttaaaatttttatagaggcaagctatgttgcccaggctggtctcaacctccaggcctcaagcagtccttcctcctcagcctcctcaagcactgggattacaggcatgagccactgcgcccagcctcttttcttcactttctacatacacgatagccttccagaactatcagatgagagatgatatttgaaagtcaccaacttaaatatgagaaaaccaagagaacgcatgagttctagtggagagcatatagagtttaaggattattcataattagcaagtaggaagaaggcaagacattagaaaataaccatatccaggataatcttaaaaactttaatatgaaataagaccttattaaacattaataaatttgatagtaactattttattaaatgccaaacacccaaaatttagaaaacatattattttaaatagttatgaaaacagattttgtagtttttaaaaatttaccgaatgcctaaaattgaaataattcttcatgcttacagcttttattttatatgcattttaaaatataaacttgtagtagaaatgtgcttttgaggacccttaatcctttctcttaattttaagccatttaaaaaattatttacattttaaaatagtaataataaaaggtaacattgttgacttattgataacttttcaaagttaggtagatacattcattgtataaataatgttttgtacatttcaaaattattaaaaattagctataaaaatttagttttggtgttatttagcacctgtattactggtgagtttaacattactgagcacatacatataactttttttgtttaagacggagtcttgccctgtcacccaggctggagtgcaatggcatgatcttggctcactgcaacctctgtgtcttgggttcaagctattctcctacctcagcctctcaagtagctaggattacaggcacgcgccaccacacccggctagttttttgtatctttagtagagacggggtttcaccttgttggccaggctggtctcaaactcctgacctcgtgatctgcccaccttggcctcccaaagtgctggggttacaggcgtgagtcaccacgcccggccaaataaagtatttttttaacactacatccagttacgttttggagaaatttctagggatctgagtagagcttagttatgttttgaaagtgataacccctctttagagtgtcagatgattgaataactttttaagttgcttatatttactttggaatgaaagtgccttatatattatctcagtgttctacacagttagaggtattcatgcctgctagatcaattggaccaccattttagaactatagagcaaatgatcagcaagaggttttgaatagttataatttttacccacaagagttaatattccatcccatgtttaatagcctactatagtgaatatactccagtgatgaatgaatgagatttaaacctatattttaaaacaataaaattctgtttatcatgaagttttacctaatgtaggctttctcttaaatttcctatatagagtaattatttggtgttcatggcggaactgttctggtggtttgaagtggtgaagccgtcttttgtacagcctcgtgttgttcgtccacaaggaggtaatcaatctttttaattttaaatgttcctatgaacagaaaaaaatggaatgttgatataaccttacctggttacatttttagaaatcagcctattattttttttttagatttcagctattacacttgatagattctcctaacctcttaaaatggttagaggagaagaaaaagaaaatggagggaatggctttgaatttgaagtcttatgatgtggaacttttagctttaactgtccatttcttttctttgcatcttttatcgttatcccagcttttattcccttttagattcttagtttttaacattgtgttacccagaatccccacaaattattgtttggccttaacccgcaactcgaatttgccattaaactataaaaaggtttgtatggatttttaaacctagtggattttatgactattatatcatgaactattgattgtacataataagaataaaattagtaagaaataagggggttactgtaaagacccctagatataaggaacaaaaaatcttcctaaattttctgtaaagcaaaatttcacatagcaaaaccaattttctcttggctcccattataaaactagaggtttatttctaggctgggtgcggtggctcacgcctgtaatcctagcactttgagaggcctaggcgggtggattacctgaggtcaggagtttgaaaccaggctgggcaacatggtgaaaccctgtctctactaaaaatacaaaaattagccgggcatgttggtgcatgcctgtaattccagctactcgggaggctgagacagtagagttacttgaacccaggaggcagaggttgcagtgagcgagattgcatcactgcactccagcctgggtgacagagatgagacaccatctcaaaaaaaaaagaaaaaaaaaaaaaactagaggtttatttctatagggggaaaaatgatcttaaattataagcttagcccactaaagaactttcttccagcataacttatggaaacatttctgtctgctaccaatagctgccctacccaacgcaacacatgatcattgtgcatcccaactacttagcagctttccttggctccaaagtttgttatttttgtaactgctaccgttacctgcacctccccgctaaacccccaaaaaataaaagaagagaaagtgatcaggaaggaggaaaaacatatgtagccaaaggggaggcatagtctagtgagtacaatgaggttacttcaggcagcccaccgcatctcaggcaaaaatctgtgaaataagcaataattagagtattgctaagcttcttaaggcagattctgaatatcgagtcactatataacattatataacttctttacatgcctataaaaaaattgagatgctcccctaagtccattgaatgaagtcagatattcttagtaattttcataaccaatatttgtataatttttaaaaattattaacagggttttcactacattgctttctgtgatttcacctgtgaagctcactattcaaaataccaacagctgttgcatcagatctcaaagtcaaaaagtaaattgagtcttcctccagagttacttacaaaaataaaagtataccagcaggtttaattattttctaaagaaattctgtttttctctaattgaccaaaataccagctgtttcataaagaagcagagctgaccatatgtatctgaagttctatgaaagctttcacaaaactaaacgctcaaacttatttttgttttttttttgtttgtttgtttttgttttgttttgttttgttttgtttttgagatggagtctcgctctgttgcccaggctggagtgcagtggcacaatctcggctcactgcaggctccatctcccaggttcacgccattctcctgcctcagcctcctgagtagctgggacaacaggcgcctgccaccacgcccggctaattttttgtatttttagtagaggtggggtttcaccatgttagccaggatggtctcaatctcctgacctcgtgatccaccggcctcagcctcccagagtactgggattacaggcgtgaaccaccacacccagccacttatttttgttttaaatacatgtatttattttatgttaggctttttccccctaattatccttaatcagatgaattttttaatttaagaaatttttggctgggcgtggtggcttacgcctgtaatcccagcactttgggaggttgaggcgggcagatcacaaggtcaagagttcgagaccagcctggccaatatggtgaaaccctgtctctactaaaaattcaaaaattagctgagcgtggtggcgggtgcctgtagtcccagctgcttgggaggctgaggcaggagaattgcttgaacccaagaggtggaggttgcagtgagctgagatcgcgccattgcactccagcctgggtgacagagcgagactccgtctaaaaaaaaagaaagaaaattttttttaattttgaaattaagtctgaatacttcaaaaagatcttaaagaaacttgaccctttgaaaattatttaagaagaaaactttatgctatgatttctcaatacgtagaaagggaaatagaagttaaattttgttataaatttgcttatggtccagaatttttcatagaaatatgctaatttgagggtgtttttaaaaatcttttattccagctgaacctgtaaaagatatgccttcaattcctgtcttgaatgctgccaaaagaaatgtcttagatagtagttctgacttcccttcaaggtaaactccacaatgactttattttcaccatttctattctatttactaattaaattacataatattatattacattaaataaggtttttaagaatttcagttggattttgaactgttataattagcttaccctattaaagcctgttttaacttaaatataaattgaaatatacactgaaatgaatgtttatgtaccacactgaaaagatgggacaatatattctaagttcccaataaccaacctaaaaccaaacttttgatgcataacttgttcataattgagaactgtctaataggtaactcttaggccttggagggaaattttgaaattctattaggacttttacatattttattattttaaaaatctttgaaggtttttcctgctttttttttttcttgttaggatagctattgagagatcacagtgttacccacacaacgggtgggtttggtctcttggcagatgacagtccaaagccacaaccaaggaggatttaacaagacgaggattttattacttgcagcaagtaaggaggacaccgggaataattccccaaagcagtgcctcctcaagcagaggtgaaaatagggcttttagtaggctggttaactgtatcattgtgtgtagaggtggagtaaaggcagtaaaggcacagtcatcagtcatgcttctgcatactggcatgtatagaaaatgcggaataagctcctccttggatgggatttttagtgtggtaatggtaatacatttccgtctcaggcatctctacatccacccagcttgtgtagtttttgttttgtaatgtggggttgggctgcttcctggaaatttctcaaacaataaaaatttcaaggtgcaacagttacaagcaggtaccttttcacagtgtgtacctgaaaacccaaggaccctgggttacaacaatagaatatttattacaatattaaatctttaatgttttagtacatagtattaggaactaaactgaaagcaaagtaaaaatgtcctatcatattaatacctagataatcctgacttctcacccaggtatatgatagggacattagtttgtttaaaaatgtatttcagcagctcctataagcagctttttatttgaatctattagaacctacaatttatattgactttggactccctaatctatctgattttttacgttaaaactaatgtcttttgtgggtttttggaaattcagacacattaaaaatacatttcaaaaattatgagtaaaacattcaaagtaatttctgtatgaattcttggcttaacacaaaaatatgaaatttagcaggcatggtgggtcaatagtgacatttccttccttgaagatttagaaaacactcagtgttctaggtcatcactcttgctctattaaatctttaaattccactttcaaagtggaggaaagtaaagctttccactcaaagattagattattccataattattctaggaacctaaatggacagtctcccacatttctgaaaaatgttttaattcatgtcctctggaaaactcatctcttttctgtctctcagacatctcagcagctcatttttcctatttttcccagcagaaactctttttataatgcagatggatgtctacattcttttccttgaaaagttattgtgtagccattattctaggctattctgagttcctagtcatcctctcatttctataagtctccatatggtccattgtagttctccaacactgtggaacttttgagaaagaattgaagtatttttacccttcctgggaataatgtagccacatctcaaatgttagtgaacctaaataatgattttatgagaaagaaaaaaacaaaggacgaagacagacaaagcaaaagatgttttcagcagctactccacacacttggctaccagctgttggagatatacaaacaggtccgtgagcagagaggctgtcaaggtattttactagggtttattatacctatagtttttagagattagatttgaccaaagtatttcaaattggtgagtttcattttacttttttatatatcagtttttatgtttataaaaatgaaaataattcatatctcacaaagacattgagatgtatatgaaagtacttcaagttgtttggctaaaagacataaaatatatatagatacatactgtaatcacagccattctttggtttaaacaatatgtttccatatttttaaaatttaggttgtagaatgagaggtggtagtgttgtttctaacttaagacattctacctaaatttatattaaacagctaaaatataacattttaaatttattttccattgcagtggggaaggagctacatttacacagtctcatcatcatttgccttctaggtattcacgtccccaggctcattcttcagcctcaggtaatatatttgaaaaagcctaggaaaatactcttttaagtaggttacctgggaaatgattgacagtaaatataaataaacaaatatccagggtttttttgtgtgtgtgtgtgtgtgtttttttgtttgtttgtttgttttctgaaaaatggctattataacacactaaaagcatggtcagtttcactgtggttgcttttcttgataaaattatctctaattctccttatgtacctatttaatttgtattgctattaatgaatcctcaaatacatgaaatctcctaagttgctataagttaatttttttacatgatttcaatggctttttcttttttgcatttgaaggaggaattagaaggtcttcatctatgtcttatgttgatggcttcatagggacatggcccaaagagaaaaggtaaacaaagagaattacttttagtgtattcagattattaagaaatgcaaattgcatctgtgtctctcttttattgataaccaaattgctaaaacttttaattagttcctaaatttgaaaaaggcagtataggcagatgatagagatgtaaaagaggctaactttaaaaagtagctagatagccctccccttaccttgaagacagtatgattatgagaactggggaaagaaaggaaatgtaatttcaaataattcttgttaaatgatactaaaaatcatttctaggatttttaaaggatttttctctttaacttttttttagatcatcagtgcatggcgtatcatttgatatttcttttgataaagaagatagtgtacagagatccactccaaaccgaggaatcactcgttctattagtaatgaaggacttactctgaacaacagtcatgtatctaaacacattaggaaaaatttgtccttcaagccaataaatggagaagaggaagcagagagcattgaagaagaacttaatatagattctcacagtgacctcaaatcttgtgtgccccttaacacaaatgaactaaattctaatgagaatattcattacaagcttccaaatggagctttacaaaatagaatacttcttgacgagtttggcaatcagatcgagacaccaagcattgaagaagcattacaaataattcatgatactgaaaaatctcctcatacacctcagccagaccaaattgctaatggcttctttcttcatagtcaagaaatgagtatcttaaattcaaatatcaagttaaatcaatctagtcctgataatgtaactgatacgaaaggtgccttgagtcccataactgacaatactgaagtagacactggaattcacgttccttcagaagatattcctgaaactatggacgaagattcttcgttgagagattatactgtaagcttggactctgacatggatgatgcatctaaatttcttcaggattatgatattcgaactggcaacaccagggaagctttgagtccttgtccaagtactgtaagtaccaagtctcagccaggcagcagtgcttcttctagttctggagttaaaatgaccagctttgctgaacaaaaattcaggaaactgaatcataccgatggaaaaagtagtggaagcagttctcaaaaaactacaccagaaggctctgaacttaatattcctcatgtggttgcttgggcacaaattccagaagaaacagggcttccacagggacgggacactacccagctgttggcctctgaaatggtgcatcttaggatgaaactagaagaaaagaggcgtgctatagaagcccagaaaaagaaaatggaagctgcttttaccaaacagagacagaaaatgggaaggacagcattccttactgtagtgaaaaagaaaggggatgggatatctcctctacgagaggaagcggcgggtgcagaagatgagaaagtatatactgatcgagcaaaagaaaaggaatcacaaaaaactgatggacaaaggagcaagtcactggcagatataaaagagagcatggagaatcctcaagccaaatggctaaagtctccaactacacctattgatcctgagaagcagtggaacctggcaagcccctcagaagaaactttaaatgaaggagagattttagaatataccaaatccattgaaaagttaaattcatccctgcattttctacaacaagaaatgcaacgcttgtcacttcagcaggagatgttaatgcagatgagagagcaacaatcttgggtgatttcacctccacaaccctctccacagaaacagattcgagattttaagccttctaagcaggcaggcctgtcatcagccattgcaccattctcctcagactcccctcgtcctactcacccatctccacagtcttctaacaggaaaagtgcatctttttctgttaaaagtcaaaggactcctaggccaaatgagttaaaaataacacctttgaatcgaaccttgacacctcctcggtctgtggatagccttcctcggttaaggaggttttcaccaagtcaagttcctattcaaactaggtcatttgtatgttttggggatgatggagaacctcagttaaaggaatccaaacctaaagaggaagttaaaaaggaggaattggaatccaaagggactttggaacagcgtggacataatccagaagaaaaggaaatcaaaccttttgagtcaacagtctctgaagtcctatcactgcctgtcacagagactgtatgtctgacaccaaatgaggaccaattgaatcaacccacagaaccccctcctaaacccgttttcccacccactgctccaaaaaatgttaatctgattgaagtttccctctcagatttgaaaccccctgaaaaggctgatgtacctgttgaaaaatatgatggagaaagtgataaagaacaatttgatgatgaccagaaagtatgctgtggattcttttttaaggtgtagtattaatctgcatagttttgggcatcttcattagatgagtgtggttgtgttggatattttttttttcagttgacatgcttgcttctttcagtagcagtcccttttgatacaagttcatccccattaactatagtaacattcaagcacactgtggtttccagtatggactcaaagctgtaataaatccttttatcacatgtttagatgtattccttggttttgctcctctactgctctttctcactcacaaaagccttttaaaaattaagctactcagatctcttcagagaatgattccattttgtctcttaatcatgtaacactgccattttttttaacagaatgctactgtagacactaatagatattaaaatttactgcctagagactctgttccttgcagaggaagggaaacaaaggggaagaaaatcattagtataaaacaggcagtacctctgttgcttcatttctattccatttatttacacatcttcaccaccccattactcatctgttggactatggttacagcttcttgactgggctgtctgtctccaatcatgccattccagtcttcatactgctactaaaggtgatagttccaagagcatagctccaattgagtctctttctagtcaaaaatcttgcctgttgaataaagttcaaaccctttagcacaacattcagggactttcacagatgaacctaaatctttttgtctagcttcttccccataattttattttgtattgttctttaagattaacttcaagcttcatctaaagccttttataattccttcagtcgaggtcaaatgtttcatcatttgtgtatctattgtatccttaaatatactcatacctgtcctgtgtcccggagttttcaactgttttgtatgatttgctttgtctcttagaccatgacctcctagaggtgctgcatctttttatttttatttatttatttatttattttttgagacagagcttcgctcttgttgcccaggctggagtacaatggcgcaatctcggcttaccacaacctccgcctcctgggttcaggcgattctcctgccacagcctccctagtagctggtattacaggcatgcaccacaaaataaattttgtatttttagtagagatggggtttctccacgttggtcaggctggtctcgaactcccaacctcaggtgatctacccgcctcagcctcccaaagtgctgggattacaggcatgagcccccgtgcccagccaaggtactgcatctttttatccccatagcataataaagtgtctggcaaactacaatatatgtaatttgatagatgaagacatatgaatgtttgaactaattgcttgaatggtatcttctgactttctccattcagagttaaatctctctctgggtttccatacaaagcctgttgtttgtacctcttctccttgtgattttttaggctccttgacctgaggtaccatatattttaatatatgtaatatctgacactatgttgtgagtatgttagacaccaaagaaatgtttattgaattaagcattggcagggacagttgacaaggagacattaagacagtgaaccacttctacaacagcttgttactttgctgaattctgaagcattttggaagcccgctgagaactagggctgtccctaaggattcaggtagaaactagggcaggcccaggaggcctatagataatgaactagctctcaaattaaaagtactgtagaagggaagtataatcatccccatcttttcttcaatggaaaaatgttcattatagttcagaacctatcaagcagactgtcagtacctcaacttaaaatcatgcagcaatagtttcatttatgtgctacaacattgggtggctaattttgggatgtttttacttgaggtatttttactgagcttatattttaaataaaatttaaatgcaattttaaaaattggtgggggaactacctactgtaagttattaaattagggttaaaaaaaatttgtgcttttttgttttgtttttatggttgttctttgcaaatctcataggttttgacagagtgtaattaaataagtttgcctgtcctcttttttgatggaactgttaccactgtagttccgttcttccttcataatttctcaaccacacccacattcagaagggttgtaatagttcaaactttcagttataggactaaccacaaaatgtgactacaacaattgaaaatgagaatattggtacctaaaatgtttgatcgttttcaatgaaattcgttcttaggatgatcaaaaagcagaaaatgatatggcaatgaaacgggcagctttgttggagaaaagattaagaagggaaaaggaaactcagctccggaaacaacagttggaagcagaaatggagcataagaaggaggaaacaaggtaaaggaaattgctggcccagtgctagatctgaactttaatgatgcatgggcatatttagaaaaagttggtaagtactcaaagaggtggtctctcattaatttttattaacagatttctttcagagaagtttgtagtatagatagacagctggatcaatgctattttttggtgctttgtagaaatcaatttattttcccaaagtattgcctaattttatatttttatcttaagtttaaggcatctcatgggaaagttctctagaaacattaatttaaataattatatgtttaaaaaacattaaaataactttcctgggagatacacacacacacacacacacacacacacacgacctaaattatctcaaatacctttatttttatttatttatttgactcttccttccctcctttatttacttatttatgcttaatcccatgtctcagcagaatcgtcaagtaccttttaaatgaaccatttattcaccaaggtgatgaaatagaattctcctttctcatatcaaatacataactctctcctgtatggtttgtctttggtatgcagaataagaactgtaaccatttgatttcttaggcgtaaaactgaggaagaacgtcagaagaaagaagatgagagagcacgcagagaatttattaggcaagaatatatgaggcggaaacaactgaaactaatggaagatatggatacagtaattaaaccccgtcctcaagtagtaaaacaaaaaaaacagcgaccaaaatctattcacagagatcatattgaatcccccaaaacaccaataaagggtcctccaggtaacatagcttattatgaagagtctgttcataaaaaacaccagcttgattggtttgtcatactaacttggttgtactttgatgtgcaaaattggatacacagtttgagattgtgcatgctcccttttggaaaaccaaaatgagcaaatgaagtttttaataaattaaatgtattatgtgtgcatgcatatattcagtagaacaaatgtgaatgctaaaaatcaaatctaaatattaatctattagggaactgtgccctcagatataatctccttgaactattaactgccctttacatacttataaatttaaataaatgttatatgcatgaaatgtacaagaaacatgttggtataataaggaatgcaagatcaagagttcacaagtccctccttcaagatagaaatggttgaaaatccaaacttataatatctggagttgagagaatatattttctttaaaagtcagtatacatactcattattactattattattttttgaaacggggtctcagtctgttgcccaggctagagtgcagtggtgtgatcatggctcactgcagcctccacctccctgggttcaggtgatcctcccacctcagcctcctgggtagttgggactacaggtgagtgccaccatacccagctaacttttttgtattttttgtacagatggggtttcttcatgttgttcaggctggtctcgaactcttgggctcaagtaatctgcctgccttggcctcccaaagtgttaggattacaggtgtgagtcactgcgcctggccatactcttatttttaaaaaaatcttggggggcagggataaattcgtaaaaataaaagaaatctttattaaaaccaaatgccatggaaattttttagagaattctcatagttatactaaacctgaggaaaaataacataatattgactgtttaaagagaactctgttttcaagcctgtaaaactaattgatataattttctacctagaatttagatattatgaaatttttttttgttattgtttttttctttaggatcacagtatcacgtctcatattaacactttccttttggaacgcaagttagttttatcattgtttcctaaaagtaggttccttgctaattttaaataaattgtgtatatatgcatgcaagcatattatgtgtttaaaagtacagagaaaaggaaaagaaactacagaagctcaatttttatatgctggtgttatctaatgaacagactctttgctagttgctccttttaaatttctgattttgtttttattcaggatcatgaatttatcgtgttttttcagtctctagcctttctttggcatcgctgaacacgggtgataacgagagtgtacattcaggcaagaggacgccaaggtaaatctataacgtatgaatatttttacagaaaagaatatagtacctgcaattatacaaactctaagtaaaaattcttcagtgtttttacattttataatgaccaaatcataatcacaaattttactaagttttgctgacttaggactgttagagtttctgttaaaataaattatgtaaagaggtgtctattcatctttcagtgcttgtcttttagaatttagaattattgacattgataacatactttttataagctatgaaacattaacagtaattatacatcagtaattgctaacatgattattaaatcacagtcagtagaatgagagtaccaacttctctagtctattaccaactaagacaaaggagttttccccattagaataattccaaagtgggttgcctatgacttaggaaggatctcttttgtattttctttctctaggattctttctctagattagaagctaaaagtcagtattttattactttatactataatatcatatcagaaaagaacatttctagtgacagtcatcatcttagagttcttatctttgtattaccatcctttgtgttatttgccagttttcacattgaaaaacattcactctttcaacagatatttatagaatgcttactatgttctaggaacttggatgtgtagctgcgaataagacaaacaatgttatattattttttattattaattttttttttttgagacggagtctttctccattgcccaggctagagtgcagtgacacgatctcggctcactgcaacccctgcctcctggcttcaagtgattcttctgcctcagcctcctgagtagctgggattacaggcgcgtaccaccatgcccagctaatttttgtatttttggtagagacgggctttcaccatattggccaggctgatctcgaacttctgaccttgtgatctacctgcctcggcctcccaaagtgctgggattacaggcatgagccaccgcgcccggccttatcatattatttttaggcctttaggttgattttgattgttactttcacgtataccctctgggccccattttttctctgtttgagacataaaacatattttattttctaattagatcagagtctgtagaaggcttcttatctccaagtcgttgtggcagtcgaaatggagaaaaagactgggagaatgcatcaacaacttcttcagtggcttctggaacagaatatacaggttagtgtctatacatttttagagaaacatttgaatttaacacactcataaatggagggtgtactaaagaaaattttattggctcacctttgggtcttaaacataggcaactaataaacagtgaatgcaggtggtcactttcaggtagttcagtaagtttctaaacaaaattagtgatgctacttatatctcatccctctaaccaatgctggccatttctgtgtgtagtttgggtccgaagaagttttagagaagttctacatagttcctcagtactgagtaaaggctagaatccaccaagtcctctccctaatactgggattccaggtatccagaattgtgcacctttagcaagtattaagaggctctaaaagataagaatgcattgaatctaggaaggtatctagcctcacatatcgccaccaagtcctcttctagcttctaggtaggcatgattggaataaaagcaatgaagaatagaatgtgggttaaggacacttctaaataaatgaagcaggagagaaatcagaagaaatgtcagcagcacgttgagaggtaagataggaaggcatgggagaacatgtatggggaagagcagagggaaaaggagatgcctccatctatccatgatagagtggaagtggaaaccctagaaaggcctaaggaggttagaacttgctagagacccactctgtggcttttaatactacctcctaccgccagtctgacagcctttaaggcctgggatttgacagtatttccatgttactcactctgcttctctatgttagttcagttgaacaatctgaaaaagaaagcttttttttgccttttgaaaagacttaaattactcatggacccattctactctaagctaaccagtaaccgtatagatttaagaaagaaggttaaataggcagtatgacagttatagcaatattttatttttagtactgctctcacagggtactccaaaaggccataggaacatcctccatatctctgggtggataaaacaatgttttggttggattgcagccagtaagaggcctttaagcacagaatttggtcttctattacaatatttcagcagtgtaggaacaattacatcattttaaaatagtagtatttctgacttaggaatgttatttttattattgttgttaaatccctaccataggaccaaagctctacaaagaacccagtgcaaaatccaataagcacataatacaaaatgctttagctcattgctgtttggctggaaaagtaaatgaaggtcagaagaaaaaaatactggaggtaagcatgtttgcatgaaaattaaatttggcaaactgtagaagtcttttatccattcaagagaatgtactctcatgggcctagactttcaacagcatgtaaaaagatctgtagctagatgttttaattatcagatttagtttattttcacattaggttctggaagcctgcagattttattaaagactagcaataggctttaagatttgtcattgaaataatgttataaaatgtgactaagaaacgtaacataattatataaactttattcagcaaaataaagggtttttattcgtgttgttatgttgtttttgttttttattttaaaggaaatggagaaatcagatgccaacaacttcttaatcttgttccgggattcaggatgccagttcagatctttatacacttattgcccagaaactgaagaaatcaataaactgactgggataggccctaaatctatcactaaaaaaatgattgaaggactttacaaatataattctgacaggaaacagtttagccacatacccgctaaaactttatctgccagtgttgatgcaattaccattcatagccatttatggcagaccaaaagaccagtaacacccaaaaaacttttacccactaaggcatagaagttgggaaatacttgcttcagaacattcatggtaaatttgcacttcatctttcctgcctatagaaaatctttctaattgccaacaagacttttattaattaaaactggacattaagctctgttgtcatgaacaactggaatgtaaaccacagtattttggagtgcagaacattctcaattaagtgataagtccaaatgatgaaggaaatgttttaattcacaaatggagatttgtatgtgttatcaggttcacctgcttgatattagatacattaaagcactgaattttcatggatattagttggatttatcattgaaatatggttaagattacaaattatgtgttttatttgttgcttttttttaaccttttaatgtatattcttgtcttcagatggtttgctatttttctctcctgggggtttattctaagatacctttgtattttatttcatgtggagatcatgaaagtaggaaatatacctttagaagtaactcgcacctttcttatgatgttaagagaaacactagtgtttagttttacagtaaccctcatattttaatggtgttacagcatttgcaaaaattattctgctaagtatttacaactctatttattattcactcaagtattaacattctctattaaataagaggaggtgttgtaaagagctgctagtaggttcgctttaaaccacatgagcttaaccaagaatatgttatgagaagttgctgattaaatcagtgctgtttttacaccacttctggccaactcagaataatttagattgttcttttaacaaaaaaggctttctatctcttttaaagtaagtcactttataagttggcagaagtgaatgacactttgagagtagtctttcaatctgaagatgtaagacttcctgaaacaagttctcaagaagtctttacattatatttataactcatataaaaattatatttagaatttttaaacatgtacaaagggctacattttaattttaaaatagcttcacattattttacttatattgggtttttcttcattttaatccttttcaagtggaatggcttagaataagtatacacttgaaatctcctctacatgatctttgttctttaacagtgtataccagagggttagttggggaaaaacttcattctcaggaaaagacttgaatgattatgtgaccctgttatatttcagtgttgtgacaaatgtgtaaactagcgggggaagacagtattgtatcataaatgagatgcgtagtttgttttctttcatgggaagtagagataaaaatatatacatttctctaattgagttgtttagagaaagaactaatgtctcatatgatgtatttacttattttaaaaaaaagaataggaatgagatgtccctgagctgtacttttctattattataaggcctttaggcatcagtgcatctgggttatcaacattttctcaaatgctgtcaatattttactgtaatttatgttcttatatttatgtatatttgttaaaactgtaaaaaaatttcacagatttttttccaatacctgtgcaagatacatgtgtagctcaaaactatttgtgatctactgtttgcatgtaagagaccaggatatgtaactcttatattttaagtgtatacatattgtgtatataacatatggatattaaaaatggggaattgcacattttaccttttggacagtaatttctatcacagttagaaggaaatgatagtcaaatacacgtttagattaaaactagtttaaaaaattataaatgaatctaatcaaaatgtgaatagtagtcaaaaggataatttaataagcattttacgttactaaatttgttcatttcaatattaactaaatttccctcatcaaagcaatctttgtgatattacttcgctattaaataaagaaaattggatgcaagacaatggagaaactttaaaactaaacaggaccaccctttattcttaaatttgtgtgtgtccaacagttgaattgaatgtctataaggtctaaaggtagaatgtgaatattgccacagagttcattgctctcagtataagattttactttattaatgcagaaggaatatggatatatttctttaagtctgcagatttttttattatggtgcagcttttttttaattatgtttttaaaattatacagttgaaaaatatgccatttcataaagtctgaggattttcgtcaaccttactgaaacacactggtgctttcatcatcagaggtcaaattattatgataactattccattaagtttgccaaacatttgtcgtggttaccagtgcagcctgtcaaattctgctatttgacacagctttggaaagatttagttcttggtttttccgttttgtattagaatgactgttacagttttatttggctgtttaaagccaaattcagctatttaattatggtttcatggacactgttgagcaatgtacagtgtatggtgtgcttacctgtccactctagagcattgcttacaggttttttgttttttaagatgctgtgctgtaaaatactgtcatacttgctatttcctggtacagtgtagtttttcccctttcatttgaataaaagcatggcaccaa

SEQ ID NO: 1990 - DNA, 24239 bp, Homo sapiens
tatgccccaggggacagatgtcttgggatctttaacatttgggatgctgcaaatgccgaagttaaatgaaatacctccggggagggcaggccgcagggaggctcggggggagggaagatggcctggacaaacaggtcctgaagctgcgaggctggagtggagggcgcaggggcaggcgggcggcgccagagctccatgggacaggtaagcgggaaaacttcggggcacccagtgcgggtgaactggggcgggggatcgggcccctgaacccacggtcttcagccttagcggagggtgccctacagggaatggggtaattttttcaaaggggcaggaattctgagttcctaccaaaaatgcacatttccagtccctcaacctttctccttcgaccttcttcgtgcctgtggatcttcctggccaggttccgggaagccagaaagcagccaaacaaaaggagcaaagtctcgggccagcctggatgtggagggcgcagtgggggaggggagcagggtggacaggacaaaggggctttttagagaaagcctagaggtctcatttcagggcgcattccaagctggcttggagttcccctgtcccagcccacttcacctttgcttagtggaggcgaacacctttcctagtgagcagggagcagacgcgagtaagaaaacagtgaaggaaccatctcctacccctcttgcctggagggtcccgggctatttcacttcttccttttttcactgttgtctctagcgctggccattgattccttaattcttgaagtaagattttagcagtgcctgagactactttgctgggggctgttggggatgtgaagatggtaggacgaggcccttgctttaaagaacttccaatctggtgttatcagaagaccctaaaagaaggaacttttttttaaaaaaaatggagagtggatggctacagcgctggggaagagttttctgactcgggacttttcctcaggaaacgaaaacactgaagaggtccagtttctcttccctggggaagggctcttgtctgcaaagatcagattccaagtactataatgttttgcaaggaaataccacttcctcaccaactggtggtctggacggcactctggggtttggggctggggcatcagtcccctgactccccggcctgactggagtggggagctgtttcagattcccagctggcctctggagtgcccacctcccccattggtattttgaattgaatgacatggccatcagagagctccaaggatggctccccggggttcttggcaggaggtttggttagccagctcccttccaaacctcagattctgcaaggttgggaaatattgagcgtgaatttgggggagcaaggtgtttttgagaattccaaaggatcaatgcaaacagtgagattgagcatctgtactaacctcccctgaagtcagagatggaggattacctgagggcagggattcttaactgggttcattggcattaggcatctgtagatggaattcagaggatgtgtaaactaggtgaggcaaaaaaagatatcattgtttttcaccaacctttaacagattttaacatcacctttagttatgaagacaacaaatcacagtagcattggcagtacctgtgactttgccattaatagaattcatagtttcatatcacactgcagtcacagcagtcttgaaatgttgtttacactcagcccttgtgtgaaattacccactgctagaccctgcttaatgttaataaagaagcatatatattgctatgtttttatatttttagaactttatttcatataattgacttttttagtgatcttcttaattttattttatgctcaagaaatgtgaactgtgagccaattcacagctggtagaaacttccaccaacccccacctggagctggagatgggcaaggtggaggaagggccgcttatgcccagagtcaacccctctctgtttgactttgtaagaaagtgccaagcctctatggggagggacggtgtgtcacggaggactggggaagggcagggctgcaggctctttgggagacccagagaacaagctcccaatggggcggggggaggaagaactgtcccctcttagggcccctcagcctcagcctgggcagaaaatgaggtggtcagcctggagcactctggggctagcattgtttggaaaaagggtgtgtacaggaatgtgaaggtgtgctgggtgtgtgtaccggagcagtgggggatgctgggggactccagccccatgagttccgctccacaggagatgcctggtgaaagcaaacttcctctgtcatccctgcacttgggggtagggagtggggacaggactttttaggggctgggggaggggaagcaatccagacatgtattgaggcactggaatctgggtcgggggaatggtgggaagatcagagagtggggggaaagggaggtggtaagatgaagacttgaggggtgcagcctgctggggacaggccaggcaacagtcagcgttagctctgcttccgccttgaaataggctagattccagtttcccatttgcttgggggtcggtgggatgggagatcttgaggcttattttttataggaaataagttccattttggtctctggctccttgcatttggggagtggacttagggtctggggtcacagtggacctcctgtggagtaggaaacaggacttgggctcaggtcagtgcctgtcagtgccccatgaacatgcgttgctgggggatggatgtaaataatcaacagagaagtgatggcctcgatacccttgggggacaatgtctgggataaaaagaacagcctgatcctctctctctaggattctagaacttctgcatattggaattccagctgccttgcctgaggttttaaaatcctcactcgggagagataaaacccaggccttggtcttcatttccatatgtggggaagagcagtgacccatccctgtcagtttgtaaatgtcctgcttgttttttccatggacagtggacatttcaccttgcttccggggtgcttaacaggcctcaatttctggaaagagaaactgaggtcaaaggaaggcagggagagccagggtcaggacaggagggcacgcaggtacctcacagctcagaatgttgtactagggtctcttgaggccatgaagacatgactcttgttgttgtcttctttggggattcctccatgggagcccctttttccctgctaccctcctgccccccggaagtgcagaggcccaggagctgcctgctggcaccagttgcacgggattagttcagggaaggacttgctcacctgctcctcccctctgactcaagtcataacaagtaacctggttcccctggcccggcagcctgggagggacggcaaggtaggcaggtgagccgagacggacggacggccagcagctccgtcagctggagagagagcacaggcctgtggcttgggagaccctgaggcgacatgtgagggccctgagccccctgactggaagcaggggctgtttttcaactcctggactaaagcccagaagcaggtgagggcgggggaggtggaatgggtctttggggctgagagcaggctggcctgggagtggaggagcccaagcagtggccatcacccccctccgacccccacccccgccagcctatgtctggtgtgtagggatgacagaggggtgctggtgggcttggacgggagcctgttcttgtggttgcctaggccttagtttccaccagagggagagcaagcagagatgagctgggacaggcaggcctgagacctggctttgggggacacacttgggatagaggaggatcccccatggcccggcctgagggaaggtgctctggagtttccctccctccctctgtgccccttctggtctcctctgcctttttctggggacattgttcagccgggtgggctgctttttagggcccagtactggagcttgaagaggcccaggagggatccctgtgttagggagggggtggggatgttacctgaactgcctttatctaaaagcaatgccttagacacttaagactcatagcctcctgggtgggggtggtgccctcgctctcacctgttgactctggggcaggttccctacagctgtggagggcggcctcggcagaggcagatgtgagggtccgctatgtggctgtacgggtttccttcttggcctgacattgaccaagaggtcgagattcagaccggggacctggaaaggctttagacactgtgcagtctttattgtgcacaggaggaaaggaagccccgggaggcctggtgacttccccaaggtagtacagaccgcagcagaaccaagccttgagcccacagccaggggctctgggcatctgacgctgttctctttgctctacttggggcagcaagtcatcccagagaggacccagcatcaggctgggaccactgggaagatcagtgcctcccctttgatgctggcagtcagagactgggctgagctgggagaaggggaagctggcggagacgggaggcgtgctaaggtacccctctgtccctgtaagtccccactcctctgcaacagtctcagagcccctgagaagcaggggctgagttggcccaactttccaaggcaactacttagtggttaataattaattagcaagcgtgactaattaatggcttcccctcccacattacttcctcctctgtgcaaagcagacacactcagcatgctagctgagaccaccttgcttcctacctctggctgcaccctgctcttggcttctggggagggtgggaggatggctagggtgggtgggaaggggtgggggtgagctgcctgctcctctgtcctgttcttatctctacgagggatagagtttgggacagatggacagtgcagagctaatagtcatcctaagtatcctgcggggtggggttccagaatatatggccaatctttcagaactttggcatgtttgcaaaggcctcccataaagttaaaaaaaataattctcccatgcattctctagacttccttgaataattgaaattccaaagtgcaaggtacatgttgctttcagggctttgtgtttgattgttgctgcctgtggttgctgtgttgtttatgtaggtctataaaagttcttgatcgtcctgctcttatcatcttgatgggtggagaggtatcaccagggacctggctgacagcagtcccctctccctgttggccttgctttgttaccagctttcccaaggccgacttttctgtcgtgttggctgcctgaggaggggtggagctcacctcccccaccctgcggccccgcgctctgaggaggcaggataggctccagacagaaactcggaaggacttttggactcttgctcaatgggctgactcagtgaggaggtggctgagctctctttccagacccaaccacctgcatgggctccgcccacccctcccacccctgctgcagccagcagctgccaggccctggccagctgggaccccaaccaggggtgtgggttggtgaggagggagagggggtgggcacaggtgttatctgggtgactggtccctagctgagccgacacaatgggatggcacctgtaccacccaagtgttctccaccccgaagcaggcagaggagcaggtgatctcctttctgtccttgcacagcttctgctctagtcactgcttgcccctctcctgtcaactcttggcaaccctgatagacacagccctgggtctcccctggctgtggggtgtaggggatctaggctgattccccttcagtggtctcccaggagtaattgatggcttgaaagttgtttgagggctttgggacagctctctggcatacagtggctgcacatatctgcagatgatgtgaagttcagagtccagggcgccaattcagagagtgggcgtcctggacttcggaggccccagaccagggccttggccatgtgcctgcccacttcttgaagtgtcctcagccactggggcgtaggacatgcctcacacctcctgggttcttgggttgaggatagctgtgtcccataaagatgtcttccccttcctcctttcttttttttttggagacggggtctctctgttgtccaggctggagtgcaatggcgtgaacatggctcactgcagccttgacttctccaggctcaggcaatcctcctgcctcagcctcctgagtagctgggactacaggtgcacaccactatgcccagctaagtttcattttggagagatggggtctaagttgtccaggctggtcttgaactcctgggctcaagctatccttctgccttggtctccagaaatgctgggattacaggcgtgagccaccatgctgggcttccttcctcctttctttgttatcccatcccattttttgtccccttcctttttatcctgtctctgctcttttccttcttgcccttctccccagtcgagcggttcttgtggctaccacagctgtcgacccccttaggcctagaggactttggcccagaggggagttaggctgggcccctgagagcccactgagaacagggtttgctggtgaggcccacagccccttctctaggtcagcacccccagtgccagaatctcctgccccagatggttcctgaagcacagtcctcccttccactcccctgctctcaagcatctattcagctttttgtaaccaagatggttcatatctagcttttttgttattgttctcttttctctttaaagctggggaagctccaggctacctacacaacctggcccaggctggtcacggtgtcccccctccctgctctgtgccctctccttccagaaatccaccatggagagtaaggatgaggtcagcgacaccgacagtggcatcatcctgcagtctggtgagtgttcagggaaatccccctgccctagtccctagtccctggtccctggtccctggccctgactcctgagtcctgagccctcaggcactagggctggctgggctgagactcccaagggctgagaggaaggggagggagaggcctctgctgggaggagggggaggttctggaagggctggagcctcagggacatgtggagttttcctccctggagaaaactggcttggagttttggttctatctggaagagggatctgcaatgttcaactttagccccagctgagaagttgaaaaatctcaggcaggcacagtggctcatgcctgtaatcccagcactttgggaggccaaggtgggcggatcacaaggtcaggagatcgagaccatcctggctaccacatagtcccagctatgtgggaggctgaggcagaagaatcgtttgaacctgggaggcggaggttgcagtgagccgagatcgcggcattgcactccagcctgggcgacagggcaagactccgtctcaaaaaaaatatatcatctggccaatgtgaaggtcttgcctctctgtttggccagacctgtgggcctagtctggcctagtcttgacagaggacaagaaagaagaggcttatgtgtgtgtgcaagagagaggggtagtggggagagggagagagagagacaggaagaagaaggagaaggaaaagaggaagaagaagggaggaggagtggggggaggactgcaccggcagaactccctcccctgcactcccccaccataggtcacctggtgggacgaccctcccttctgagttgtaacatttgtgcagccaagagacgtggtgttttgtggctgtgacacaggccacagcagccagcctgcaatttgtgggcaggcatgagatgtgtgtgtgtgtgtgcatgtgtgtgcatgtgcattcccctaggggtggtcaataagtaacggaggaggcttccatcttcagcctccctgagcatgtgccccccaacccttgcaggccccgacagcccggtctccccaatgaaggagctgacccatgcagtgcacaagcagcagagggccctggaagcgaggctggaggcctgcctggaggagctgaggagactctgccttcgggaagcggtgaggccccagccagcacacacaagcatcgggttcatctcaggagctgtggagccacgtgtggggatgcgggagctggggagagggagccccattcttgagggaattctggacatcaggctgggggctggggcccagagtccccatgatgcagtgtttgaccttgtgctggatggagaagagtcagacccaggcaggggcccaggcacagagaacaaagttcatcaggggctgcagagggactgcacagacataagtgcatatgagtgctgtaacccgggtcggtgtagctctggaggaagtgatcagaaagaggtctgaagggaaaggggaggagtgcagagtgggtctgaagacaggagagacagtgtggaggatgggatgaggtggggtggagggtggtcccaccagggcttctatggaaggcaggcacatgcagtgcaggggccagtgagccaagtctgggcaggtggagaggacctggctggtctctgcttcctccccaggagctgacgggcaccttgccagcggagtatcccctcaaaccaggggaaaaggcccccaaggttcgccgcaggatcggagcggcttacaaactggatgactgggccttgcacagagaggtgaggaacctcaggaagctgccagtacccctcgatccccaaagctgatcactgagacgccacacctcagctcagtaccctggcaggttcccttccaccctttcacacccagtgagggtgcttggctgcctgttggtgagagacaccatgaatatgtagcccaaatggctgtggagaaggggcgccactaaggaaccgagagctgggagctcaagggaggacactgggtttgaccccattgggcagaagatcagttaagagcaccagccaccaacccagcgggcaatagcctgctcagacaggttactctggcccctagggctgtcctcctttctcaggaggaggtgggggcagtcaggccctgggtgcccttcccctgtggcgtcaatggcagcagtttcccatgggccagcctgccccaccctttggggtcaggagggaaagtgtcccacttgggttcccaccctgcccggttcagcaggtgggctggtgggtgggtgcccatgccagcttttcaggctgacaagtttgcttttcggctcctcccactccttcaccctctgctccacgtccgtccattggtgctgctgtctgcctctcttctgtcctcagggcttaggactgggacctagagcactgtgtcagggctgctgtccaccctctgggcccccaatctccctgcctctctctagcctcactcctgccccctctctcaggaccccctaagcagcctggagcgccagctggccctgcagctgcagatcacagaggcagcccgtcggctgtgcctggaggagaacctcagcaggcaggctcggcggcagcggaagcactccatgctgcaggaggagaagaagctgcaggagctccagcgctgcctggtcgagcggcggcgcaatagcgagccacctccggctgctgctctccccctgggccgaggtgagccggctgccctgaggggggccatgctccttaaatgagcttttgagggatggtgggcgcacagccccgtgccactgcctttgcatttggctccagctgggtaaagctgattcttgggttcagctccaccccatcctgattctctccaactccagcaaggcttccccatcctgtgaggtcttcttctccgtctccttagaaaacaccctactctctccttccgtatcctcctcaaaatacactaccttcaagagacttcctacacagagatatttctcagctgaccctgagctgaatccaaggtgtattcaactgggtagcccaggctggccccgctgccctccaggcccacagggtgatggcatctctgggtcagggtagtgtgaggctcccgtgagcccaaggctctgagttgatgtgtagtcccctggcctgagttaggcagcaaagggtttgacgattgctatgtgttactgatcactgaattgtttcaggggcccacagctacttaggagatgttcaggttgaaatccagcaggactggtgccacaccccacagccccttaagtatctacaaccaccctggtcaagggtgggatccttccatgtctgttctctgccctccttgtgtctgtagttcaatccctgagctccttggcccagagactagtggccgtgggggcacctagtgagttgttgatgcccaggtgctgccacatcacatcagtgtgtccaccacaggttagcttccaacaggtggttctgagcccttaggtgtgactgttttcctttgtcctgacccaaggccagcctgtcaggtcaggacttgcatctctccattccaaaccccaccgcagcaggcccatgactcagctctgccccccgtctctcacatgggacccagacctccctggctgcctcagagggaaccgggagggaatgaggccgtggccctgcaaaaaaaaatccagaattggattcagaggtctcggccttcattcacattctcaggctcccatccctgcatatcgtgttggctttttgccaagactactcctcagcctgggagcagtcatggggaagctggaaagcccttgctagtccctgtgccctgcagcctatgcctcaggcagggagttatctcagcacaggtctcagaagtccctgctcctatccatggcttttaatttagggtagaaagtgcatgaccagacaccacccaggtcacctcccgcagccaagagtaggtgataaaggaggaggtgcctccatgtgacagttaacccagtaaactcagaagacagtggggctgacccagggaaaatggccagacctctgtccggttccagtggttctggcttggccgcagaacaacactcccagtctctgaggctctaatggaagacaagttctacaaccttactccactctcaacagggatcccaggacttgacagcaaccttgaaaggtagctgctgaattggacatggaagcccctaagggccaacttgctctgtgcctgcagggagaggtcagggtggtgagatatgcccgttggttgcagcgcctcctgctccccggtccagcctcacactgctcagcagcctcccctgcccaccggggctgccattgctgggagcttctgcccatgatgggtggcaggggagtgtcaccctgatgctgccattgtgacccataatgcttcttgttgggagtcgggagcaggccaggactggcctggggctctgtggaaggcaggaggatgaggttctgaaaccttggagccctcagtacaggtgaagacagagctgtggagaggagacaactggtgtagttgctgactttcccacatcaggaatcaagatcccactggccaacttcaggccctgggatctaaagtcctgttgtgagagcacagaagggatcagttctagacaagtaatttctgttttgtggctcctctgcccagccgagccctcctagaaaggaggaagtaaagcagaattattagtagctgaggtgttttgaattaaaaagggaaggccggacactgtggctcatgcctgtaatcccaatacttttggaagccaaggtgggcggatcatgaggttaggagttcaagaccagcctggccaacatagtgaaaccccatctctactaaaaatacaaaaattagccagacatggtggtgcatgtctgtagtcccagctactcgggaggctgagccaggagaatcccttgaacctgggaggtggagcccaggatcaagggagccgagatcgtgccactgcactccagcctggcaacagagtgagactttgtctcaaaaacaaaaaacaaaacaaaacaaaaaaacaggaggccaggtgcagtggctcacacctgtaatcccagcactttgggaggccgaggcgggtggatcacttgaggtcgggagttcaagaccagtctgaccaacatggagaaaccccatctctactaaaaatacaaaattagccaggcatggtggcgcatgcctgtaatcccagctactcgggaggctaaggcaggataatcacttgaacccaggaggcggaggttgcggtgagccgagattgcaccattgcactccagcctggtgacaagagcgaaactctgtctcaaaaaaaaaaaaaaaaaaaagggaaaaaagcaaacaacccaaaaaccgaaataaaaaaccaccctgcccccttgggctccatacaagggtaatttagtttgggaaagtaactgctaggtgagagtcatcagccatactttgcagtggcagggagcagtcaggtgttgagctcatttactagagtgaaccgcatgagggccacccagcacccacctgtgcaatgtaataggcactctggatgcatctgttgatcaacaacaccagccattagccacatcctcataacattttttttttttttttgagacggagtcttgctctctcatccaggctggagtgcagtggagccatctcagctcactgcaacctccacctaccgggtttaagcgattctcctgcctcagcctcctgagtagctgggactgcagatgcgtgctgccacgcccagctaatttttgtatttttagtagagatggggtttcaccaaattgtccaagctagtctcgaactcctgacctcaagggatcctcccgccttggcctcccaagtggtgggattacaggcgtgagccactgcgcctggccgctcatagcatttctgagatggtggaagtgttctgtatctgtgctgtccaatacagtagccactcgctgcatgtggctatggagcatttgaactgtgcctagtgtgactgaggaactgactttatttagttttaatgaaaatagccacatgcggctagtggcaactgtgttggacagcatagccttgggggaagctcagcatttgtgagtaaaatctccaccgttacccctctgtctggggtgtcctgcgatgctgctgcggggcaggggaacgctgagctagggcagggttgggacagttgctgagatagtgagcagctctcagaaacctgaatctttttttttttttttccaatctttttagagacagggtcttgttctgttgctcaggctggagtgcagtagtgtgatcatacctcactgcagccttgaactcctgggctcaagtgatcttccttcctcagcctctagtagctgggactacagtcatgtgccaccacacccagcaaattaaaacaaaacaaaacaaaaaaactattttagagatgggatcttgctatattgcccaggctggtctcaaactcctggtcttaagcaaacctcctgcctcagcctctggagtaactaagattataggtgtgcctggcccaatgaaaatctttattcctaaggtttttataaaagatcaaaggcaggagaccagaattcagtaagagggggtctctttaattgaaccctaaagcaaaggctacttgtgagccaagcaaagcatgggctggctggctactcaggagtcaagcccagctcctggtaccgtatgtcctagaaatctactgcctgctctgggtaaagattttttcattaaattgcggagcaggctgagcatgttggctcaagcttgtaatcccagcactttgggaggccaaggcaggaggatctcttgggcccaggagtatgagacctgcctggaccacacagggagaccctgtctctacaaataactaaaataaaaaaattggataggcatggttgtggacacctatagtcccagctactcaggagtctgaggtgggagattgattgagctcaggaggtcaaggctgcagtgagctgtgatcgggccactgcactccagcctaggcaacattgtaacaacccatctttaaaaagatgggttaaacctttgtggagcaaaggttaacaaacttttccataaagagccagacagtacatattttagtctttgtaggctctttggtctttatcacaactgttcaactctgctacttcagtgctaaaacagccagacattacataaacaaattcatagccgtgttccaataaacatttatttacaaaagcagctattgaactggatttgacccctgggccatagtttgctaacctctgttgtaagggatttcaagatggttggaactttttactttttttgaaacttcctgggcaatgcccatgcatttgagatgcaagctcacaggggagagcccataaagggttgtggttaagagcagactccagtcagactgtctgggtgtgaattctgactcaaccacctttgttgaatgtataacctaaaccacgttactcaactcctctgagacgtggtttcctcaactgtcacttgcaggtgataatatctaccttacgtggttgttatgagaattacctgaattaatatatataaagtgctgtatttagaaatgtattggcacagtagaaacattagcaattattactttttcctcatcttcattctcaaacacagttgaaaatgtttcgtgagttccatccaggtcactttaggcttattctcaagatctgaaggcctggccgggtgtggtggctcacgcctgtgatcccagcactttgggaagccgaggtgggtggatcacctgaggtcaggagttcaagaccagcctggccaacctggcaaaaccccgtctctactaaaaatacaaaaattagccaggcatagtggtgtgtgcctgtaatcccagctactcgggaggctgaggcaggagaatcgcttgaacctgggaggtggaggttgcagtgagtcgagatcacaccactgctctccagcctgggtaagagaatgagactccatctcaaaaaaaaaaaaaaaaaaaatctgaaggcttaagtttcttcaaaagcaatagcacaaatgagttccctctgatttcttaggtaaaaagtgctgctataccatgaagtaaagtcacactgaatttccttcaggtgacttgccagatcaccaactgaagaaacttccctggggccagctggccagaccttatcttaaattcaaattcctaccttgcgttcctcttgttgttggtaacacaggaggtctcacattgggatctttgaattgtgtttgtgatgtgagatgattatacaaaagttagagtgaaattcccttttttttatttgagacagggtctcactctgttgcccaggctggagtgcggtggtgtgatcacggctcactgcagcctcgacctcccaggctcaagtgatcttcccatctcaggttcccaagtagctgggactacaggcatgcaccatcatgcctggctaattttcgtattttttgtagagaccagatttcaccatcttgcccaggtgggtcttgaactcctgggcttaagccatctgctgccttggcctcctaaaatgctgggattacaggcatgaaccaccgcgcctggccatgaaattctttttatcctaagggccttccaaaatgaccctttgtctttcctttccactaccaagaagccctgccagaggacaccctttttctttttttttgacaggtggggaaactgaggtctagagcattgaaatggtttattcaaggttgcatagctagtatcagagtcaggattaaaatcaggtttcctgtctcctagctctgccttctatttttttctacttccatgtagtaagtttacagccaggccaggcacagtggctcatgcctataatcccagcactttgggaggccaaggtgggatgatcacttgagcctaggagttcaagatcagcctgggcaagacagcaagacctcttctctacaaaaaaaataaaataatttagctgggtgtgctggcatgcccctgtggtctcagctacttgtgaggctgaggtgggaggatcccttgagcctgggaggtcaaggctgcagtgagccatgatcacaccactgcactccagcctgggccacagggtaagaccctgtctcttaaaaaaaaaaaaaatcactcccaatgtgtatttagcacacagagggtatttcctcataactgatgctgtcctgggggagtgatcaggcctgagctgctcagcactgctggttactcatatctgtttgttcatttcttcacttccttctcttctctcccctttgtctttcgcagagctcagtgcctctgatgacagctccctgtcagatgggctcctcctggaggaaggtgagaaggacgtttgggggactattgtcaaggctggactcctactgcaagaccatggggtttgggcagtttgctggtgtggaatttaagtgggagtgaaggctagggtgccaggcttagggtttccgcttggacttcatgtcaatttccgcatgtccttgcacatgctcagttgaagatggggaatgtgcgatcatctcccattctggaagctcattatttttacagggaaaggaaaggtgaactccaagagagctgatcaaccccagatgtccctccttcacccttgggtgtgatttcaagatgcaccagtcagagccaaagagcaatctgcccacaatcattgctgttttttaaaagaagggagcaggaaggaaacacaagtctatagattaagaaccctgtgtacaaaccatgaggatgccagggtcaaggtggatcgagaagctgttgcagtcctgcccaggggagtgcccaagccaataaggaaataaataggccatatgggcatggcaggaacaagaaaaataggtaaacaaaagataactgcagacatggtaccaggaacaaaggttagaaagtggagcactgtaagcccaagagagtcaatctgggaggcttcttgaaggaggaaggcataaaatagggctgtgtgggaagaagtaagtcccaaaggagaagaaaacatgtttgagcatctagggctggagccatggcctgcagcagctgcacaagccagcatgggagggagagcggcgaggcatgggctgtggtttgtggaggttcttgttgggccggttcccccagcctctggccttaccaggtttcttttactcctgcagaggaatcccaagtgccaaaacctcctccagagtctccagccccaccttctcggcctctcccaccccaaacccttgagggtctgcagccaacaggacctgaggctgggagcccagaacgggctccagtccagaacagcccctggaaggaaaccagcctggaccacccctatgagaagcccaggaagtcttctgagccctggagcgagtccaggtcaggatcagggggaagggagaagggcagggcagggcagggagtcggtgggagctatgctggggatggctataggctgggcagatggaaaagtggaaaggtggaggagagagctcctgcagtcgtgggatggaggtgtgagccttgatagttccccaagggtgctggcagtttgccctactaactttgggagccccttccactgcatccccattcttctgcacctcttgagcccctgaatggaggcattcctgccactgacctgtctctaatccttttgcagcagcccagccaccacaccacaggatgggcccagtgcctccagcctgtggcttctggagcctgcctcctaccacgtggttcccatccgtggtgttcctggccagtggcagggccgcaccagtgccccagccacccctgagatacaggggaggaggggccagtcgcagtctctgaggtaagagacagcttccccagagagatgggggacccacttagagcttatcgttggagggtgggagctcccaggacacaggtgggacaaccctgggtgacacatggctagtgccttgacttctcttaggatctcttcttggggcgcctcttgacagagaatgcactgcaccccactaagccaaaggccatccatgaagcaagtggttttcttccaaagactctagttttgtctttttgcataacttgattcaaattttctacccttgccatgtttccttgtgctggtagattattattggtcactgacaataggcaactcactttttcaattgatgcacagttgattctcattatctgtggtagttatgttctataaagtaaaattgacgcaaatcctgaattagcaaatactgaacccttgcccctggggaaatatagggttaggttcccgtgagcctttggtcacgacattttgcatcaactgattaatatataaccttatgttatgtgagtttctgcttaaggacaccttacttaatatgggttgttgattcattaactcatggccaacagcactgtaactcatacccagatgaagcttacctagcacacatattttctccacaaggcacaccacagccttttcccagtatgccttagggaggaacagtagacagcactttggcactgtatttgggggcattttaaacagcagaatcactaatcaaagcaaaaacacacacagtacataaatatgccacaaaaaggacactgtgcacttacagcatgagaactgaaacatgagggcagaacatggcctcgtttaacctcagaacttaaagagactcaaatttgtcacttttctgcagtgtccaagaatgaccatgaaagcactgtgtatattgctttggggattaaaaataaagtttagcaactaggaaaattacaaatactgaatctgcaaataatgagaattgactgtatgttactttctaagtcatctgctacttggtaatagtttaaatggctaagcgttgacaggcagtattggccataccatatggggactggggcaccatgaaagcactgctgaattctccatcagcttaaattggctggtcaggcagcactgaactgggggcagcttgggacaactgctctcaagtaaagcaatggattttgtttaatttttaaattttttttgaggcagagtcttgctctgtcatccagcctagagtatagtggcgcaatctttgctcactgcaacctccgcctctcaggttcaagcgattctcctgcctcagcctcctgagtagctaggattacaggcgtccgccaccacacagcaatagattttatattttacatgctacgagggccattttacaaaccatgcctttgtgcaaattaggaaaaggcagacacagccccatacctgggtgcattagtagagtgaagtgaaggctggatttcagcccctgccggtcttgggctgcaggtaactgctctgggtaccacatgacagcttttacacgttcaagtaaggtacctggcagtgcctaccgaacagatgctgtggatgatctgccactggacacggtgtacctaagctgaaagtacttaatgtagtactttaaaaaaagtagttaatgtagtactttaaaaaaagtagttaatgtagtactttaaaaaaagtacttaatgtagtactttaaaaaagtacttaatgtagtactttaaaaaaagtacttaatgtagtactttaaaaaaagtacttaatgtgctacttgatgtagcacactttacacgaatcacaagcttgtgaatgcagcaggaacacttttgcacacagggaaggaatgcgttggcacccacgcagcccggcagagggtttgttggtttgctttgggagacttgacctaagacccttgcacgagggccatgcttgggccttgaggtagagcaggactcacctgttttaactccacctcccgccccaaccccagtgtggagtttctgccccccacactcagaatgcctctctttccctcttcagggtggattccttccgggcgggtcctgagggccgaggtcgcagcgcctttccccgccgccgccccactcactacacggtgacagtgccagattcctgctttcccgcgaccaagcccccgctgccccacgccgcctgccactcctgctcagaagacagtggctctgacgtctccagcatctcccaccccacttcgccgggcagcagcagccccgacatctcctttctgcagcctctctcccctcccaagacccatcgtcaccgcggggcctgggtcccagccggcagcagagagctggtcgcccaccaccccaagctactgctgccgcctggctatttcccggcggggcggtacgtggtggtggctgagagccccctgccgcctggcgagtgggagctgcgccgcgcagccccgggccctgcttacgaggaggagggcactcccctgcgctaccagcgtctggtgccctcccgcagccgcatcgtgcggacgccctccctgaaggacagcccggcaggccgggggctcagcaaggccgccgtgtccgaggagctcaagtggtggcacgagcgtgcacgcctccggagcacccgcccccactcactggaccgccaaggagctttccgggtcaggagcctgccccttgggagagagggcttcggacgagccctgggaccccgggcacaggtacggctgctctggagggaccccggggccaggcaggagggctgttttgttggggaggggctgcaattctagtatgtccaagggtacagaggcatcaaagcagcaacctagtggccgggtaatccccgtctaggaagaacaggccaaaaaatcatttcctcttggctttggaaggcactcttggcttccctggggcacctcctaattttgcctgccatgtctagctcaagagcatatacactggtggagatgatccccgaagatagctgagactttttctctccctaaatgatgatgcacaaagcagataagcctcttcataatcaaaagtccagtccaaatcagcccctcagatttccatttgaaggtctaggacaaagggagagtaggaaatgagttgcagaagccagaacctgtgattttctgggcatcagcatcctccctgacacccctcctcaccaccaagccgagaagaagggtggcatcagagttaagagcacccaccctcaagctagaccaccaggttcaaatcccagttctgccacttacgagctgtatgattgggcaagttacttaacccctttggacctagtgtttcctcccctgtgaaatgagagtagtagagtacctatctcatagggctgccaagaggctgaaatgattagagcaatgcatggtaagcgctagatatgtgatattattatcatctggggccacagaggccagggagcaggctggagggtagtatataggatagagcaccctgacactgggtagggtggcagccttggtttccttggcccctatttcttcattctggaagtggggagccacacacaggaatcctttctttattctttctccctggtacggagggctctgcaggtgatgtgctccagaagttaccaacaagctgcttctttgagaccccagattcccagcagacccagctgcgtgtccctcccccacccacggttctttggactgcagctggcatcctgggcctggcagcaccctggccccggtccgaggccgcgccctccagctgacgtgcttttccctttctgcgcgcttgggcctgtccttggctggatagacccagcccatcccaacgtgccagacagggagggtgatgagaagtgagcccaggaaaggtgggggaggaggaggtcagggcgcctgtcacaccccaaaagaacatggaggaaaatgtgtaaagggggtccctgaagaacagagagcatcctgggaggaaggggctgagtgccagggcctgctgctgctgctgcttctgctggtcagtgtccctaagggataaggatggtgtaactgtgcctgctgtccccgcttttctgcctggttcatttacccacctgtcctttcttcctgaccctggcaggtgcccacagtttgtgtgctgcggagatcgcctgatggggcccctgtgcaagtctttgtacctgaaaaaggagagatcatcagccaggtgtaactctgcgccccacgctggaaaaaactgtttcatagaggggctgggctgagacccccccacccctgagtgcctctttcagctcccccatccccatcgcaggccgatgacctggagctgagaccttttattattttttttttacacgacttttttcagaagccctgacctaaggatttatatatgtggattgtcctcaatacccctgtgatatgattatgttttatcccccagagtttggcctactggacttaaggccttgcctgtctgactgacagcctctatctccttatataagacaagtggcaggggacgagtgaagcagagtgagccaccttgggagttctccaacgctctgtgctctggttctaagaaattccctggggaactgcccctggccctcctgtcccactattgctggaggctggacatggtacatactcatgcacatgactctcccccatttcccaggtctctgggtaccccagcctgggctgggggagaatctcttcccccttttctaatgtgctctgtgatgcacacaccaagtggtaggtcaaaggtcagtatatcccggtggtgtattgtcttgctagaccctgctattttcctgaccccctaaatcctctttagggacccagtcactataccctgtctatgccctgtgggctcccagacccctgagctttgagtcagtggcatcacagtttgtagcctcagggggtctggctgggggctggtccatgcttgtggttagtggacagcagccaccctttgacagctacctctgggcatctcaagggcttgcagccccactgctccttctaacattttgtttgtttttgagatggagtctcgctctgtcgcccaggctggaatgctgtagcaagatttcggctcactgcaacccccgtctcccgggttcaagcgaatctcctgcctcagccttccgagtagctgggattacaggcaagcaccaccatgcctgctaattttttatttttagtagagatggggtttcatcatgttggccaggctggtctcgaactcctgacctcaagtgatccacctgccttggcctttcaaagtgctgggattacaggcatgagccaccgcacctggcccttctaacgttttttcatcatagtcccaaaaaccaatactttacaagtggttttggaaaggcaccacttttgtggcatgttctggttgggagagggagtcacagttcctactccccccaccagctatgcttctgctctgagaaggtggttatttatacaaacatggacatactcactcccaagggctgatgagatgctgaattttctttgggggcattcattaattgtcccagctgcagcgactggagcaagtctggaagctgcctgtgctaagaccacccagctgtccctgggttctcatcctagggccttctttgcttccaggtcaggggacctgcttcaatgagaaagcaactgaattgaggctaggagaggtagggagagctgagttctgacttcacctgtgcagaactctctgcccccatgttacctggactggaacagactgtgaatatagcagaaggttccaagaactctggtgtctgacctagaagaggcacagttctctctactggaaagaaaacgatgtagccgattgcacaagggtgccaagggaagacccaggatggcccatcaaaggaacctgggggaggatgcaggaggctgaagggatgcacctggcatttctctcactgtgctcttaccgcatcagcaacccccaacttttgggcctactctgccccccatgcgtgaataccctgcttggatgctgtgcttttccggtttgtctctaagcccctttctccagggcatgttggtttccctggcctctcagtgtcctaactggagcccagagtgccttgttctgagccaggagacggctgagcactggccctccacacctaagcgtcctttacattaacttattggtcttgtataacacctggtgccattgccaagtggctgtgtcctcagctacagagctggaattgtgtggggtttagtgctaaatacttcaataaagtctgttttttgtgattggctga

SEQ ID NO: 1991 - DNA, 20917 bp, Homo sapiens
gattagttcagggaaggacttgctcacctgctcctcccctctgactcaagtcataacaagtaacctggttcccctggcccggcagcctgggagggacggcaaggtaggcaggtgagccgagacggacggacggccagcagctccgtcagctggagagagagcacaggcctgtggcttgggagaccctgaggcgacatgtgagggccctgagccccctgactggaagcaggggctgtttttcaactcctggactaaagcccagaagcaggtgagggcgggggaggtggaatgggtctttggggctgagagcaggctggcctgggagtggaggagcccaagcagtggccatcacccccctccgacccccacccccgccagcctatgtctggtgtgtagggatgacagaggggtgctggtgggcttggacgggagcctgttcttgtggttgcctaggccttagtttccaccagagggagagcaagcagagatgagctgggacaggcaggcctgagacctggctttgggggacacacttgggatagaggaggatcccccatggcccggcctgagggaaggtgctctggagtttccctccctccctctgtgccccttctggtctcctctgcctttttctggggacattgttcagccgggtgggctgctttttagggcccagtactggagcttgaagaggcccaggagggatccctgtgttagggagggggtggggatgttacctgaactgcctttatctaaaagcaatgccttagacacttaagactcatagcctcctgggtgggggtggtgccctcgctctcacctgttgactctggggcaggttccctacagctgtggagggcggcctcggcagaggcagatgtgagggtccgctatgtggctgtacgggtttccttcttggcctgacattgaccaagaggtcgagattcagaccggggacctggaaaggctttagacactgtgcagtctttattgtgcacaggaggaaaggaagccccgggaggcctggtgacttccccaaggtagtacagaccgcagcagaaccaagccttgagcccacagccaggggctctgggcatctgacgctgttctctttgctctacttggggcagcaagtcatcccagagaggacccagcatcaggctgggaccactgggaagatcagtgcctcccctttgatgctggcagtcagagactgggctgagctgggagaaggggaagctggcggagacgggaggcgtgctaaggtacccctctgtccctgtaagtccccactcctctgcaacagtctcagagcccctgagaagcaggggctgagttggcccaactttccaaggcaactacttagtggttaataattaattagcaagcgtgactaattaatggcttcccctcccacattacttcctcctctgtgcaaagcagacacactcagcatgctagctgagaccaccttgcttcctacctctggctgcaccctgctcttggcttctggggagggtgggaggatggctagggtgggtgggaaggggtgggggtgagctgcctgctcctctgtcctgttcttatctctacgagggatagagtttgggacagatggacagtgcagagctaatagtcatcctaagtatcctgcggggtggggttccagaatatatggccaatctttcagaactttggcatgtttgcaaaggcctcccataaagttaaaaaaaataattctcccatgcattctctagacttccttgaataattgaaattccaaagtgcaaggtacatgttgctttcagggctttgtgtttgattgttgctgcctgtggttgctgtgttgtttatgtaggtctataaaagttcttgatcgtcctgctcttatcatcttgatgggtggagaggtatcaccagggacctggctgacagcagtcccctctccctgttggccttgctttgttaccagctttcccaaggccgacttttctgtcgtgttggctgcctgaggaggggtggagctcacctcccccaccctgcggccccgcgctctgaggaggcaggataggctccagacagaaactcggaaggacttttggactcttgctcaatgggctgactcagtgaggaggtggctgagctctctttccagacccaaccacctgcatgggctccgcccacccctcccacccctgctgcagccagcagctgccaggccctggccagctgggaccccaaccaggggtgtgggttggtgaggagggagagggggtgggcacaggtgttatctgggtgactggtccctagctgagccgacacaatgggatggcacctgtaccacccaagtgttctccaccccgaagcaggcagaggagcaggtgatctcctttctgtccttgcacagcttctgctctagtcactgcttgcccctctcctgtcaactcttggcaaccctgatagacacagccctgggtctcccctggctgtggggtgtaggggatctaggctgattccccttcagtggtctcccaggagtaattgatggcttgaaagttgtttgagggctttgggacagctctctggcatacagtggctgcacatatctgcagatgatgtgaagttcagagtccagggcgccaattcagagagtgggcgtcctggacttcggaggccccagaccagggccttggccatgtgcctgcccacttcttgaagtgtcctcagccactggggcgtaggacatgcctcacacctcctgggttcttgggttgaggatagctgtgtcccataaagatgtcttccccttcctcctttcttttttttttggagacggggtctctctgttgtccaggctggagtgcaatggcgtgaacatggctcactgcagccttgacttctccaggctcaggcaatcctcctgcctcagcctcctgagtagctgggactacaggtgcacaccactatgcccagctaagtttcattttggagagatggggtctaagttgtccaggctggtcttgaactcctgggctcaagctatccttctgccttggtctccagaaatgctgggattacaggcgtgagccaccatgctgggcttccttcctcctttctttgttatcccatcccattttttgtccccttcctttttatcctgtctctgctcttttccttcttgcccttctccccagtcgagcggttcttgtggctaccacagctgtcgacccccttaggcctagaggactttggcccagaggggagttaggctgggcccctgagagcccactgagaacagggtttgctggtgaggcccacagccccttctctaggtcagcacccccagtgccagaatctcctgccccagatggttcctgaagcacagtcctcccttccactcccctgctctcaagcatctattcagctttttgtaaccaagatggttcatatctagcttttttgttattgttctcttttctctttaaagctggggaagctccaggctacctacacaacctggcccaggctggtcacggtgtcccccctccctgctctgtgccctctccttccagaaatccaccatggagagtaaggatgaggtcagcgacaccgacagtggcatcatcctgcagtctggtgagtgttcagggaaatccccctgccctagtccctagtccctggtccctggtccctggccctgactcctgagtcctgagccctcaggcactagggctggctgggctgagactcccaagggctgagaggaaggggagggagaggcctctgctgggaggagggggaggttctggaagggctggagcctcagggacatgtggagttttcctccctggagaaaactggcttggagttttggttctatctggaagagggatctgcaatgttcaactttagccccagctgagaagttgaaaaatctcaggcaggcacagtggctcatgcctgtaatcccagcactttgggaggccaaggtgggcggatcacaaggtcaggagatcgagaccatcctggctaccacatagtcccagctatgtgggaggctgaggcagaagaatcgtttgaacctgggaggcggaggttgcagtgagccgagatcgcggcattgcactccagcctgggcgacagggcaagactccgtctcaaaaaaaatatatcatctggccaatgtgaaggtcttgcctctctgtttggccagacctgtgggcctagtctggcctagtcttgacagaggacaagaaagaagaggcttatgtgtgtgtgcaagagagaggggtagtggggagagggagagagagagacaggaagaagaaggagaaggaaaagaggaagaagaagggaggaggagtggggggaggactgcaccggcagaactccctcccctgcactcccccaccataggtcacctggtgggacgaccctcccttctgagttgtaacatttgtgcagccaagagacgtggtgttttgtggctgtgacacaggccacagcagccagcctgcaatttgtgggcaggcatgagatgtgtgtgtgtgtgtgcatgtgtgtgcatgtgcattcccctaggggtggtcaataagtaacggaggaggcttccatcttcagcctccctgagcatgtgccccccaacccttgcaggccccgacagcccggtctccccaatgaaggagctgacccatgcagtgcacaagcagcagagggccctggaagcgaggctggaggcctgcctggaggagctgaggagactctgccttcgggaagcggtgaggccccagccagcacacacaagcatcgggttcatctcaggagctgtggagccacgtgtggggatgcgggagctggggagagggagccccattcttgagggaattctggacatcaggctgggggctggggcccagagtccccatgatgcagtgtttgaccttgtgctggatggagaagagtcagacccaggcaggggcccaggcacagagaacaaagttcatcaggggctgcagagggactgcacagacataagtgcatatgagtgctgtaacccgggtcggtgtagctctggaggaagtgatcagaaagaggtctgaagggaaaggggaggagtgcagagtgggtctgaagacaggagagacagtgtggaggatgggatgaggtggggtggagggtggtcccaccagggcttctatggaaggcaggcacatgcagtgcaggggccagtgagccaagtctgggcaggtggagaggacctggctggtctctgcttcctccccaggagctgacgggcaccttgccagcggagtatcccctcaaaccaggggaaaaggcccccaaggttcgccgcaggatcggagcggcttacaaactggatgactgggccttgcacagagaggtgaggaacctcaggaagctgccagtacccctcgatccccaaagctgatcactgagacgccacacctcagctcagtaccctggcaggttcccttccaccctttcacacccagtgagggtgcttggctgcctgttggtgagagacaccatgaatatgtagcccaaatggctgtggagaaggggcgccactaaggaaccgagagctgggagctcaagggaggacactgggtttgaccccattgggcagaagatcagttaagagcaccagccaccaacccagcgggcaatagcctgctcagacaggttactctggcccctagggctgtcctcctttctcaggaggaggtgggggcagtcaggccctgggtgcccttcccctgtggcgtcaatggcagcagtttcccatgggccagcctgccccaccctttggggtcaggagggaaagtgtcccacttgggttcccaccctgcccggttcagcaggtgggctggtgggtgggtgcccatgccagcttttcaggctgacaagtttgcttttcggctcctcccactccttcaccctctgctccacgtccgtccattggtgctgctgtctgcctctcttctgtcctcagggcttaggactgggacctagagcactgtgtcagggctgctgtccaccctctgggcccccaatctccctgcctctctctagcctcactcctgccccctctctcaggaccccctaagcagcctggagcgccagctggccctgcagctgcagatcacagaggcagcccgtcggctgtgcctggaggagaacctcagcaggcaggctcggcggcagcggaagcactccatgctgcaggaggagaagaagctgcaggagctccagcgctgcctggtcgagcggcggcgcaatagcgagccacctccggctgctgctctccccctgggccgaggtgagccggctgccctgaggggggccatgctccttaaatgagcttttgagggatggtgggcgcacagccccgtgccactgcctttgcatttggctccagctgggtaaagctgattcttgggttcagctccaccccatcctgattctctccaactccagcaaggcttccccatcctgtgaggtcttcttctccgtctccttagaaaacaccctactctctccttccgtatcctcctcaaaatacactaccttcaagagacttcctacacagagatatttctcagctgaccctgagctgaatccaaggtgtattcaactgggtagcccaggctggccccgctgccctccaggcccacagggtgatggcatctctgggtcagggtagtgtgaggctcccgtgagcccaaggctctgagttgatgtgtagtcccctggcctgagttaggcagcaaagggtttgacgattgctatgtgttactgatcactgaattgtttcaggggcccacagctacttaggagatgttcaggttgaaatccagcaggactggtgccacaccccacagccccttaagtatctacaaccaccctggtcaagggtgggatccttccatgtctgttctctgccctccttgtgtctgtagttcaatccctgagctccttggcccagagactagtggccgtgggggcacctagtgagttgttgatgcccaggtgctgccacatcacatcagtgtgtccaccacaggttagcttccaacaggtggttctgagcccttaggtgtgactgttttcctttgtcctgacccaaggccagcctgtcaggtcaggacttgcatctctccattccaaaccccaccgcagcaggcccatgactcagctctgccccccgtctctcacatgggacccagacctccctggctgcctcagagggaaccgggagggaatgaggccgtggccctgcaaaaaaaaatccagaattggattcagaggtctcggccttcattcacattctcaggctcccatccctgcatatcgtgttggctttttgccaagactactcctcagcctgggagcagtcatggggaagctggaaagcccttgctagtccctgtgccctgcagcctatgcctcaggcagggagttatctcagcacaggtctcagaagtccctgctcctatccatggcttttaatttagggtagaaagtgcatgaccagacaccacccaggtcacctcccgcagccaagagtaggtgataaaggaggaggtgcctccatgtgacagttaacccagtaaactcagaagacagtggggctgacccagggaaaatggccagacctctgtccggttccagtggttctggcttggccgcagaacaacactcccagtctctgaggctctaatggaagacaagttctacaaccttactccactctcaacagggatcccaggacttgacagcaaccttgaaaggtagctgctgaattggacatggaagcccctaagggccaacttgctctgtgcctgcagggagaggtcagggtggtgagatatgcccgttggttgcagcgcctcctgctccccggtccagcctcacactgctcagcagcctcccctgcccaccggggctgccattgctgggagcttctgcccatgatgggtggcaggggagtgtcaccctgatgctgccattgtgacccataatgcttcttgttgggagtcgggagcaggccaggactggcctggggctctgtggaaggcaggaggatgaggttctgaaaccttggagccctcagtacaggtgaagacagagctgtggagaggagacaactggtgtagttgctgactttcccacatcaggaatcaagatcccactggccaacttcaggccctgggatctaaagtcctgttgtgagagcacagaagggatcagttctagacaagtaatttctgttttgtggctcctctgcccagccgagccctcctagaaaggaggaagtaaagcagaattattagtagctgaggtgttttgaattaaaaagggaaggccggacactgtggctcatgcctgtaatcccaatacttttggaagccaaggtgggcggatcatgaggttaggagttcaagaccagcctggccaacatagtgaaaccccatctctactaaaaatacaaaaattagccagacatggtggtgcatgtctgtagtcccagctactcgggaggctgagccaggagaatcccttgaacctgggaggtggagcccaggatcaagggagccgagatcgtgccactgcactccagcctggcaacagagtgagactttgtctcaaaaacaaaaaacaaaacaaaacaaaaaaacaggaggccaggtgcagtggctcacacctgtaatcccagcactttgggaggccgaggcgggtggatcacttgaggtcgggagttcaagaccagtctgaccaacatggagaaaccccatctctactaaaaatacaaaattagccaggcatggtggcgcatgcctgtaatcccagctactcgggaggctaaggcaggataatcacttgaacccaggaggcggaggttgcggtgagccgagattgcaccattgcactccagcctggtgacaagagcgaaactctgtctcaaaaaaaaaaaaaaaaaaaagggaaaaaagcaaacaacccaaaaaccgaaataaaaaaccaccctgcccccttgggctccatacaagggtaatttagtttgggaaagtaactgctaggtgagagtcatcagccatactttgcagtggcagggagcagtcaggtgttgagctcatttactagagtgaaccgcatgagggccacccagcacccacctgtgcaatgtaataggcactctggatgcatctgttgatcaacaacaccagccattagccacatcctcataacattttttttttttttttgagacggagtcttgctctctcatccaggctggagtgcagtggagccatctcagctcactgcaacctccacctaccgggtttaagcgattctcctgcctcagcctcctgagtagctgggactgcagatgcgtgctgccacgcccagctaatttttgtatttttagtagagatggggtttcaccaaattgtccaagctagtctcgaactcctgacctcaagggatcctcccgccttggcctcccaagtggtgggattacaggcgtgagccactgcgcctggccgctcatagcatttctgagatggtggaagtgttctgtatctgtgctgtccaatacagtagccactcgctgcatgtggctatggagcatttgaactgtgcctagtgtgactgaggaactgactttatttagttttaatgaaaatagccacatgcggctagtggcaactgtgttggacagcatagccttgggggaagctcagcatttgtgagtaaaatctccaccgttacccctctgtctggggtgtcctgcgatgctgctgcggggcaggggaacgctgagctagggcagggttgggacagttgctgagatagtgagcagctctcagaaacctgaatctttttttttttttttccaatctttttagagacagggtcttgttctgttgctcaggctggagtgcagtagtgtgatcatacctcactgcagccttgaactcctgggctcaagtgatcttccttcctcagcctctagtagctgggactacagtcatgtgccaccacacccagcaaattaaaacaaaacaaaacaaaaaaactattttagagatgggatcttgctatattgcccaggctggtctcaaactcctggtcttaagcaaacctcctgcctcagcctctggagtaactaagattataggtgtgcctggcccaatgaaaatctttattcctaaggtttttataaaagatcaaaggcaggagaccagaattcagtaagagggggtctctttaattgaaccctaaagcaaaggctacttgtgagccaagcaaagcatgggctggctggctactcaggagtcaagcccagctcctggtaccgtatgtcctagaaatctactgcctgctctgggtaaagattttttcattaaattgcggagcaggctgagcatgttggctcaagcttgtaatcccagcactttgggaggccaaggcaggaggatctcttgggcccaggagtatgagacctgcctggaccacacagggagaccctgtctctacaaataactaaaataaaaaaattggataggcatggttgtggacacctatagtcccagctactcaggagtctgaggtgggagattgattgagctcaggaggtcaaggctgcagtgagctgtgatcgggccactgcactccagcctaggcaacattgtaacaacccatctttaaaaagatgggttaaacctttgtggagcaaaggttaacaaacttttccataaagagccagacagtacatattttagtctttgtaggctctttggtctttatcacaactgttcaactctgctacttcagtgctaaaacagccagacattacataaacaaattcatagccgtgttccaataaacatttatttacaaaagcagctattgaactggatttgacccctgggccatagtttgctaacctctgttgtaagggatttcaagatggttggaactttttactttttttgaaacttcctgggcaatgcccatgcatttgagatgcaagctcacaggggagagcccataaagggttgtggttaagagcagactccagtcagactgtctgggtgtgaattctgactcaaccacctttgttgaatgtataacctaaaccacgttactcaactcctctgagacgtggtttcctcaactgtcacttgcaggtgataatatctaccttacgtggttgttatgagaattacctgaattaatatatataaagtgctgtatttagaaatgtattggcacagtagaaacattagcaattattactttttcctcatcttcattctcaaacacagttgaaaatgtttcgtgagttccatccaggtcactttaggcttattctcaagatctgaaggcctggccgggtgtggtggctcacgcctgtgatcccagcactttgggaagccgaggtgggtggatcacctgaggtcaggagttcaagaccagcctggccaacctggcaaaaccccgtctctactaaaaatacaaaaattagccaggcatagtggtgtgtgcctgtaatcccagctactcgggaggctgaggcaggagaatcgcttgaacctgggaggtggaggttgcagtgagtcgagatcacaccactgctctccagcctgggtaagagaatgagactccatctcaaaaaaaaaaaaaaaaaaaatctgaaggcttaagtttcttcaaaagcaatagcacaaatgagttccctctgatttcttaggtaaaaagtgctgctataccatgaagtaaagtcacactgaatttccttcaggtgacttgccagatcaccaactgaagaaacttccctggggccagctggccagaccttatcttaaattcaaattcctaccttgcgttcctcttgttgttggtaacacaggaggtctcacattgggatctttgaattgtgtttgtgatgtgagatgattatacaaaagttagagtgaaattcccttttttttatttgagacagggtctcactctgttgcccaggctggagtgcggtggtgtgatcacggctcactgcagcctcgacctcccaggctcaagtgatcttcccatctcaggttcccaagtagctgggactacaggcatgcaccatcatgcctggctaattttcgtattttttgtagagaccagatttcaccatcttgcccaggtgggtcttgaactcctgggcttaagccatctgctgccttggcctcctaaaatgctgggattacaggcatgaaccaccgcgcctggccatgaaattctttttatcctaagggccttccaaaatgaccctttgtctttcctttccactaccaagaagccctgccagaggacaccctttttctttttttttgacaggtggggaaactgaggtctagagcattgaaatggtttattcaaggttgcatagctagtatcagagtcaggattaaaatcaggtttcctgtctcctagctctgccttctatttttttctacttccatgtagtaagtttacagccaggccaggcacagtggctcatgcctataatcccagcactttgggaggccaaggtgggatgatcacttgagcctaggagttcaagatcagcctgggcaagacagcaagacctcttctctacaaaaaaaataaaataatttagctgggtgtgctggcatgcccctgtggtctcagctacttgtgaggctgaggtgggaggatcccttgagcctgggaggtcaaggctgcagtgagccatgatcacaccactgcactccagcctgggccacagggtaagaccctgtctcttaaaaaaaaaaaaaatcactcccaatgtgtatttagcacacagagggtatttcctcataactgatgctgtcctgggggagtgatcaggcctgagctgctcagcactgctggttactcatatctgtttgttcatttcttcacttccttctcttctctcccctttgtctttcgcagagctcagtgcctctgatgacagctccctgtcagatgggctcctcctggaggaaggtgagaaggacgtttgggggactattgtcaaggctggactcctactgcaagaccatggggtttgggcagtttgctggtgtggaatttaagtgggagtgaaggctagggtgccaggcttagggtttccgcttggacttcatgtcaatttccgcatgtccttgcacatgctcagttgaagatggggaatgtgcgatcatctcccattctggaagctcattatttttacagggaaaggaaaggtgaactccaagagagctgatcaaccccagatgtccctccttcacccttgggtgtgatttcaagatgcaccagtcagagccaaagagcaatctgcccacaatcattgctgttttttaaaagaagggagcaggaaggaaacacaagtctatagattaagaaccctgtgtacaaaccatgaggatgccagggtcaaggtggatcgagaagctgttgcagtcctgcccaggggagtgcccaagccaataaggaaataaataggccatatgggcatggcaggaacaagaaaaataggtaaacaaaagataactgcagacatggtaccaggaacaaaggttagaaagtggagcactgtaagcccaagagagtcaatctgggaggcttcttgaaggaggaaggcataaaatagggctgtgtgggaagaagtaagtcccaaaggagaagaaaacatgtttgagcatctagggctggagccatggcctgcagcagctgcacaagccagcatgggagggagagcggcgaggcatgggctgtggtttgtggaggttcttgttgggccggttcccccagcctctggccttaccaggtttcttttactcctgcagaggaatcccaagtgccaaaacctcctccagagtctccagccccaccttctcggcctctcccaccccaaacccttgagggtctgcagccaacaggacctgaggctgggagcccagaacgggctccagtccagaacagcccctggaaggaaaccagcctggaccacccctatgagaagcccaggaagtcttctgagccctggagcgagtccaggtcaggatcagggggaagggagaagggcagggcagggcagggagtcggtgggagctatgctggggatggctataggctgggcagatggaaaagtggaaaggtggaggagagagctcctgcagtcgtgggatggaggtgtgagccttgatagttccccaagggtgctggcagtttgccctactaactttgggagccccttccactgcatccccattcttctgcacctcttgagcccctgaatggaggcattcctgccactgacctgtctctaatccttttgcagcagcccagccaccacaccacaggatgggcccagtgcctccagcctgtggcttctggagcctgcctcctaccacgtggttcccatccgtggtgttcctggccagtggcagggccgcaccagtgccccagccacccctgagatacaggggaggaggggccagtcgcagtctctgaggtaagagacagcttccccagagagatgggggacccacttagagcttatcgttggagggtgggagctcccaggacacaggtgggacaaccctgggtgacacatggctagtgccttgacttctcttaggatctcttcttggggcgcctcttgacagagaatgcactgcaccccactaagccaaaggccatccatgaagcaagtggttttcttccaaagactctagttttgtctttttgcataacttgattcaaattttctacccttgccatgtttccttgtgctggtagattattattggtcactgacaataggcaactcactttttcaattgatgcacagttgattctcattatctgtggtagttatgttctataaagtaaaattgacgcaaatcctgaattagcaaatactgaacccttgcccctggggaaatatagggttaggttcccgtgagcctttggtcacgacattttgcatcaactgattaatatataaccttatgttatgtgagtttctgcttaaggacaccttacttaatatgggttgttgattcattaactcatggccaacagcactgtaactcatacccagatgaagcttacctagcacacatattttctccacaaggcacaccacagccttttcccagtatgccttagggaggaacagtagacagcactttggcactgtatttgggggcattttaaacagcagaatcactaatcaaagcaaaaacacacacagtacataaatatgccacaaaaaggacactgtgcacttacagcatgagaactgaaacatgagggcagaacatggcctcgtttaacctcagaacttaaagagactcaaatttgtcacttttctgcagtgtccaagaatgaccatgaaagcactgtgtatattgctttggggattaaaaataaagtttagcaactaggaaaattacaaatactgaatctgcaaataatgagaattgactgtatgttactttctaagtcatctgctacttggtaatagtttaaatggctaagcgttgacaggcagtattggccataccatatggggactggggcaccatgaaagcactgctgaattctccatcagcttaaattggctggtcaggcagcactgaactgggggcagcttgggacaactgctctcaagtaaagcaatggattttgtttaatttttaaattttttttgaggcagagtcttgctctgtcatccagcctagagtatagtggcgcaatctttgctcactgcaacctccgcctctcaggttcaagcgattctcctgcctcagcctcctgagtagctaggattacaggcgtccgccaccacacagcaatagattttatattttacatgctacgagggccattttacaaaccatgcctttgtgcaaattaggaaaaggcagacacagccccatacctgggtgcattagtagagtgaagtgaaggctggatttcagcccctgccggtcttgggctgcaggtaactgctctgggtaccacatgacagcttttacacgttcaagtaaggtacctggcagtgcctaccgaacagatgctgtggatgatctgccactggacacggtgtacctaagctgaaagtacttaatgtagtactttaaaaaaagtagttaatgtagtactttaaaaaaagtagttaatgtagtactttaaaaaaagtacttaatgtagtactttaaaaaagtacttaatgtagtactttaaaaaaagtacttaatgtagtactttaaaaaaagtacttaatgtgctacttgatgtagcacactttacacgaatcacaagcttgtgaatgcagcaggaacacttttgcacacagggaaggaatgcgttggcacccacgcagcccggcagagggtttgttggtttgctttgggagacttgacctaagacccttgcacgagggccatgcttgggccttgaggtagagcaggactcacctgttttaactccacctcccgccccaaccccagtgtggagtttctgccccccacactcagaatgcctctctttccctcttcagggtggattccttccgggcgggtcctgagggccgaggtcgcagcgcctttccccgccgccgccccactcactacacggtgacagtgccagattcctgctttcccgcgaccaagcccccgctgccccacgccgcctgccactcctgctcagaagacagtggctctgacgtctccagcatctcccaccccacttcgccgggcagcagcagccccgacatctcctttctgcagcctctctcccctcccaagacccatcgtcaccgcggggcctgggtcccagccggcagcagagagctggtcgcccaccaccccaagctactgctgccgcctggctatttcccggcggggcggtacgtggtggtggctgagagccccctgccgcctggcgagtgggagctgcgccgcgcagccccgggccctgcttacgaggaggagggcactcccctgcgctaccagcgtctggtgccctcccgcagccgcatcgtgcggacgccctccctgaaggacagcccggcaggccgggggctcagcaaggccgccgtgtccgaggagctcaagtggtggcacgagcgtgcacgcctccggagcacccgcccccactcactggaccgccaaggagctttccgggtcaggagcctgccccttgggagagagggcttcggacgagccctgggaccccgggcacaggtacggctgctctggagggaccccggggccaggcaggagggctgttttgttggggaggggctgcaattctagtatgtccaagggtacagaggcatcaaagcagcaacctagtggccgggtaatccccgtctaggaagaacaggccaaaaaatcatttcctcttggctttggaaggcactcttggcttccctggggcacctcctaattttgcctgccatgtctagctcaagagcatatacactggtggagatgatccccgaagatagctgagactttttctctccctaaatgatgatgcacaaagcagataagcctcttcataatcaaaagtccagtccaaatcagcccctcagatttccatttgaaggtctaggacaaagggagagtaggaaatgagttgcagaagccagaacctgtgattttctgggcatcagcatcctccctgacacccctcctcaccaccaagccgagaagaagggtggcatcagagttaagagcacccaccctcaagctagaccaccaggttcaaatcccagttctgccacttacgagctgtatgattgggcaagttacttaacccctttggacctagtgtttcctcccctgtgaaatgagagtagtagagtacctatctcatagggctgccaagaggctgaaatgattagagcaatgcatggtaagcgctagatatgtgatattattatcatctggggccacagaggccagggagcaggctggagggtagtatataggatagagcaccctgacactgggtagggtggcagccttggtttccttggcccctatttcttcattctggaagtggggagccacacacaggaatcctttctttattctttctccctggtacggagggctctgcaggtgatgtgctccagaagttaccaacaagctgcttctttgagaccccagattcccagcagacccagctgcgtgtccctcccccacccacggttctttggactgcagctggcatcctgggcctggcagcaccctggccccggtccgaggccgcgccctccagctgacgtgcttttccctttctgcgcgcttgggcctgtccttggctggatagacccagcccatcccaacgtgccagacagggagggtgatgagaagtgagcccaggaaaggtgggggaggaggaggtcagggcgcctgtcacaccccaaaagaacatggaggaaaatgtgtaaagggggtccctgaagaacagagagcatcctgggaggaaggggctgagtgccagggcctgctgctgctgctgcttctgctggtcagtgtccctaagggataaggatggtgtaactgtgcctgctgtccccgcttttctgcctggttcatttacccacctgtcctttcttcctgaccctggcaggtgcccacagtttgtgtgctgcggagatcgcctgatggggcccctgtgcaagtctttgtacctgaaaaaggagagatcatcagccaggtgtaactctgcgccccacgctggaaaaaactgtttcatagaggggctgggctgagacccccccacccctgagtgcctctttcagctcccccatccccatcgcaggccgatgacctggagctgagaccttttattattttttttttacacgacttttttcagaagccctgacctaaggatttatatatgtggattgtcctcaatacccctgtgatatgattatgttttatcccccagagtttggcctactggacttaaggccttgcctgtctgactgacagcctctatctccttatataagacaagtggcaggggacgagtgaagcagagtgagccaccttgggagttctccaacgctctgtgctctggttctaagaaattccctggggaactgcccctggccctcctgtcccactattgctggaggctggacatggtacatactcatgcacatgactctcccccatttcccaggtctctgggtaccccagcctgggctgggggagaatctcttcccccttttctaatgtgctctgtgatgcacacaccaagtggtaggtcaaaggtcagtatatcccggtggtgtattgtcttgctagaccctgctattttcctgaccccctaaatcctctttagggacccagtcactataccctgtctatgccctgtgggctcccagacccctgagctttgagtcagtggcatcacagtttgtagcctcagggggtctggctgggggctggtccatgcttgtggttagtggacagcagccaccctttgacagctacctctgggcatctcaagggcttgcagccccactgctccttctaacattttgtttgtttttgagatggagtctcgctctgtcgcccaggctggaatgctgtagcaagatttcggctcactgcaacccccgtctcccgggttcaagcgaatctcctgcctcagccttccgagtagctgggattacaggcaagcaccaccatgcctgctaattttttatttttagtagagatggggtttcatcatgttggccaggctggtctcgaactcctgacctcaagtgatccacctgccttggcctttcaaagtgctgggattacaggcatgagccaccgcacctggcccttctaacgttttttcatcatagtcccaaaaaccaatactttacaagtggttttggaaaggcaccacttttgtggcatgttctggttgggagagggagtcacagttcctactccccccaccagctatgcttctgctctgagaaggtggttatttatacaaacatggacatactcactcccaagggctgatgagatgctgaattttctttgggggcattcattaattgtcccagctgcagcgactggagcaagtctggaagctgcctgtgctaagaccacccagctgtccctgggttctcatcctagggccttctttgcttccaggtcaggggacctgcttcaatgagaaagcaactgaattgaggctaggagaggtagggagagctgagttctgacttcacctgtgcagaactctctgcccccatgttacctggactggaacagactgtgaatatagcagaaggttccaagaactctggtgtctgacctagaagaggcacagttctctctactggaaagaaaacgatgtagccgattgcacaagggtgccaagggaagacccaggatggcccatcaaaggaacctgggggaggatgcaggaggctgaagggatgcacctggcatttctctcactgtgctcttaccgcatcagcaacccccaacttttgggcctactctgccccccatgcgtgaataccctgcttggatgctgtgcttttccggtttgtctctaagcccctttctccagggcatgttggtttccctggcctctcagtgtcctaactggagcccagagtgccttgttctgagccaggagacggctgagcactggccctccacacctaagcgtcctttacattaacttattggtcttgtataacacctggtgccattgccaagtggctgtgtcctcagctacagagctggaattgtgtggggtttagtgctaaatacttcaataaagtctgttttttgtgattggctga

SEQ ID NO: 1992 - DNA, 1087 bp, Homo sapiens
catggcccccacagagccctggagccccagcccggggtcagcgccctgggactactcggggttggacggcctggaggagctggagctgtgtccggccggggacctgccctacggctacgtctacatccccgcgctctacctggcggccttcgccgtgggcctgctgggcaacgcctttgtggtgtggctgctggccgggcggcggggcccgcggcggctggtggataccttcgtgctgcacctggcggcagctgacctgggcttcgtgctcacgctgccgctgtgggccgcggcggcggcgctaggcggccgctggccgttcggcgatggcctctgcaagctcagcagcttcgcgctggcgggcacgcgctgcgcgggcgcgctgctgctggcgggcatgagcgtggaccgctacctggccgtggtgaagctgctcgaggcgaggccactgcgcaccccgcgctgcgcgctggcctcgtgctgcggcgtctgggccgtggcgctgctggccggcctgccctccctggtctaccgggggttgcagcccctgcctgggggccaggacagccagtgcggcgaggagccctcccacgccttccagggcctcagcttgctgctgctgctgctgaccttcgtgctgcccctggtcgtcaccctcttctgctactgccgcatctcgcgccgcctgcgacggccgccgcacgtgggtcgggcccggaggaactcgctgcgcatcatcttcgccatcgagagcacgtttgtgggctcctggctgcccttcagcgccctgcgggccgtcttccacctggcgcgtctgggggcgctgccgctgccgtgccccctgctgctggcgctgcgctggggcctcaccattgccacctgcctggccttcgtcaacagctgcgccaacccgctcatctacctcctgctggaccgctcattccgagcccgggcgctggacggggcctgcgggcgcaccggccgcctggcgcgaaggatcagctcagcctcctcgctctccagggacgacagttccgtgttccgttgccgggcccaggccgcgaacactgcctcggcctcctggtag

SEQ ID NO: 1993 - DNA, 163733 bp, Homo sapiens
gccggaggacgcgctgctgcgagaccagccgcggcgtctttggcagtagtgggcgtgcttgcgggtccaggagggcccctctcccgcgaccgccgaccacgatgagagcgtgaagaccctctcgaaaggaagggctctgctctacacactggtgtctcctgcggaagggcagctgggcacgccttccagaccgaggtatcagacgagaggccccctggggacggggcggttaccgcagtctcccttcttgctcccgactgtcagccctcctcccctcccatcagcagctcagggatggggctggctctggggcctcctcttccatcaacccctcagctacggggctggttcaggggactcctcccctcccatcagcagctcagggatggggctggctctggggcctcctcttccatcaacccctcagctacggggctggttcaggggactcctcccctcccatcagcagctcagggatggggctggctctggggcctcctctcccaggctcagctgccgctgggacccactcccctgagcgcctctcccctaagtaatgttattcatagcaaaaactagaaaaacacattttaatgaaataaatgttcaggttaattttattatagcatgccaactaaatgttttatactatagaaataaatatttaacaaaatatgaagatatatatgaaactttaatgaaaaatgattagcctttcacaattggaaaattaaaaacaatagtaataaatgttaaccatattttggtgaattggacatcataacatattgtaggcatacatgaaatatggtacaaacattttaaaaagaacagtgtggcaatatatattaaggaccttaaataaactatgaaattatcttctaataatacaactatttaatgttcataatttagacataaaataagcaattattatatattaataacattttttccctgacaattgagtttttttacttgattccagtcctgtaacagtctcctatccctggtgtgctaaggagttttatttcagtagagaatgagtaaaattactaatataatgatatataaaaatgtattgctaagagacgttcaaaattgactggaagtgctaatgttaatattagatgcatcaggtgctgtatttttttaaagcctgcttttacaactcataataatacctaatgtggacccaagagcagcatgaaatcagagacagtaaaaatccgaatagcaagatattattgtaagcaagagaaagtcattctgctgaacagatctgaggatgatatagaagtttagaagtcagaattcatagatttacaaatttccagattaaaatacaaaaataatctgtgatagggctaaaaaacatttttttcctgttggggatatagaaacatagaaacgcctacattgagggtagtagaagacttcatgtaaataaacatgcccacacacacatgcacacatacacactgacacacacacatatatttttcttaataaagagtgtaaagagcatggttcaatcagtgtgggattgtaaagcatacttggatgaaattggaagtggaaagtaagatattttaaacattaaccacatacctaaagtactgcacatagaaataattaggcttaaaggtaaagcctatcacaatctaaagacatgcatttgtagtggtgcgtgttcagatacctgggtattgtggtggagatacacatagtcttttgaacattccgttgtaggtcgctggtagctggatatgtcctttaaacttttgtggcaattcatttgagaagaaacgcagctttttctattgagttcttatgctataagtaaaggatgcaagacattaattagacaaaataaggtaaaattttgtattcgcttagagagtttaagaggctattagccactagtctctatagtgcctaagtaaatcgattctgcttaataaactgctacctggcttagtaagtaaacaaattgaaacttattttaggaaagaaatatatattcttatatctacatcagattctcttatgtagaaacactagagggtgaatgaggagttaatgtaagcagcatcatatttttgctcattcctttctctatgatttctgcttcttctgtccaaattctgtgaggtgtcctctagatgaaattatcacaggcatggaaaaggtcattttccacttggtccatcctcatgattgcagttgtaacatactgggactcattcattttcacatatgtatatgagacttaaatcatccacatttcaggccaggttaagtttctagaaatattctatgctttccttgcacttacactcaatcctgtcgtctacagcgttggcactgacagtgttctggtggcaatgaaaaatatgctctagagcaacattctacataaaaaaaagaataggaaaattcctttcacttgtgtattccctctatttccacattcaatgtctatagagtgttgttagtttctttggaaagaaaaccgaaccttctgtctttctaagtgtagaaagatgtggatattttcaaaaccccaataataataaagtttttacatatgtttgttttttcaatgcatgtctaaaaatgtattgttcctcttgtgggtaccgatttcaatcactcaacacactctagaaagacaaagataacctaaggcttccaccaccctcccactaaaattgtaagaatatataagaattacatttgaaatacaatcaaaccattatattaaaaacatgtactaatataatatctgtgtttttatgaaacttcctaaaattgtatttcaagtctcacaatcagtttcttttcaaaaatctacaactccacttgaaattaccattattcattgaatggtttgttttgacactttagtttcctcaagtgaaaaatacatgcacatacacatatatacatacacatacttacatacattgattgtagtcaaatcaagtttctcattctttgttggaagcatgaatacaatatttaagaatatcctgaaaattatgtcttatttcatgtatacatacaggcttatattttacaaacccttctaacaatttatcctaaaagttattgcaaagagaaaaataaatgtttctattaggaatacttttaaatggttttattaataggaaaaactagaaaaacattttaatgaggtaaatgttttaagttaattttatcaagttaactagattttgtatatttaataaatatcataaagtatttaacaaaatataaaggtatcatagcaagctttaatgggtgaaagtgttactttgccttctataattggaaactttaagacagtaacaataattgttatcaaagttttgggttgaatttaacagaaaacctataggtattccttatccaactcactgttgatgagcacctaggttgaatgtatgtctttgctgttgtgaatagtgcagcaatgaacatatgaatgcatgtgcctttttggtagaatgattttgtgtgtgtgtgtgcatacgtgcgtgtgtgtgtgtgtgtgtgtgtgtgcgcgcgctaagcaatggaattgctgcgtcaaatggtatcctttttaaattttttgagaaatctccagactgctttccatagctgctggactaatttacattcccaccaacagcatataagaattcccttttctctgcagcttcatcaacatctgtgcttttttttaaattttttgtaatagccattgtgacttgtatgaaatggtgtctcattgtggttttgatttgcatttctgtgatgattagtgatgctgagtattttttcgtatgcttgttggccacttgtatgtcttcttcagagatgtgtctgttcatgtactttgtgcattttttaatggggttgttttttgcttgttgatttatttaacttccctatatattctgggcattagatatttgtcagatgcttagtttgcaaatattatttcctattctgtaggttggctgtttcctctgttggtagtttcttttgctgcacagaagttctttcatttagttaggtcctgctcatcaattttattttgttgctgttaattttggagacttataagtcaggtagaggagtaagtatttgggttatatcatagatattgaaaggtttgctctctgaggcatgtcaaaagagagtttagatatataaagaatggtgaatggatactagactttctgatgaactagcattaccatgcccctcatttatttatttacatggtcattgtaaaggagatatggaatatgtaagaagtttgttatatgcatgatacttggagaaatagacatggaagatgaaaaaaatagatggattttggtcttgattcctcaattaaaccaacaaattcctgtggtgctatttggacagacgccgaatggagagagatagagaaaaagagagagagagagagaccttgtcatgaaagagagagaccttgtcatgaaagaatttgtgaaacaaatggacaagcattggtacctatagaacctagtgatggagtgtgactcagagctgtgtacaaaggctgtctcttcatttcattaatgaatacaatgtgtggcagggatacaggaatgtctcttattctcttcggcatcttaaagtttctgtatgtttcagattttgtggcatggagccttcctagtgagaatcccaatcatgattaattcccatttggtctcacaagctggtaaatactgggaattattgtgttactatgactgtagcctcccagtaccagtcttggtttcctttctttctgtccttcaatccagactggctttcagatacacacatacacaaaaaaactacatgatctcacttacatattgggcctaaaaataattggaataagttgcccagactggtctcaaactcatgggtgcaaatcatctggaaaccatcctcacaaaatgaataaaactaaattctgggtttttaaccaaaagcataaacttttagtagaagcatacagtaagcatgaaccagcttgcccaataacctattttgtgtggctgcttagtgcttaaaagtcatgtagcccctgtcacaaggtcctcatttcccttaattgcttctttagatatcatctttaatattaggaaacctcaagttttctacataaaatgttttctagatcctgaattccagtgggtccacggaaccagtggggctaccgagcttgtctgagaaactgactcagtgtactacatgttctacttgccaataattaaactagtaatataaattatataatattggattagtcttaatcccagtctcttattgattcctaatgacatttatgaaaataatttggtgttctaaattttctataaaaaattgcccaaagtcataaagtaactgaaaataaattgctctgcagagaagcagaaacctgccaaaatttttaaaaaatgtatttggaaattaaattagaatagtttcagtgcatttaaatgatttttattagggtaaatatatataagagaaacaccattttaaccattttaagtgtagagttctgtgtcattgcacatttatattgtgcaatcatccctatcgtgcatatccaaaacagtttcattgtctccaactaacactttgttcttgttaaacaattactctccttctctcccttctcccattccctggggtccactcttccacttcctctctctatgaatttcactactctgggtacttcgtgtaggcgaattcatacaatatttgtcttttgtgacggacttatttcgcttagcataatatattcgaggttcatccatgttgtagcatgcgtcaaaatgtcttctctttttaaaactatatatacatacatttttattgattcttctgtagatgagcactttctttctttctgcctttgggctattgtgaataatgttgctataaacatgggcatagaaatatttgtttgatgcaaaaacagagtaacaaataagtgggagctaaacattgggtacacatggacataaagatgggaatagtagacactggggactccaaaagaggagagtgagggaggaggcaagggttggaaagctacctatttgtactatgttcattattttagtgaagggttcaacagaagcccaaacctcagcatcacacaatataaccatgtaacaaaccacaaatgtactccctgaataaaaaaaaatccaaaaatatctgttcaggtgtctgcttttatttactggatacactgaaattgttggatcatatactaattctatgtttaaattttgaggaattcctacacatatggttccagatttacaataatttgatgttttttgactttatgatgaatttatcgaaacataaccccagtgtaaattgaggagcacctggacatatgatggtttgacttgcacctttttatgttatgatgagtttatcaggatattaactttttacttacagtattttcaacttatgatggttttttcagggtgaaactccactgtaagtgagaagcatctgtatcattttccacagtgcctttattatttgacatttcccccaactattcttttataattttttctcttacatttagatttttgattcattttgacttaatttttctatatactataaagtaaacatccaacttcaatatcttgaatgtaaatatccacttttccaaacaccatttatcgaaaagactgtcccttctccacgagtggacttagttccctttttgaaaaaaggttgccatgtatatgagagtctatttcttgactctgttttcctctgttgggctatatgtctggctttgtgccagtgccacattgttttgattactatagctttgagtaagttttaaaatcagaaaggatgagtctttaaattttgttcttttttaaaaaaagtcaagattttttgaatattgaggatcctttaagattcatataaattttaggatgagctttctgtttgtgagaaaaaagatttatttgaattttgatggagattccattgaatctttttttttgctttgcatgctttattatttttttaataattattttattgtttgtttttaagtttcagggtacatatgcaggatgtgcagttttgttacataggtaaccatgtggcatggtggtttgctgcttttatcaattcatcacctaggtgttaggcccagcatgcattatctcttttccctaatgctctcccccaaattgtcctcccccaacaggccccagtaagtgtggttcttctccctgtgtcaatgtgttttcattgttcagcatccacttacaagtgagaacatgcagtgtttgcttttctgttcttgcattagtttgctgaggataatggcttccagctccatccatgtccctgcaaaggacatgatcttgttcctttgtatggctgcatagtattccatggtgtatacgtaccacaatttctttatccagtctatcattaatgggcatttgggttgattccacatctttgctactgagcatagtgctgcaatggacatacacgtgcatgtacctttataatagaataatttatattagtattctctgatgattgtatttctgtgggatcaatggtggtatttcccttatggtttctgattgtgtttgtttgaatattatctcttttcttctgtatttgtcttgctaatgatctatctattttattgattttttttttcaaaaaccagctcctggattcattaattttttgaagggttttttgtgtctccatgtccttcagtttctctctgatcttggttatttcttaccttttgctagctctggggtttgtttgctcttggttctccagttctttcagttgtgatgttagggtgtcgatttgagatctttctagctttttgctgtgggcatttagtgccataagtttcccctttaacactgatttagctgcatcccagagattctgataagttgtctctttgttttcattgatttcaaagaacttcttgatttctgccttaatttcattatttacccaggagtcactcaggagcaggttgttcaatttccatgtagttgtgtggttttgagggatattttaatcttgagttctaatttgattgtgctgtggtctgacagactgtttgttatggtttcatttattttgtatttgctgaggagtgttttacttccaattatgtggtcaattttggagtaagtgccatatggtggtgaaaaaatgtatattgtttttggatggagagtcctgtagatatctatcaggtccacttggtctagagctgagttcaagtcctgaatatctttgttaattctctggctcaagatctaatagtgacagtggggtattaaagtctcccgctattattgtgtgggagtctaagactctttgtatgtgtctaggaacttgttttatgcatccgggtgctcctggattgggtgcatatacatttaaagtggttagttcttcctgttgaattgaattctttaacattacaaaatgcccttctttgtcttttttgacctttgttggtttgaagtctatttcgtcagaaactaggattgctacccctgctttttccttctttccattcacttggtaaattttcctctatccctttattttgagtctatgtgcatttttgcacatgagatgtgtctctcgaatacagcacaccaatgggtgactttgggtattgttgacatcttaaccgtattagccttcgataaataaatatgtaggatgcatttccatttatttttgtcttctttaatcgctgtaatcagcattttgtcattttcagtgtgtaaagttttcacctccttggtttggtttattctaagtgtttcatttctttttgatactattgttaataaaatgagagtgcaattttcagattgtttattgttagtgtatagaagtacagcaggttttggctgttgttgatgttacatcctataattttcctgattttgtttattgcttatcctaagttttctacatatataattatgtcatatgcaaacagaaataattttacttttcttttgaattaagatatttttatttctttcttatttaattgctttgactgaacttccagtaatatgttgaacagaagccgggaaagtggactgtagtgtcttgttccaaatctcagactaaaagctgccagtccttcattattatgatgaagctgcaggttaaattcttaactgggacaaaatttttacatcactttaatgttttattcaagtaatgcatagacatagtctcagcagaccacagggtaaaatgttagaaacataacaaactcttgctgaccccaaaggcaaggacttcaatttatctttccagtttttccccatatttgcccttgtatttttagacaatatgttcatctgctaatgcctgatttctatatcccaaatagcattccttgacccatgatatatgctagcatggatagcgacctgctccctcctccataatcacccccaggttccttacccttctcccattgtcacagcagaattacattccactttatgtctgcaatgaggggttgacaacatcatttcatcttacagaatttattgctgcaatacaaaaaaaaactattgcatttgaacatgatagttaatatatttcagttgagagaaatttttttaagaatactaacttcactattattttgctatatccctttctaggaatgtccttaagcacatattggtcctcctgtatgaatcccctcatttttctatcttccctaaatagcagtcttttcatgtggttattgcttttgtttaccttcaaatagagttttcttactttgtcttttgaaacttccgcttaatatttttatcaattaatacaattttagttttcaaaagttctttaatgttacgtgtcacatcctttcatatagcaaatgatatttattttatggatttcataacagatcatacatctctgaagaaaggaattttgatcacaaaaaactattctttctgcatattttaatcattttaaagtcagtgtatttatgcatatgactgtgtgtgattgtgcatatttgtgtgtgtttgcacactgggaatcttcctcgtacatgttgttatacttgctccaaattctggtgatctttggctctagactaatatttaagcctaaaaactctggttcttttaggcttactgtgcaaagctgtttactgatgtcttacatctggagtggaatttctaacacacctctacctagaagtctgtcagaattttagtttcttttttttatttaggcaattgcatgctcctccaagtgcattcttttgaaggatccataaagcaatgtgtaatgttatctaatcactagagaagcaaaagacaaaatctgtaacatatttggtaaggggtctgctttaaatagagtattctgaaattaggcgaggaggccaaagagaatggatgatgatgaatattgaaaatcaagagtgtggattaatatgactttccgtaaaagggacatagcaataaggatttattctaggtttctaaataggaggaccaaattataactgacaaaagaagtttgacttggcattattgcacaaagatcattcaagtttctcaaaatgagagacaagctgctgcagttttagaagtaaatctgacagaataaacatgggttgggtggggagctgttgcctgcaatcacagcactttgcaaggccgagacaggaggattactgaggccgagggttcaaaaccagcctgagaaacacagtgacacttcatgtctacaaaagtataaagttaactaggcattgtggcacgtggctgtagtcgcagctactcaggaggctgaggcaggaggatcacttgagcccagaagttcaaggctgcagtgagctatgatcttgccactgcactccagcctgggtaacagagagagaccctgtcacttaaaaaaaaagaaaaagaataagtgtggaaatataacagatcattctataaaggtaagactaatttattcaaatataaatctgtaatgtatgcatttatagtgactttctatgcataggtattcagtataatatttgactttgaatgtatctgagtttgcgtcaggcagtaaaccattcatattctattgaagttgtaatagaggtatctttcttataaatttacatatttctcagaaaaaaactagtaacaaatgttgatctcatcaaatgtgaaactctgggtaagaaaataagatttcttttttcaaaataggtaaaaatcagaacaaagaagtctgagtacagtacaataaaagattttgagaaagatagagatcatattcacatatttatagtatactgtataattgttctattttattatcagttactcttgttaatctcttacttgtctaatttattaattaaactttatcagaagtatgtatagacaaaaataatagtgtatttagggttcagtatcaactgcagtttcaaacatccactgggggggcttggaatgcatcccctgcagataagggcgaattactgtacgtaaattactcttgtgtctcccttccgaatggattgtaggaatgctccatggaaaattacaatcaaacatcaactgatttcatcttattggggctgtttccaccatcaagaattgaccttttcttcttcattctcattgttttcattttcctgatggctctaattggaaacctgtccatgattcttctcatcttcttggacacccatctccacacacccatgtatttcctactgagtcagctctccctcattgacctaaattacatctccaccattgttcctaagatggcatctgattttctgcatggaaacaagtctatctccttcactgggtgtgggattcagagtttcttcttcttggcattaggaggtgcagaagcactacttttggcatctatggcctatgatcgttacattgctatttgctttcctctccactatctcatccgcatgagcaaaagagtgtgtgtgctgatgataacagggtcttggatcataggctcgatcaatgcttgtgctcacactgtatatgtactccatattccttattgccgatccagggccatcaatcatttcttctgtgatgtcccagcaatggtgactctggcctgcatggacacctgggtctatgagggcacagtgtttttgagtgccaccatctttctcgtgtttcccttcattggtatttcatgttcctatggccaggttctctttgctgtctaccacatgaaatctgcagaagggaggaagaaagcctatttgacctgcagcacccacctcactgtagtaactttctactatgcaccttttgtctacacttatctacgtccaagatccctgcgatctccaacagaggacaaggttctggctgtcttctacaccatcctcaccccaatgctcaaccccatcatctatagcctgaggaacaaggaggtgatgggggccctgacacgagtgagtcagagaatctgctctgtgaaaatgtagaaacactttctgcctaaggtctcaggactcagatacacatccattcagcagtgtatagtaattaaaatattatgtccttcctagagtgcaggactaaaactaaccaacggaagaagaaaatcactgatatatggacaaaattgttttacaaatatatatataattctaagaaaccttttttcttgatggcctttttccaaaaattttgaaagtacatatttttgctaatatgttgtcaataagaattttttttttggtcatgcagaaatgaaaatgaaaatggcctaactgaagttggcactcagcataacaattttattattgtcaatttattttccagtaattaaaatttttttttggttatgtctaaaacaaaaccaaaaatctcttgacttggtggatctaattgaaagccataagatgttttctgtttcttatcttagacacttaacgtaccagttactctttctttcaatttagggggacttattattactgagatttagcagaaggctcatcagtggttcttaagtcctgataccactctggatggcctgtgacaagtttatgctttctgtagtggaatgaatcccagggaaatgatttaacatcaggtaaattttagatcaacaacaagtattggaagatgccatcagtgatcaagaatgattacacttaggtctttaacccattttatgttgattttggtatagtgtaagaattgggagtttagtttcatttttctgcatatggatatccagttttacaagcaccttatattgaagagactgtcagtttcccaataaatgttcttggcattgttgtcagatatcatttaactatgtcaggcacagaaagacagattttgcatgttctcactcctacctaggacctaaaaattttaaaaattgagctaatagaaatagataatagactggtggtcaccagaggatcggaagggtataggggaggggggataaagtggggacggttaatggttgtaaaaatatagatagcacgaataagagccagtatgtggtagcacaacagagtgactgtagcaaacaataattcattgtagaatatattgtatatattaaaaaataactgaaagtttggaattggaatgttcccaacagagagaaatgatacatatttggggtgctggttatcccaattaccctgatttgatcattacacattgtacgtgtttttcaaaacatcacatacactctataattacatattactattatgtatccatagtgattaaaaataaaaaattaaatcagttagctagagatacgtggatttattgctgaattctctgttctgtgtcattgttctatgcatctgtttttatgccagtactattctgttttgattactacatctttgtagtatagtttgaagtttgctactgttatgcttccagctttgctctttttttcaggattgatttggctgtttggggtctttcatagttcatacaaatcttagaattgtttttactatttatgtgcagatgtcattggtattttgacagacattgcattgaatctgaggtttggtcatttaaataataataattcttccaatccacaagcattggatgtctttcgatttgtttgtattcttcttcatttcctttcatcagtattttgtagaaataaattctattgttctcttctatgactaaagttaacagtaaagtattacatagttaaaattcttgaaatgctctttaacatcatttctatttctaagcctgtggatatttgttttgcaatgttgttgcagttaaaacacacattttgaacttgtcttatgaatcagagtaagtcctttttgtgttttgctgcaatgagcagtgtatatttttattttgtaatagtttgctaacaatgtttactgctaatcttcctggctttttcttttctgatattcaatgaatacaacaggcgtgggctctgggacagagggaaaataggcatcccatcagcagtcacttgctgctgccagggcaagcacctcctctcttccaagctagggacacttggaccctactgccacctgcactgctgcttctgtcatcaccatcaatatgagcccaggcataccccagacactgcttgggtcctgtggtgctgtgaagtattacaagatgtgtgtgtgtttgtgtgtgtgtgtgtgtgtgcgcgcgtgcgcgcatgagaagaccaggccaattgccccatgtggttgttgcctgagcccacttgtgtagtcactaccagtggacccaaactgcgtgctaacactgccagcctgtctagctcctctatcacattcatactcagagatgaaattattagatatttcaatgacaacagaagagcatgaaaccatgcatggagccctttgagtgtgaaccctgtgcatatgcccgtgaggccagtcctgagaaggatggaaagagtggacaggaagtgaatgacatcatgcagtctaggatagtggtgggaatgtgtgatggtctgagtgtttgtatcctctgaaaatctatatgtttaaatctaaacccctaaaatgagagtattaggagtaggggccttttgggaaatgattaggtcatgagggtagcaccttcttgaataagattaatgcctttctaaaggaggctcgagggagcttgttcatcccttctaccatgtgaggtcacagtagacggtgccatctatgatgtcatagaagccaccatctatgaaccagaaagcaagatttctccagacactgaatcttcaggcactttgtcttggacttcccagcttccacacctctgagaaatatgtttctgttgtttataggttaccacagtttaagatattttttcatagcagcttgaatagtctaagaatgtctgctgtttttgttaattattattattggaaagagcctgagggaggactgaattaagcagtggtgtctggttcagaccctatacccatttcaggtagtgattcatggagggaatcaggagacctagctctgtgattttctctgacataccatggccttggggaaatcattccatctctctgaagttagtttactgaaaaacaatatgggtgccttgtacctgatcagtaaatggcatcactgacatttactgctgacattcctgtagaggcaatggtaatcctatttttcatgccaatgaccctgggattggagataaagaggtcacccctctaacatgctgtcttcacttagaggccactcctttccccttaaggtcattaagaagaacaacagaaaaagaagtcaaattattcaaatctactgtcatttactacattgtttatgagaatgtactccagataattttgaaagttggacgataattcctcttgatggggaaattaacgaattcattacctcacagagtccttggctcactgttcattgtgcctcgttttagccattgttctttgtatgcaaatgttatgctgtggttattatttcgcacttcacagtcattctttaattgtttcatgtccttagactaggagatgcaaattttatatcatgcggtatctatgtatctatgtggatttcataacatagactctgtgcatttagagatttcttatgtattacattagcaaaatttgatttatggaaagggacatgagtattctttctattttaaaggatgagtatctttctcatcacaagaagctgtggttcaatagtcaaatagagctgtggttcaatagtcaaatagggtaaattgaaggaatgaatgatatgccatccacaaatatgctaagttggcatatttattagtttgagctgaaaacattgaagaaattttggttaacattagaggaagaggttatctgacctgtcttttttggcatgcagcaagctctaaagattcctccaggagtctttggtacattctaatactctttcggtaccctccctgtaatggaatataaaatagcccttatcactacagcctgggaattgggggaatgcagtgtacctgaataaataaactaccagaattaactcttatttttcactatctttacacccccatatacctcctagggactcccctggaatttatggtttcgagccagtgtctctttttttttctttgtaattttttctgcaatttatcattctgtttctaaaagtataaagacatcttgctttgaccatttatttagatttcacactcttgtgaggattcccatgtacatgtgaaatgcataaaactcatatgcttttccttcattaatccatcttgtatcaatttgtttcctatacctgggcagaaagctcacataggagataaagcgggtgaggtggaggtgatccctcatgtttccacagaagtaataagtagcttccttttgtaagatttatgtcaaccaccactactaaattttttttacttgccttttaaatctggaaaaaaatagacaatgacttttaaaggctaaatatcttttcaattactgaataattattcagtacttacagcatggtaagaaaatgcaaagatatatacatggattccacaaattggatggaggtcaatttgacatttgggacttaatctctgctattttgtctcattaccacaaattcaacataagatccttttaattttgtctgctaaatattttaaaatacatttatattcctaaatccctgggatcactgcccttacttttcatagggttttctagttaaatttaaactgacattaaaaatctgattgtatcaatcaaggtccttaattgaaagtgaaatataaaatgtcttttctttttttttgattttttgagtactgctagatttaattgctagtgactacaaaattagtaacttatttcatgtgtttaaaaatgcaaaactgaatttctgcataacaagataaggaggataatcagtggatatttaaagcatgccaacgttttcatcatgttcaggaggaagataagaatacgacttgaaaattgctagaaaaagatcatcattatgtatacattaagactttctcaaaattacaattatgtatacagtacaacttctatttctgacagtatgttgcactaaataacctgaaatttgccattcattcattcattcaatatatatatatatatttttactttaagttttagggtacatgtgcataacgtgcaggttagttacatatgtatacatgtgccatgttggtgtgctgcacccattaactcgtcatttaacattaggtatatctcctaatgctatccctccccccttcccccaccccacagcaggccctggtgtatgatgttccccttcctgtgtccatgtgttcccattgttcaattcccacctatgagtgagaacatgcagtgtttggttttttgtccttgagatagtttgctgagaacgatggtttccagcttcatccgtgtccctacaaaggacatgaactcatctttttttatggctgcatagtattccatggtgtatatgtgccacattttcttaatccagtctatcattgttggacatttgggttggttccaagtctttgctattgtgaatagtgccacaataaacatatgtgtgcatgtgtctttatagcagcatgttttataatcctttgggtatatacccagtaatgcgatggctgggtcaaatggtatttctacttctagatccctgaggaattgccacattgacttccacaatggttgaactagtttacagtcccatcaacagtgtaaaagtgttcctatttctccacatcctctccagcacctgttgtttcctgactttttaatgatcaccattctaactggtgtgagatggtatctcattgtagttttgatttgcatttctctgatggccagtgatgatgagcattttttttcttttggctgcataaatgtcttcttttgagaagtgtccgttcatattcttcgcctgctttttgatgggattgtttttttcttgtgaatttgtttgagttcattgtagattctgtatattattagccctttttcagatgagtagattgcaaaaattttctcccattgtgtaggttgcctgttcactctgatggtagtttcttttgctgtgcagaagctctttagtttaattagatcccatttgtcaattttggcttttgttgccattgcttttggtgttttagtcatgaagtccttgcccatgcctatgtcctgaatggtaatgcctaggttttcttctagggtttttatggttttaggtctaacatttaagtctttaatccatcttgaattaatttttgtataaggtgtaaggaagggatccagtttcagctttctacatatggctagccagttttcccagcaccatttattaaatagggaatcctttccccattgcttgtttttgtcaggattgtcaaagatcagagagttgtagatatgcggcattatttctgagggctctcttctgttccattggtctatatctctgttttggtaccagtaccatgctgttttggttactgtagccttgtagtatagtttgaagtcaggtagcgtgatgcctccagctttgttcttttggcttaggattgacttggcaatgtgggctctcttttggttccatatgaactttaaagtagttttttccaattctgtgaagaaagtcattggtagcttgatggggatggcattgaatctataaattaccttgggcagtatggccattttcatgatattgattcttcctacccatgagcatggaatgttcttccatttctttgtatcctctttcatttcattgagcagtggtttgtagttgtccttgaagaggtccttcacgtcccttctaagttggattcctaagtattttattctctttgaagcaattgtgaatgggagttcactcatgatttggctctctgtttgtctgttattcgtgtagaagaatgcttgtgatttttgcacattgattttgtatcttgagactgtgctgaagttgcctatcagcttaaggagattttgggctgagacaatggcgttttctagatatacaatcatgtcatctgcaaacagggacaatttgacttcctcttttcccagttgaatcccctttatttccttctcctgcctgattgccctggccagaacttccaacactatgttgaataggagtggtgagagagggcatccctgtcttgtgccagttttcaaagagaatgcttccagtttttgcccattcaatatgatattggctgtaagtttgtcatagatagctcttattattttgagatatgtcccttcaatacctaatttattgagagtttttagcatgaacgttgttgaattttgtcgaaggccttttctgcatctattgagataatcataggtttttgtcattggttctgtttatatgctggattacatttattgatttgcatatgttgaaccaaccttgcatcccagggatgaagcccacttgatcatggtggataagctttttgatgtgctgctggattcggtttgccagtattttactgaggatttttgcgtcgatgttcatcagggatattggtctaaaattctctttttttgttgtgtctctgcctggctttggtatcaggatgatgctggcttcataaaatgagttaaggaggattccctctttttctattggttggaatagtttcagaaagaatggtacgagctcctccttatacctctggtaaattcggctgtgaatccatctggtcctggactttttttggttggtaagatattaattattgcctcaatttcagagcctgttattggtctattcagagattcaatttcttcctggtttagccttaggagggtgtatgtgttgaggaatttatccatttcttctagattttctagtttatttgcgtagaggtgtttgtagtattctctgatggtagtttgtatttctgtgggatcggtggtgatataccctttatcattttttattgtatctatttgattcttctctgttttcttctttattatccttgctagtggtctgtcaattttgttgatcttttcaaaaaaccagctcctggattcattgattttttgaagggtttttgtgcctctatttccttcagttctgctctgatcttagttatttcttgccttctgctagcttttgaatgtgtttgctcttgcttctctagtttttttaatggtgatgttagggtgtcaattttagatctttcctgctttctcttgtgggcatttagtgctattaatttccctctacatactgctttgaatgtgtcccagagattctggtatgttgtgtctttgttcttgttggtttcaaagaacatctttattcctgccttcatttcgttatgtacccagtagtcattcaggagcaggatgttcagtttccatgtagttgagcagttttgagtgagttttttaaccccaaggtctagtttgattgcactgtggtctgagagacagtttgttataatttctgttcttttagatttgctgaggagtgctttacttccaactatgtggtcaattttggaataggtgtgttgtggtgctgaaaaaaatgtgtattctgttgatttggggtggagagttccgtagatgtctattaggtccgcttggtgcagagctgagttcaattgctggatatctttgttaactttctgtctctttgatctttctaatgttgacagtggggtgttaaagtctcccattattattgtgtgggagtctaagtctctttgtaggtctctacggacttgctttatgaatctgggtgctcctgtattgggtgcatatatatttaggatagttagctcttctcgttgaattgatccctttaccattatgtaatggccttctttgtctcttttgatctttgttggtttaaagtctattttgtcagagactaggattgcaacccctgcctttttttgttttccatttgcttggtagatcttcctccatccttttattttgagcctatgtgtgtctctgcacgtgagatggttttcctgaatacagcacactgatgggttttgactctttatccaatgtgccagcctgtgtcttttaattggaatatttagcccatttacttttaaggttaatattgttatgtgtgaatttgatcctgtcattatgatgttagctggttattttgctcgttagttgatgtagtttcttcctagcctcgatggtctttacaatttggcatgattttgcagtggctggtaccggttgttcctttccatctttagtgcttccttcaggagctcttttaggtcaggcctggtggtgacaaaatctctcagcatttgcttgtctgtaaagtattttatttctccttcacttatgaagcttagtttggctggatatgaaattctgggttgaaaattcttttctttaagaatgttgaatattggcccccactctcttctggcttgtagagtttctgctgagagatctgctgttagtccgatgggcttccctttatgggtaactagacttttctttctggctgcccttaacattttttccttcatttatactttggtgaatctgacatttgcttttcttggagttgctcttctcaagaagtatctttgtggcgttctgtgtatttcctgaatttgaatgttggcctgccttgctagattgggaaagttctcttggataatatcctgcagagtgttttgcaacttggttccattctcctcgtcactttcaggtacaccaatcagatgtagatttggtcttttcacatagtcccatatttcttggaggctttgttcatttctttttattcttttttctctaaacttctcttctcacttcatttcattcatttgatattccatcactgataccctttcttccagttgattgaagtggcaactgaggcttgtgcattcgtcacgtagttcttgtgccttggttttcagctccatcaggtcttttaaggacttctctgcattggttattctagtcagccattcatctaatttttttcaaggtttttaacttctttgcaatgggttcgaacttcctcctttagctcagagtagtttgatcatctgaagccttcttctctcaactcgtcagtcattctccgtccagctttgttccattgctggtgaggaactgcgttcctttggaggaggagaggcgctctgatttttagagtttccagtttttctgctctgttttttccccatctttgtggttttatctacctttggtctttgatgatggtgacgtacagatggggttttggtgtggatgtcctttctgtttgttagttttccttctaacagtcaggaccctcagctgcagttctgttggagtttgctggaggtccactccagaccctgtttacctgggtatcagcagcggaggctgcagaacagcggatattggtgaacagcaagtgttgccgcctgatcgttcctctggaagttttgtctcagaggagtaccaggccgtgtgaggtgtcagtccacccctactggggggtgcctcccatttaggctactcaggggtcagggacccacttgaggaggcagtctgtctgttctcagatcttcagctgcatgctgggagaaccactactctcttcaaagctgtcagacagggacctttaagtctgcagaggtttctgctgccttttgttcaggtatgccctgcccccagaggtggagtttacagaggcaggcaggcctccttgagctgcggtgggctgcacccagttcgagcctcctggctgcttttttttacctactcaagcctcagcaatggcaggcacccctcccccagcctcgctgccaccttgcagttggatctcagactgctgtgctagcaatgagtgaggctccgttggcgtaggaccctctgagctaggcgcgggattaatctcctggtgtgccatttgctaagaccattcgaaagtgcagtattagggtgggagtgacccgattttccaggtgctgtctgtcacccctttctttgactaggaaagggatttccctgaccccttgcacttctcaggtgaggccatgccttgccctgctttggctcacgctcagtgtgctgcacccagtgtcctgtacccactgtccgacaatcctgtgtgagatgaacccggtacctcagttggaaatgcagaaattacccgtcttctgcgtcgctcacgctgggagctgtagactagagctgttcctattcggccatcttggctccacctccagaaaatttattttcattgagatataaaagaaacatttttaaaaatcgggtggctcataaattttcagaaacacagaagaatcaggcttggtatacacacattatgcacaatgcccaatatgagcctggaataaattccacacatcaccaggacacagacagataaatgggcataatctccagcctagaactgtcaggtcaagtaacctcaaggaagaccacattgcataggtttgaggaagtatttgtaagaagatagtattgagaactgggtcttggaaggaattgggcatgtggactgtggctcatgaaattgacttgaggcagatagatgagaaaggatgggaatgtaatgataagtaatctacaagcctgtttgtaaggcttgtgatggtaaagtaaggtgccctttgggaagcaggctaattgaactgcctagattcaaggaaggcaaagactccgatgtccggttcagatggaccatggataatatacaaggaaatatctcctagtagagtcagggatcatggacaatattgggtcagaaatttgtcccaagatcaggatccacatccagagaaagaagccatgtctggacctgaagaggaggactccctgtgtttttattgggaggcaatgactgggtagaactttggggtgtctttccagacggtgtttaaataatttcatggataaaatgcagtttacatttttggatatttggtagctagcagagctcagtattacacactttggcaaaggccaaaaaaaaagcctgattctcgtgtgtttctgaaaatgtatgagccacccgatttttaacttttgactcattaaaaattcagaatcttacttgtaaagattagaacagttactggaagggggccaatttggtcagggagaacctattttcgttgctgcttccagtgtgatcatatgatccctcccctcctccatctcagatttccagattttcagaatggagtccaattttttgctttggcccagaggagaaagtctaagaaatatgtaaatatactgagtaaacttaaaaatttcacagaagttgtgcctttaccagaagtagtgggttatttaccttcagtatcctctatgaattctataattgtaaactggtgagactagagtgccaattaggtaattgcaaagatatttccctggtgctaaatcttaattagtggagacagctaccagggatcagatgctaactactgattcagtagactattgaaagtaaattaatacaagtatctaccattcacagaagaaagtattgactccaggagaaggagaagggctgaatgtcaggaagcagacactggctgtgtgacactgatttaaactgcaagtagaaattcatcagggctactaattttatcacaagttagagttaatgacctgattaaatatctcataagtattgaatggtttatccctatttgccctataaatttcaccttttcaatgtgcagttttaccagcgtaaacttttttgaaaatctaactatcacattatagcagaagtgtctacttttactattatcagctaaaacatctttttggcctcctaataaactgctttgttagaaatatagttgcactgtatcttcccaggtagttttaattgactttctacaaatcgccaaatttaattgttcctagatagttgcatgttttaaagaaatccaggaaaaatactcctaaatatgacaaaaatatttgatgcaattccttgctcatattattattcttgtaaattatttttctttaatttctaaataatacatgtattttctttttttaagaataagactcaaatttcaatacacaataaattgaagaaatagataagtttggacttgcaaatgttctagtcagattatcacagggcaaaccgcaaaattgaggctcagcccgggatgccatgtgggttcttgccttcatgcaggaaggaattcaagagcaagccaacagagtaaagtgaaagcaagtttattgaaaagtcaaggaataaaaaggtgcctactcataggcagagtagcagcatgagcttaccacatacttggggttgttatttcttgattatatgctaaacaaggagtgaattcttcatgttttctgggaaaggtgaggggagttccaggaacggaggggtcctcaccttttcagaccatatagggtaacttctggactttgccatggcatttgtaaactgtcatggtgctggtgggagtttcctttggtatgttaatgtattctaattataatgagcagtgaggaccaccagaggtggctttcattgccatgatggttttggtaggtttcagtcagcttatttaccacatcctgttttatcagtggagtctttgttccttgtatcttttgaaacaagtccggctgaattcctatctcaggaatattcaagggcattttgaaaaacatacatgcttgggttgaaactccagatttcagatttttagtataatcgagatatgcctttttcttatgtctatgttttagttaattttggcatagttataagtaattaatatatgacaataacataagcataaaattagaaaaacatttagaatttaggctgattttctttccaatctgcattcctcatatatgtcctctgtcctctctctagtacaaaaagggtttccagttcattgtgtatcattccataggtagacacatatatgaccatatattatttttattaattactattctgcatcttacttttattaatgttgttatggtaaaatttaaaacacatacacacacatagccataggcaagataaccacaaggaaacaaggtatgataaattgaacacctgtgtgaccacttgccagttcaggatatagaccaatgtcagcacgctcagaagccctttgcattcccatttccaaacaaaaagtcctccttccacctgaatgtaattactatcttatcttgtagtaatactcttcatactttatttataagttctaaagaaatgtgtaaacagtgtacattaattttaaaccacttattctactgagtttggcctccagtgagttttgtgtttatgacacattcctgtctctcatttttattgacatataatatttcattgtgtcatcttactgcagtgtgtttagccatatcaggattgatgggcacctatttggattctatcacatctgatgctgtaatggagatggctatagaaatctactggtcttcctgtgcaaagctctaattgattatatacccaggaactgctgcgttatagcacaagtaaattccaaatttactagaaaataacacatgacttccaaagagtatgaaatttgcactctattggaagactttggaagtcataatgatcaaatttatcatccacacaatttttctgtgtatttcttttattatttttaaagtttcacaattctggtatatatagtgcatggtggtgttactttacatttctctggtttttagaataatatttaatactctattttatattaacatagcatagttcattaattcattctactttgggacattttcagtttctgactattttgagtaatgctgctatgaattttcttctacacatctatgatacgtgttcttaaacttttatcttttttataagtttacacacatatgtgtatatatgtgtatatgtattgctgtacacatacataagcatgcatgttatatattagcatatatgtaatatataatatattgaagtatatatagaaattacatatatttttatataatattcataaatacacatgagtaatatgtttatagatacgtgtatataaaatatacttgtctttaaaagatatataactatgagtatatataattcatatatacttaagtgtatataaatatacatttacatatatttctattactatatgtaagtatatttaagtattatatatgtatatgtacatatacttacatataatttaagttatctcatgtatgtttgcatatataatctgtctatacattaggtaattcttccaaaaagttataaaaatttgcatcccagtaacagtatgcgagaatgtgtttgccattttgtaccagaaagcactttgtgctctaaacatgtagatagttgccaaacatgtaagtgaatatttatttctgaatgccatgtcattttactttctcttaagggaagtcaacattattacatgaacatttcagatgtcatctcctttgatattttggtttcagccatgaaaacaggaaatcaaagttttgggacagattttctacttgttggtcttttccaatatggctggataaactctcttctctttgtcgtcattgccaccctctttacagttgctctgacaggaaatatcatgctgatccacctcattcgactgaacaccagactccacactccaatgtactttctgctcagtcagctctccatcgttgacctcatgtacatctccaccacagtgcccaagatggcagtcagcttcctctcacagagtaagaccattagatttttgggctgtgagattcaaacgtatgtgttcttggcccttggtggaactgaagcccttctccttggttttatgtcttatgatcgctatgtagctatctgtcaccctttacattatcctatgcttatgagcaagaagatctgctgcctcatggttgcatgtgcatgggccagtggttctatcaatgctttcatacatacattgtatgtgtttcagcttccattctgtaggtctcggctcattaaccactttttctgtgaagttccagctctactatcattggtgtgtcaggacacctcccagtatgagtatacagtcctcctgagtggacttattatcttgctactaccattcctagccattctggcttcctatgctcgtgtgcttattgtggtattccagatgagctcaggaaaaggacaggcaaaagctgtttccacttgttcctcccacctgattgtggcaagcctgttctatgcaaccactctctttacctacacaaggccacactccttgcgttccccttcacgggataaggcggtggcagtattttacaccattgtcacacctctactgaacccatttatctacagcctgagaaataaggaagtgacgggggcagtgaggagactgttgggatattggatatgctgtagaaaatatgacttcagatctctgtattgattgagcattaacaacataaaaagctgttcctgaaaactatctggaaagatataaatatgtgttttctgtatagaagtcacaaaaacagtgtttatcaatcttgtttaacttgtaaagcaatagaattcaggcttcttaaatctgtgttcccctggcattttaatgcttttacttgccctcttgaatactctgaaatgtgaaccataaaaataaaatctacttaaacatttaacctcaagataatctatataacaaccaaagttaacagagagaaaaatgcataattcatttattccttctttcactcaggtgttttaatgctttaatttgtgtgtgacactgttacagacactggtcatgtgagagtaaacaaaaatgaaagctgacagaaatctctgctgatcggcaaacttaatttctgttcctgttttcctttcgtggttttcatgcttgattaataatgtttctttaagaaaatccagtgattgaaatttattaatattgaataatgtattaacaggaaagaaattgctgttttcttatcttgaggaagagaagagtcaaagcttacagcatctgaagggaaaatcatgacaggtggcagtagaaaagagagtagggtgaaacaaagacaggagtatctattgatgtgactcttttccttctgcaccgtaacaccttttgtgcatgcaaacacaccacacaccacacacacacacacacacacgaggtgcacacccggggccacccaggcacttctgacaagttcctttaagggggattacacaactgcttttccctctgcctctattttcagaaaatattctcttaagacacaatgcacatcatccattcatttctttctttctttctttttttgtttgtttgtttgtttttttgtttttttgagatagagtcttgttctctcgcccaggctggagtgcagtggcttgagcttggctcactgcaacctctgcccctcgggttcaagcgattctcctgcctcaggctcccaaatagttgagattacaggcacccgccaccacacccggctaatttttgtatttttagtagagactggttttcaccatgttgctcaggctggtttcgaactcctgatctcaagtgatccttctgccttggcctcccaaagtgctgggattacaggcatgagccactgcgcccagcctcagtcatttattaatacaaaattaatatatcaaattattgttattgatactattgatgttttttagtatcaatattccattattaaacatttgattattttttatttaatcaatttgtccagaaataccagcttttgatttctattttttctttttcctccccccttacttcattgacctcctataattacctacctatttaaatatgaatctcaaacagctctttatatattatttttgagaatcctagtattattaaaaaataatttcacaatgtcttttacttcctaaccagttgtaagttctcctcctcttcctccttctcctcctcctccttctcctcctcgtccttccttcctcctccttcctcgtcctcttcctcttcttcttcttccttctttcttctttctttcttctttttctccttctcctcatcctcctcctctcgttctccttcttcttccttttaaatctcttctcattactgtgtatcatatcagaaatcaagactttctgttacagaaagtagaaaggagaaagaggaacaaacgtttgtgtgtaaaaagcatatatgtggtgctttttattcatcgcataaagtaaaccatgaataatcataataaccataaataataataaactttataatataaaaggagaatatgactccacttttatagataattaaactgaatgtcagagagtttatgtaacttaccctaaatcataaaactaagaagttttaagattagaagagttcaatggaaccatcctgcttttggaagaataccttttgggacaagacatttttatttatttattttttttagtatactttaagttctagggtacatgtgcacactgtgcaggtttgttacataggtatacatatgccatgttggtttgctgcacccatcaacttgtcatttacattagatatttctcctagtgctatccttcccccagccccccaccccccaacaggcccaggtgagtgatgttccccaccctgtatccaagtgttctcattgttcaattcccacctatgactgagaacatatggtgtttggttttctgtccttgtgatagtttgctgagaatgatggtttccagctccatccatgtccctgcaaaggacatgaacgcatccttttttatggctgcatagtattccatggtgtatatgtgccacattttcttaatccagtctatcattgatggacatttgggttggttccaagtctttgctattgtgaatggtgctgcaataaacatacgtgtgcatgtgtctttatagcagcatgatttataatcctttgggtatatacccagtaatgggatggctgggtcagatggtatttctagttctagatccgtgaggaatcgccacactgtcttccgcaatggttgaactaatttacacttccatcaacagtgtaaaagtgttcctatttctccacatcctctccaacatctgttgtttcctgactttttaatgatcaccattctaactggcgtgagatggtatctcattgtagttttgatttgcattcctctgatgaccagtgatgatgagcattttttcatgtgtctgtttcctgcataaatgtcttcttttgagaagtgtctgctcatatcctttgcccattttttgatggggttgtttgtttttttcttgtaaatttgtttaagttcttcatagattctgggtattagccctttgtcagatgggtagattgcaaaattttctcccattctgtaggttgcctgttcactctgatggtagtttcttttgctgtgcaaaagctctttagtttaattagatcccatttgtcaattttggcttttgttgccattgcttttggtgttttagtcatgaagtcttcatgggacaaggcatttttataacacacgttcccctatgttattactagctctttcttgacacattggttattaacaaagtgtaggctagcaggattggatgctttcccaagaaggagataattactttacaaatgctatctcatttaacaatagtttaaagcagacctcactttcaaattagtcatatcctgatgttagcagtatattagcaaaacaggccattttctgccaggattaaatatctccagatttgaaaataatctgcatgaaatgtagaaagtatttggtaatcttttttctcctaaatgtgatccagttggcattttcagagcctgaagctaagggctttattcagatgccttgcattttgtaccagcagcaaaagcaccgatgagatctacatggtgatccagggggccagagccatggaatactaggaaccttctacatgatggctgctcctgatgcagattattgctaagactctgagactgagtgcatacaacatgggttggtgttctctgaagcttttgggttaattccgccaggtttttcacttcccggccaactcctatgcagaactatacttcagtcagttactgaatgcttatgttttggtcatgtactacagcattgtaataacctgccagaattaagaaaacctgtgttgccagggaggatgttttatttttttatttccaaaattatttccataattttgaggatttcctcaaaattaatagcattttgtaaacaaagaatctggatctcccctaataatttaataactattccattttatagtctctcatatacattttataaaatttgtaaaacatgacatttgcctgtcaattaacatgtatacgtatgtaactaacctgtacattgtgcacatgtaccctaaaacttaaagtataataataattaaaaacaaacaaacaaaaaacatggtctctgagatcaccttcgctttcatattgtattccatggcaacaatgtaatagttttgtaatagtttttcttgttatgcatcatgaagaatcttggggaaaaacccacaacttgtgtgtatataggatttttccccctttcttttgggttacttcttagaatgcaacttggatcatattcaatagtaccaagggacaagactaactctacagttttcatcctatattgtcaacccgattttataaagattttttatttttactctaaaattaatcttcactatattccaactggcaaagcatattataaagaaacacataaatttctaggtgagtcactaggagatatacaaagggatgtaaaacttgtagaagagttactcacgtaactttatttattcagatccattgcagccccagatcccaggctctggtgtaagagctattttatcaacgtggtacatggagctattttatcactgaggaatctttatggcttcatgcatgcaggaggagacaggtcagctggccctttctgaaagaaccattcttcctatgtatttaactcaaagtaatcaatattccaatttgttgtttgggagatggcatgtccttcactcctttactgataaatgactatatagatacggtaattttcaggcaagaaatttggcagctttaaagagactgttgattttaccaagtaaacaaatataaacatatatttatttctatatcaacttatttataaatatatactcatgtgatctccaaagataaaaaaattaaatccaaaaattaactgtgatacaatagtttcacatacctggagactgtttttttactttgcttttttttagtctgaatcttttcttttcttcaaataaggagcagaagaacgtagagcagacactattagggagcaccagccatcgagatccaggttggcaggtccttgcagtactttggaagtagtggcacctagggattgtggaagaaaggttggttgaggcatttatcctgagcctgcaggttgtgctctcggctatctaacagaactcagccaatttgttatagtttaaacctgttttattcccataaacattgacataatttgatgatagggtcatgtcatcaatattctgcttccatattctctttcagacacattaagtgaattggtttaaccctcatctagataaagtaaagtgagtataacttcttgtataaggtgtaagaaaggggtccagtttcagttttctgcatatggctagacttaaacttccacgctataatagtgggagactttaacaccccactgtcaatattacacagatcaatgagactgaaaatttacaaggatattcaggactggaactcagctctggaccaagcggaccgaatagacatctacagaactctccaccccaaatcaatggaatgtacattcttttcagcaacacataacccttattctaaaattgaccacataattggaagtcaaacactcctcagcaaatgcaaaagggcagaagtaatagcaaacagtctctgagaccacagtgcaatcaaattagaactcagggttaagggactcactcaaaactgtacaactacatggaaactgaacaacctgctcctgaatgaatactgggtaaataacgaaattaaggcttaaataaataagttgtttgaaaccagtgagaacaaagacataacataccagaagatctgggacacagctaaagcggtgtttagaggaaaactgatagcactaaatgcccacattagaaaaggggaaaaatctaaaattgacacactaacatcacaattaaaagaaatagagaagcaagagcaaacaaattcaaatgactgcagaagacaagaaataaccaagatcagagtttaactgaaagagatggagacatgaaaaacccttcaaaaaaatcagtgaatccaggagctggttttttgaaaagattaacaaaatagacaactagcgacaaataaagaagaaaagagagaagaatcaaatagacacaataaaaaatgataaaggggatatcaccactgatcccacagaaatacaaactcgcatcagagaatactataaacatctctatgcaaataaactagaaaacccggaagaaatggataaattcctggacacatacactctctcaagactaaaccaggaagaagtcgaatccctaaatagaccaataacaagttctgaaattgaggcagtaattaatagcctacaaaaacaaaacaaaacaaaaaaaacccaggaccagacagattcacagccaaattcaaccagaggtacaaagaagagttggtaccattcattctgaaactattccaaacaatagaaaaagaggaactcctccttaactcattttatgaggcaagcatcatcctgattccaaaacttggcagagacacaacaaaaaaacaaaatttcaagccaatatccccaatgaacattgatgtgaaaatcctcaataaaatactggaaagctgaatccagcagtacatcaaaaagcttatccaccacggtcaagttggcttcatccctggtatgcatggttgattcaacatatgcaaataaataaatgcaatccatcaaataaacagaaccaatgacaaaaaccacatgattatcttgatagatgcaggaaaggctttcaataaaattcaacaccccttcatgctaaaaacactcaataaattaggtattgatgaaatatgtctcaaattaataaaagctatttatgacaaacacatacccaatgtcacactgaatgggcaaaatctggaggcatcccatttgaaaaccataacaagacaaaaaatgccctctctcaccactcctgggcaacatagtattggaagttctggccagggcaattaggcaagagaaagaaataaaggatattcaaataggaagggaggaagtccaattgcctctgtttgcagatgacataattgtatacttagaaatccccatcatctccacccaaaaactccttaagctgataagcaacttcagcaaagcctcaggatacaaaatcaatgtgcaaaaatcactagcattcttatacatcaataatagacagacagagagccaaatcatgagtgaactcccattcacaattgctacaaagaaaataaaatacctaggaatacaacttacaagcaatgtgcagggcctgttaaaggagaactacaaaaagtgggcgaaggatatgaacagacacttcccaaaagaagatatttatgtggccaacaaacatttgaaaaaaagctcattatcactagtcattagagaaatgcaaatcaaaaccacaataagatatcttctcatgccagttagaatggtgatcattaaaatgtcgggaaacaacagatgctggtgagcaagtggagaaataggaaagcttttacactactaatgggagtgtaaattagttcaaccattgtgggagacagtgtggcgattgctcaaggatttagaaccagaaataccatttgctctagcaatcccattcctgggtatatacctaaaggattataaatcgctctagtataaagacacagacacacgtatgtttatagcagcactatttacaatagctaaggctgggaaccaacccaaatgcccatcaatgatagactggataaagtaaatgtggcacatagacatcatggaatactctgcagccatgaaaaagaacgagttcatatcctttgcagggacatggatgaagctggaaaccatcattctctagccaactaacacaggaatagaaaactaaacatctcactcataagcgagagttgaacagtgagaacacgtggacacatggaggggaacatcacacaccagaacctttgtgggggggccaagaggagggatagcattaggacaaatacctaatgcatgcggggcttaaaacctaggtgatggattgatggatgcaacaaaccaccatggtacatgtatacctacataacctgcacattcagcacgtgtatcccagaacttaaagtatattaaaaaaaaaagttattttgacagagagaaaaaagagaccacatttacataatgtttactacggtgtatttttataattgttctattttatttttatttttgttaatctcttacttgcctaacttataaactgaatgttatcataagtatatatggatccaaagaaatagtggaaatagtgtatatgagactcaatattatcctcagtttcaggcattccctggaggtcttggaatgcatcccctgtggataaggaggaactaattcacttatctttctgccgccctgcaggaaggattgtaggaatgccccatggaaaaatacaatcaaacatcaactgatttcatcttattggggatcttcccaccatccagaattggctttctcctcttcattctccttgttctcattttgctattggctttaattggcaatcagtccgtgatccttctcatcttcttggacactcatctccacacgcccatttatttcttacttagtcggctctacctcattgacctaaattacatctccactattgtccccagatgttttctgattttctgtttggaaacaagtctatttccttcattgggtgtggaattcagagtttcttctttgtgactttagcaggtgcagaaatgctgccactgacatcaatggcctgtgatcattatgtagctgtttgctttcctctccactatcccatccatatgagcaagatagtatgtgctgatgataataggatcttggataatgggctctatcgacacttgtgctcacatttcatatatgccccatatccctgttgctcagccagggctgtgatgtcccagccatggtgactctggccttcgtggacacctgggtctatgagtgcacagtgtttttgagcacaaccctctttctcatgtttacctttattggtattgcatgttcctatggtgaggttctccttactgtctaccacattaaatctgcagaagggaggaagaaggcctattcgacctgtagcacccacctcactgtagtaattttctactatgcaatgtttgcttatacctatctatatccaagatacctgcaatctccaacagaggacaaggttctggctgtgttctacaccatcctcacctcaatgctcaaccccatcatctacagcctgagaaacagggaggtgatgggggccctgacacgagtgagtcagagaatcttccctgtgaagatgaagacaaactttctgccttagagtccaagcactagcctcacatcaacttagcagtgtacagcagttacgaaaaataatattccatgccaggagcgtggaacaaaaattactctagaaaattttttaaaattgagtcttgacattataattgcatattctaagacatctatgttgttttgtttttgctgtttctttttatcaaaatatagatcatttattttccactaaattgtgggcagtagggtttcattaaaattaaaataataaatgttcaaactaatcatagcattcagcataatagttatatgtcattcatttctcattattattaagacaaaaataataaattatttaagattactgaatctaattgaatataagatagtattgtattttctctcaaccggtgggtatagcttattctttttcctaaagtaatgatttattaataaatttacctcaggataaataattatttttggggataagccaatttgtctttagaaaaacaagagtttctttacaagagattctataggagttacagtctactgagtgtggagtagattatttgaaccattccccagtcacatcacaacacactcaatttctgcccccttggttgccaccggtattctcatacaagacattctgcctggacaattttatttctacttatttttctcataaatcaacacatctatacagcttgggttggggtcaaatcctctgctccactatttttatacctgcttaggcatgtgcctaaaagcatcaacattatttccataaaacttatactgtattatatattgaaaatttgctaagagaatgggttttaagtcctcttactataaagattgtaactatggaaagtgctgtataatttgagtgtagtaatcatttcaacatgtagttggatgtcaaacatcatgttgtacagttttaataacataaaatatgtggcacatctttaatgaaatcaataatcaatcaatctagactggcttgaaaagttcctagaactatctaattaaaatatattttgatgatgtcattttctttagtagggtatgtgattctctccactggctaattcactcctacactggcaggatcacactgtacctggaactttatgttctcttcatcttaagttgaatgcagttttctgaacaagttttgaaaaggcagtccttcattacattaaggatacaattggttttacctttaatgcattgttctctatcctcacaagtttctttcactgcgtgaatcctcatttctcccttttctcagggtacacatcaggtatcatctacatgaggaagcatgttgaatgtgcttgttcaactttatctttatattctactctcatacatcctactatttctaataataacatgtgtcatcacaatgtattgtaataatctcttttctctatggctccacagactattatctgttaccatcagtggcttggtcttttcctcttcacatgcccagatgatgctcttaagtacctgttctatgttcaaattattcatacctcaaagcatgtttatgtattcttagcccattgcattttcacataataattagaatcaaccagcaaaatgtctataggaaaaaagttttgtgtctcagtgtgaattcttaccatctagagcatgatttgtgggaaaatgaaatcttttctatattaaatctcttgattcattaatgaaacatattttactacatatatatctacttatgaagagcagaatcccatccatatctaggcaatagtcatgggaatgattcctgtagatacttttttttagacaccgtcttactgtgttgccaaggctggtctcaaacacctcagtgcaagtcatgctaaaactattctcataaagtgaagaaaactaaattgctgggtttttagccaaaagcataaacttttagtagaagcatacactaagcatgaaccagctcgcccgatagcctacttccgtatgactgcttactgcttaaaagtcaggtagcccttctcacagggtcctaactaccgttaattgtttctttagatatcatctttaattttaggaaacctcaagttttctatttaaaatgttttccggatcctgaattctagtggatccactgacgcagggggtctgtggagcttgtctgagaaactgactcagtgcaggatgcagcatcttcatctcgctgtctagtgactccatcactcacttctcgaccaatcagcagtccccacacttcagctcatcacccgtccagactccttaaaaacgtcatctccaagtctctccagaaggctgatatgaggcttcctttcttttctttcttcagagcgatgaagccagctggacttcctgggtcgggtggggacttaggaaaattttgtgtcttacaagaggattataaatgtaccaatcagcactctgtaaaaatgcaccaatcttgctgctgctcagtcttcgggtccgcaccacctttaagagctgtagcaatcaccgcgagggtcccaagtcagtgagaccacgaacccaccggaaggaacaaactccagacatacttcagctgacatatgattattaaactccttctctgctgcaactcccactgttttgatgttttggtctgctaccactcaatgggtaattgaacccgtgggcgtgtaacaatcctcctcccttggtctccccataggtggaattacaggcctgtgccaccgtgccctgctctttaacaaaagatttggcataatggttatcacttgaatcttggatctttgggacatttgtatttgggcttctttttaagtaaatgtcattatgcatttcatgtgcctgcaaaggacatgaagcaactatgttgtttaatgaataattcaaatggactgaacacagacattaaaaaatttaaaataaacaggtcacttttatttacattccttgctctcatttcttccttcagtataaaccaagttgtggctactctatgcttagtggtttctactgaggaagtgtgaaatgttcaattcccacttccagagcattctcagggaaagcaggggtctttcaggatcccctcctcctctgggcttccttgtgttgcgtaggagctctaagggactgccacagtgcttctctgacacaggccactcggacctgtctactctcctgggcaccctgccacagtcttggtggtcccctgaagatgattctgtcctgagatccagactgcaggcttcctttgtttcatatgcccaagtccatgttagtttctgtctcatgtcccccacatgtgtttacaggatcccagtgggtagtcttgagtcatgacctataaagtctttctttcatacagaaatcctctcaaatcaccttttcccacatcaaataaggattcttccttccttattcagcacaaatgtgttttgtctactaaagaagatataaaaacagtgtacaatgtgcactaaatgtggcatcttcttttatattattatactttaagttctagggtacatgtgcataacgtgcaggtttgttacacatgtatacatgtgccatgtggtttgctgcacccatcaacttgtcatttacattaggtatttctcctaatgctatccctccctcaggccaccaccccccaaaaggccccagtgtgtgatgttcccctccctgtgttcatgtgttctcattgttcaactcccagttatgagtgagaatatgtggtgtttggttttctgtccttgtgatattttgctgagaatgatggtttccagcttcgtccatgtccctgcaaaggacatgaactcatccttttttatagctgtatagtatttcatggtgtatatgtgccacattttttttatccagtctattattgatggacatttgggttggttcaaagtctttgctattgtgaatagtgctgcaagaaacatatgtatgcatgtgtcttcagcttgacctccgtgggctgcacccactgtccagcctgtcccaatgagatgaaccaggtacctcagttggaaatccagaaatcacttgtcttctctgttggtcccgctgggagatgtagactggctgtgttcatatttggccatcttggaaacgactcctagatgtggcatctactgttatgttcaaaggcatggtttaaaaggtaaagaaattctttagattttcaaatgcaagaatattgaaacagttgtgtttgattttcaggaaattttctttgctacctaccctgattagatcattatataacatacacttgtataaaaacatcaaattgtaacccataaattcatacaataacagtgtatcaactaaataaatatttcttaaaaacatttataaaattccaaatatataaaatggactaatgttactttttcaagatagaaggcataattaatttactggaaaccatggaaaatttgagtacatttaagatactctttggcataaaaatttaattactaaatataccctagatagtattataccacaatcaatagttgcatcatttttatcatcaattttaataacagaaaattgttttaaaatttaatgggcatttccagaataaaagaaacaatataaacatatacttaaaatatgttaaagataactccaatatgtgatattttaataccttctacttatgtgttttaagtaaattaacatagttccacttttatgttctaaaacttactgccagtataaactaaattgggaaagaaattaatatatacagagatatcattggtatgaatgcagtgaataacaacatataaaatgtaggatttcataaactattagagacacaaatgcattagtaaaacctgaataaacataattgtttcttttcccagtgagtttacctttgacgtgacttgaaacatctaaatacattatcataactcatttctaaacgttggactaaggccatcctatgttattagtgattcagcctagaatgtccaaactctcagtggacattccccggtgaatcctagcaaaacagtcattaaacttgttcttcaggtaaagaaacaccggaatcatggttgctactgaatcaccatgaagctctctaaaatctcaagtgtagggatgaaaatgaatacatacctttctttaaaaagcattcagagatcttgctcagaaaaatgactgttcatatgatgcctgtacgactcctcacagctaaccaaggcagtgtgtgtttgaaattgaggagataataaaaggtactaattatatttgtattttaaaatttttattgatcacagggaagaagggactctggcaactgcttaagagaactttgtttcagaaatagaattgaagtctgagcaatagtgactgtactttctgttaacaaaattcagcagaaatcctggagtatagaatgcagacaaccaacagtggttttgctgctaactcataaatgtgttttctggatgggaagctaaatgatgttcatggaagagatggggctaaattacattagaatatgcttttatgggctcaagtcaaattaatgaatccacatataataatccagtctttctagtaaaatacctgaaagtactagtgttgtttttgcgtaaaaatattaaaatgacatgaaggtaaaggcaaaatgagaatggttaaaattaccatctgtaaagcaataatatatattttttaaaataaaggaccctcttctgaaaataaataatgcaggtaaccatatgattagtagctgtgatatggttatccagattttgtttttacatccaatttgtgcaaaattatagtgctttgtgcttttaatttttatattgtgtttattttttcttcaagacacaatgtaaacttccagtgaaataatagaaatatctgctttaacaaccatgcagagtttttgtgagaagcaaatgagcatagtatgtggaaacaatgtgaaggctgtattattctacagtcatagcggataacaagtgtgtgagtgtaagtgatagtgattattttgatgttgagggcactgataatgagaaagatgcttaaacttgcagcttctcttcaatgataccctcagtcaagtaatacatgttcactatgtcacagactgctcataataacaattttttttttttttttgagacggagtctcgctctgtcgcccaggctggagtgcagtggtgtgatctcagctcacagcaagctccgcctcccgggttcacgccattctcctgcctcagcctcccgagtagctgggactgcaggctcccgccaccacgcccggctaatgttttgtatttttagtagagacggggtttcaccgtgttagccaggatggtctcaatctcctgacctcgtgatccatccgcctcggcctcccaaagtgctgggattacaagcgtgagccaccgcgcctggcccataataacaattttaagtagagcagccttattttgtaatgaataataatttttctttgaaaatagttttgataaaactgaggacagtgtaggtttcataaatctctgaattagtggaaaactgcagtatctggactcaagaggaccatcctccttggttcccaagtctatcactaggtcattgcacagtcatgaataactctcttcaaatccttgtgattcagttactctttctgataatgagaatatagttgaaaaatctttgtcttctatgaatatatgaatcactacaatttggttatttttattatctcattttcaactctaaattgaaggataggaaaaagagatctatgcaatgcaatgatgcattctgactttaaaagatagtgatatgtaattcatttgaaacgtgggcactgtttggagaattttaattattatgctgaatatgtagatcctcaacttgattatgtagtatattaaatgtgtattttttagtaagtgaattcttccagtagggaaacttttatattgggaacaagacagaaattgcatttcttttagagtttctgagaaaccatttttctataaaaatgtatggttgttgctggatcaagtgaaagcacagtaaaaccaggtgatacgaggaaatagaagaagttgaaatgattaaattttaatcattaaaataaccttatttgtgatttaaaaatttttattatttcacagttatttactatctataatgatttttttattttaataaatttaacctcttatatttttgttttgggtaattaaagtgagccagccttatttcagacttactgcctaaaaatatttgaaggataaaatagaccacacattttaaagaagtttatgtaaatgtttatttttatatataatgtttatttatatgtttgcataaatatgtatatgtgtatatcaacttatatgtgtatgtgtttgtttgtgtgtatatatatgcatatgtgtatgtgtgtttgtgtgtaatctggataagtccacttaaaatctctgaatctcaatttcatcatctataaaacgtcgtggtgatgtccacgtgaagagtttgttattaggattaaatctaatggaattatggaacaaatcctgacatattgcaagtgccagtgtgtggagacagtcagtaaaagttcatgccattatccttcctttcatgccagacgtcgcccgggttgaatgtttggttttcctactcactatgaaaccatcatcagaattttttctgcttgctttttctccagtgtacaacatcattaatgctgacacctagatatatacattttatgagaattacaaaaataaaagcaagtgtatatgtttttaaatgggcttaaaatacttatagctattttggtggataaaaaactaagggacagaagtaactcatttggatttatttttatctaagaaaaaaatgtccttaaattacttagacagatatataatggctgagactgcttccttgttagtgacagggctctaattttatttaaataatgtaatatgatagaattagaaccgtggaacgtgaataatcaaagagacactacattggtgttcaagagatattgtaacatcacagaacatatctcctgccactcacgacttgcaaagtccaattaacgagaacaaggtctggtagaaagaaagtgactttttcttccaagcttagctgaggggaagcaggacaggtgtctgccttattgggaagtgcttcccctttcggggcagtaggcagggtcttttaatggggtcttggcgtgaatgacatgcagggagtgaggagatggggggtccagtgattttcttctgatgtcttttctacccggtggtctggctggcaccatcgcaggcagagctgtgttgtaaattgaggcaatctcctagtgggagggagttttgagggtgcctgatttgcttcaaggttccgtctctagaacttctaagtaaacacaaagtcatataaacttgccttgtagaacgcgtctggtggagacagtaaaggatatatttttattcctaaccagttaagtaggaggtggggggaggaggagaaaataagtcattattattattattattattattatttttaaatgaggtagtcagttaaaacgtggcattaaatatgagatctgatgtgccatttaggattctgtcctatgttacattttctctttttaaagttaggactataactatctcatggaaagttgatcatagactgccctgtataaaatacaaatgatagaaatgtttgaaatgttaattgtgttagtaatttcaaacagtatatattctacttgccaataactaaactactaatataaattacatactattgcatcacaattaatgctgatcttgtactgtttccaaatgacatatgtgaaaataatttgttcttctgaattgtccttcacaaattaccagaggtcataaaataattggaaataatttgctctgtagaggctgagaaacttgccagaattttcttaaaatgtatttgggaatccaaatatggaataatttcagtacattttaatgtttttatgaggataaatatgcataaggtaaactgcaccattttaactattttaagtgtggaattcggtggcactaagtacatttatgttgttgtgcaaccatccccaccatgcatctccagaacagtttcattgtctccaactaaaattttgttccctacacaattattctccctgtctcccttctgctatcccctgggttccagcattcgactttctgtctctatgaatttgactactctgggtacttcatgtaggtgaattcatacaatatttgcctcttcatggcttatttcactgagcataatgtattcaagatttatctatgttgtagcatgtgtcaaaacttcattcacttttacaactgaatatgtacttactacattattttttactcttttttttaatactttaagttctagggtacatgtgcacaatgtgcaggttagttacatatgtatacatgtgccatgttggtgtgctgcacccatcaactcatcatttaacattaggtatatctcctaatgccatccctccctccttcccctaccccctaccccacaacaggccccggtgtgtgatgttccccttcctgtgtccatgtgttctcattgttcaattcccacctatgggtgagaacatgcggtgtttggtttttttgtccttgcaatagtttgctgagaatgatggtttccagcttcatccatgtccctacaaagggcatgaactcatcacttttatggctgcatagtattccatggtgtatatgtgccacattttcttaatccatcctattattgttggacatttggattggttccaagtctttgctactgtgaatagtgccacaataaacatacgtgtgcatgtgtctttatagtagcatgatttataatcctttggttatatacgcagtaatgggattgctgggtcaaatggtatttctagttctagacccctgaggaatcgccacactgacttccacaatggttgaactagtttacagtcccaccaacagtgtaaaaatgtttctatttctccacatcctctccagcacctgttgtttcctgactttttaatgatcgccattctaactggtgtgagatggtatcccattgtggttttgatttgcatttctctgatggacagtgatgataagcattttttcatgtgtctgttggcagcataaatgtcttcttttgagaagtgtctgttcatatctttcacccactttttgatggggttgtttgttttttcttgtaaattagtttgagttcattgtagattctggatattagccctttgtcagatgagtagattgcaaaaaatttctcccattccgtaagttgcctgttcactctgatggtagtttcttttgctgtgcagaagctctttagtttaattagatcccatttgtcaattttggcttttgttgccattgcttttggtgttttagacatgaagtccttgccaatgcctatgtgtcctgaatggtattgcctaggttttcttctagagtttttatggttttaagtctgacatttaagtctttaatccatcttgaattaatttttgtataaggtgtaaggaagggatccagcttcagctttctacatatggctagccagttttccccgcaccatttattaaatagggaatcctttccccattgcttgtttttgtcaggtttgtcaaagatcagatggttgtagatatgcggcattatttctgtgggctctgttctgttccattggtctatatctctgtttcggtaccagtaccatgctgttttggttactgtagccttgtagtatagtttgaagtcaggtagtgtgatgcctccagctttgttcttttggcttaggattgacttggcaatgaggactcttttttggttccatatgaactttaaagtagttttttccaattctgtgaagaaagtcattggtagcttgatggggatggcattggatctataaattaccttgggggttatggccattttcacgatattgattcttcctacccatgagcatggaatgttcttccatttgtttgtatcctctttcatttcattgagcagtggtttgttgttctccttgtagaggtccttcacgtccgttgtaagttgtattcctacgtattttattctcattgaatctttaagtaactttggatattattgacatcttaacagtgttaagccttctaatctataaatacaggatatatttccatttatttgtgtcttctttaattgctgtaatcaacattttgtcatttttcagtgtataagccttttaccttcttggttatgtttattcctaagtgtttcattttttttgatactattgtaaataaaatcacaatctctttcagattgtttgttgttagtgtatagccacttgaagcctaggctcaaaacagacacagttttgtttctgtcacattcaatgggtcacagcaaattgttagtatatagaagtcaatagcttttgactattgttgcatgctgcaattttgcttattttgttaattatttgtaacagtttttagtgtgtaaaatcctatggctttctacatatatagttatgtcatatgcaaatagaaattatcctgcttcctttcttttaattaagataactttttttcttcttttgttctattgctttggctgaacttccaataatatgttgaatagatgcagtgaaattggacatttgtgtcttgttccaaatcctagagtaaaaattgtcattctcattattatcatgaagttgtgggttaaattcttaaccgtgatagaatttttacatcactttaatgttttattcaagtaatgcatagacatggtgtccacagtccgcaggctaaaatattcgacccataacaaactcttcctgaccccaaagataaggacttcaaaatttcttaccagtcttgccctgtttttgcccatgtattttcaaacaatatgcttatctgctaatgcttgatttaagtatctcaaataccagcccttgactcatgacacaggccactgtcactagttacctgctccccccagcatcactacccccaaactcattacccttctcccactttgtccacataaatacattccaatttatgtctgcagcaaggggttgacaacatcatctcatctgatagaatctattgattaaatacaaaaaatatatattcttgtaaaacctgatggtaatacatacatgcatgtatttcttctgattattattactactatttctctcaaaaacttaatattttatctctagataattaaaatttttagaagtgttttcaaggagacacaattttcatgaaattttttctaggaaaatatttctcactttgtgatttaacatgccatttgagtatggtggctaatatatttcagttctgagaattttttttttacaatattgagtttattattatttgctatgtgcatttctgggaatgcctgtaagtatatgttggtcctgttatattaattttctaatatttctctctcttctaattttcaatacttttaggttgttttcttttttccttctgatagaattttcccaatttgtcttttgaaattttcatttaaattttatcaattattgtatttttaatttccaagagtcatttatcgttacctgtcacatccttttacatagataatgatatttattttgtggatttcataacatatcatacatattttccttcctaaagataggaattcttatttttaaaaaatcattctttttgcaggtttctgatcattttaatcagggtatatatacatgtgtattgatgtttaagtgagtgtacatctttgtgtgtgtgtatagatgtgtgtttgcacactgtgtggatcttactctttcacattgttacacttcctcaaaggtctgctgacctttggctctaaaataatatttaagcctaaagacttcagtccttttaggcattcagtgcaaagtcgtccactgatgtcttctatctggagaagaatgctcgaaccacctatacccaggaaactgtcaagttgctgcttccttttttccatttaagtgaatgttcatttctccaaaccccttcttttgaaggatcataaagtaatttattgtttttgcttccctaatgcttagattacattatactttatggatcctcctaaataattgataaatattcttatgatcctttcataagacttgaaggatccacaaagtctatgtaatctaagcattaggggagcaaagatacagaatacacattctattggggagagcgtgaacagagacatggaaggtaaaatgaacttggcatatagatattcagatgggggtctgcactaacttaagaattctgaaattggatgagaaggcaaaagagaatggatggtggtagacattaaaaatgaactgtatgaattacatttcatgaaaaaggtacttgaaataaggatgtattctacatttctaaatagaagaaccaaataatgatgtttaactaatgaaagtttgacttggaattattaggcaaagacaattcaagaaggaaatataagttactccaaatgagccataggctgctgcagttttaaagaataaatgtagaaaaaaatcatcctgaaaaagtagtgctaaattgttcataatatggatccataacatatgcataaaatttactgttgcatgcatatgttttaagaataacaaatgatcttgatgacatctgagtttgtgttgggcagcaaacatttgtatcctactgaagttttaagagaaatgttttttcctataaatgtatatatttcttattaaaaattgtggttataaatatttctctcacaaaatataatttctgggtgacaaaataagatatttttctaaataggaaagattacttcatcatttaagagttgtaaaattgtataaataattcatagtctaactaaactaaggactttttaaaaactattggcttactgttttataactagtcccccttatccactgctttgctttttgtggtttctcctgaaatcaactgtcatctgagattgcatggaaaattccacaaatgagcacttcataaattttaaatttgttttcagtcatagcccaatgttgcattaccgtgcctacattgttcccctcactttatctcatcacgtagacattttatcttcccctgaagcattttatcatcagaagaaaaataaacaccgttcaataagatattttgagagaaagaaaaaaactgcattcacacaacttttattacagtatataattataattgtttggttttctttttagttatttttgttaatctcttccttgcctaatttataaattaaactttataatatatatttattgatacaaaaatagtgtatatagggttcagtgtaaaccccaatttcaggcattcactggcgggcttgaaatgcatcccctgcagataagggggaactactgtacttcacttacccttgtgtctcccttcaggaaggatcatatgaatgctccatggaaaattacaatcaaacatcaactgctttcatcttgttgggattgtcgccaccaccaaaaattggccatttcatcttcattctcattaatttcgttttcctaatggctctaattggaaacctatccatgattcttctcatcttcttggacatccatctccacacacccatgtatttcctacttagtcagctctccctcattgacctaaattatatttccaccattgttcctaagatggtttatgatttttctgtatggaaacaagtctatctccttcactgggtgtgggattcagagtttcttcttcctgactttagcaggtgcagaagcgctgctcctgacatcaatggcctatgatcgttatgtggctatttgctttcctctccactatcccatccgtatgagaaaaagagtgtgtgcactgatgataacaggatcttggatgataggctccatcaactcttgtgctcacacggtatatgcactccgtatcccatattgcaagtccagagccatcaatcattttttctgtgatgttccagctatgttgaccctagcctgcacggatacctgggtctatgagtgcacggtgtttttgagcaccaccatttttcttgtgtttcccttcatttgtattgcatgttcctatggccggattctccttgctgtctaccacatgcactctgcagaagggaggaagaaggcctattcgacctgcagcacccacctcactgtagtgactttctactatgcaccctttgcttatacctatctacgcccaagatccctgcgatctccgacagaggacaaggttctggctgtcttctacaccatcctcactccaatgctcaaccccatcatctacagcctgagaaacaaggaggtgatgggggccctgacacgagtgattcagaaaatcttttcagtgaaaatatagacatacgttctgccttagagtcaaagcgctaggttcatatcaactcagcagtgtacggcggttaaggaaaatattattacatgcccagtatgtcaaacggaaattaatctaaaagatttgtattttaatttagtctggcatttcaattgcatattctaagacacctattttggttttgtatttgtttctttttatcaaaagatagatcgtatattcatttttttcctaaagtagtgatctattaaaagtttacctcaggataaataattatgtctggggagcagtctacttggctttagatagacaagagtttccctataagaggttctatacagctaccttctgtagaacctcttagactgtagttgacttagactcagttgggtgtcaagtaggttatttaaaacatttgcagtcacatcacaacacactcaatgtttccctcgtgagtagccactggtattctcgtgcaagacattctcttctgcacaattttatttctacttactcttgtcataaatcaacgggtctatttagcatgacttgggatcagctcctctgctccactatttttatacatgcttaggcatgtgcccaaaaggatcaacgttattttcataaaagttatccgcttaggtcctttctctgagtgaaaggccattgctttccagaagagcccattcctgagaaactctttaatctctgaggagaggaggcaagaaggaaggtagaatgagcaaatgagaaaagccccgaattatccaagtgacagcagtggtgagtgactgataggaagttggtccttgaacaacatagatctgaactgtacaggtccacttacatgtggttttttttctgcctctgcctctcctgagacagcaagaccaacctctcctcctcttcctactactcagcctactcaatgtaaaggcaacatagatgaagatcttcatgacaaaccacattcactaaataagtagtaaatatgttttctctttctgatgattttcttcataagattttctttttctagcttactctactgtaagaatacagtatataatacatataagatacaaagtgtgagttaattatttatgttattttttaaggcttcctgtcaacagtaggctatcattagttatgttatggggggagtttgaagttatatgcagatatgttttatttcaacgtctattttaggtatgagagtacatgtggatatttttacgtgggaatattgcatgttgcttagagttagagtgtggatcctgtcacctggtagtgaacatagtacccaatcaatagtttttaatcccatcccctccctctagcagggcacagtgtctgctgtcaccatatttatgtccatgtgtgggccaatgcttagttcccacttacaagtgagaacattctgtatttggtttgttcttcctcagtcaatttgcttaggattatggcccccagctctatccattatcacttgcaaacagtatgctcttactgttttttatagctgtgtagtgtttcatggtgtatatgtagcatattttcttattccaattcactattgatgggcacctaggttgattgtaggtctttgctgttgtgaatagtgcagcaatgagcaatgaatgcatgtgactttttggtagaatgattttgtgtgtgtgtgtgtgtatacagagcactggaatttctaggtcaaatggtatctctaagtattttgagaactcttcagactgctttccatagtggctgggctaatttacattcccaccaacagtgtataagaattcccttttctctgcagcttcaccagcatctggtgttttttttgattttttaattatagccatagtgactggtataaaatggtctctcattgtggctctgatttgcatttctctgatgattggtgatgctgagtaatttttcttgttttttggccacttgtatgtcttcttcacagatgtgtctgttcgttgttcatgtaacttctgcatttttaatggggttagttttttgcttgttgatttatttaacttccctacagattgtggacatttaatctttgtcagatgcatactgtgcaaatattttttcctattctgtaggttggctgtttcctcgttgttttttttttttttctgtgcagaagctcttttgtttaattaagtgcctcttgtcaattttgttttgttgctattgttactcctcaggtagaggaataagtgtgtaggttctatcatggatattgaaatgtttgctctctgaggcatgtcaaaagtgagttcagatatataaagaatggtaaatggaatctagactttctgctgaaccaggagtaccatgcccctcatttatttatttacatcatcattataagggagatatgggatatgtaaaaagtttgttgtatgcatgatacttagagaaacagatatgggaggtgaaaaaagtagatatgatttaatcttgattcctcagctaagccaacaaattcctgtggtgctatttggacagacactgaatggaaagagacagagagagggggagagagagagagagagagagagagagagagagagagagagagagagagaaagaaagagaaagaaagagagagagaccttgtcatgaaagagtttgtaaaaccaatggacatgcattggtacctgtgggacctagtgatggagtgtgactcagacctgtgtagaaaggctgtctcttcatttcattaacgaacacaatgtgtggcagggatgcaggaatgtctcttattctctttggcatcttaaaggtcctgtatgtttcagattttgtggcatggagctttcctagggagaatcccaaccacaattgattcccatttggtctcagaagctgagaaaaactgagagtgattggccgggcacggtagctcaagcctgtaatcccagcactttgggaggccgaggcgggcggatcacagggtcaggagatcgagaccatcctggctaacacggtgaaaaccccgtctctactaaaaatacaaaaaattagccgggcgtggtggcgggcgcctgtagtcccggctgcttgagaggctgaggcaggagaatggcgtgaacccgggaggcggagcttgcagtgagctgatatcgctccactgcactccagccggggcgacagagcgagactccatctcaaaaacaaacaaacaaaaagaactgggagtgattatgttactatgactgtagcctaacactacaagtcttggtttctcttctttctgtccttcaatccagactggctctcagacacacacacagaaatactacatgatcttacttatattttgggtctaaaaataagtggaatagatagaaacagagagtaaaatggtggttactagcagtggggagggagagaaagagcgtaggtcaaatgctacaaacttgaagttatgtaggatgagtaagtctagatagctgatgaagactatggttaatactattgtattatatattgaaattttgctaagacagtgggttttaagtgttcttagtaaaaaaaatcataactatggaacatgctgtataagttgagtgtggtaatcatttcaatatgtatatgaatgtcaaacaacatgttgtatatctttaataaaataaaacattttctggtacatctttaataaaatcaacactcaatcagactgacttgaattattcctggaattatctaattaaaatatattttgatgatctcactttccttagtatggtatgtaattctctccattggctaattccttccttcatctgactctacctggaactttatgttctcttcatgttaaattgaatgcagttctctgaacaagttttgaaaagccagtcctcatgacattaggtccaatagcttttatctttaatgcattgttctctattctcataaagttctttcactgcatgaatcctcatcactcccttttctcagtgtaaacatcaggtatcatctacacaaggaagcattctgaatgtacttgttaaactctatctttcccttccactctcatagatcccactatttctaataataacatgtgtcatcaagatgtattgtaacaatctctgttctctatggctccacagactattatctgttaccatcagtggcttgctcttttcctcttcacatgcccagatgttgcacttgagtacctgctctgcattcaacctattcatagctcaaagcatgcttagttattcttagcccattgcattttcacataataattagagtcagcctgcaaagtgtttatagaaaaaatttttgtgtttcagtgtgattttatacaatctagagcataattagtggaataacaaaatattttctatatcagatttcttgattcattaatgaaacatattttactatacatatgtctatttatgaagagcagaaacctatccacatctcagtcaatattcatcggaatgatttattttataattcctctagcatttattttttgtttatttatttttttgagacatcatgtccttctgttgcccaggctggtccttgtcaccaggtcctcacttcccttaattgcttctttacatatcatctttaattttaggaaacctcaagttttctgtttaaaatgttttccagatcccgaattacaatgggtccactgacgcagtgggtctgcagagcttgtctgagaaactgactcagtgcaggatgcagagtcttcatctccctgtcttatgacttcaccactcgcttctccaccaatcagcaatccccacatgttagctcatcactcatccagactccttaaaaatgccatccccaagcatctccagaaggctgatttgaggcatccttcctcttcctccttcagctgacctacgattgttaaactctttctcttctcaacttctactgttttggtgttttggtctgctaccactccatgggcaattgaaccctgtgggcctaaaacaatcctcctgcctcagtctccccataggtggaatgacaggcctgtgccactgcgccctgctcttttacaaacatttgacataaatgcttatcacctgaatcttgtatctttgggacatagaatgggacttcttttccaaattggtaaatatgattatgcatttaaagatccatgtgatttaatgaataattcaaatgcactgaacacagacatctaaaaatgtaaaataaagagctcagttttatttacactctttttctaaactcttctttcagaataaaccaagttgtggcctactctatgcttggttttgtgctttgtactgtagaagtgtaaaatagtcaatttctatgtccagaaaactctcagggaaaactgggtatttcaggagtaagttgctgacttatatcccccatatttgcatacataacccttgtgggtagttgtgaggtacacctaaacatctttcttttttttacagaaattcccttgaagtctgtcttcccacatcaaataaggattcttacctcctctttcagcacaaataggttttgtcatctgtcttttgaagatgtggaaacagttccctggttgcactagacatggcacctactattatgttaatagccaaggttttaaacttgacaaaaaaaattttcagcttttcaaatgcaggaatattgaaacatctgtacattctgactttcaggaaattgtcatttccaagaatgtacaccaactaccctgactggatcattatacagcatatacgtgcattaatatatcaaattggctggtctgagtgcagtggtgtttacaattgatcacaaccagttacaggtttcttggttcctttccactcccactgcttcatctgactagcctatgcatatcaaaataaatataaataaaaatacatatcaaaatgtgtcaaataatttatctattaaatccatgtggagaaattcaaatacttttaacattcaaaaaaattaaaatgaactaataccttttttcccatgtaggtggtataatttattcatttactagaaacaagaaattagagaacacttaaagcactctactgaataaaaatttattcaattactattttctaaatattaataaagcagagtaacatcattttatcatctgatttaataggagaaaatcactttataatttagtgagcatttccaaattaaaagaaacaatttgaatgtgtataatacctaaaatatgttagaagataactcccatgtatgcgatattttaataatttctacttatgtgtttctattaaattaacctcattctattttagtggtttaaatcttactgccaatataaaccaaactgagagagaaattagtgaatgcagacacattgttactgtggatgcctgaataacaacattcaagctatagagtttcatgaagtttagaaacaaaaaaaactgaaataatgtgaataaatatatttgtttctttctccactgagtttacccttgacatgccttgaaacatctaaatacattatcagaactcatttctgaacgttggactaaggccatcctctgacattagtgacttagcctacaatgtccaaagtttcagtggacattccctagtgaataccagcaaaacaactgttaatctcattctccaggtaaaaaggactggattcatgattgctactgaattcccatgaaagtctctgatatctcatgtgtagggatgatgaatgaatatatacatttctttaaaaaatattcttaattcttactcagaaaaatgactttgtttctatgatgactacaggactgccatcagctaagcaaggcatgaatgtttgataatgaggaaataataaaggtactacttataattgtattttaaaatttttattgatcccagggaagaagggactctggcaagtgcttaagaggactttgtttcagaaatagaattgaggtgaatttcagcactagtgactgtactttctgtaacacgtcagcagaaatcttggagtgtgaaatacaggcaacaaaaagtggttttgcagctaattcataagtgtgttttctagaggggaagggaggtgatgatcaatggaagagatagggataaattagactatgcttttataggatccagtgaaattaacccacattcacaataattattgtagggggcaacatttcctcattcctacttggttggtgttttgttttgttttgtttttgtttgatttattttgtcctgaatgatcagtgattatgtcatgctcattataatcttattgctgcttctcactttgtattttaccttatatgaatccagcctgtctaatgaaatacctagaaagtactagtgttgtctttgcataaaaacgttaaaagggcattaaagtaaaggcacaatgagaatggttaaaattaccagtctgtagtgcaatgatacattttcttaaaagaaggaccttcttctggaaataaataatgaaggtaactgcatgattagtagctgtgctatggttatccggattttgtttttacacacaatttgtgccaaattgtagtgctttgtgcttttaatatttacaatgtattaattttttcttttggtacatatggtaaagtttcagtgaaataatagaaatatctgccttaacaaccacgcagagtttttgtgagaagcaaatgagcagagcatgtggaaacaatgtgaagctttattattcaacagtcatagcagataacaagtgtgtggatgtaagtgatagtgattatcttgatgatgagggcaagggtaatgaggaaaatgctgaaacttgcagcttctcttcagtgatacacccagtcaagtaagacacgttcactatctcacagacagctcctggtaacccatggattcttccccctgttgtaattataaactacagggtcagacattcatcaacaaaagcttacatttctagtaattgtaagagatagaatttgatttaattttaaatggagcctctgtcccttgaacttacccagtgaagcagagtaagcacatcctcattccaaaataacagacaaaggatatactttcataatcagtttctatatatccatggaaatgtctgtctacgtacttactggtgtatctatctgtgagagctgatgcactattgtgggcctcaatgcaggttgtgacttggaagcacacatgcacacaagcaaatactcactttacattctttactcctttacacctgaaagagttatggttctccaacttcatacccttctcaacaattaaatatacacattgtgtaaatatgtgtaagaccagttattcctatgtcagttacctacaacattatgtactgtgtctcttcttaggagaatctattgtggaggaacttgaaggaaggaggaatctcctataggattccatgccaggatgctgtggagagccatccttgtctagactccagaggacactcttctgtgtcatctgattgacattctagacaagtgctgtcaatgtgaaataattcttactaaagacatgcagattcaggtacagacagcttgttttaaggaattaagagtgactcatggagtcaatgacttcactgccatttcagtgaaactgatgctatttcctgttttaccattttccagctctatgtgttagtagggagatcactttctggaagtttcaaagattcagaactttaggatattacagatatcacttcagaagagagaaagtaatccagattctggaaaatcccataatgagtgtcttggattttgcagacttttagaagttccatctgatttcttataaatcttgcaggtaagccaacttgtgcccctgccttcctagctttttctttttctttctttttttttttttggtgtgtgtgtgtgtgtgtaaatccagtttttctgcacctatgcaaataatcctatcaattttaaggagaccagccttattttgtgatgaataatggtttttctgtttgatcaaagctgaggaaagtatagggaggaaaatctgtgccccagtagaaaactgcagaatctgaactcaagaagaccatcctccttggttcccaactctgtcactaggtcactgcacagtcatgagtaactctcttcaaatcctgtgattcagtgattcttccttgtgataagtagactataggtgaaaaatctttgtcttctgtgaatgtatgaatcactaaattagagtactttcttcatcttactttcaactctaaattgaaggataggaaagagatccatgcaacgcaatgatgctttttgacttcaaaagttagtaataggttcttcatttgaaactttggcagcttttggagaattgtaattattatgctgaatatgtacatcctcaacttgatttacacaggagattatatggctgtttttttttttaactgaattcttccagtagggaaacttttacattgggaacaagacagaaaatgtctttcatttagagtttctgagaaaccgtttttctgtgaagatacataactgttgccaggtgaagttaaagtacattaaaaacaggtgatatgaggaaacagaagaattgtaatgagtaaagtttaattattaaaataattctacttgtttttaattttttatactttctcaattatttaccacttatatggagtttttgacttaataaatttaattttttttcttttccttttgttttgggtgattaaaaagtgagccaccgttatttcagatttactgccaaaaatttttgagggatgaactacaccacacatttttaaaaggtttatattaatgtatgtttatttatgtaggtgtgacatttactcataggtttgtgtgtgtgtacatacatatgcatatatgtatgtgtgtttgtggatctagagaagtttactgaaaatctctgaatctcagtttcatcatctataaaatgtcagtggcgataccaatctgaagagttattttgatgaactccaacagaatcaaggaatgaatgctgtgacgttccaggtgccaatatgtggagagagtctgtgaaagttcacgcctccctccttcctttcatgtgagacgtagttcaggtttaaggtttgtgggtcctactcactctgaaatctcgactacaactttttctgcttgttttttcctcctgtgtattatttcattaatgctgacacctgtatactgaatttttagtgaaaagaaagtaaaagcaagtaaagatgtttcttagttggcttaaataccttctttatagctatttctgtaaataaaaaaataaaatatagctatttctgtaaataaaaaaaataataaaaggactatttctgtaaataaaagaataaaatttcttatattttacataagaaaaatatatcctgttcacattattgaaacagaaacatcatggctgaggctgctttcctgtcaggaaccagcctctcattttatttaaataatattatataataggacattagaatattaaaaccctggaacatggataataaaaagatgatacattggcagtcctaaaacacagcattaaatatcagatctgatgtgtcatttattatgctgttttatgttcctttttcctctctttaaaattaggataatgtaaaccatatcttggacagtttgtcttagacagccctctgtaaaatacaaatgatagaaatgtttgaaatgtaaattgtgttaacaatttcaaatattacatgttctacttaccaataattaaccaataatataaattatattgtattggatctgtatatagtattggatttgtcttaatgccaatctcctattgattccaaatgacatttatgaaaataattttctcttctaaatttttttttaattaccaatgtcataaaatacctgaaaataaattgctctgcagaggcttagaaacctgccaagattttttaaaaatgtatttggaaatccaaattggaataatttcagtaaatttaagtgattttttattagggcaaatatacataagagaaacaccagtttaacctttttaagtgtagaattctgtgtcattaagcacatatactgttgtgcagccatcactaccatgcacctatctccaaaacaatttcattgtctccaactaatactttggctccagcataccactttccctctctgtgaatttcactacagtgggtacttcatgtaagtgaattcatgcaatatttgtctttctgtgacaggcttatttcacttagcataatgtattcaagcttcatccatgttgtagcatgtgtcaaaatttcttcgcttttaaaaactgtatacaggccaggcgcagtggctcacgcctgtaatcccagcactttgggaggcccaggtgggaggatcacgaggtcaggagatcaagaccatcctgtgtaacacggtgaaaccccgtctctaccaaaaatacaagaatttagccaggcgtggtggcgggcgcctgtagtcccagctactcgggaggctgaggcaggagaatggcgggaacccgggaggcagagcttgcagtgagccgagatcgcaccactgcactccagcctgggcgaagcgagactccagctcaaaaaaaaaaaaaagagttatggtggattccccccttttcaattgtttggaactgtttcagaagaaattgtaccagctccactttggacctctgatagaattcagctataatccatctggacctgggccttttctttggttggtaggctatttattatagcctcaatttcagaacttgttattggtctattcagggattgaaattctgcggataaggatgaatttctgtcttaacttactcgtgtctcccttccggatggattgtaggaatgccccatggaaaattgcaatcaaacatcaactgatttcatcttactggggctgttcccaccatcaagaattggccttttcctcttcatcctcattgttttcattttcctaatggctctaattggaaacctatccatgattcttctcatcttcttggacactcatctccacacacccatgtgtttcctacttagtcagctctccctcattgacctaaattacatctccaccattgttcctaagatggcatctgattttctgcatggaaacaagtctatctccttcactgggtgtgggattcagagtttcttcttcacgactttagccgttgtagaagcgctactcctgatatcaatggcctatgttcgttgcattgctatttgctttcctctccactatctcatccgcatgagcaaaagagtgtgtgtgctgatgataacaggatcttggatcataggctcgatcaatgcttgtgctcacactgtatatatactccatattccttattgcccatctagggttatcaatcatttcttctgtgatgtcccagcaatggtgactctggcctgcatggacacctgggtctatgagggcacagtgcttttgagtgccaccatctttctcgtgtttcccttcattgctatttcatgttcctatggccgggttctccttgctgtctaccacatgaaatctgcagaagggaagaagaaggcctacctgacctgcagcacccacctcactgtagtaactttctactatacaccttttgtctacacctatctacgtccaagatccctgtaatctccaacagaggacaaggttctggctgtcttctacaccaccctcaccccaatgctcaaccccatcatctatagcctgaggaacaaggaggtgatgggggccctgacacgagtgagtcagagaatctgctctgtgaaaatgtagaaacactttctgcctaaggtttcaggactcagatacacatccattcagcagtgtatagtaattaaaatatcatttcattcctagagttcaggagcaaaaagtaatcaacagaagaaaaaaaaatcactgatttctggacaaaattgttttacaaagatgtatataattctaaacaacctttttcttcatggcatttatcccataaattttgaaagcacatacttttgccaaaatattgtcaatgagaatgtttgtttttagttatgcagaaatggaaatgaaatttgtctaaccaaagttggcacttagtataacaattctattattgtcaatttattttccagtaattttaaatttacatttttgtttatgtctaaaacaaaaaaatatctcttgacttggtggatccaattgaaaactgtaaaatgtctttcttatttagacacttaacgtaccagttactgtttctttcaacttagggaagttatttttacacaatttagcagagagctcgtcagggattcttaagtcctgataccacgctggatggcctatgacaagtttatgtgttttataggggaatgaatcccaggaaatgattgaacatcaggtatattttaggtcaacaacaaggactggaatgtgccagcagtaataaaaatgattacatttagttctttaacccattttgagttgattttggtatggtataagaattgggagtttagtttcatttttctgcttaaaaatatccagttttccctgcacagtgtattgaagacactgtctttttcccagtgaacattcttgggtctgttgtcaaaaatcagttgactgcaccaggcacagaaagattctgcatgttctcactcatctgtgggagctaaaatttttaaaaatggaaccagtggaaatagagaatagactgatggtcaccagagggtgggaagggtgcaggggaggggtgataaagtggggatggttaacagttgcaaaaatataattagatataatgaataagagccagtaattggtagcacaacagagtgactatagtaaacaataatttattgtagaatttattgtatatcttcaagaataactcaaagtgtggaattggaatgttctcaacacaaagaaataatgcatatttcaggtgatggttaccccaattacccaaatttgatcattacacattgtatgcctttatcaaaacatcacataccctccataattatatattactattatagtaattaaaaataaaaaaattaaatcagttaactgtagatgggtggatttatttctgggttctctgttctgtttcattgttctatgtgtcttttttatgccagtaccattctgttttggttattccatgtttgtagtatagtttgaagtttggtacttttatgcctccaggtttgttctttttgttcaagattgctttgactatttggggtcttttatagttccatacgaatcgtagaatggtttttactatttatgtgcagaatgtcattggtattttgatagacattgcattgaatctgtagtttggttatttaaataatattaattattcaatccatgagcattggatgttttcccatttgtttgtattcctcttcattttcttttaccagtgttttgtacaaatcattctagtgttctcttccatgtctacagttaacagtaaagtattacggtaaaaattatttcaatgcttttgaaatgtcatttctatttctaagcctgtggatatttgttttacaatgtcgtagcagttaaaacatacattttgaacttgttttatgaatcagagtaagtctttgttgtgctttgttgcaatgagcagcgtatatttttatttggtgatgatttactaacaaagtttactgcctaaacttcttgccatttcctgtcctgaactcagtcagatacgtcatattccatgaatacaacagagatgggctctggagcagagggaaaataggcctcccatcagcagtcacttgctactgccagggagagcacctcctctcttccccgttagggacaattgtacccaactgccacctgtgccactgcttctatcattactaccaatctgagcccagtcataccccagccactgcttggggtcctgtggtactgtgaaatattgcaagatatgtgtgtgtgtgtgtgtgtgtgtgtgtgtgtgtgtgtgtgtgtttgtgtgcataagaacgccaggccagttgtctcatgtgggtgttgcctgagcccacttgtgtagtcactgctactgaaccaaaactgcatgcattctgccaacctctccagttcctctgtcacaagcatgcttaaagatgaaatgattgaaacttccaatgataacagcagagcatgaaaccatgcatggagccctttgagtgtgggaccctgtgcataggtccatgaaaccaatcccgagaaggatgggaagagtgaacatgaagtgaatgagatcatgcagcctaggatagtggtgggaatgcgtgatggtctgagtgtttgtatactccccaaatccatatgcttaaatcttaaccctcaatgtgataatattaggagttggggccttttgggaaatgactaggtcatgagggtagcaccctcttgagtaagatttgtgcctttctaaagaaggcttgagagagcttgtttgtgccttctaccatgtgaggtcacagcagacagtaccaactatggtgtcatacaagctaccatctatgaaccagaaagcaacctttctccagacactgaatcttcagtcacttcgtcttaaatttcacaggttccacaactctgagaaacacatttctcttgtttataggttaccccatttaagatacatttgtcatagcagcttgaatacactaagatggaatgtctactgtttttgttatttattattattggaaagaacctgagggaggactgaaataagcagtggtgctcagttcagaccctttaccctttcaggtagtgattcatggagggaatcagtagacttagctctatgattttctgtgatgtaccatggcctcggggaaatcattccatctctctgaagttagttgactgaaaaacaatatggatgccttgtaccttatcagtaaatggcatcattgaaatcactcctactgacattcctgtataggcaatggtgatcctatttttcatgccaatgactctggcagtggagataaagaggtcatcagtgaatattgagccttccaaggctatcataaatgacacttcaaaagtcttttatgccagtaggctctggctcaggaaagcaataagctagtcccctctgacgtggtgtctgcactcaagaggccactcctttccccttatggtcattaagaagaacaacataaaaagaagtcaaattattcaaatctactgtcatttgctacattgtttatgagaatatacacaagataattttgaaagttgggcaataattccccttggtggggaagttaatgaattcattacctcacagagttcttggctaatttttaagttatgcctcttcctcgttttagccatttttctttccatccaaatgttatgctgtagttattattttgcacttcacagtcgttctttaattatttcctgtctttggaacagaagatgcaaattttatagaacatggtatctatctggatttcataacatacactgtgtgcatttagaaatttcttatgtattccattagcaaagtttgatttttggaaaaggacatgagtactctttctattttgaaggatgagtatatttctcgttagaacaagttgtggttcagtagtgaaataattaaagtaaaggaatgagtggtgtaccatccacaaatatgctgactcagcatatttattagtttgagctgaaaacattggagaaattttggttaacattagaagaaaaggttacctaagctgtctttttctgcatgcagcaagctataaagattcctccaggactctttggtacattcttatacttttctggtaccctccctgtatcacaatagaaaatagcacttacaaccagagcctgggaattggaagaatgcagttgacctgaataaataaactttaagaattaacccttattttccactagctttacacccccatatacctcctagtgacacccctagaattaatggcttcaagccagtttctctattctttgattttttctataatttatcattctttgtctaaaagtataaaaatatcttgcattgaccatttatttggacttcatactcttgtgaagagtcacatgtacatgtaatattaatacagcttatgtgtttttttctcattaatctgtgttgtatcaatttgtttcctagacctgggcaaaaagctcacataggagataaagtgagtgatctctcatgtttctacagaagtaacaattaacttccttttgtacttacaaagaggcttagactcccacacaataatagtgggagactttaacaccccactgtcaatattagagagatcactgagacagaaaattaacaagaatattcaggactttaactcagctctggaccaagcaaatctaataggcatttacagaactattcaccccaaatcaatagaatatacattcttcttagcaatacattgcacttattctaaaattgaccacataattggaattcaaacactcctcagcaaatgcaaaagattggaaatcataacaaacagtccctcagaccacagtgcaatcaaattagaactcaggactaagaaactcactcaaaaccacacaactacatggaaactgaacaacctgctcctgaatgactattgggtaaataatgaaattaaagcagaaataaataagttgcttgaagccaatgagaacaaagacacaatgtatcagaatctctgggacacagctaaagcagtggttagaggaaaatttatagcactaaatgcccacatcagaaagcgggaaaaatctaaaacagacacactaacatcacaattaaaagaaaaagagaagcaaacccaaacaaattcaaaagctagcaaaagacaagaaataactaagatcagaggagatagagactcaaaaaatccttcaaaaaatcaatgaatccaggagctggttttttgaaaaggttaacaaaatagaccactagtcagattaataaagaagaaaagagagaagaataaaatagacacaataaaaaatgataaaggggatatcaccactgatcccacagaaacaccgactatcatcagagaatactataaagacctctacacaaataaactagaaaatctagaagaaatgggcaaattcctggacatatacaccctctgaagtctaaaccaggaagaagtcaaatccctgaacaaaacaataacaagttctgaaattgaggcagtaattaatagccttataaccaaaaaaagcccaggatcagatggattcacagccgaattctaccaaaggtacaaagcagagctggaatcattccttctgaaacagtttcagacaattgaaaaagagggacccctcccttttatgaggacagcatctccccaacaccaaaacctgtcagagacaaaacagaaaaagaaaatttcaggccaatattcttgatgaatgtagatgcaaaaatcctcaataaaatactggcaaaccaaatccaacagcatatcacaaaacttatccaccaccatcaagttggattcacccctggaatgcaaggatggttcaacataagcaaatcaataaatgtaatgcatcgcataaacagaactaatgacaaaaccatatgattatttcaatagatgcggaaaagaccttcaataaaattcaacactcctgcatgctaaaaactctcaataagctaggtgttcacagaacgtatctcaaaataataagagctattcatgacaaacccacaaccaatacaatactgaatgggcaaaagctggaagcattccctatgaaaaccagcacaagataaggatgccctctctcaccactcctattctgcatagtattggaagtagtggccaaggcaatcaggcaggagaaagaaataaagggtattcaaataggaagagaggaagtaaaattatctctctttgcagatgacatgattgcatatttagggaaccgcatagtctcagcccaaaatcttctgtttgttatgatttccgttttttgcatttgctgaggagtgttttacttccaattatgttgggtcagtttaagaagaagtcaatgcagtgctgagaagaatgtatattctgttgatttggggtggagagtactgtagatttctattaggttggcttggtgcagagctgagctctagtcctaaatatccttgtgaattttctgtctcattgctctctctaatattgacaatggggtgttaaagtctcccattattattgtgtgggagtctaagtctctttgtaggtctctaagaacttgctttatgaatctgggtgctcctgtattgggtgcatatatatttagaatagttagctcttcttgttgtattgatccctttaccactatgtaatgcccttctttgtctcttttgatctttgttggtttaaagtctgttttatcagagactaagattgcaaatactgctttgttgttgttttttttttttttttttttttttgctttccatttgcttagtaaatcttcctccatccctttattttgagtctatgtgtgtctttgcatgtgagatgggtctcctgaatacagcacaccaataggtcttgactctttatccaatttgccagcctatgtctttgaattgggatatttagcccatttacatttaaggttaatattgctatgtgtgaatttgatcctgtcattatgatgctatttggttactttgtccgttagttgatgcagtttcttcatagtgtcgatggtctttacaatttggtatgtttttgcagtggctggtacccgttgtttcattccatgtttagtgcttccttcaggagctcttgtaaggtaggcctggtggtgacaaaatctcttagcatttgcttgtctgtaaaggattttatttctccttcatgtatgaagcttagtttggctggatatgaaattatgttttgaaaattcttttctttaaggttgaatattggctcccattctcttctcgcttatagggtttctgtagagagatccactgttaattttgatggtcttccctttgtgggtaaaccagtctttctctctggctgctgttatcatttttccttcagtttaaccttggtgaatctgacaattatgtgttgtagggttgctcttctcgaggagtatctttgtggtgttctctgtatttcctgaatttgaatgttggtctgtcttgataggttggggaagttctcctggataatatcctgaaatgtgttttccagcttggttccattctccccatcattttcaggtataccaatcaaatgtaggtttggtcttttctcatagtcctatatttcttggaggctatgatctttatagtaagaggacataaaacccattttcttagcaaattttcaatatataatgcagtattattaaccattagctatcaagacttattcaaccctttctctgctgcaatttctgctgttttggcattttggtctgttaccactccatgggcaattgaaccctgtgggtgggcctgtatcaatcctcctgccctcagtatctctgtaggtggaatgacaggcctgtaccactgtgtcctgctcttttacaaaagacttgacataaatggttatcacctgagtcttgtatctttgggagatagaatgggcttactttttaagtaaatattattatgcatttaatatctatgtgatttaatggataattcaaatggactgaaagtagacatttaaaaatataaaccaaacagctcagttttatttatgttccttattctaatcacttcttccagaataaatcaagttgtgaactactttatgcttgcttttgtggtttctgctgagaaagtgtgaaatactccatttctacttccagaccattctcagggagaacaggggtatttcagggttcccttcttctctggatttgttgggtaggagatgtaagggactgccacagtgcttctctgacacaggccaccctgccacaatcctggtggtcccctgaagatgattctgtcctgagatccagacggcagacttcctttgtttcatatgcccaagtccatgttagtttctgtctcatatcccccacatgtgtttacaggatcccagtgggcagtcttgagtcatgacccataaagtctttctttcatacagaaatcctctcaaagcacctctacctgcatctaataaggattcttccctcctcattcagcacaaatgtgttttgtcttctaaggaagatataaaaccagtgcctagtgtgcactagatgtggcatctacttttatgttcaaaggcagggttttaaaggtaaagaaattctttagattttgaaatgcaagaatatcaaaacatctgtatttgactttcaagaaattatttttgctagtaatatacactacctaccctgattagatcattatgtaacatatacttaaataaaaacatgaaattgaaacccataaatacatacaataacaatgtatcaattaattaaataaatgattattaaaaacatttaaacatttataaaattccaaatattttaaatggactaatgctactttttcaagatagaaggcatatttaatttactgtaaaccatgaaaaatttgagtacctttaaggtactcttttgcataaaaatttaattactaaatatattctagatattattataccacagtcagtagtaagatcagttttattatctattttcataagagaaaattgttttaaaatttaatgggtatttctagaagaaaggaaacaatataaatatatatttaaaatatgttaaagataactccaatatgtgatattttaataacttctacttacatgttttaattaaattaacctagttccattttcatgttctagaatttattgctaaaataagctaaattgggaaagaaattaatatatacagacacatccttgctataaatgcagtgaataacaacataaaaagtgtaggatttcataaagtattagagacacaattgcattaccataatctgaataaatatacttgtttctttcaccactgagtttccccttgacatgccttgaagcatctaattacacaatgagaactcatttctgaaccttggactaaggccatcctctgttattagtgactcagcctagaatgtccaaagtctcagtggacaatccccagtgaataccagcaaaacaactgttaatctcattctccaggtaaagaaggactggatcatggtttctatggaatccgcatgaaggtctctgaaatctcatgtgtagggatgatcaatgaatgtatacatttctttaaaaaccattcagaaatcttgcttagaaaaatgactttgttcatatgatgactatacgactgctggcagccaacaaaggcagtgcgtgtttgaaattgaggagataataaaaggtactgattatatttgtattttaaaatttttattgatcatagggaagaagagactctggcaagcgcttaagagaactttatttcagaaatcgaactgaagtttgagcactagtaattgtactttctgttaagaaaattcagcagaaattttggagtatagaatacagacaaccaaaagtgtttttgccgctaattcataaatgtgtttcccggattggaagggaaatgatgatcaatggaagagatagggctaaattatattaaactatgcttttttgggctcaagtgaaatttaaaaacccatattcacaataattatcatagagggcagcatttcctcatttgtacttggttggtgattttttggttttggtttgatttcttttgccacaagtggtgagtaattaattatatgatgcttataataatcttattgctgtttcttacttgctatttcacctcatatgaatccagtatttccaaggaaatatgtagaaacaactagtgttgtttaaaagtattaggaggccattaaagtaaagacagaatgagagtggttaaaattaccagtctgtagagcaatgatatagtttttaaaataaaggaccctcttctggcaataaataattaaggaaaccatatgattagtagctatgctatgggtatccaaattttgtttttacacccaatttgtgacaaattgtagtgctttgtgcttttaaattttgcaatatatttatttttttcttttggtacacaaggtaaacttccagtgaaataatagaaatattatttctgctttaagaaccatgcagtggttttgtaagaaggaaatgagcatagtatgtggaaacaatgtgaaggctatattactctacagtcatagcagataacaagtgtgtaaatgtaagtgatagtgattatgttgatgatgccagcaatgataatgatgaagatgctgaaacttgtagattctcttcaatgatacacccagtcaagtaatacacggtcactatgtcacagacagctcctaataacccatggattattccccctgttgtaattataaaatacagggtcagacattcagcaacaaaagcttacatttctagtaattgtaagagctaggattccatttggtattaaaccgagtctctttcccatgaacttacacagtgaagcagactaagcacatcctcatcccaaaataacagtcaaaggatacttcatactcactttcataatcactttctgtctatccatgaaaatgtctgtctgcccacttacctatgtatctatctatgagagctgatgcactatcgtggacctcaatggtaggttgtgacttggaagcacacatacacacaagcaaatattcactttatattcttcactcctttacaccttaaagagttgtggttctccaaattcatacccttctcaacaattaaaaatacatattgtgtaaatattaaataagatcagttattcctacgtcagttaaacacaacattatgtactgtgtctcttcttaggagaatctattgtggaggaacttgaaggaaggaggaatctcctgtaggattccatgccaggatgctgtggagagccgtccttgcctatactccggaggacactcttctgtgtcatctgattgacattctagacaagtgttgtcaatgtgaaataattcttactatagacatgcagattcaggtacagacagcttgttttaaggaattcaggctgacttacgaagtcaatgacttcacagctgttccagtgaaactgaccctgtcacctgttttaccatttcctagccttatctgttagtaagaaagatcactttctggaagtttcagagtttcagaactttaggatatttcagttatcccttcagaagagaggaagcaacctagatttttgcaaaatctggtaaagtgtggcttggattttggaggcttttaaaagttcaatctgatttcttacaaaacttccagcaaagccaacttgtacccttatctcccttcctatttttttggtaaattcacacattttctgtgcctatgcaaatgatcataccaactttaagaggaacagccatattttgtaatgaataatgatttctctttgagaatacttttcatcaaaactgaggaaaatatagggaaaataaatcagtgagtgccccaagggaaaactgcagtatctagacacaagagaaccatcctccttggttcccaactctatcactaggtctctgtactgtcatgaataacgctcttcaaatcctgtgattcagctattcttccttatgataatgagactatcactgaaaaatctttgtcttctatgaatatgtgaattacttaaattaggctattttaattagctcatattcaactctaaattgaaggataggaaaaaatctatgcaatttaatgatacattctgacttcaaaagatagtaatatgtaattcacttgcaacttgggcaccatttgtagaattgtaattattatgctgaatatgtacatcctcaacttgatttacacaggagattacatgggtattttttttgtaagtgaattattccaacagataaacttttatgttgggaacatggtggaaattgtatttcttttagattttctgagaaatcttctttctttgaaaatatgtatgattgttgcctggtcaaggaaagtacaataaaaccagataacatgaggaaacataagaagtttaaatgattgaattttagccattaaaataatcttattcgtgatataaaaatcttattatttctcatttatttagcatctataatgattatgtatttcagtaaatttaacctctgtcttttatttttgttgtgggtaattaaaaagtgagtcagccttatttcagatgtactgcctaaaaatatttggataaactagaccacacatttttttaaacgtgtatataaatgtatatttatatatgtaacatatatatttatttatatgttttcatagatatgtatgtgtgtatataaacttatgtatgtatgtgtgtgtttgtgtaaatataggcatatgtgtgtttgtgtgtgatgtagagaagttcacttacaacccctgaatctcaattttgtcatctataaaatgtcggtggtgatgtcagtgtgaagagcttgttattaggattaaatctaatggaattatggaagaaatcctgacatattgcaagtgccagtgtgtggagatagtcaataaaagttcataatgttatcgttcctttcatgtatgatgcctcccgggttgaagttttgcttttcctaatcgctgtgaaactatcatcggaatcttttctccttgctttttcatcttttgtatgacatcattaatgctgatgcccaggtatatacattttagaagagttataaaaataaaagcaagtggaagtgtttttaaatgggcttaaaatatttacagctaattctgtggataaaaaattaaggggcacaagtaacctgtttggatttatttttacataagaaaaaaatgtcctcttcacattactgaaacagatgtataatggctgagactgcttcctcattaaagacagggatctaattttatttaaataatgttatatggtagaattagaaccctgaaacatgaataatcaaagagatgctacactggtgttcaagagatatcgtaacgtcacaaaatacgtctcctgccactcaccacttgcaaagtcatgttaacaagagcaaggtctggtagaaagagactttttcttccaagcttagctgaggggaagcaggacaggcttctgccttattgggaagtgcttcccctttcggggcagtaggcagggtcttttaatggggtcttggcgtgaatgacatgcagggggtgaggagatgggggtccagtgattttcttctgatgtcttttctacccggtggtctggctggcaccatcgcaggcagagctgggttgtaaattgagacagtctcctagtgggatggagttctggggttgcctgatttgcttcgtgattccgtctctagaacttctaggtaaacacaatgtcatacaaacttgccttgtagaatgtgtctggtgggtagagtaaaggatatatttgcattcctaaccagctaagaaggaggtgagggagaaggaaaaaatacattcgtatcgagaccatcctggctaacacggtgaaaccccgtctctactaaaagtatatgtatatataaaaaaaattagcctggcgtggtggtgggcccctgtaatcccagctacttgggaggctgaggcaggagaatggcgtgaacccgggaggcggagcttgcagtgagccgagatcacaccactgcactccagcctaggcgacagagcgactccatctcaaaaaaataaaaaaaaaaattcgttatttttcttttttaaaaatgaggtactcagttgcaacatgacaataaatatgagatctgatgtgccgtctattattctgtcctatgttacttttccttttttaaaaattaggataataagtctcatggaaagtttatcatagattgccctatataaaatacaaatgatagaaatgtttggaatgttgtgttagtaattacaaatagcacctattctacatgctaataattaaattactaatacaaattacatactattgcatcagtcttaatgctgatctcatactgtttccaaatgacatatatgaaaataatttgttcttctatactggccttcacaaattaccagaggtcataaaataattgctctgtagaggctcagaaacttgtaggaattttcttaaaatgtatttggaattccaaatatggaataatttcagtacatttaaatgtttttaattagagtaaatatacttaagataaactgcaccattttaactcttttaagtgtacagttctgtggcattaaggacatttatgttgttgtgcaaccatcaccaccatgcatctccagaacagtttcattttctccaactaaaattgtgttctccacacaattattctccttgtctcccttccccggtcccctggggtccagcattccactttatgtctctatgaatttgactactctggatacttcatgtaggagaattcatacaatatttgcctctttgtggcttatttcactttgcataatgtaatcaaagttcatctatgttgtagcatgtgtcacaatttatttcatgattaaaatgaataatagtccatgtatgtactcactacattttttattgatttctctgtggacggacacttgtttctgcctttggggtattgtgataatactgctgtgaatgtggccatataagtatctttctgagggtcttatttctttgggtccacattcagaagttaaatagctggagcatataataattctgtttaatttttgaagaaattactatacagatggtccagaaatacaatattttgatgattttttgactttaatatgcatttataggaacatataatcctattgtaagtcaaggagcatctggaattacaatggtttgacttacaatattttaacattgagatgactttttcaggatagtaaatgtatattttacttacaatattttcaactcataatgggtttatcaggatgaaacccatcataaatcgagaagcctctcaatcattttccacagaggctgtagaacttcattttggcactgactatacttttatggttttagctcttacacttaggtctttgatttagtttgaattaatttttctatatggtgtaaagtaagcatccaatttcatattttgaatgtagttatccagtttttcaaacactgtttattgaaaacaccgtcccttcccaactgagtaaactcagtttcgtttccaaaaaatatattgctgtttataggagagtctatttcctgactctattttcctcctcgtcctcctcctccttccttccttctccttctccttctccttcttcttcttctttgtcttgttctgcttctttcttcttcttcttgtttgagacacggtctcactctgtcacccaagtgggaatgtggggctacaatcttggctcactgcaacctcggcctcctgggctcaagcaatcctcccacctcagcctccccaagtagctgggactactggtgcgagccaccacccctggctaatttttgtattttttgtagaaacaggatttttccattttggttggtctcaatgttctgagctcaagcagtctgcctgcctcaggctcccagagtgctgggattacaggtgtgaacaaacgcacctgacctctcctttcttctattggtatacatgtctggctttataccaatgccatactgttttgattaccatagcttttggaactggaacaagacaaggatgcccactctcaccactcctcttccacatagtactggaagtcctagccagagcagtcagacaagagaaagaaataaagagcatccaaattggtaatgaggaagtaaaactgtcgctgtttgctgatgctatgattgtttacctagaaaaccctaaagactcctccagaaaactcctagaactaaaaaaggaattcagccaagtttcatgacacaaaattaatttacataaatcagcagttctattcaccaacagcagccaagcagagattctaagcattagggaagcaaagacacagaatacacatcctgctggcaagagcttgagcagaaacatggaagctaaaatgaaattggcatatggatattcagatatctatatctggggtccacagtaactggagaattgtgaaactgaatgaggaggcaaaagagaatgaacatttaatggtggcagacattaaaaaccaagactgtgagttacattttgtgaaaaggatacttaaaataataattcattctacatttttagatagaagaaccaaataatgatgtctgacttagagaaagtttgacttggaattattatttttttatataactttcatttatttcatttcattttattattattttattttttattatactttaacttttagggtacatgtgcacaacatgctttgcataataattccaagtcacatatgtatatatgggaccaacatggcacatgtatacatatgtgacttggaattattatgcaaagacaattcaagaaggaaatataagttcctccaaataagtcacaggctgctgcagctttagaagtaagtgttacacaataaatgtagaaaaaaatcatccagaaaacataatgctaatttattcctaataagatccataatatatgcatttaacttttccatgcatttgttttaagcataacatatgatcttgattacatctgagtttgtgttgggcatcaaacattcctatccttttgaagttgtaagacagatgatttttcctataaatgtatatatttcttagaaaaaattttggttataaatatttgtctcatcaaatattaatctctggatagagaatacgattttttttctaatttggaaagattagtcatctaagagttataaagttgtataaataattcacagtctaactaaactaaggatttttaaaaacaattggcttactattctataagtagtcccctcttatccactgttttgctttccatagtttctcctgtgatcaactgcagtctgaaaatattgggtggaaaatgccacaaatgaacacttcataaattatcagttggatttcagtcatagcccaatgttgcatcatagtgcctacattgttcccttcactttatttcatcatgtagacattttgtcttcccatgaagcattttgtcatcacaagaaaaatgagtacagtacaacgaggtattttgagaaaaagaaaaagatagaaactgcatttgcataacttttattagagtatatagttataattgttctattttatttgcagctatttttgttaatttcttccttgtctaatttataaattaaaatttataatacatattgatggatataaaaaatagtgtatatagggttcagtgtcaactgcaatttcaggcattcactggaggccttggaatgcaacccctgcagataatggggaactactgtacttgacttacccttgtgtctcccttcaggaaggatcgtatgaatgccccatggaaaattacaatcaaacgtcaactgatttcatcttattggggctgttcccaccatcaaaaattggccttttcctcttcattctctttgttctcattttcctaatggctctaattggaaacctatccatgattcttctcatcttcttggacacccatctccacacacccatgtatttcctgcttagtcagctctccctcattgacctaaattacatctctacgattgttcctaagatggcttctgattttctgtatggaaacaagtctatctccttcattgggtgtgggattcagagtttcttcttcatgacttttgcaggtgcagaagcgctgctcctgacatcaatggcctatgatcgttatgtggccatttgctttcctctccactatcccatccgtatgagcaaaagaatgtatgtgctgatgataacaggatcttggatgataggctccatcaactcttgtgctcacacagtatatgcattccgtatcccatattgcaagtccagagccatcaatcattttttctgtgatgttccagctatgttgacattagcctgtacagacacctgggtctatgagtacacagtgtttttgagcagcaccatctttcttgtgtttcccttcactggcattgcgtgttcctatggctgggttctccttgctgtctaccgcatgcactctgcagaagggaggaaaaaggcctattcgacctgcagcacccacctcactgtagtaactttctactatgcaccctttgcttatacctatctatgtccaagatccctgcgatctctgacagaggacaaggttctggctgttttctacaccatcctcaccccaatgctcaaccccatcatctacagcctgagaaacaaggaggtgatgggggccctgacacgagtgattcagaatatcttctcggtgaaaatgtagacatacgttctgtgttagagtcaaagcgctaggttcatatcaactcagcagtgtacagcagtgaagaaaaacattattacatgcccagtatgtcaaacagagattaatccagaatgtttgtcttttaatttagtcttgacattatagttgcatattctaagacatctattttgtttctgtttgtgtttctttttatcaaaagacagatcatatattttacactaaattgtaaggccatagaatttcattatcatgtataaatcaaaacaataaatgtccaaaggaatcatatcattcagcataatagttatatgttaattgtttcccattattattaaaataagacaaaataacaaattatttaagattactgaatctaattgaatattaaataatattttatttactctcaactggtgtgtatgtgttcctctttttgctaaagtaatgatttattaataaatttacctcaggataaataagtatgtctggggtgaagccaatttgcctttagtaaaacaacaatttctttataaaagattctatggaatttaccttctatagaacctcttagactacagttgacttagacttagttgaatgtggagtaggttatttgaaccattccccagtcacatcacaacacacacaatgtttgtctcctgagtagccacgggtattctcatgcaagacgttctcttctgaacaatttttttctacttactcttcaaaatcagcaagtctatacatcttggattgggatcaactcctctgctccactatttttatacctgcttaggcctgtgcctagaaggatcaacattatttttataaaagttgtcagcttaggtccattctctgagtgaaaggccatggctctccacaagagcccattcctgagaaacgctttagtctctgaggagaggaggcaagaaggaaggtagaatgaacaagtaagagaaaagccctgcattatacaactttccataatgtaacatttttctataactatttttctaaagttctttctgttgctctcaaatagaataatcttcactctggaaatataattaaagtgcataaaaactatttatctgaagaataacatcatgtgatcagaaaatatatttttatttttatttgttattaattttatttgtttattttgtttattttttatgggggttctggcatatgtgagcagaacgtgcaggtttgttacacaggtatacatgtgccgttgtggtttgctgcaccaataaacccgtcatctaagttttaagccccatatgctttaggtatttgtcctaatgctctccctccccttgcccaagaatttgtaatgatagccattaaaatcccaatgtagaaaattttatatctgatttgaaaaaacactgtaggttttaatattatgtgtttaaaatgctattatagcaatgtaaaataaaaaagatgatagagtaaaatgactgtaaaattcaaggaaatatgcattcaatatttacaacattgaacttatcttttcattgtaaataatataaaactacattttgtctttacttgtataaaatgcatttttattaaaatacactgtgtatccattaaaaatcatttggcctaggttttcttctagggtttttatggttttaggtctaacgtttaagtctttaatccatcttgaattaatttttgtataaggtgtaaggaagggatccagtttcagctttctacatatggctagccagttttcccagcaccattgattaaatagggaatcctttccccattgcttgtttttctcaggtttgtcaaagatcagatagttgtagatatgtggtgttatttctgagggctctgctctgttccattgatctatatctctgttttgataccagtaccacgctgttttggttactatagccttgtagtatagtttgaagtcaggtagtgtgatgcccccagctttgttcttttggcttaggattgacttggcgatgcgggctcttttttggttccatatgaactttaaggtagttttttccaattctgtgaagaaagtcattggtagcttgatggggttggcattgaatctataaattaccttttgcagtatggccattttcattaccattcaggacataggcatgggcaaggacttcatgtctaaaacaccaaaagcaatggcaacaaaagacaaaattgacaaatgggatccaattaaactaaagagcttctgcacagcaaaagaaactaccatcagagtgaacaggcaacctacaaaatgggagaaaattttcgcaacctactcatctgacaaagggctaatatccagaatctacaatgaactcaaacaaatttacaagaaaaaaacaaacaaccccatcaaaaagtgggtgaaggacatgaacagacacttctcaaaagaagacatttatgcagccaaaaaacacatgaaaaaatgctcaccatcactggccatcagagaaatgcaaatcaaaaccacaatgagataccatctcacaccagttagaatggcaatcattaaaaagtcagaaaacaacaagtgctggagaggatgtggagaaataggaacacttttacactgttggtgggactgtaaactagttcaacccttgtggaagtcagtgtggcgattcctcagggatctagaactagaaataccatttgacccagccatcccattactgggtatatacccaaatgactataaatcatgctgctataaagacacatgcacatgtatgtttatcgcggcactattcacaatagcaaagacttggaaccaacccaaatgtccaacaatgatagactggattaagaaaatgtggcacatatacaccatggaatactatgcagccataaaaaaggatgagttcatgtcctttgtagggacatgggtgaaattggaaatcattattctcagtaaactatcgcaagaacaaaaaaccaaacaccgcatattcttactcataggtgggaattgaacaatgagaacacatggacataggaaggggaacatcacactctggggactgttgtgaggtggggggaggggggaaggatagcataggagatatacctaatgctaaatgaggagttaatgagtgcagcacaccagcatagcacatgtatacatatgtaactaatctgcacattgtgcacatgtaccctataacttaaagtataataataaaaaaagaaaaatcatttggcaaatataagtgtgtctatgtaaaaagtagaatataaatatgtttacctccacaaatctagcattgttttaaaaagaaaagccctggattattcaaactacaacagtgatgaatgcctgatctgcagttgacccttgaacaacgcggacttgaactgtgcagtccacttatgtgtggatttccttctgccttcaccactcctgagacagcaagaccaacctctcctcctcttagaaggtcattcaaaggtcctgcatgttgcagatgtttttacatggaactttcctggagagaatcccaagtatggttcacgttggttctctcaagctgggaaaaactggaaatgattatgttgctatgattgtagccttccagtgaaagtcccatttctttctgtccttcaatccagactggctttcagacacaaaaagaaaaatactgcatgatctcacttatatattggtgttgcgggaagtcaggaccccgaatggagggaccggctgaagccatggcagaagaacataaattgtgaagatttcatggacatttatttgttccccaaattaatacttttataatttcttacccctgtctttactgtaatctctgaacataaacggtgaagatttcatggacacttatcacttccccaatcaatacgcttgtgatttcctatgcctgtctttactttaatctcttaatcccatcatcttcataaactgaggaggatgtatgtcacctcaggaccctgtgatgattgcattaactgcacaaattgtttgtagtgcatgtgtgtttgaacaatatgaaatctgggcaccttgaaaaaagaacaggataacagcaatgttcagggaacaagggagataaccttaaactctggctgcctgtgagctgggtggaacagagccatatttctcttctttcaaaagcaaataggagaaatatcgctgaattctttttctcagcaaggaacagccctgagaaagagaatgagttcctagggggcggcctctaaaatggccactttggggatggctgtcttttacagtcatagataagggacgaaataagccccagtctcctgtagtgctcccaggcttattaggacaaggaaattcctgcctaataaattttgttcagaccggttgtctgctctcaaaccctgtctcctgagaagatgttatcaatgacaatgtgtgcccaaaacttcattagcaattttaatttcgccccagtcctgtggtcccgtgatctcgccctgcctccatttgccttgtgatattttattaccttgtgaagcatgtgatctctgtgacccacaccctatttgtacacttcctccccttttgaaaatcgctaataaaaacttgctggttttacagttcgggggcaccacggaacctgccaacatgtgatgtctcccccggacacccagctttaaaatttctctctttgtcctctgtccctttatttctcagaccagcggacacttagggaaaatagaaaaggacccatgtgaaatattgggggctgaatttcccctgatatattgggcctaaaaataaacagaatacaaagaaacagagagtagaatggtgattactcaaagttaacttgtctgagaaactgactcagtgcaggatgcagcatcttcatctccctgtctcatgacttcaccactcacgcctcgaccaatcagcaatccccacactttagcccatcacccatgcagactccctaaaaacatgtccacacctgtgatcccagcactttgggaggctgaggtgggtggatcacgaggtcaggagatcaagaccatcctggctaacacagtgaaaccccgtctctactaaaaatacaaaaaaattagctgggcgtggttgtgggtgcctttagtctcagctactcaggaggctgaggcaggagaatggcatgaacccaggaggctgagcttgcagtgagccgagatcacgccactgcactctagcctgagcgacagagcgagattccgtctcaaaaaaaaaaaaaaaaaaaaaaaaaaaaatcatgtccaagtctctccagaaggctgatttgaggcttcctgtctcttcctccttcagctgacctatgattaacaaaccctttctctgctgcaattcctgctgttttggtgttttggtctgctaccactccatgggcaatggaaccctgtggccctgtaacaatccacctgcctcagtctcccagtaggtggaattacaggcctgtgccaacatcccttgctctttaacaaaagatttgacataaatggttatcacctgaattttgtctctttgggaaatagaatggagcttctttataagtgaatatgattatgcatttaaaaatctgtttgacttaatgaataattcaaatggactgaatacagacatggaaaaatgtaaaataagcagctcagttttatttatatttcttattctaatctcttctttcagaataaaacaagttgtggcctacgatctgcttagtttcatcgtttctactgcagaagtgtgaaatagtcaatttctacgtccaggaaactctcaggagatctgggatatgtatttcaggaataagttgttgactcatatcccccatatttgcatatgtgatgtgaccctggtgggtagttttgaggtaaacctaaaagtcttccttgttttacagaaattcccttgaagtctatcttcccacatcaaataaggagtcttacctcctctttcagcacatataggttttgagtttaacaaaactgtgaaaacagtaccgtggttgcactagacatggcgcatactattatgtaacagccaaggttttaaacttgcaaaaaaattcttcgacttttcaaatgcaggaatattgaaacatcggtacacttggactttcaggaaattgtccttgccaggaatgtacactaactaccccgactggatcattatacaacatatatatgcatcagtacatcagattggctggtccaagtgtagtggtgtttacaactaattgatcacaaccagttagaggtttcttggtttcttctccactcccactgcttcatctgactagcctatacatatcaaaatatatatcacaataaatataaataaaaatacatatcataatgtgtcaaataatttaacaatttaaatacatgtggaaaaattcaaatacttttaaaactcaacaaaattaaaaatgaagaaatattacttttctcaggtagattgtatcattaattcatttagtaagaaaataagaaatttgagaacatttaaagcactctactgaataaaaatttaattaaattactattttctaaatattaataaaccaaagagagtaataacaacattttattatctgttttaataggagaaaaatcactgtataatttactgagcatttccaaatacaaagaaccagtgtgaacatatataatacctaaaatatgttaaaagataactcccatgtatgtgatagcttaataatttctacttatgtggttttattaaattaacctcgttctattttagtggcttaaatcttgttgccaatataaattgaactcagaaagaaattaatgtatgcagattcattattactgtggatgcctaaataacaacattcaaactatagggtttcataaagtttagaaacacgaaaacattgacataatgtgaataaatatgtttgtttcttcctccattgaatttacccttgacatgccttgaaacatctaaatacataatcagaactcatttctgaaccttgaattaaggccatcctctgttgttagtgactcaacctagaatgtccaaagtctcagtggacaatccccagtgaataccagcaaaacaactgttaatctcattctccagctaaaaaggactggattcatggttgctactgaattccaatgaaggtctctgaaatctcgtgtgtagggaagaaaaatgaatatatgcatttctttaagcaatattcttaatgcttactcagaaaaatgaatttgttcctatgatgactgtaggactgccgtcagctaagcaaaggcactgagtgtttggaaatgaggaaataataaaggtactaattataattgtatttttaaatttttattgatcacagcgaagaagggactctggcaagtgcttaagaggactttgtttcagaaatagaattgaggtgaatttcagcactaatgactgtactttctctaacaccattcagcagaaatattggagtatgaaatgcaggcaaccaaaagtgattttgcaactaattcataaatgtgttttctggaggggaagggaaatgatggtcaatggaagagacagggatacattatattagactatgctttcatgggctcaagtgaaattaaagaacccacattcacaataattattgtaaggggtaacatttccttgtacctacttggttggtgttttgttttgttttggtttgatttcttttgccatgagtgatgtgcgattgtacgatgctcattataatcttaatgctgcttcttactttgtgatctagagaagttcgcttacaaactctgaatctcaatttttgtcatctaagatgtcggtggtgatgtcaatgtaaagagctttttattaggattaaaaccaatggaatcacggaacaatcctgacatattgcacgtgccagtgtgtggagatagtcaataaaagttcatgctggtatcattccattcatgtaggacatcactggggttgaaggctggtttttctacttgtgatgaaaatatcctcagaaatttttctgctctctttttcctcctgtgtataacatcattaatgctgatgcctaggtatatacattttaggagagttacaaaaatgaaagcaagtagaaatgtttttaaataggcttaaaatatttgttgctattttggtggataaaaaactaagggacagaacccacgtggatttatttttacataagaaaaaaatgtcctcttcacattactgaaacagatgtataataaatatcctctttgcattactgaaacagatatataatggctgagactgctttctcattagggacagggctctattttttctaacaataatattatatggtagaattagagccttggaacatgaataatcaaagagatgctacattggtgttcatgagatattgtaacatcgcagaacacatctcctgcccctcagcacttgtaaagtcctgttaacaagagcaaggtctggtagaaagaaagactttttcttccaagcttagctgaggggaagcaggacaggcttctgccttaatgggcagtgcttccccttctggggcagtaggcagggtcttttaatggggtcttggtgtgaatgacatgcagggggtgaggagatggggtccagtgacttgcttctgatgtattttctatccaatggtctggctggcaccaccgcaggcagagctgggctgtaaattgaggcaatctcctagtgggagggagtttttggggtgcctgattttcttcaaggttccttctctagaacttttaagtaaacacaaagtcaaataagcttgccttgtagaatgtgtctggtggagagtgtaaaggatagatttgcattcctaaacagttaagtaagaggtagggggagatcggaaaaataaatttgttatttttcttttttaaaaatagggtactcagttataatatggcattacatatgagatctgatgtgtcatttaatattctgacatatattacttttcctctttttaaaagtaggataataactctcatggaaagtttgtcatcgactgccctatataaaatacaaataatagaaatgtttggaatgttaattgtgttagtaatttcaaatagtacatattctaattgccaataattaaactactaatataaattcaaactattgcatcagtcttaatgctgatcacatattgtttccaaatgacatgtataaaaagtaatttgttcttctaaattgtccctcacaaataaccagaggtcataaaataattgaaaataaattgctctgtagaggctcagaaacttgcctgaattttcttaaaatgtatttggacatccaaatatggaataatttcagtatatttaaatgtttttattattttttatttcttatttcatacatgagataatacatattatctcatgtattaaatatacataagataaactgcaccatttaaactattttaagtgttcaggtctgtggcactaagtatatttatattgttctgcaaccatccccaccagtcatctccagaatagtttcattgtctccaactaaaattttgttctctacacaattattctccttgactcccttcccccatccccaggggtccagcattctactttctgtctctataaatttgactactctgggtacttcctgtacataaattcatacaatacttgcctgtttctggcttattttgcttagcataatgtaatcaagtttcatctatgttgtagcatgtgtcaaaatttctttcattttaaaaactgaataatattccattgtatgtactcattacattttttattgatttctctgtggatggacacttaagttgtctctgcctttggggtattgtgaatactgctgctgtgaacgtgggcatataagtatgtttttgtgtgtcttgtttctgtgggtccacattcagaagtgaaatagttggaacctatactaactctgtttaatttttgaagaaattactatacagatggtccagaaacacaataatttgacaactttttgtctttactatgcatttataaaaacataaaaccctattgtaaatcaaggagcatctggaattacaatggtttgacttacaatattttaacattgagatgactttttcaggatagtaaatgtatattttacttataatattttcataatgggtttatcaggatgaaacccatcataaatcgagaagcctctcaatcattttccacagaggctgtacaatttcattttgccactgactatacttttatggttttagctcttacacttaggtctttgatttattttgacttaatttttctatatggtgtaaagtaagcatccaatttcaatattttgaatgtagatatctagtttttcaaacaccgtttgttgaaaagactgtcccttccacattgagtaaacttggtttgcttgccaaaaaaatattgctgtgtatatgacagtctatttcttgactctgttttctatttcttcttcttcttctccttcatttttttttgaaacagggtctcactctgtcacacaggttggaatgtggtggtgtgatcttggctcactgcaacctctgcctcctgggctcaagcaaccctcccatctcaagcccccaagtagatgggactactggtgcgagccaccacacctggctaatttttgtttttttttttttgtacagacaggattttaccatgttttactggctggtctcaatgttctgagctcaagcaattctgcctgccttagcctcccaaagtgctgggatttcaggtgtgagccatggcacctgtcctctcttttcttctattgttatacatgtctggctttataccaatgtcatactgttttgatttctgtagttcttggaagtggaaaaattcaaggatgctcactcttacctcttcaacatagtattggaagtcctagccacagcagtcagaaagagaatgaaataaagggcatccaaatcagtaaagaggaagccaaactgtccctctttgcttataatatgattgtttacctagaaaactctaaagccttctccagaaaacttctaaaactgataaaagaattcagccaagtttcaggatacaaaattaatgttcacaaatcagctgcaaataataaactgcttaggaatatacctaaccaaggaggtgagagaactctataaggaaaactacaaaacactgctgaaagaaatcatagacgaaacaaacctatggaaacacgtaccatgctcatggataggtagaatcaatattgtgaaaatgaccatattgccaaaacaacctacaaattcaatgtaattcccatcaaaataccaccatcattcttcacagacaattctcaaattcatatggaaccaaaaagagtctgcatagccaaagcaagactaagtgaaaaaaacaaatctggaggcgtttggtaagttttaaaatcagaaagtatcagtttttcaattttgtccttaaaaaaacgttttccagatttttcgactatttaaggtcctttgaaattccatagaaattttagcatggtttttctatttctgaaaaagatttatcattagaattttcatagattccattgaatctttaagtgactttggatattcttgacatcttaacagtgttaagccttccagtctataaatacagaatgtatttccatttatctgtgtcttctttgattgttctaatcagcattttgtcatttttcaatatataagccttttacttccttggttaggtttaatccttaagtgtttcgtttctttctgatactattgtaaataaaatcacaatctcatttttagattgtttattgttagtgtatagccacttgaagcctaggttcagaacagacaattttgcttctgacactttctgtgagtcacagcaaattgtgggtgtataggagtgcaaaaggttttggctgttgatgttgcatgctgcaattttgcttattgtgttaattatttataacagttttctttgcgtggagtcctaaggttttctacacatatagttatgtcataaacaaataaaaattatttcacttctttcttttgaattaagataacatatttatctttccctttttttttttttttgttcaatcgctttggctgaacttccagtaatatgctgaatagatgccgtgaaagtggacatttttgtctttctccaaatcttagactaaaaagtgtcactcttggccaggcacggtggctcatgcctgtaatcccagtactttgggaggccgagatgggcggatcacgaggtcaggagatcgagaccatcctggctaacacggtgaaaccccgtctctactaaaaatacaaaaatttagccagcttggtggcaggtgcctgtagtcccagctacttgagaggctgaggcaggagaatggagtgaacctgggaggcggagcttgcagtgagccgagatcgcgccactgcactccagcctgggtgacagagcgagactccatctcaaaaagaaaaaaaaaagtgtcagtctcatattatgatgaagctgtgggttaaattcttaactgtgacataatttttacatcactttaatgttttattcaagtaatgcgtagacatggtgacaacagtccacaggctaaaatattggacccataacagacccttcctgaacccaaaggtaaggacttcaaattttcttaccagtttttccctatttttgtccatgtattttcaaacaatatgcttatctgctaatgcttgatttatataccccaaataccagcccttgactcatgacataggccacagtcaatagtgacctgcttcccccaacatcactacccccacactcattacctttctcccattctgtcaacataattacattccactttatatctgcagtaaggggttgacagcatcatctcctcttatgaaatttattgattaaatacataaaatatatactcttgtaaatcctgatggtgatacatatatacatagatttcttctgattattattactactatttctctcaaaaacttataattaaaatttttagaatgttttctagaagacagaattttcatgaaatattttactaaaaatatttctcacttactttgtgattttacatgccatctgaatatggtggctaatatattccagttctgagaatttttgtatggtattgagtttattattatttgctatgtgcatttctgggaatgcctgtaagtatatgttggtcctgttgcattaattttctaatatttttgtctcttctaatcttttcagtttttttttccttctgatagatttttcactttcgtattttgaaactttcatttaatgcggtatcaattattgtatctttaatttcaaagagtcatttattgttacatttcacatccttgcatatagctaatgatatttatttggtggattttataacatatcatagacatcttcattcctgaaaataggaattcttaattttaaaaactcactctttttgcaggtttgtgatagttttaactcagtgtacatacacgtgtattgatccttaagtgagtgttcatctttgtgtgtgtgtgtatagatgtgagtttgcacactgtgtagatcttactctttcatattgttacacttcctcaaaggtcggctgacctttggctctaaaataattttcaagcctaaaaacttcattccttttatgtatcctgtgcaaagttgtccagtgatgtcttctatctggagaagaatactcgaaccacctctacccagaaaactgtcaggttgctgtttccttttttccatttaagtgaatggtcatttctccaaatcctgtcttttgaagatgtaaagtgatttattgtttttgcttccctaatgcttagattacattatactttatggatcttaacaaaaaattgataaatatacttatgatcccttcatatgaatgggaggatccctaaagtctatgtaatctaagcatgagggaagcaaagacacagaatatacatcgtatacggggagagcttgagcagagacatggaagctaaaatgaacttggcatatagatattgagatagagagtctgcattaacttgagaattcagaaattggatgagaaggcaaaagagaatggacatttgatggtggtggacattcaaaatcaagactatgaattacatttcatgaaaaaggtacttaaaataacaattcattctacatttttaagtagaagaaccaaataatgatgtctaacttagagaaagtttgacttcaaattattatgcaaagacaattcaagaaggaaatataagttcctccaaatgaatcataggctgctgcagttctacaagtaagtcttaaagaataaatttagtgagaaaaatcatccagaaaaagtaatgctaatttattcataatatggatccatagcatatgcatttaatttaccttcccatgcgtatgttttaagcatagcacatgatcttaatggcatctgagattgtgttgggcatcaaacattcatatctttttgaagttgtaagacaaatgatttttcctataaatgtatatatttcttagaaaaactttggttataaatatttgtctcatcaaatattaatctctgtgtaagaaaataatttttttctaaatagaataaatgagttcatcatttaagtgttgtaaagttctataaataattcacagccttactaaactaaggatttttaaaaacaattggcttactattctataagtagtcccctctcattcactgttttgctttccgtggtttctcctgtaatcaaatgcggtctgaaaatattgcatggaaaagtccacaaatgaacacttcataaattttcaattggttttcagtcatagcccaacgtcacatcacagtgcctaccttgttctcctcactttatgtcatcatgtagacattttgatttcccatgaagcattttgtcatcacaagaaaaatgagcactttttcaatatgatggtttgaaagaaagaaaaatatagattgcattcacataagttttattacagtatatagttgtaattgttctattttatttgtagttatttttgttaatctcttccttgcctaatttataaattaaagtttataatatgcatttatggatataaaaatagtttatatagggttcagtatcaaccccagtttcaggcatccactgggagtcttgtaatgcagccactgtggataaaagtgaattactgttcttaatttacccttttgtctcccttcaggatggattgtaggaattccccatggaaaattacaatcaaacatcaactgatttcatcttattggggctgttcccacaatcaagaattggccttttcgtattcaccctcatttttctcattttcctaatggctctaattggaaatctatccatgattcttctcatctttttggacatccatctccacacacctatgtatttcctacttagtcagctctccctcattgacctaaattacatctccaccattgttccaaagatggtttatgattttctgtatggaaacaagtctatctccttcactggatgtgggattcagagtttcttcttcttgactttagcagttgcagaagggctgctcctgacatcaatggcctatgatcgttatgtggccatttgctttcctctccactatcccatccgtataagcaaaagagtgtgtgtgatgatgataacaggatcttggatgataagctctatcaactcttgtgctcacacagtatatgcactctgtatcccatattgcaagtccagagccatcaatcattttttctgtgatgttccagctatgttgacgctagcctgcacagacacttgggtctatgagagcacagtgtttttgagcagcaccatctttcttgtgcttcctttcactggtattgcatgttcctatggccgggttctccttgctgtctaccgcatgcactctgcagaagggaggaagaaggcctattcaacctgtagcacccacctcactgtagtgtccttctactatgcaccctttgcttatacctatgtacgtccaagatccctgcgatctccaacagaggacaagattctggctgttttctacaccatcctcaccccaatgctcaaccccatcatctacagcctgagaaacaaggaggtgatgggggccctgacacaagtgattcagaaaatcttctcagtgaaaatgtagacatacgttctgtgttagagtcaaagcgctaggttcatatcaacttagtagtgtacagcagtgaagaaaaacattattacatgcccagtgtgtcaaacagaagttaatctagaagaaatttgtcttttaatttagtcttgacaatattataatacatattaatacatattctaagacatctattttgattttgtttgtgtgtggtttttgtttgtttgtttgtttgtctttttaatggattttggctcttgttgcccaggctctaatgcaatggcgcaatctcagctccccataacctctgcctcctgggttcaagcgattctcctgcctagcctcctaagttagctgcgattacaggtgtgagccaccatgccctgcctgttttttttttaatcaaatataggtcatatattttctactaaattgtgggcaacagggtttcattaacatgtagaaatcaaaacaataaaggtccaaactaatcatatcattcagcataataattacataatagttgtttatctcccattattataaaaataagacaaaaataacaaattagttaaaattactgaatctaattgaatattaaatagtttttatttactctcaactggtatgtatgtcttcttctttttcttaaagtaatgttttactaataagtttacctgaggataaataattatgtttgtggagcagccaatttggctttagaaaaacaagagtttctgtataagaagttctatagaagttacagtctatagaccctcttagactatagttgacttagtggagtgtggagtaggttatttgaatcatttcccagtcacgtcacaacacactcaagatttgcctcctcagttgccacgggtattttcatgcaagacattctcttctgcacaattttatttccacttactcttctcataaatcaataggactattcagcttggattgggatcagctcctctgctccactatttttatacctgcttaggcatgtgcttaaaaggatcaacattatttcataaaggttatctgcttaggtccattctctgagtgaaaggccattgctctccagaagagcccattcctgagagactcttttatctctgaggagagaaggcaagaaggaaggtagaatgagcaagtaagaagagcctcatattatccaagtgacagcagtggtgaatgactgaatggtccttgagcaacacagatttgaactgtgcaggtccacatatatgtggattttgttctgcctccaccactcctgagacaacaagtacaacctctcctcctcttcctccgcctcagcccactcaacgtgaagacaacaatgatgaagaactttatgacaaacctctatccctaaataaatagtaaacatattttctctttctgatgattttctcaataagatattcttttttagctcactttactgtaagagtagagtatataagacatataagatacaaagttgtgttaattgaatgcttatgttatttgtaaggcttgctgtcaatagtaggatatcagtagttaggttttggggagttcaaagttaaatgcatattctactgcttggcggtcagtgaccctaatttccgcgttgtcctagagtcatctgtactacaattggaataatcattttcaaacaagaacattaacatttgaataggagatacaaatatggatctggatatactcatttcaattaagcatttagagtttactagagtactgaataatttaaattttgacttatagaatggcaaatgtttatgactttcttctcctctaatttaaattaagtagaattttctcatcattaggactgtatgagaatgtcataataatatgagaaaaggtagtagttgcctgatgttgaaagatttacctaatctcacataaataaccaaaacagcatggtactggtaccaaaacagaaatatagatcaatgcaacagaacagagccctcagaaataacgccgcatatctacaactatctgatctttgacaaacctgagaaaaacaagcaatggggaaaggattccctatttaataaatggtgctgggaaaactggctagccatatgtaaaaagctgaaactggatcccttccttacaccttatacaaaaatcaattcaagatggattaaagacttaaacgttagacctaaaaccataaaaaccctagaagaaaacctaggctttaccattcaggacataggcatgggcaaggacttcatgtctaaaataccaaaagcaatggcaacaaaagccaaaattgacaattgagatctaattaaactaaagagcttctgcacagcaaaagaaactaccatcagagtgaacaggcaacctacagaatgggagaaaatttttgcaacctactcatctgacaaagggctaatatccagaatctacaatgaactcaaacaaacttacaagaaaaaaacaaacaaccccatcaaaaagtgggtgaaggacatgaacagacacttctcaaaagaagacatttatgcagccaaaaaacacatgaaaaaatgctcaccgttactggccgtcagagaaatgcaaatcaaaaccacaatgagataccatctcacaccagttagaatggcaatcattaaaacgtcaggaaacaacaggtgctggagaggatgtggagaaaacacttttacactgttgttgggactgtaaactagttcaaccattgtggaagtcagtgtggcgattcctcagggatctagaactagaaataccatttgacccaaccatcccattactgggtatataaccaaaggactataaatcatgctgctataaagacacatgcacacctatgtttattgcggcactattcacaatagcaaagacttggaaccaacccaaatgtccaacgatgatagactggattaagaaaatgtggcacatatacaccatggaatactatgcagccataaaagatgatgagttcatgtcctttgtagggacatggatgaaattggaaatcatcattctcactaaactatcacaagaacaaaaaaccaaacaccgcatattctcactcataggtgggaattgaacaatgagaacacatggacacaggaaggggaacatcacactctggggactgttgtggggtggggggaggggggagggatagcattgggagatatacctaatgctagatgacgagttagtgggtgcagtgcagcagcatggctcatgtatacatatgtaaataacctgcacattgtgcacatgtaccctaaaacttaaagtacaataataaaaaataaataaacaaataaataaattgcaaaaaaacaaaaaacaaaaacaaacaagcaaaaaagacaataaaataaaagacaagtgcttaccaagcacttacttcactgtgagggacacagaccatcacatgtcacataaaatgatgagacaatctagcaactgcaagttaacttaggtcttttgttctttcattgtaatgtataaaattaatcataatattttatcaatcttgtctacattaatattttaaaactctctttctcatattttataatcactgccttgctccagatcctcatcctctcttcactaaagtttttcaaactaaatcaaaatataatttgaaatttgatattatcagctaagattcttaactaaaaacaacaaaaataaattcatcgtaattaaacagaaaatataatattttaagaagatgcaaaggcttgccaaatcaccaaaaaatggacactagtaaggtctgaaaatctgccaccatgagcagtttccaatatgtgcttgataatgagttctgtgaagtcaccactcttgctccttctgggtgccattcacagccctagaaacttggtgaatttatttctgcggtgtccaggtagcctttgaggatttgcacccgccctgctgctttgagctacccattcccatgttaaaatctgggatccaaaaatctaatatagactctccacctatatacaatagccatagctgaaagtcaggtagagaagtaagtatttgagttctatcagagacagtgaaatgtttgctttctgaggcatgtcaaaagagagttcagatacataaaggatggtaagtaaattctgcactatatgttgaggcaacagtcccacggccacagatttatctatttacatgggccgatatgaaggagatatggaatatgtgagaagtttgttatatgcatgatacttggagaaatattcatgggagaagaaaagagtagacatgatttgttttgtatttctcaagcaggccaacaaatttcggtggccctatttggacagacattgaatggagttgcaagagaggcagatagatggactagacatgaaagagtttgtgaaacttactggaaaggggtcctgatccagaccccaaaagagggttcatggatcctgcacaaggaagaattcagtgcaggtccccagtgcaaagcaaaaacaagtttattaagaaggcaaagtgtgaaagaacagctactccacagacagagtagggcgttcccgaaagtaagaggaggacgtgtccaccctaggtacaatacttgtttatatatagaataaaaaagagcatggggagatgtgctctgctactagggtttgtgataaaggattaattttcttaattagtatatttttcaagaatcaatattattatctttaaagaaaaattaagaatgcctttgttcttaggatgtcgggatatctggacactcccaagtctggatctgtttagtaaacattgtcaatctgtttccttagccgtaaacatctaaaggctcaaaataccaaactttctagaaatatcaaactatctaggaataccaaactttctgggaatgcagcccagcaagtccccggctcattttccagccctcactcaaggtggagtcgctctggttcaaaagcctctgacaaaacgagtggacaataattatgttaccaagattgtagcctcccagtgcaaatctcagtttctcttttttctgtccttcaatccagactggctttcagacacaaaaagaaaaatactacatgatctcccttatatattgggcctaaaaataaatggaatacatagaaacagagtagaatgctggttgctcaaagttaacttgtctaagaaactgactcagtgcaggatgcagcgtcttcatctccctgtctcatgacgtcaccactcactctccaccaatcagcaatacccacactttagctcatcacgcatccggactccttaaaaacgccttccccggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagccgagattgcgccactgcagtccgcagtccgacctgggcgacagagcgaaactccgtctcaaaaaaaaaaaaaaaaaaaaaaaaaaaaaacgccttccccaagtgtctccagaaggctgatttgaagctccctttctcttcctccttcagctgacctatgattattaaactttctctgctgcaactcccactgttttggtgttttggtctgctaccactccatgggcaattgaaccctgtgggcctgtaacaatcctcctgcctcagtctccccataggtggaattacaggcctgtgccactgtctcttgctcttttacaacagatttgacataaatggttatcatctgaatcttgtatctttgggacatagaatggggtttcttaataagtaaatatgactatgaaattaaagaactatgtgatttaatgaataattcaattgcactgaacacagacatttaaaaatgtaaaataaacagcccagttttatttacgttcctcattctaatctcttctttcagaataaaccaagttttgacctactctatgcttggttttgtgctttctactgtagatatgtgaaatagtcaattactgcttccagaacaccctcagggagaagtagcgtatttcaagagtaagttgctgactcatatccaccatatttgcatacttgaccctcgtgggtagttttgaggtaaacctaaaagtctttcttttttacagaaattcccttgaagtctgtcttaccgcatcaaataaggattcttatctcctctttcagcgcaaataggttttgtcttctgtcttttgaagatgtgaaaacagttacctggttgcactagacatggcacctactattacgttaaaaatcacggttgtaaacttaagaaaggaattcttcagcttttcaaatgcgggaatattgaaacatctgcacactttgactttcaggaaattgtccttgccaagactgtacactaactatgctgactggataattataaaacatatacatgcatcagtaaattaaattggctggtcggagtgtagtggtgtttacaactaattgatcacaactagttacaggtttcttggttccttctccactgccactgcttcacctgactagcctatacatatcaaaatatgtatcacaataaatatgtcaaaatatatatcaatatatgtcaaagtacaatttatcaatcaatacatgtttaaaaaattcaaatatttttaaaactcaaaaaaattaaaatgaaccaatatcacttttctcagatagatggtataattaattcatttgctataaacagtaagaaattcgagaacatttaaagtactctactgagtaaaaattcaattcaattaataaatattttctaaatattaataaaacaagagtagtaacatcattaggtcatctaatttaataggagaaaatagcttttcaatttaatgagcatttccaaatgaaaggaaacaatttgaacatgtttaatacccaaaatatgttaatagataactcccatgtatgcgatattttaataatttctacttatgtgtttctataaaattaacctcattctattttagtggtttaaatcttactgccaatataaaccaaacggagaaagaaattaatgaatgcagacgcattgttactgtggatgcctgaataacaacattcaggctatggagtttcatgaagtttagaaacacaataacattgacataatgtgaataaatatatttgtttctttctccactgagtttacccttgacatgccttgaaacatctaaatacatgatcagaactcatatctgaaccttggactaaggccaccctctgtattagtgactcagcctagaatgtccaaagtctcactggacaatccccagtgaatatcagcaaaacaactgttaatctcattctccaggtaaagaaggactggattcatgattgctaccgaatccccatggaggtctctgaaatctcacatgcagggatgaaaaaccaatatacacatttctttaaaaaccatgtatttgtttctatgatgactgtaggactgccgtaagctaagcaaaggcagtgagtgtttggaaatgaggaaataataaaggtactaattataattgtatttttaaatttttattgattacagggaagaaggaactctggcaagtgcttaagagaccttttttcagaaatagaattgaggtgaatttcagcactaataactgtactttctataacaccattcagcaggaatcttggagtatgaaatgcacacaaccaaaaatggttttgaacctaattcataaatgtgttttctggacgggaaggtaaatgatggtcaattgaagagacagggatacattatattagactatgcttttatgagctcaagtgaaattaaagaacccacattcataataatgattgtagggggcagcatttcctcattcctacttggctggtgttttgtgctattttggtttgatttcttttgccatgaatgatgagtgattatatgatgctcattataatcttattgctacttctcactttgtattttaccttatatgaatccagtgtttctaatgaaatgcctggaaagtattagtgttgtttttgcataaaaatgttaaaggggcattaaagtaaaggtacaacgagaatggttaaaatcaccagtcttcagtgcaatgatatattttcttaaaagaaggatgttcttctggaaatcaataatgaaggtaaccgtatgattagtagctgtgctataggtatccagattttgtttttacacgcaacttgatccaaattgtagtgttttgtgcttttaacttttacaatgtatttattttttctttcgggacacaaggtaaacttccagtgaaattatagaaatagctgccttaacaaccacacagagttttgtgagaagcaaatgagcatagtatgtggaaacaatgtgaaggctatattactctacagtcatagcggataagaagtgtgtgagtgtaagtgatagtgattatgttgatgatgctggcaatgataatgatgaagatgctgaaacttgcaggttctcttcagtgatacacccagtcaagtaatacacagtcactatgtcacagcttctaataacccatggattcttctccctgttgtaattataagatacagggtcagacattcagcaacaaaagcttacatttttagtaattgtaagaggtagaattcgatttattttaaatggagtctctgtcccgtgaacttacagcgtgaagcagagtaagcacgtcctcattccaaaataacagtcaaaggatatactttcataatcagtttctgtctagccatggaaatgtctgtctgcccacttacctgtgtatctatctgtgagagctgatgcaccatcgtggacctcaatggcaggatgtgacttggaagcacacatacacacatataaagcaaatattcactttatattctttactcctttacaccttaaagagttgtggttctccaacttcatacccttctcaacaattacaaatacacattgtgtaaatattaaataagatcagttattcctaagtcagtcaaatacaacattatgtactgtgtctcttcttaggagaatctattgtggaggaacttgaaggaaggaggaatctcctgtaggattccatgccaggatgctgtggagagctgtccttgtctatactccagaagacactcttttgtgtcatctgattgacattctagacaagtgttgtcaatgtgaaataattcttactgtagacatgcagattcaggtacagacagcttgttttaaggaattaaggttgactcatggagtcaatgagttctcagcttttgcagtgaaactgacactgtcacctgttccaccatttcccagccctatgtgcaagtaacggagatcagtttctggaagtttcagagattcagaacttttgtatattttagatatcgcttcagaagacaggaagtaaaccagattctggaaaactccataaagaatgtcttggatttgggagacttttaaaacttcagtctgattttttataaaacttccagcaaagccaacttgtgcccctgcctccccagctttttctttccttttctctctctcttttttttttttttggtaaatccacacgttttctgcacctatgcaaatgatcataccaactttaaggagaccagccttatattgtgatgaataataattttttctttgagaatagctttgatcaaaggtgaggaaaatatagggagtaaaatctgtgcctccgtggaaaactgcagtatctggactcaagacgaccatcctccttggttcccaactctgtcactaggtcactgcacagtcgtgaataactctcttcaaatcttgtgattcagtttttcttccttgtgataatgagactatgtttgaaaaatctttgtcttctctgagtatatgaatcactaaattaggctactttcttcatctcactttcaactctaaattgaaggataggaaagagatccatgcaatgcaatgatgctttttgacttcaaaagttagtaataggttcttcatttgaaacttgggcagcatttggagagtcgtaaatattacgttgaatatgtacatcctcaacttgatttacagaggagattatatgggtgtttttttataactgaattcttccagtagggaatcttttacattgggagcaagatagaaaatatctttcatttagagtttctgagaaaccatttttctgtgaagctacataatagttgccaggtgaagtgaaagtacagtaaaactgggtgatacgaggaaacggaaaaagatttgtaatgagtaaattttaatcattaaaaaatcctacttgttttacatttcttatactttctcaattatttaacacttatgtggagtttttgttttaataatttttttctattatttttgttttgactgattaaaaactgaaccagccttatttcagatttactgccaaaaaattttgagggatgaactacaccacacatttttaaaaggtttatattaatgtacgtttatttatctagatgtcacatttattcacagatatgtatgtatatatgtatatatgcatatatgtatgtgtgtttgtggatctagaggagtttactgaaaatctctgaatctcagttttgtcatctataaaatatcagtggcgatacctatctgaagagttattttgatgaactccaatagaatcacggaacgaatcctgtgacgttccaggtgccaatgtgtggagagagtctgtgaaagttcacgcctccctcctgcctttcacatgagacgtagttcaggtttcaggtttgtgggtcctactcactctgaaatagtgaccaggactttttctgctcgttctttcctcctgtgtattctgtcattaatgcttatgcctgcatactgaatttttagtgaaaaaaaaaaagtaaaagcaagtgaagatgtttcttaataggctaaaataccttccttatagctaattctgttaatacaaaagtaaaagggccagaaataatccatttggatttatttttacataagaaaaaatatcttcttcacattattgaaacaggaacatcatggctgaggctgctttcctgtcaggaaccagcctttaattttatttaaataatattatataataggacattagaatattagaacactggaacatggataataaaaagatgatacattggcagtcataaaacatggcattaactatcagatgtgatgtgccatttattatgctgttctatgttatttttttctttaaaattaggataatgttaactatttcttggacagtttgtcatagagagtcctatgtaaaacacaaatgatacaaatgtttgaactgttaattgtgttaacaatttcaaatattacatattctacttaccaataattatactagtaatataaattacggagtattggattaatcttaatgccaatctcatcttgattccaaatgacatttatgaaaatttgctcttctaaattttttttcaaaaattagcaatgtcataaaattactgaaaataaattgctctgccatggcttagaaacctgccaagatgtttaaaaaatgtatttggaaatccaaattggaatagtttcagtacatttaagggatcttttattagtgcaaatatacttaagaggaacaccattttaaccattttaagtgtagaattctgtgtcattaagtacatatattgttgtgcaaccatcactaccatgcacctgtctccaaaacaatttcattgtctccaactaacactttgtttttgttaaacaattactctccttctttcccttcccctatcctccagggtccaccattccactttccatctctgtgaatttcactactgtgggtacttcatgtaagtgaattcttacaatatttgtctttttgtgacagacttatttcacttagcataatgtattcaagcttcatccatgttgtagcatgtgtcaaaatttcttcgcttttaaaaattgtatatacatactatatttatattgatttctttgttgatgaccacttgctttgtttctgcctttgggctattgtgaatagtattgctatgaacatgggaatagaaatatttgtttgatgcaaaaacagaataacaaatactgcatgttctcaggtataattgggagctaagcattgggtacacatggacataaagatgggaacagtagacactggggactccaaaagaggagagtgagggaggaggcaagggttggaaagctacctatttgtgctatgttcattattttagtgaagggttcaacagaagcccaaacctcagcatcatgcaacatatccatgtaacaaaccacgattgtactccctgaataaaaaaaaatccaaaaatgtctgttcaagtgtctgcttttattttatttatttatttattattttatttatttcattcagaactaaaattgttggatcatatacttattctatgtttaagttttggaggaattacaatgcagatggttccaggtttacaataatttgatgatttttgactttatgatgagtttataggaacataaccacattgtaaattgaggaatacctggacatatgatgctttgacttgcaatttttgacattatgatgactttatgcagatattaaatgcatttttacttacaattttttcaacttgcagtgggtttgtaaaggtgaaactccactgcaagttgagaagcagctgtatcattttccacagtgcctttattattcgacattttcaccaacaattctttatagttttatctcttgcatttaggatttttattcattttgacttaatttttcaatatggtataaacatccaacttcaatatcttgaatgtaaatatccacttttccaaacaccatttatttaaaagattgttccatctccactgagtggacttagttcctttttgaaaaaaggttaccatgtatatgagaggctatttcttgactctgttttatactgttgagctatatgtctggtgccattgccacattgttttgattactatagcttcgagtaagttttaaaatcagaaagtatatggcctggtgcggtggctcatgccggtaatcccagcactttgggaggccgagccgggcagatcacaaggtaaggaggttgaggccatgctggctaacatggtgaaaccccatctctactaaaaatacaaaaaaaaattagctgggcgtggtggcgggcacctgtagtcccagctactcaggaggctaagccaggagaatggtgtgaatctgggaggtggagcttgtagtcacctgagatggtgccactgcactccagcctgggcgacagagtgagactccatctcaaaaagaaaaaaaaatcagattgtatgagtctttaaattttgttctttttccaaaaaagtcaagattttttgactactgaggattctttaagattcatataaattttagaatgggcttttctgtttctgaaaaaaaaaatttatcattttaattttgatagagattctactaatttttttggctttgtacactttttatttttatttttaataattattttattgtttgtttttaagttccagggtatatgtgcaggaagagcagttttgtttcatgggtaaacgtgtgccatggtgatttgctgcacgtatcaatccatcacctaggtattaagcccagcatgcactagctcttttccctaatgctctcccctccaccgccctcccacaacaggccccagtaagtgttgttctcttcctgtgtcaatgtgttttcattgttcagctcccacttataagcgagaatatgcagtatttagttttctgttcctgcattagtttgctgaggataatggcttccagcttcatccatgtccttgcaaaggacatgatcttattattttttatggctgtatagtattccattgtgtatatgtaccacagtttctttattcagtctatcattaatggacatttgggttgattccatgtttttgctattgtggatagtgctgcaatgaacatacacatgccagtacctttataatagaataatttatattcctttgggtatacacccagtaacgggaatgccggatcaaatggtatttccagttctaagtctttgaggaattgccacactgtcttccacgatgggtgaactaatttacattcccaccaacagtgtgaaagcattcctattcctatttcacagcctcactagcatctgttgtttcttgactttttaataattgccattctgatcggcagcagatggtatctaattatggttttgatttgcatttctccaatgatcagtgatgttgtgctttttaaaatatgtttgttggccatacctatgtcttttttttgagaaatgtcttttcatgtcctttgcgcaattttaatggggttgtttgttcttttcttgtaaatttgcttaagttctttgtagattctggaattagatctttgtcagatggatagattgcaataattttctcccattctgtaggttatctgttcattctggtgatagttttggttgctgtgtagaagctctttagtttagttagatcccatttgtcaatttttgctattgttgcaattgcttttggagtctttgtcataaaatcctttcccatgcctacttcctgaatgatattgcctagattttcttctagggcttttatagttttgggttttacatttcagtctttaatccatcttgagttaatttttgtgtaaggtgtaaggaaggaatccagtttctattttctgcatatggctagccagttctcccagcaccatttattaaatagggaatcttttccccgttgcttgtttttttccagtttgttgaagatcagatggttgtagatgtgcagttttatttctgagttttctattctgttccattggtctatgtgcttgtttttgtaccagtaccataagtttatgttactgtagctttgtagtatagtttgcagtcgggtagcctgatgcctccagctttgttctttggctatgcaagctcttttttggttccatatgattttaaaatagttctttttttctaattctgtgaagaatatcaatggtatttattggaatagcattgtatctataaattgctttgggcggtatggccattttcacaatattgattcttcctatccatgagtatggaatgtttttccctctgcttgtgtcctttgtgatttccttgaacaatggtttgtagttctctttgaataggtccttcacttcccttattagctgtattcccaggtattttattatctttgtggcaattatgaatgggagatcattcatgatttggctttctgcctgtctgttgctggagtgtaggattgcttgagatttctgcacattgattttgtatcctgagagtttgatgaatttgcttatcagcttaagaagcctttgggctgagtcagtctggttttctagatagaatcatatcatctgaaacaaagacaatttgacttcctttcttcctatttgcataccctttctttatttcctttgattgattgccctggtcataccttccaacactacattgaataagagtcatgagagattgcatccttgtcttgtgctaattttcaaagggaatgcttccagtttttgcccattcagtacaatattggctgtgggtttgtcataaatggctcttattattttgatgtatgttccttaaatacctaatttgttgagagtttttaacatgaagggaagtcgaatttttttgaaagccttttctgtgtctattgagataatcatgtagtttttgtctttagttctgtttatgtgatggattacattcattgatttgtgtatgtacaaccagcttgcatccaggggatgaagctgacttgattgtgatggagaagctttttgatgtgctgctggattcaatttgtcagtattatattgagtatgtttgcattgcattgttcatcagggatattggcacaaagttttcttttttttttgttatgtctctgctgggttttggaagcaggatgatgctggcctcataaaatgagttagtgtgggctgggcatggtgactcatgcctgtaatcccagcactctggaaggccaaggcaggtggatcaacagaagtctggagttcgagaccagcctggccaacttcgtgaaaccctatctctactaaaaatacaaaaaattagccaggcatggtgttgtgtgcctgttgttccagctactctggaggctgaggcatgtgaatcacttaaacccaggaggcgaaggtcgcagtgagctgagattgtgccactgtaggtgacatcatcacctgggtgattgtgagactggatgacagtgagactccgtctcaaggaaaaaaatgatttagggtggagtccctccttttcaattgtttggaaaagtttcagaagaaatgataacagctcctctttttacctctggtagaattcagctgtaatccatctgaacctgggctttttttcctttggtaagctatttattattgcctcaatttcagaacttgttattggtctatttagggattcaaattcttcctggttcagtgttgggaaggtttatgtgtccaggaatttatccatttcttctagattttcctgtttatttgcatagaggtgcttttagtattctctgttggttgtttgtgttcctgtggggttggtggtggtatttcccttattgtttctgattgtgttcattggaatcttctctctttacatctttattattctttttttattatactttaagttttagggtacatgtgtacaacgtgcaggttagttacatatgtatacatgtgccatgttggtcttgatagtggtctacctagtttattgatttttttttcaaaaaccagctcctggattcattgtttgaagggtttttgtgggtctccatctccttcagttccaccctgatcttggttatttcttgtgttctgctagttctggggtttgtttgctcttggctctctagttcttttagttgtgatgttagggtgtcgatgtgagatctttctagctttttgctttgtgcatttagtgcaataaatgtccctcttaacactgatttctctgcatcccggagattctgatgagttgtctctttgctttctttggtcttaaagaacttcttcatttctgccttaattttattatttagacaggagtcattcaggagcaggttgttctatttccctgtagttgtgtggttttgagggggctttttttttttttttagatggctggagtgcaatggtgtgatctctgctcacttcaacttttgcctcctgggttcaagcaattctcctgcctcggcctcttgagtagctgggactgctggtacacgccaccatactcggctaaatttttttggattttagtagacacagggtttcactgtgttgcccaggcttgtcagaaactcctgagctcaggcaatctgcccgccttggcctcccaaagtgctgggattacagtcgtgagccactgtgcctggccttgagggggctttaatcttgagttataatttgattgtgctgtggtctgagagactgtttgttatgatttcagttcttttgtatttgctgaggagagttttacttccaattatgcgatagttttagagtaagtgccataaggtgccaagacaaaattttgtattttgttgttttgggaaggagagttctgtagacatctatcaggtccacatgatctagagctgagttcaagtcctgaatatctttgttaattttctgtctcaattatctaatagtgacggtggggtattaaagtctctcactattattgtgtaggggtctaagtctctttgtaggtctctaggaacttgttttatgaatctggatgctcctgtattgggttcataaatatttacaatggttagaaatttttgtcgaattgaactcttttacattatgtaatgcccttctttgtcttttttgacctttgttggtttaaaatctgttttgtcagaaactaggattgctaccactgctttttccttttttccttttgcttggtaaatttttctctattcctttattttgagtctgtgtgcatctttgcacataagatgtgtctcttgaatacagcacatcaatgggtgactttggctgttgttgacatcttaacagtattaacccttccaattgataaatatataggatgcatttccatttattcgtgtcttctttaatagctctaatcagcattttctcattttcaatgtataaagtttttaactccttggttaggtttattcttaagtgttttatttctttttgttactattggaaataaaatcagagtgtagttttcagattgttctttgttagtgtatagaattacaacagattctggttgttgatgttgcatcctgtaattttgctaattttatttattatttatcctaagttttctacatatataattatgtcatatgcaaacagaaataattttagttctttcttttgaaataagataatttttatttcttttcttgtttaattgttttgactgaacttgcagtaatgtgttaagtagatgcagagaaagtggacttccgtgtcttgttgcaaatcttagagtcaaagctgccagtctttcattattatgatgaagctgtgggttaaaatcccaactgtcacataatttttacatcactttaatgttttatgaaagaaatgcatagacatggtctcagcagaccacagggtaaaatgttagaaacataacaaactcttgctgaccccaaaggcaaggacttcaaattatcttttcagttttccctcatatttgtccatgtattttcagacaatacattcatctgataatgcttgattttctatatctcaaatatcattccttgatccatgatacagacccccatggatagtaactgctccctcctccgtcatcacccccaggttccttacacttctcccattgtcacagcagaactgcattacaccttatgtctgcaccaaggggttgacaacatcatttcatcttatggaatttattgctacaatacaaaaaatataaactattgtaaaacctggttatatatatatatatcttctgatatttattacttttatttcaaaagctttagaatttgtcttgtgggtaatatttagaatttttaggaaatttttccgaggaaatagaatttttatataatatttttcaggaaagtatttctcacttatttttgtgaatttgcatgccatttgaatatgatggttaatatatttcatttcagagaaaatttttaaagaatattaacttcattattattttgctatatgcatttctaagaaagtccttaagcacatattgttcctccaatatgatttccctactttttttatctttcctaaattacaattttttcatattgttgttgcttttgtttaccttctaatagatttttcttactttgccttttgaaactttcacttaatattttttatcaattattatatttttaattttcaaaggtcctttatgttacctgttgcatcctttcagatagcaaatgatatttatttcacagatttcgtaacatatcatacatctctgaagatatgaattctgatcacaacaattcattctttctgcatttttaatcattataatctcagtgtatttatgagtatgatcatgtgtgattatgcatatttctgtgtgtttgcatgctgtgtgaatgttagttgtatacgtggttatagtagctcaaaattctggtggtatttggctctagactaatatttaagcctaaaaaactccagttcttttaggcatactgtgcaaagttgttctctgatgtcttctatctggagtagagtttctaacgcacctctacccggaagtttgtcagaattctagtttccctttttatttaagagattgaattttcctcaaaattcattcttttgaaggatccataaagcaatctgtaatgttatctaagcactagagaaggaaaagacaaaatgtgtaacctatttggtaaggcatctgctttaactagagaattttgaaattaggcaaggaggcaaaagagaatggatgatgatgaatattgaaaatcaagagcgtgaattaacatgactttggttaaagggacatagcaataaggattccttctggatttctaaataaatgaaccacaaaatgataactgactaaataattgataattggcattattgtgcaaacatcattcaagtttctcaaaatagcagagaggctgctgcagttttagaagtaaatctggcagaataaacatgggttgggtggggaagctcatgactgcactcccagcatttgcaaggccaagacaggaggattggtgaggccaagagttcaaaaccagcctggcaacatagcaagacttcatgtctacaaaaatagaaagttaactaggtatggtggcttgtggtcgtagtctcagctactcaggaggctgaggcaggtggattgcttgagccagaatgtcaaggatgcagtgagctatgatattgccacttcactcccacctgggtaacagagagagaccctgtcactcaaaaaaaaaaaaagtataaatatggaaagataatagatcatcctataaagataatactaatttttcaaatataaatctaaatgtatgcatttatactgactttctatgcatatgtattcaatataacatctgattttgattatatctgaattagtgtcaggcagtaaaacattattctattgaagttgtaatagagatatctttcttataaatttacatatttctcagaaaaatatctggtaacaaatgttggtatcatcaaatgtaaaactctaggtaaaaattaagatttctctttcaaaataggtaagaagtcagatcaaagaaggctgagtacaataaaacattttgagagagaaagatagagaccatattgacataatttgtattatagtatactgtatattcattctattttattataagttactcttgtttatctcttacttgtcttatttaaaaattaaactttatcagaagtatgtgtggacagaaaataatagtgtatatagggctcagtgtcaactccagtctcaagaatttactgaggggcttcaaatgcattccctgcagataaagacgaatttctgtgcttaacttacccttgtgtctcccttcaggaaagagcacacgaatgccccatggaaaattacaatcaaacatcaactgatttcatcttattaggattcttcccaccatcaagaattggccttttcctcttcatcctcattgttttcattttcctaatggctctaattggaaacctatccatgattcttctcatcttcttggacacccatctccacacacccatgtatttcctacttagtcagctctccctcattgacctaaattacatctccaccattgttcctaagatggcatctgattttctgtctggtaacaagtctatctccttcactgggtgtgggattcagagtttcttcttctcggcattaggaggtgcagaagcactacttttggcatctatggcctatgatcgttacattgctatttgctttcctcttcactatcccatccgcatgagcaaaagaatgtgtgtgctgatgataacagggtcttggatcataggctcgatcaatgcttgtgctcacactgtatatgtactccatattccttattgccaatccagggccatcaatcatttcttctgtgatgtcccagcaatggtgactctggcctgcatggacacctgggtctatgagggcacagtgtttttgagcaccaccatctttctcgtgtttcccttcattgctatttcatgttcctatggccgggttctccttgctgtctaccacatgaaatctgcagaagggaggaagaaagcctacctgacctgcagcacccacctcactgtagtaactttctactatgcaccttttgtctacacttatctacgtccaagatccctgcgatctccaacagaggacaaggttctggctgtcttctacaccaccctcactccaatgctcaaccccatcatctatagcctgaggaacaaggaggtgatgggggccctgacacgagtgagtcagagaatctgctctgggaaaatgtagaaacattttctacctaaggtctcaggactcagatacacatccatccagcagtgtatagtaattaaaatattatttcaatcctagagttcaggagctaaaagtaatcaaggtaagagaaaaaaatcactgatttctggacaaaattgttttacatatatatgtatatataactccaaacaaccttttttcttcatggcattgtttccataaattttgaaagcacctacttttactaatatgttgtcaatgagaatttttgtttttggtcatgcagaaatagaaatgaaattggtctaactgaagttggcactcagcataacaatttccttatggtcagtttattttccagtaattttaaatttacttttttgtttatgtctaaaacaaaacaaaaaataagtctcttgacttggtgtatctagttgaaagctgtaagatgttttgtctttcttatcttagacacttaacgtaccaattactcattctttcaatttagggaactcattacacagtttagcagagagctcatcagggattcttaagtcctgataccactctggatggcctatgacaagattatgttctttataggggaatgaatcccaggaaatgatttaacattaggtatattttagatcaacaaaaggactggaacatgccagcagtaataaaaatgattacatttaggtctttaacctgttttgagttgatttggatatagtgtaatgactgggagtttattttcatttttctgcttaaaaatatccagttttgccagcaccttatattgaagacactgtctttttcccaatgaacagtcttgggtctgttgtcaaaaatcagttgcacagaaaggttttgcttgttctcactcctatgcgagagctagaatttttaaaaactgaactagtggaaatagagaagagactgatggtcaccagagggtgggaagggtacaggggagggacgataaagtggggatggctaatagttgcaaaaatataattagatagaatgaataagagtatttgatagcacaatagagtaactatagtaaacaataatttattgtagaatttattgtatgtattaaagaataactgaaagagtggaattggaatgttcccaacacaaagaaataaccatatttgaggtgatggttaccccgattaacccgatttgatcattatgcattgtatgcctttatcaaagcatcacatacactccgcaattatatattactattatgtatccatagtaattaaaataaaagaaccagttcactgtagatatatggatttatttctgggttctctgttctgtttcactgttctatgtgtctgtttttatgccagtaccattctgttttggttattccatgtttgtagtatagtttgaagtttggtactcatgcctccagttttttctttttattctacagtgctttgactatttgggttctttaatagttccatacaaatcttaaataatggtttttactatttatgtgcagaatgtcattggtattttgatagacattgcattgaatctgtagtttggttatttaaataatattaattcttccaatccatgagcattggatttctttccattcatttgtattcctcttcattttctttcaccagtgatttgtacaaatacattctagtgttctcttccatgactaccgttaacggtaaagtattacatagtgcaatgctctttaaatgtcatttctatttctaagcctgtggatatttgttttaccatattgtagcagttaaaacataaattttgaacttgttttataaatcagactatgtctttgttgtgcttttttgcaatgagcagtgtgtatttttattttgtaatgatttactaacaaagtttactgccttagcttcctggcatttcctgtcctgatattcactcagctaggtcatattccatgaatacaacagggaggggctttgggacagagagaaaataggccttccatcacgagtcacttgctgctgccagggagagcacctcctctcttcccaggtagggacatttgtacccaactgccacctgtgccactgcttctgtcatcaccaccaatctgagcccagccacacccaagccactccttggaatcctgtggtgctgtgaagtattacaagatgtgtgcgtgtgtgtgtgtgtgtgtgtgtgtgtgcatgcctgagaaggccaggcaaattgccccacgtgggtgttgccttagcccccttgtgtagtcatttctactggaccaaaactgcttgctaatgctgccaacctgtccagctcttctgtcacatgcttactcagagatgaaattattaaatattccaatgataacagcggagcatgaaaccatgcatggagccctttgagtgtaggaccttgtgcataggtccacgaagccagtcctgagaaggatgggaagagtgagcaggaagtgaatgagatcatgcagtctaggatagtggtgggattgtgagatggtctgggtgttgctatcctcccaaaatccatatgcttaaatcttaaccctcaatgtcatagtattaggagttggggccttttgggaaatgattaggtcatgaggatagcaccctcttgaataagattaatgcctttctaaaggaggctcaggggagcttgtttgtcccttctaccatgtgaggttacaacagatggtgccatctagggtgtcgtagaagccatcgtctatgaaccagaaagcaagccttctcaggacactgaatcttcagtcactttgtcttaagacaaagaacttcccagcttccacaactctgagaaatacatttctcttgtttataggttacccagtttaagacatttttgtcatagaagcttgaatagaccaagacacaatacctgctgtttttgttagttgttattactggaaaaagcctgagggaagactgaattaagcagtggtgcccagttcagaccctttacccattccaggtagtgattcatggagggaatcaggagacctagctgtatgattttctgtgacataccacggctttggggaaatcattccatctctctgaagttagtttactgaaaaacaatatggatgcctttatcttattggtaaatggcatcattgaagtcccacctactgacattcctgtataggcaatggtaatcctatttttcatgccagtgtctctgtgaatggagataaagaggtcaccaatgaatgctgagcatttcaaggctatcagaaatgacttcaaaattcgtttacccctgtaggttctggctcaggaaagcaataagctcgtccccactgacatagtatctgtactcagaggccactcctttccccttgtggtcattaagaagaacaacggagaaagaagtcaaattatccaaatatactgtcatttgctacattgtttatgagaatgtagtcctgataattttgaaagttggacaataattcctcttggggaaattaatgaattcattacctcacagagtccttggctcactgttcattgtgcctcgttttagccatttttctttccatccaaatgttacgctgtggttatttttcacttcacagtcattctttaattctttcatgtcctcaggctagaagatgcaaattttacagcatgtggtatctattagcatttcataccacacagtgtgcatttagaaatttcttaagtattaaattagcaaagtttgatttatggaaagggacatgagtattcattctattttgaaggatgagtatctttcttttttttttgcatttatttatttatttattattattatactgtaagttttagggtacatgtgcacaatgtgcaggttagttacatatgtatacatgtgccatgctggtgcgctgcacccactaactcgtcatctagcattaggtatatctcctaatgctatccctcccccctccccccaccccaccacagtccccgatgtgtgatgttccccttcctgtgtccatgtgttctcattgttcagttcccacctatgagtgagaacatgcggtgtttggttttttgtccttgcgatagtttactgagaatgatgatttatcacaacaagctgtggttcaatagtgacatagttgggtagagtgaaggagtgaattacatgccatccacaaatatgctgagtcagcatgtttattagtctgagctgaaaacatgtgagaaattttggttaacattggagaaaaaggttatctcacctgtcttttcagcatgcagcaagttctaaagattcttccaggaatctctggtacattctgatactcttccagtaccctctctgtatcagaatagaaaatagcccttcaccagagcctgacagctggaggaatgcagtctgaataataaactaccagaattaacccttatttttcactatctttacacccccatatacctcctagtaactcccttggaatgtatggctttgagccagtttctcttttttctgtaattttttctgcaacttatcattctttgtctaaaattataaaagcatcttgctttgaccatttatttggacttcacactcttgtgaagattcccatgtacatgtaaaatgaataaaacttatatgcttttccctcgttaatctgtcttgtaccaatttgtttcctagaccttggcaaaaaaactcacagaggatataaagtgggtgaggtagaggtgatccctcatgtttctgtagaagtaataattgtcttccttttgtaagatttacctcaaccccactactaactttttttttacttgcctttaaaatctggagaaaaaataggcaattattttacagatgaaatatcttatcaatcactgaatacttagtacttagagcattttaggagaatacaaagatgaatacgtggaccacacatgttggactgaggtcaatttgacatttgggacttaatctcagctattttgtctcactgccaccaaattcaatcatatgatccttttaattttatctgctaaatattttaaaatacatttgtcttcctcagtccctctattcactgcccttacttttgatagggttttccctctttaaggaaacttaaaatttcagaaattttgtctttaccacaagtagtgtgttatttaccttcagtatcctctatgcattctataattgtaagctgtctggtgaagctagcagtgccaattagatagttgcaaagatatttccctggtgctaaaacttaactagtgaagatagctaccagggatcagatgctaaatactgattcaatagactttattaaaagtaaatgatcacaagcatctacaatttgcaggaaaaagcattaattccaggagaagacgaagggcttaatgtcagggagcagtcattggctatgtgacactgatttaaagtgcaagaagtaattcagcagggctactaattttatcacaagttagagttaatttcctgattaaacatctcataagttttgaatggtttatccctatttgcactagaaattttaccttttcaatgtgcagttttaccagcataaagtgtattgaaaatctcagtatcatattatagcagaactgtctacttttacatattatcaactgaaacaccttttcagccccctaataaactgatttgttagaaacatagttatactgtatcttcacaggtagttttaattggcttcctctgaattgctgagtttaattgttcctagatagttgcatgttttttaaaaatccaggaaaaactcctaagtataataaaaatatttggtgtaattatttgctcatattattctttttgtagattaattttctttaatagctaaataatatgagggctggcagccaagatggccaaataggaacagctccagtctacagctcccagcgtgagcgatgcagaagacgggtgatttctgcatttccatctgaggtaccgggttcatctcactagggagtgccagacagtgggcacaggacagtgggtgcagcgcaccgtgtgcgagccgaagcagggcaaggcattgcctcactcaggaagcacaaggggtcagggagttccctttcctagtcgaagaaaggggtgacagacggcacctggaaaatcgggccactcccacccgaatactgcgcttttccgacgggcttaaaaaacggcgcgccaggaggttatatcccacacctggctcggagggtcccacgcccacagagtctcgctgattgctagcacagcagtctgagatcaaactgcaaggtggcagcgaggctgggggaggggcgcccgccattgcccaggcttgcttaggtaaacaaagcaggcgggaagctcgaactgggtggagcccaccacagctcaaggaggcctgcttgcctctgtaggctccacctctgggggcagggcacagacaaacaaaaagacagcagtaacctctgaagacttaaatgtccctgtctgacagctttgaagagagcagtggttctcccagcacgcagctggagatctgagaaagggcagactgcctcctcaagtgggtccctgacccctgacccctgagcagcctaactgggaggcaccccccagtaggggcagactgacacctcacacggccgggtactcctctgagacaaaatttccagaggaatgatcagacagcagtattcgcggttcatgaaaatccgctgttctgcagccactgctgctggtacccaggcaaacagggtctggagtggacctctagcaaactgcaacagacctgcagctgagggtcctgtctgttagaaggaaaactaacaaacagaaaggacatccacatcaaaaacccatctgtacatcaccatcatcaaagacaaagatggggaaaaaacagagcagaaaaactggaaactctaaaaagcagagcacctctcctcctccaaaggaacacagttcctcaccagcaacggaacaaagctggacggagactgactttgacgagagaagaagccttcagacgatcaaactactccgagctacaggaggaaattcaaaccaagggcaaagaagttaaaaactttgaaaaaaatgtagatgaaagtataactagaataaccaatacagagtagtccttaaaggagctgatggagctgaaagccaaggctcgagaactacatgaagaatgcagaagcctcaggagccgatgcaatcaactggaagaaagggtatcagtgatggaagatgaaatgaatgaaatgaagtgagaagggaagtttagagaaaaaagaataaaaagaaatgaacaaagcctccaagaaatatgggactatgtgaaaagaccaaatctacatctgattggtgtacctgaaagtgacggggagaatggaaccaagttgcaaaacactcagcagtatattatccaggagaacttccccaatctagcaaggcaggccaaaattcagattcaggaaatacagagaacgccacaaagatactcctcgagaagagcaactccaagacacataattgtcagattcactaaagttgaaatgaaggaaaaaatgttaagggcagccagagagaaaagtcgggttacccacaaagggaagcccatcagcctaacagtggatctctcagcagaaactcttcaagccagaagagagtgggggccaatattcaacattcttaaagaaaagaattttccacccagaatttcatatccagccaaactaagcttcataagtgaaggagaaataaaatgctttacagacaagcaaatgctgagagattttgtcaccaccaggcctgacctaaaagagctcctgaaggtagcactaaacatggaaaggaacaaccggtactagccactgcaaaatcatgccaaattgtaaagaccatcgatgctaggaagaaaccgcatcaactgtcgagcaaaataaccagctaacatcataatgacaggatcagattcacacataacaatattaactttaaatgtaaatggactaaatgctctaattaaaagacacagactggcaaattggataaagagtcaagacccatcagtgtgctgtattcaggaaacctatctcatgtgcagagacacacataggctcaaaataaaagggcggaggaagatctaccagggaaatggaaaacaaaaaaaggcaggggttgcaatcctagtctctgataaaacagactttaaaccaacaaagatcaaaagagacaaagaaggccatcacataatggtaaagggatcaattcaactagaagagctaactatcctaaatatatatgcacccaatacaggagcacccagattcataaagcaagtcctgagtgacctacaaagagacttagactcccacacaataataatgggagactttaacaccccactgtcaacattagacagatcaatgagacagaaagttaacaaggatacccaggaatcgaactcagctctggaccaagcagacctaatagacatctacagaactctccaccccaaatcaacagaatatacatttttttcagcaccacaacacgcctattccaaaattgaccacatagttggaagtaaagcactcctcagcaaatgtaaaagaacagaaattataacaaactgtctctcagaccacagtgcaatcaaactagaactcaggattaagaaactcactcaaaaccactcaactacatggaaactgaacaacctgctcctgaatgactactgggtacataacgaaatgaaggcagaaataaagatgttctttgaaaacaacaagaacaaagacacaacataccagaatctctgggacacattcaaagcagtatgtagagggaaattaatagcactaaatgcccacaagagaaagcaggaaagacctaaaattgacaccctaacatcacaattaaaaaaactagagaagcaagagcaaacagattcaaacgctagcagaaggcaagaaataactaaaatcagagcagaactgaaggaaatagagacacaaaaaacccttcaaaaaattaatgaatccaggagctggttttttgaaaggatcaacaaaattgatagaccactagcaagactaataaagaagaaaagagagaagaatcaaatagacgcaataaaaaatgataaagtggatatcaccactgatcccacagaaatacaaactatcatcagagaatactgcaaacacctccacgcaaatagactagaaaatctagaagaaatggataaattcctcgacacatacaccctcccaagactaaaccagggagaagttgaatctctgaatagactgataacaggctctgaaattgtggcaataatcaatagcttaccaaccaaaaagagtccaggaccagatggattcacagccgaattctaccagaggtacaaggaggaactggtaccattccttctgaaactattccaatcaatagaaaaagagggaatcctccctaactcattttatgaggccaacatcatcctgataccaaagccaggcagagacacaaccgaaaaagagaattttagaccaatatccctgatgaacattgatgcaaaaatcctcaataaaatactggcaaaccgaatccagcagcacatcaaaaagcttatccaccatgatcaagtgggcttcatccctgggatgcaaggctgcttcaatatatgcaaatcaataaatgtaatccagcatataaacagaaccaaagacaaaaaccacatgattatctcaatagatgcagaaaaggcctttgacaaaattcaacaactcttcatgctaaaaactctcaataaattaggtattgatgggacatatctcaaaataataagagctgtctatgacaaacccacagccaatatcatactgaatgggcaaaaactggaagcattccctttgaaaactggcacaagacagggattccctctctcaccactcctattcaacatagtgttggaagttctggccagggcaattaggcaggacaaggaaataaagggtattcaattaggaaaagaggaagtcaaattgtccctgtttgcagacgagatgattgtatatctagaaaaccccattgtctcagcccaaaatctccttaagctgataagcaacttcagcaaagtctcaggatacaaaatcaatgtacaaaaatcacaagcattcttatacaccaataacagacaaacagagagccaaatcatgagtgaactcccattcacaattgcttcaaagagaataaaatacctaggaatccagcttacaagggatgtgaaggacctcttcaaggagaactacaaaccactgctcaatgaaataaaagaggatacaaagaaatggaagaacattccatgctcatgggtaggaagaatcaatatcgtgaaaatggccatactgcccaaggtaatttacagattcaatgccatccccatcaagctaccaatgactttcttcacagaattggaaaaaactactttaaagttcatatggaaccagaaaagagcccacattgccaactcaatcctaagccaaaagaacaaagctagaggcatcacgctacctgacttcaaactatactacaaggctacagtaaccaaaacagcatggtactggtaccaaaacagaaatatagatcaatggaacagaacagagtcctcagaaataacgctgcatatctatggctatctgatctttgacaaacctgagaaaaacaagcaatggggaaaggattccctatttaataaatggtgctgggaaaacccatagccatatgtagaaagctgaaactggatcccttccttacaccttatacaaaaattaattcaagatggattaaagacttaaacgttagacctaaaaccataaaaaccctagaagaaaacctaggcattaccattcaggacataggcatgggcaaggacttcatgtctaaaacaccaaaagcaatggcagcaaaagccaaaattgacaaatgggatctaattaaactaaagagcttctgcacagcaaaagaaactaccatcagagtgaacaggcaacctacaaaatgggataaaatttttgcaacctacacatctgacaaagggctaatatccagaacctacaagacctcaaacaaatttacaagaaaaaaaaaacaaccccatcaaaaagtgggcaaagcacatgaacagacatttctcaaaagaagacgtttatgcagctaaaaaacacatgaaaaaatgctcaccatcactggccatcagggaaatgcaaatcaaaaccacaatgagatagcatctcacaccagttagaatggcaatcattaaaaagtcaggaaacgacaggtgctggagaggatgtggagaaataggaacacttttacactgttggtgggactgtaaactagttcaaccattgtggaagtcagtgtggcgattcctcagggatccagaactagaaataccatttgacccagcaatcccattactgggtatatacccaaaggactataaatcatgctgctataaagacacatgcacacgtatgtttattgtgtcactattcacaatagcaaagacttgcaaccaacccaaatgtccaacaatgatagactggattaagaaaatgtggcacatatacaccatggaatactatgcagccataaaaaatgatgagtttatgccctttgtagggacatggatgaaattggaaatcatctttctcagtaagctatcgcaaggacaaaaaaccaaataccacatgttctcactcaaaggtgggaattgaacattaagaatacatggacataggaaggggaacatcacactctgaggactgttgtggggtggggggagcggggagggatagcattaggagatatacctaatgctaaattatgagttaatgggtgcagcacaccagcatggcacatttatacatatgtaactaacctgcacattgtgcacacataccctaaaacttaaagtgtaataataataaaataaaaaagaattaaaaaaataaaaaataaaaataaaaaaaagaagcatggatgttagcttgctagtgggtacaaatcaggtagatgatctttcattaatgaaagagtgcatggttaaaaaaataaatattatagaaaagttaatatgtagataaataacatgttttgactaaaacattatacacttaaaaaccacaaatctctctccattgacacatggactaatataaatattaactctataaagctctaaaaaagtaagatggcatcttttaacttttgaagtatataatttttttgtagatacaactcataagaaaagcccactaattgtataaaacggaattatatatcggacttaaaaaaattaaatctctgttctgtgaaatataccattaaaataataatcaggctagccaaaaagcaagaaaaatatttacagtacacatgtttgacaaaatacttttctccagaataaataaaaaatttaaaactgaataaaataaattaaaaacattttggccacagatataaagatacttttcttaaaataacatatatcaatgaccagtaagcatcttagaaggtgctgaacttgattattctctaggtaatggcatattttaaaatgacgtgaagataccaccactagaagggttaaaattaaaaatattgaaatgccaaatgctagtgatgatggagagtaatacgagctctcaaacattgctggtggagaggtaaaatgtgttaaaaaaaaaaaaagtcaaattatctttcttcattgacgatatgattctatacctagaaaaccccaaagacacagccaaaaggcttctagaactgataaacaacttcagcaaagtttcagaatacaaaataaacatacaaaaatcaatagcatttctatacaccaacaacgttcaagctgagagcaggaacagaacactaaatagtgaatgtctcacttaaaagtgcaagcatggacacatgcttggtacagaaggacacatgcatggtaacaaaagacactgaagactactaaagaggttaaggagagggagatgtggggagaaaaattacctattgggtggtatgctcactacctggatgacagaatttgtaccccaaagctcagcattatgcaatataccatttaacaaaactgcacacgtaccccttgaatctaaaatacaagttgaagttaaaaataaaaatcttagaagacatagacgaaaatcttctttttttatggttacactttaagtttagggtatatgtgcacaatgtgcaggtttgatacataggtatacatgtgccatgttggtttgctgcacccatcaactcatcatttacattaggtatttctcctaatgctgtccctcccccagacccccagcccctgagattccccagtgtgtgatgttccccaccctgtgtccaagtgatctcatcgttcaattcccacctatgagtgagaacatgcagtatttggttttctgtccttgtgatagtttgctgagaatgatggtttccagcttcatccatgtccctgcaaaggacatgaactcattcttttttatggctgcatagtattccatggtgtatatgtgccacattttcttaatgcagtctatcactgatggacattttggttgtgaatagtgccacaataaacatatgtgtgcatgtgtctttatagtagcatgatttataatcctttgggtatatacccagtaatgggattgctgggtcaaatggttattctagttctaggtccttgaggaatcaccacactgtcttccacaatggttgaactaatttacactcccaccaacaatgtaaaagcgttcctatttctccacatcctctccagcatctgttgtttcctgactttttaatgattgccattctaactggcgtgagatggtatctcattgtggttttgatttgcatttctctgatgaccagtgatgatgagcattttttcatttgtcttttggctgcatagatgtcttcttttgagaagtgtctgttcatatcctttgcccaatttttgatgaggttgtttgtttttctcttgtaaatttgtttgagttctttgtatattctggatattagccctttgtcagatgggtagattgcaaaaattttctcccattctgtaggttacctgttcactttgatggtggtttattttgccatgcagaatctctttaattagatcccatttgtcaattttggcttttgttgccattgcttttggtgttttagtcatgacgcccttgcccttgcctatgtcctgaatggtattgcctaggttttcttctagggtttttatggttttaggtctaacatttaagtctttaatccatcttgaattaatttttatataagatctaagggagggatccagtttcagctttctacagatggctagccagtttcccagcaccatttttaaatagggaatcctttccccatttcttgtttttctcagatttgtcaaagatcagatggttgtagatgtatggcattatttctgagacctctattctgttccattggtctataattctgttttggtaccagtaccgtgctgctttggttactgtagctttgtagtataatttgaagtcaggtagcgtgatgcctccagctttgttctttttgcttaggattgtcttggcaatgtgggctctttttggttccatatgaactttaaagtagttttttacagttctgtgaaggaagtcattggtagcttgatggggatggcattgaatgtataaattacattgggcagtatggccattttcatggtattgattcttcctatccatgagcatggaatattcttccactcgtttttgtcctcttttatttcattgagcagtggtttgtagttctccttgaaaaggtccttcatatcccttgtaagttggattcctagatattttattctctttgtagcagttgtgaatgggagttcactcatgatttggctctctgtctgttaatgatgtataggaatccttgtgatttttgcacattgattttgtatcctgagactttgctgaagttgcttatcagcttaaggagtttttgggctgagatgatggggtttactaaatatacattcatgttatctgcaaacagggacaatttgacatcctcatttcctaattgcataccctttatttctttctcttgcctaattgccctggccagaatttccaacactatgttgaataggagtggtgagagagggcatccttgtcttgtgccagttttcaaagggaatgctttcaattttgcccattcaatatgatattggctgtgggtttgtcataaattgctctgattattttgagatacgtcccatcaatacctagtttattgagagtgtttagcatgaagcactgttgaattttgtcaaaggccttttctgcatctattgagataatcatgtggtttttgtcattgattctgttcatgtgataaattacatttattgatttgtgtatattgaaccagccttgcatcccagggatgaagcccacttgatcatggtggataagctttttgatgtgctgctggattcggtttgccagtattttactgaggattttcgtattgatgttcatcagggatattggtctaaaattctctttttttgttgtgtctctgccaggctttggtatcaggatgatgttggcctcataaaatgagttagggaggattccctctttttctattgattggaacagtttcagaaggaatggtaccagctcctctttgtacctctggtagaattcggctgtgaatctgtctggtcctggactttttttggtgtaggctattaattattgcctcaatttcagagcctgttatttgtctattcagaaattcaccttcttttctggtttagtcttggtagagtctatgtgtccaggaatttatccatttgacatagaagaaaatctttatgacttggggttagggaaataattcttgggcatgacagcaaagacatgacccatgaagaaaaactgtgtaagtacgacttcatgaaaattaaaaacttctgttaaagggagattagaagaaaatatttgccaatcacagctctgtcaaaggacttgtgtagagaatatgcaggtaactatatatttattagtacataaaaactaaatccaatcagactatgagcaaaagagttaaacagacaactcacaaatgaaatatatgtcaatatatgaaaatcacaaatgtgacaaaggcctattctctagaatgtataaaaaaacacaaaaagtcaacagtgaaaataaatgataaaagacattaagaggcatcttatcaaataggataaacacctaaataagcaaaacaaacaaaaatactaaaatgatttccaatatatttttataattaaaattaaatctgtgataaaataaactacatacgtatcagaataaaattattggtagtgccaagtgctaaataagatgcaatgcaattgggtatttcaaaaattgctagtaggaataaaaaatggtacagctggctgggcgcggtgcctcacacctgtaatcccagcattttgggaggctgaggcgggtggatcacgaggtcaggagatcgaaatcatcctcggcaatatgatgaaaccccgtgtctaccaaaaatacaaaaattagctgggcgtggtgacgtagtcccagctactcgggaggctgaggcaggagaatcacttgaaaccaggaggcggaagttgcagtgaactgagatcgcgccattgtattccagcctggcaacagagcgagactccatcacacacacacacacatacacacacacacacaaactaagtacagctgttttggaaaaaaaaggggcagtattttatgcagttaaatatatatttattataccacaccaggatggcagtgattcgttttacaaccgaatgttcctggatcgttatcctagagaaataaaaacttacagtcattcaaaaacctgtacatgaaggtccatagctatggaccttcacttgtaatagcaaaatctgtaaacaacacaaatgttcttcaatacaaatgcataaacaaactttggtacaattagacactagaatgctattcagaaaataaaaagaacaaattattgacacatatgataacttggatagggctcaagggcattgtactttgtaaaaaaaagaaaagttaatctctgaagtttacataatgtatgttttatatctatatctgtatctatgcgatgaaattatagtgatatagcacagatcattggtctccagacgttaggaggtttggggagaagatgtgactgactattgaggaataacaagaggaagtttctctgtggtaataaaacagttctgtatcctgattggggcgaaggttacataaatctacacatgtgataaaaatttcattgaattttacaaacacacacacacaatacatataacaactggtgaaatttgaatgagttaatagtattctaccaaaatgaatttcctgggtttgataatgtactatggttatataacatagtaacactgggacaagctgggtgaagggtatacagaaattttctgtactttttttaatgtcctaaaattcaacacacaaataacggcaacaaaaattcaatgcaaaaattgtaataataaagcaaaaaagttatctttaagttatgatttttccctaaattgagctaaatacttactgcaatctgaatttaaaaatttcagcattttttgtgtgtgaaattgaaagcagagtctaaaatttctacaggaatgaaaagaatcaaaaacaggaaaacttgaaaacaaaaagaaagaaaaagaacaagacaggatgattattctacctaatatcaaaacgttttataaggctacagaaattaatataatgtggtatctgttcggtaatagaaatatagacaaagggtaaaacatagccagtctattaattgccccacatagatacataattaataacaatacctaatctgtcactgaggccttttcaataaatgatgctgggtcagtttgtaatgatcctacaacatatatgcaaaaactaattggaaaagaattacaatgttagcatagtagactatctttatgacttggattaggccaagatttcttaaagaagaccaaaagaaaaaccacaaaataaaagattgatgaatttatcttcatgcaactaaaactttctgctcatgaaacagctccactatgaataaagatgcaagccacacattggaagatattgggtaaaatattgatatccaacatgcacaaggaattcttaacaaatcagcaagaagagtcagctctccctccccaccaatatgttagaataatgatttcctttgtgaaggtatcgacttggaagagacaaaaggaagacataaagggaactagatgatctttgttgtagttacagatacatatttttttttacatctgtaaaaaaaattatcaagctgtacaattaagatttgcattaactgtattaaataaatctgtattaatgtaaataaattgcactttgaagatgaatgaattctttttttcattgcattaggtatttattttaatttattagaattatactttaagttctggggtacatgagcagaacatgagcgggtttgttgcataggaatacacgtgacatggtggtttgctgcacccatcaactcatcatctacattaggtatttctcctaatgctatccctcccctaaacctccacctcaaagaggccccggtgtgtgatgttcccctccatgtgtccatgtgtcctcattcttcaacttccacttatgaatgagaacatgcagtgtttggttttctgttcctgtgttagtttcctgagaatgatggtttccagcttcatccatgtccctgcaaaggacgtaaactcatcctttctaatggctgtatagtctttgtggtgtatatggggcacattttctttagccagtctatcactgatgggcatttgtgttggattcaagtctttgctattgggaatagctgcaataaacatacgtgtgcatgtgtctttatagtagaatggtttctaatcctttgtgtatatacccaggaatgggattgctgggtcaaatagtatttctggtcctagatccttgaggaatcaccacactgtcttcacactggttgaactactttacactcccaacaacagtgtttgtttctgggtgctagaacttcgtatattcaaagtaactcctcattcgaaattttgtttctaccattcatgggcttgtataatctgtctctatcaggtactccttctttaacttagagattcatgagaaccatatcagctcatttttaaacacacaatgggaaatcactaaaagcttccagggacaatgtatcttcaatataagtgtctgaaagctaacccaccattttgaagattttgaagattttgaagattttctatgcaaacctttattaagaaattaagagtagaaacatctgcaaattgaaaatgcaataagaaatgaacatatttctaaaattatttaaaatttttattttatatttaatttcattgtggtcagataacaagtctgaaataccacttctttgaaacatatttctatttttataggtattttgtgcatttttattaatgtcttacatttgcttggagataaagttcattccgtttttgttgttgtcgtcgttgctgtagctttcgcctgtatattaggcttaattttctggttagaattttttattcttccaaaattttataggcctcatttaccattttttagctcaatatgttttaaaataatttctctgatggtgaatgaacctggtatgagtaatgaaatttccgcgacaacatgtacttgtgtaattttcattcattctaagagaagattttttagatggtataaatgacagaatttatgcagttctgttcctttctcaccctaacactgggtaaggagataattaaaaagagtagcaaacttttagtcttaaacaaatgatgctatctcctgtcatcctcaactctttcagggagacaagtgtttactgaataaccttctcttgagacatgggctcaggatttacatgcactggttaaggtactatcttaaatatattactgctttggaaactgaagctctatatgaagcaggaaactcctctcatttgttctaaaacaagccccttttgaaattcaggatggtctgaaatggcgggttaactttcagacacttatattgaagatacattgtccctggaagcttttagttatttcccattgtgtgtttaaataaatcatgctgctataaagacacatgcacacgtatgtttattgcggcattattcacaatagcaaagacttgaaaccaacccaaatgtccaacaatgatagactggattaagaaaatgtggcatatatacaccatggaatactatgcagccataaaaaatgatgagttcatgtcctttgtagggacatggatgaaattggaaatcatcattctcagtaaactattgcaagaacaaaaaaccaaacaccacatattctcactcataggtgggaattgaacaatgagatcacatggacacaggaaggggaatatcacactctggggactgtggtggggtggggggtggggggaggggggaggatagcattgggagatatacctaatgctagatgacgagttagtgggtgcagcgcaccagcatggcacatgtatacatatgtaactaacctgcacaatgtgcacatgtaccctaaaacttaaagtataataaaaaaaaagaaaaaaacatattatttcttaagtgtgttttacgtacaggaaatatagcctttatcataaaactctctaagacaatgtgatagcctgtctctgattgcaatttggctttgataaccacagctttctgccatcattatctagcttgtgtctttataaataaaatagtcttcttttttttgttttgcaaaccccaaacctttagaaggtgtcccaaacttttcattagaaatatctctactcacctatgccttggcagaagtaaggtgactcaattatgtataaggttgttgagtgttactcagctttgataactcattgttagtaactgttaacattcagcatgattatgcaattcagagttcatatccatggatctatgtccataagtcaaggtaaccttaaaacatgtgtagaaaagagaacttagttgtagtttaaagcaattttccaatgtgattacagtgagactctgggaaaagataaatattgcttaaatgaaaaattacataaatttaaaaaggtttgcctttaaacaccaaataaaaacagactgtggaataaatacaaaagaaatgtgacaatatagcagttacatttgagttgtgtacctcccctttttcatgcaactatattttaaaatataattttaaaataatgtgatttgtctttggtggagtcctcatatttagtttttaatcatagagcatacacataggaaataacactcaaaatacgttattgaacagaaataaacttttccaggttatggtacaagctctggagtcactttttaatatttccacgctatgtgaaattggaaacaatatttaactttccattgttaatttctttttttagaaagtaggatatattgtcaacagtacttatatcatggggttgttttaggatacaaagtaatatatagattttacttcacttgaagaaaagcacataaatgctcaaaaatggtatctctcaatacaattagctcacttcattcttaaaaatatcttattatatcaatgcacaaacttaattttctgttcatgaactactaaagggagagaattacaatgtgttaaaatgttgataaattcaggaacttagagtcatttgacactagatcatcttgacctgtgggcctcattttgctggtgtttcaggtttacacatgtccccagccaccgtttcagggcttccttgacctcactgttcctcacactgtagatgagggggtttagtaaaggggtgaacatactatagaaggctgacacaaccttgtcgtggttagtggacctgtgggatttgggtctcatataggtaaaaatggcagctccataaaagagtcccaccacagccacatgtgaagagcaggtggcgaaggccttcttgcgggcttctgtagagcgcatgtgcagaacagcagcgaggatgagaccataggaggacaggatgagggaaaaggggaccaggagcattaacacacagcagatgtacatggcgttttcgaagactgaagtgtcagcacaagccaaacgcaccagcacgggggcctcgcagaagaagtgatcgatctcgtgtgcaccgcaatatgggaagctcagggtagcaacagcctgcaggagcccgtcagctgcacccaggagccaggacgacatggtcatcctcaggcacagctgccagctcatgagagtgggatatcggagtgggtggcagacagccgcatagcggtcataggccatggctgctaagaggaagcactctccaccacccagtgtggggaggaagaagatctgcacaccacagccagcgcgggagatggccttatttccggtcaagtagtcagccgccattttgggcacagtggtggaaaccagcatcacgtccatgagggagagttggctcaggaggaagtacatgggcgtgtggagccggccggtcccggtgaatcaggagaatcatgagggaattgccaaacagggaggtcaaaacgatactcagaaccatcatgaagaggacttggtgggctctggtgtggttaaagagtcccaggagaataaagtctggggtagtatttctcatctccataatttcccctggtgtgatggtgcaaatggaaaaatagagaaggaagaggcttttatcatctgaataacgagctaacttccctcttttttttcatagaaaattcacaaatgtcatggtttgaatattttagacttcatctcagacacagatggtctcattcagggacctccagaaaggcagtgccaaggactcattaaattactacatccagcatgtgagcattcagatgtgagcagccacaaacacacagtaacactagcatctttgagatgataccttgtctgtgactaataacacttcatttttaagttgtttcctgtcctatacttactccaagtactacttactcattatagttactgctattctcttccagcatttaccaacatcaaagattctgtcatgccatcagggaaataaacagagattataggacaataaaacaggcaaaataggcaaagattctacctaatcaagcctgtgccaagccttgtcggttgcattactgtcttcccatatagtgtatgcactccccttattttacatactgtttaaagtatctttctcatgtgattgccacagcccactgactccttgactgcagacctccactgcctccattataactttaaaccaccctcagactcattttattaatgcagaactcatggataaaaaagcactcgacatggcattaaaaagtccatctcaaaaaatcactactgtccaaaccaccatcgccctggtatacttatgtaacaaacctgcacgtttggcacatgtatcccaggactcaaataaaataataaaataaaataaaataataaaataaaataaaataataaaataaaaaaatgtgtgcagagaagcaccaaaaaaaaaaaaaaaatcactactgtctagttatctttttccagattatagtaggtgtaccactgctagtatgtgtcatgattttaggaagtatgtgaaataacatattctacctgcaaagttacataacttgtatttgtgctaagaaaaaaagtaaacatgaaagcatgggaaaaaaagaatcatttctgtcattttacattataaggagaaagttatataacatttctgttttgttttgtttacttaaatgttttaaaccagtggtccccaaacttttctaccaatgggggttgtgggagaggggatgcttttgggatgatactgtttcaccttggatcatcaggcattagattctcataaggagcatgcgatctagatccctcacacgtgcagttcacaatagggctcacactcctatgagaacctaatgctgctgctgatctgacggaggcagaactcaatgggtaatgcttgttcacctgctgcttacctcctgtgcaggccaggtcctaacaggccacagtctagcattgaactttctaaaaagattactaaaaaaaaattacatgagttttgcatatcagagtttgaaaatagttttttaagccatagtgcatattgacacaaaatttttatttttaatttaattttttagtttagatcattttatgttgccattttttcatatattcagaagcttaaaaatcacagcataaaatattaattagattagtgagctgaatactatgttgacatgatggtgaaagtctaagatttgaaaattcttagactttctaaatggttatactttttcattctgagtggttatactttttcagaattgaattctcttctctacaggtggaggcaaagagtaaatatcgctttaatttggaaccattgctcttttctttaacattcaaatgtaacaaaaataaataaacctgtattatgctaagctgtgaaaaattatgatgtataatatggttatagatgagacttttcagcacattgtatcggtcagataatttaatagaaaagttagtttaactgtattaattcttctttcaggtatacggaggtattgcagcttgattgtttttactaattatcatttttgaataaaggattttttggtgttttaaatatacagctatatttatttgttaagtggaatatttatctctcatttaaaggctatattaactcagcaaattataagaatgtgaacaaatgctgataaatatttcttctttaaggcaatttgtgggctgatattaattctaagctattaaataggatacctggatttaaataaaacattttaatacttttgtatttttatgtataaaatatatatctttttatttatttttccacatacacttatatatacatttctattatatatatttatatttatttctatttgtctttcttagctcttctaggcactttatttagaaatagctgaggaatgttgtgtctattagtgtcaaagccatgccctttctgaagctggtaggtaaactgattatcgtccccttccccaccttcatgcttacttgaaaacacacacagatcactgttctggaacattagagttccactcaacaatctccttctctcttctttctggcatcctaccctccacaaaggcagtgtctctatgtccacaagctattgatataacatggagaaattattgaaacagccatactcttcagtaaaaaaaaaaatcttctaatacaaattcaatcatttgacctaattaactgctttattcaagaatttttgaattggtgtttctgggtagacacagactgcatcttacattttcaaaacaccctgtggatgacaggacaacatttaatttgtgtgatttgtgcctgcaactttacaaaggttactttgcaattcaaaattcatatataaaatgctgaatacataataaatacgagtaatttgaaattactacctaaaattaaagaaaaataattatcaaacaaattgactcacctttgcagtagagaatcacagccagtgtgacatatatatgggactgaatctttctgatgggttgagtacaaatgtttgcttaacctcagtattgtggctactgctttgtgctttttgctctatttagttaaaaatcctctgtggtcactgaaagtttctaacaaccaaatatcttccctggagctatgccacttggaaaggtatatcatctttggcaagggaatacagattaaagtatttcctaagggtaaatgaatgtaatgaacaaatttagcacccaagttttgctaaaagcaaaaacactctgaatgggaatgtgaacagatatgtcccttgtaaggatagcaagcacaatgaattagtgaagtgaaagtctagaattctgatcattgataatccttgaatatatgtgacttaattacctgaaataaatttttaaattttctgaaattgtatcatgaaaataataatagattttatttattcaacatttctacatgctagtgaatatgctcagcattttacatacatttacacgcgtgctatttaatcttttagttagctgtttgttctatgaacttttacattaatatagcaatgtaaacaatgttaatggttttaaataccatacctatatttaactatcacgaggtagcagagcggaagaactttaatgttcaaatcatagacttgtggttcttaaaggttgaggaacatctgaatcactcagaatacttaggaattacactttgagaaatactgccttttataaaaaaaaaaatctgaaggtgaatttcgactattttgaactgggccccaatgcttggatagcctataaactaatcaattcccaactttacatgtttaaatgtttttgtgttttgtttttaatctcacttctatttcttacgcatttcatgattttggataaaatgatcttcatgttcctttcctataaaagatgcataataaaattgcttactttgtagcattataggaaggaataaataaaatattggtaaacgttctgggagagtgtctggcccatagtatattctccatccatgttcattgatgtcattattgtaattgttctgaaataaaaaacaatccctgcaaggcagagtaaagttgattctggcctacatattgtaaaaagttatctaaaacaagataagggcagggtagcctgttctttcggtgtttaatagtcctgctcaaagactatttagtgctctgggtgaatgcttctgtgtttgatttgccatttaccataaattacagcccagaatctgtgaagttgttttgtcaagtagacatgtaaagaacttctgtccatgccatattagatatcaaccagttttatactaatggaaaacaaaacaaaaataatgaattttttttttgaaatcaaattcacagtgtcttttccaataccgcttctccaactctcacaccaactaggtgtcttactattcaatttaatcctgacactgaccggagtctggagcatcagactccagatgctgatggagtcaatcccacaagactgccttctcttcagatgccagtctcaagtaggggatatccaggttacctctacctgatttggatacaaacttggaggatctcacaactactctgcttcaggttatataactggctggaacgaagcatggaaatgaggaaaatgctacccttgctattatagtttattataaaggacgcaaatgaagaatcaaatgaagaggtacatctgggaagctccggaagggtcccaagcacaggagctcctgtgccaccctctgggcaaggaaatgtgtttgccaactcagaagctccctgaaccctgtcattatgggttttatggtggcttcattatataggcattaatgtggctgttggtaattaactcaatctccagcccccacctccccagaagttgagtcatggggcttgagatggagcagggagccctcttagtgacctgtaagttcctccaagtgcagagataaaggaaaagcttaagttccttcggggaaattccaggcacctagctagtcctgagaaataaatgagcaacttcataagcaagaagataattatagcctaatgcaatagccaaggaagttaaaatcacagggtacttagttcctttataaaaactagagataacagcttaacatttgtccctgagttgtttttcagaaacttggaatcccactaaatagctctactggcacatagacctcagataaggaggaactgaggacagagctcggacaaccatgttttcttctgaatttcttcctgaaggtcctggaggaagtcacacccatggatgagagttaacattgttttctgctgactctaattttttagacaaagctttacttccttaaccaatcacaaatcagaaaatttttgaatctccctatgatgtgtgggccccccactttgagatgtcccattttttcaggttaaacccatgtataacctccatatattgatttatgacttttcctgtaacctcttcctccctccctttaaaaacttacctgtagccatccatcagagagttcaggtcttaagcattagctgctcacttctccttgcttgcccccctgtaataaattcctccctttctcttgctgcaatccccatgtcagcatttgactttgctgtatcaggcaggctgacttgagtttcgtttggtaacatctctgtggacttggggtgtgccactctcagggtatgtaaatgtgtttgctaacacagaagctccctgaaccctttcgtttagtatgttttttaatttctagtttttggggtatatgtgcaaatttgtcatacaggtaaattgtaggtcacagaggtttcatgtacagattattttgtcatgcaggtaataagcatagtacccagtaggtggtttctcattgtctctcaccttccaccctcaagtaggccccggtgtctgttgttcctgtctgtgtgtccatgtgtacttaatgtttagctcccacttataatgaaaacatgcagtttttggcttgtagttccttggttggtttgcttaggctaatggcctccacttcatccatgttgctgcaaaggacattatctcagtctttttgtggctgcatagtatttcgtggtgtatatgtactacgttttctttatccaatctactattgatgggcatgtaggttgattccatgtcttcgctattgtgaatagtgctgtgatgaacatacatgtgcaggttactttattgtagaacaatgtatactcctttgggtatgcaagtaatattgagatgggtggcttgaatggtagttcagttttaagttctttgagaaatcacaaagctgctttccacaatagttgaactaatttacatttgcaccagtagtgtataagcgttcccttttctctgcatcctcaccttttgttatttttagatttttttagtaatacccattctgactggttatgagatggtatctcattgtggttttgatatgcatttctctaatgattagtaatgttgagtactttttcatatgcttattggcaacatggatgtcatcttttgaaaagagtctactaatattctttgcccactttttaatggagctgtttgttttctgcttgatttgtttaaatttctttatagattttggatagtaaacttttgttgcatgtatatttgcaaatattttatcccattctgtagtttgtctgtttattcttttgatagtttattttgctatgcaagagctctttaatttaattaggttccacttgttaatttatgtttttgttaaaatcaattttagtatcttcattgtaaaatctttgccaggtcctatgtccagaatgacatttcctaagttatttttcagagtacttagagtttaggttttatgttgaagtctttaatccatctgaagttgatttgtgtatgtgatgtaaaaagggttccagttacaatcttctgcatttgactagctagttatcccagcaccatttattgaacaggaagtcatttccccattgattatttttgttggcttcgttgaaaatcagatggctctcggtgtacggcattatttctgggctctccattctgttccgttggtctatgcatctgtcattgtaccattaacatgctgttttgattattgtagccttgtagtatagtttgaagtcaagtaatgcgatgtctccagctttgttcttttggcttaggattgtcttggctatttgggttttatttatttatttttattccatatgaattttaaaattgttttctctaatcctgtgaggaatgtcattgatagtttgacctaggaatagcattgaatctgtaaattgctttgggcagtatggccattttaagaatattgattcttcctatccatgaacatggaaagtttttctatttgttggtgtctctccaattcctttgatcagcattttatatttctcattgtagagatctttcaccaccgtcattagctgtattcttttcatggccatagtgaataggattgagctcctgatttggctcttaccttggctgctattggtgtatagaaatgacactgacttttgtacattgattttgtatgctgaaactttgctgaagttatttatcaaatcagggagcttttggacagagactatggggttttccagatatagaatggtatcatctataaagagagatatgttgacttccttccttcctgtttaaatgcttttcatttttcactcttgcctaattgctctggctaagacttcctacataatacatattaatacttaatgtgtatgtacctaacaacataatgtcaaaatagatgaggcaaaaacatataggacaacaaaagagaaatacataaatctgcaattaaagttggatattcagcacccctctgttagtaactgatacatccagaggcaggaaaacagtaagaatataactgaacagcaccatcaaccaactggatctatttcacatctgtggactactccattcaacaacattagaatacacactcatcaaagtacaccacattctggtctataaaacagactttcacaaattatacctgcctcacagtcttcttagaagggttacactggttaaaccaaaactttattgtcactaagaaattgtaaagaatctctaaactcattataagctcccaggcttcatggagacaccatcacagagtaattcattacatcctggattttttttaattgatcgcacctactgaaaccccttgtctataatatccatcaccgctccaacttgttaatgagtaacttccatctctgcagaaagaaaaagatgctcaatctttggtcagagcctccaaggagtatgattgaatctttgacagccatattttcctctaaagaatttatgtttctgtgcagatgaagatggaaatggaaatgtaaaaaggagatgctgagaggggctgagccttgtgcaaaagtagagagtgggtttaggcaggagcacggtcatttcatacgctgtcacaggaaacaaggctgagtatatggtacagaatgagggaggctgatacagttcatggaagaaaagtttgaaatctgattgttttattaacaggtttgtttatttttcccagaggagtctaagagatgtggaagtggggtaaggtttggggaaagcaggaggaggcatggatcactacttttcagagaaagtctgcagagaacaagaacatactgtgacgtggcaaaagggccatgagatttgtattcataaatctgagatgtattgtcataaatttgaggtgagatgcatcatcatatattggactttcctcaagtcacgtttcattgctgtgtatggatcttacagggacggtaacaggctgagaatgagttttacctgggtttgagttttgcactgagttaaatgcaagcagcaccacattgcagcagggaaaaacatagaagttaccaaagactaacaagagcaataaaaaatctgtatgtgatcataactggtccactcttcttatttaaagcactagaatggctttgtccagtttcgtacttcatcgtatttgcatccagtatttattgagtctcatctcatcatctcctaggacaaagggtgccaagataattcaagaatccagcattactttagttccggttccatccatgttgttgcaaatgaaaggaattcactcttatttttttttatggttgaatagtgttctatgtatctagtaaattttcattatccattatattacatgaaataagccaggcacagaaagacaaactttgagcattcttgctcatatgtgggagctaaaattaaaaaataataaatatagtagaatgactgttaccagaggctcggcagagtagagtagagtggggaataaactggagatgattaatgggctcaaaaatacagttaggatgaataagacttagaatgtagtagcacaacaggatgactatagttaacaataatttattgtatatttcaaaataactaaaagtggaattggaacatttctaacagaaaaaattaataaatgcttgaggtaataggtaccccaaatacccttatttgctcattacacattgaatgcctgtattgaaacatcacatgtacctcatgaatatatgcaaccattagataatcataataattctaaaaaattaaaggaaaaaaacaaagaacatggatattaattttatagcattatttctaatttctgacataaaatatagcagttagtgccttcaaagataaaaaaagaacaatataaccccaaataaagtgttcttttctagttaaccaatgtatggattaaagaggttaagagatgctacagttgattgagcccttcctctgcaacagacactatgtaaacatttggcatacatcattctatttaattattagaatgtccctcaaattagtccagttgtaaagattagtaacaggctgaaatcttaagtaattttcccaactcagcttcctaattagtggcatagctgtcagactagagtattctctctgactctaaatgctcattttatcacattgtctctaagagtcagctttcactttagtagaatagctaaatggatatatattgtcatgtatcaattatctacccccacctaacaagtagaaggaagtgttttatcctagtataatttaatttagtcacaatcatcaatcattccccctggaaactcactaaagagtggacaggaaactatccttgggactagttctgctattactgagtcgagtacttgtaagtggttcctgcacttttttaatccggaattctctaacttacatgatgacagaatttccataaacataatttaacatcttctatagctctgaaatcatgtactggaatattaaatacacccctctttagtctgattctgggtagcagctgaatgcagcaaagttgattgggttggttgatttgctttaagttcagaatttgagttcatccccaaatcagcaaagtcaagtgaagtgaccaaggttttggcccccgtggacttggacactggagatcaattagaggagaaagaggaatatctaagggttggtgacttaaggttctgtgtgtaaaatatagccattcatccttctgtcttccaatggtggaacctgagagacttcagtgtaaaatgccttattctgttctcactgaaacaaggtaagaggaaaggaagagactttatctaaacactgcatatgcaaacaggataatatttcacaagagctggtgaagttgttttctgatttcaccataaagacaatgactagctgtgggagctgtaaggaatgaatattataaagtgttacctggtgtttcttcctcatgaattttggcagataaagaagagattctcacttcagaaagagttttggtttaatgcagagcctattgatcagtgatataatgttattgatagcctgatatactatcagaacatagtttgatgcttacatgttttaaataattatatggaatgtttgcagattatgatgtcactgtaaagctgctgctttttttttttttttttgagatggagtctcactatgtcacccaggctggagtgcagggtcacgatctcagctcactgcaacttctgcctcccaggttcaagtgattcttctgcctcagcctcccgagtggatgggatcacaggcgcatgccaccacgcctggctaatttttgtgtttttagtagagatggggtgtcaccatattggtcaggctggtcccgaactcctgacctcgtgatccgcccgccttggcctcccaaagtgctgggcttacagacctgagccactgcgcctggccataaaactgctttttataccactatataaactgaagaacttcgggcaaagtgagtcatagtaatataactgaattgagttgatttgggtcggctttatcctagaaagcttttttggaaatgttttcctatcatcaggaaactctctgctgcacagggaatagacagttccataacaaattgaaaaagaaggctgggcacccaggtggctcatgcctgtaatcccagcactttgggaggccgaggtgggcagatcacgaggtcaggagatcgagaccatcctggctaacacagtgaaacccggtctctactgaaaatacaaaaataaaaattagccgggcgtggtggtgggcgcctgtagtcccagctactggggaggctgaggcaggagaagggcgtgaacccgggaggcggagcttgcagtgagccaagatcaggccactgcactccagcctgggcgacacagtgagactctgtctcaaaaaaaaaaaaaatgaaaaccaagagtgaactaaaaatgtaaaaaaaggtaacatgaacttgttagagttgcactatgtgcagctctcaaacaatgtgacattaataaaaacattttctcagggcgtgagggctctccatggttaacacagggaatgggcaaaggacagtgacaattactaaggacctactatgtgctgaacacacagaactgtgaattctctttatagttgtcctatacgttgttgagattgagggagctgagtctatgactatttgctattggtctcctgctgattgtttaaaagagttttaagaagcattcactaattgtaattttgcaaaataaattcaggaccctacacttgctacacttacattgttagtttctgtgaaatgaggtgttttttaactctataaatttcagcaacgtatcttttagaatgagaaagaaaataaactttttatctgaggaataagtagccccctttaaattatcaggcccagcaagattgaaatgtggccgcagtcacatctcactctttcttgagctaggtaatcatctcttgaatctacgtgctatgggggctctggactgacttgtggcaactaaccatgaattaacctatcaatcccctaaaccacatatcctatagttaaataatgcataaccaatcactgatcaatgttgtttctgaaaccagtgagacttgctgataaataactttagaatttgtctccactcctgattcctccctttctttaccttaaaaacttgggtctcttcttgttctccaggttacttgccacagaagtgtttctgggctgcagccctcaaccttggcccaaataaactttctgtattaattttgccttagtgtcgttctttaagtcaacaaggatggccaaggcagtcactaatctcacactcacctgatagccacaggaacaacattttcccagctataaggtaaccgacagaatgatgcttcatgtaattctggtgcatgaaataaggtcccatgtctaacaaggaaagctgctggacatcaatggaaatagatcctaaactcaaactccaatatcccatgacctaaaatctccaagtcccagattcacaggatcctaaaagtaactattctcttccattgcctaacaacatgccacttttccatttttggaaacaaaatcattattgtagtaactgccataaaacaatctttataatactctgagctatagtctatgcaacaaagaatcaaaatgtctctcttcaaaacaactccaggatggaacacataaacctacacccaagtcagcttgttcagggctcggtattggatacacctcatgggatcatgctggcagctttcttcccctggatttaaacctggattaaacaaaggaattcagaaagcactacaaaaggcttttccaatttccaggacatgttgggcatcccctaaggcctgggcacatcaggacagttggtcgcccacttggggatgggacagcacctgatgaatcattctatccccactgcctcactcagtgactactgcatcaaaggctgtcaacatgttaatctgataaaattaatcaaatatttgcttggaactaaattactaggatagttcttactgatagaatgaagccacatgagttacaaaatcaatctttatcatacataccctggaaattagaaaagtcgtttggaatactttttgaattcctttgtttaatccaatgatctctctgcttttttatttttctatagaatcgtaatcactacataacatcactgtatgtttgagtttgttggtctattgtttgtataattatctcaattttaattacatattctaaaatcctttgtgtttcatcaccaaagcacatcagtagctagcagcactgtcataaaacataaattcagtgaacactatttgaggaaatgaatgtatcataatgatggttttcatgtttttttctgatcagtttttatttctaaagcactataagaagcagagagtgcctgtgatcccatttggcatccaagtccaatgctactgtgcacctgtcatgttcccaacttttcattgttagtgtttattccttagacagctatagaaatgaatttccattttttttcctgtggcaggctctctttcacaattgtattcatgctacccaaggttatatgaactaacagttgagtttaagttcctaaatgtgaataattgcaacaaactatgatttgcttttgaacagcaaaagttgaaaaatcagtaacccaagatgactaaccaaatcaatatgctgggcaggatgagacatcagtgtctgcctcagacagaagagcacacacaaaacatgacctctcactccaagcccaggtaaaggaagaagtcacacagatgttagaaatatagtttacgaatacctgggaaactgcatgaagaaaaaaacaaactgccagatttggggtggtgtaaagagaaaaagagagattctaaaagtcataaataaaaattcccaaggaaaagcctaggcataaaaagctagacaaactttccagggagggaaaattatttatttttgtttgcttgatttctttattctcaattattaacatttaattgtgttgttctatctaattaaattggaagacatgcttaagccataaattacaattgttctactgctcacactggcttttccagttgaatagatttgtagctgcttgactctgctgtcatctacagtaatgaaaatcaaactataagaacagaaagtgaatatcctctctaatctccatatgcttcagatatagaaattgattaaaaaaaacctgcagtgttagtggagaaacaactcattctaaacaaacattgataaagtcagttcctttttgtttttctattgtgttttatttcatgttttgtgctttgcttttgtttctatttctctttcaacagttacagcagaaagttttcatggagaaatggaatcacacttcaaatgatttcattttgttgggtctgcttcccccaaatcaaactggaatatttctcttgtgccttatcatcctcatattctttctggcctcggtgggtaactcggccatgattcacctcatccacgtggatcctcgtctccacacaccgatgtactttcttctcagccagctctcccttatggacctgatgtacatctccaccaccgtccccaagatggcgtacaacttcctgtccggccagaaaggcatctccttcctgggatgtggtgtgcaaagcttcttcttcctgaccatggcgtgttctgaaggcttactcctgacctccatggcctacgaccgttatttggccatctgccactctctctattatcctatccgcatgagtaaaatgatgtgtgtgaagatgattggaggctcttggacactggggtccatcaactccttggcacacacagtctttgcccttcatattccctactgcaggtctagggctattgaccatttcttctgcgatgtcccagccatgttgcttcttgcctgtacagatacttgggtctatgaatatatggtttttgtaagtacaagcctctttctccttttccctttcattggcatcacttcttcctgtggccgagtcctatttgctgtctatcatatgcactcaaaggaggggagaaaaaaggccttcaccaccatttcaacacatttaactgtagtgatcttttactatgcaccttttgtctacacctatcttcggcccaggaatctccgctcaccagctgaagacaagatcctggcagtcttctacaccatccttacccccatgctcaatcccattatctacagcctgaggaataaggaagtcctgggggctatgaggagagtgtttgggatattctctttcctgaaagaataatcatggccatccccactccctttgtatttcctctttccaagttgattccaacacgctagagcagggttgtccaatagaaatacaacataatttaaaattttctaataggtacatttaagcagtcaaataaatttaaataatatatttaattcaaaacaatgttataattaatattaatattaacaatattgatgttaattacatagcatactatttcaataaattatatgcaatatattatagtacatgtttgtacatatattactattaacgtgataatgtttattcttgtatattgacatagaatttcttcatgtaataacacaaatttgttaatgttgccttttactctgtttgcattctaagtcttcaaagtcttgtgtttgttttatagagtgcagcgcagcttggacaaaacacatttcaagtgcccagtagtcagtgtctatagtgttggacagcacattcttagagcatccccaatcaatagtttcagaagttatatatgcatgtgtatgtgcatgtatggtgtatacaaacatatttttgttatatacaatattgctgatgaactgaaaattaacaagtaaaatgcacatgctaaggta

SEQ ID NO: 1994 - DNA, 22939 bp, Homo sapiens
ggggagacggtgcgggcggccgggagcgcagccctccgggaggcgggtcatggcctgggcgccgcccggggagcggctgcgcgaggatgcgcggtgcccggtgtgcctggatttcctgcaggagccggtcagcgtggactgcggccacagcttctgcctcaggtgcatctccgagttctgcgagaagtcggacggcgcgcagggcggcgtctacgcctgtccgcagtgccggggccccttccggccctcgggctttcgccccaaccggcagctggcgggcctggtggagagcgtgcggcggctggggttgggcgcggggcccggggcgcggcgatgcgcgcggcacggcgaggacctgagccgcttctgcgaggaggacgaggcggcgctgtgctgggtgtgcgacgccggccccgagcacaggacgcaccgcacggcgccgctgcaggaggccgccggcagctaccaggtgaggcgccccccggcgggggctgcgggcgctgcggtgaccgggaagcgggcgacagtccggagcggagccgccgaggccacccgtctcctgagcggctcccacggccgctccccccaccgcgcgccgtcccccccgcccacgcggctcactcagtgtgggtctctttgccttggctgtggtaaccccctttgcgacacacacccattattttacaccgtccgcccctcccccaagcactctcctgtcgtcgaactcgcgctgggctggtttctcccgatgcggatagtctggtccctcagctgggctctggtcgggagggctgtgtggtccagttcattcttggtaacaattgtacgtctatatcgtaaacttgccataataattctcatttgtgcaatgctttgcttttgcacagtgtttacattaaatgagtgttgtcagcaaagcaaccctcgggtttgggcgttgttaagaagagtgtcgagctgggtacgggttccgacccctccaaagctcaggtgcacgtgcctcctgaagtaggagcgggtggctctccatcagcagggatttggggacttaggattcgaacatcctcaatgaagaggtgcttcatttggggtgtagcccgggaagcttcaaagagaaagaagaaaaacaaaatgggagtatttggtccccagagtggcatctgtgaaattgtgtgtcgatttcttcctactggtgcccttcaaaagttcttggatgttttctgaacacacttgaatcccagcatgtagaacaactgccagcacagaggaggtctaagtcgtctttactgacagatttaaccaaaggactgtcagtcgcgctgtagtgcattgcaaatactttcttaaaatttttatttatttattttgtttgttttaaattaaggtttaggatattttccccttccttctctaccaatatctctcttggtatttcttcttgattttcgttgtcatttgcgagatgtaggtactagtactaggtaatttctagctaaacttttctggaatgttcttgcctttttaaaaaaagtccagaaagaggattggtagtaacttttttttttttttttttttttttttgagacggagtctagttctgtagctcaggctggagggcagtggcgcaatctcggctcattgcaacctccgtctcccgggtcctggtgcaagcaattctcctgcctcagcctcccgggtagctgggattacaggtatgcgtcaccacacccggctaatttttgtatttttagtagagacggggtttcactgtgttggccaggctggtcttgaactcctgaccttgtgatccatccgccgtggcctcccaaagtgctggtgttacaggcagcccagcctctagtgtaatatttctaaaggtgttctccatattttcagtagttcttcggttaaataccaaataaatattatctaaactcctgagcctctcagtgaaagctttctagggccctaagttatgtttccatagctctcttgtcttaaccagccaggaaacccagcaaatttagccgaatcactgttttcctaactgtgctacatctccttgcttttgctgacagtttctttggcctgagggagcttttctttatctacaagtgtcaaagtgctccgttctttgtaaacaccaaaacacatgccactttccccactgagtcaaatggtatcatgaattctactgttattttatatataacaattataatattctccttttaaaaacaattgatgtgtatgtaggatttattgagtaactttgggaatataattttttaattaaaatcctgtttatgtatgtatctttgtgagtatttaaaatacacatatttacctctagtgagcgccctatcattgaaggaagatttagttctcattgtatttttactcattgcaaggtttacaacatactgtgttttttcatataaaatatgataacctaccaagttccttctgacctaataatactactaatactacaataataaacccatgctttatcataaagtaaccaataacttcaagaagttgaagttatatagagaaatacagaatacagttatatagagaaatatataaatatagagaaatgtataaatatagttatatagagaaatatatgaaatatagagatataatagcatcactcttcatccaaacaccaatagatgacattttatctaatatcattctcatttacatcagcccagttttaatatattcattaccagcacattttttttcaaaattcatgttgttttgtaaaatatttttattcattggacattatcattgtatttctagtcattaaacattctgtaacatcttattttaattctatccagttaatataatttttttctcccctatctttaatgttttagtttagttatgctatcgtatataacaatgcagtgagcatacttttagataaatatttgattgtatctggtattaaaatacatttaaggagctaggcccagtggctcatgcctataatcccagcactttggaaggccaagatgggagactctctggaggccagcagtttgacaccagcctgggcaatatagtaagaccccatctctacagaaaacaaaattagctgaatgtaatgatgtgtgcctggagtcctagctgcttgggaggctgaggtgggaggatcatttgatcccaggagtttgaggctgcagtgagccatgatcgcaacactgcacaacctgagtgacagagcgagaccctgacactaaaacttaagtacatttatgtttagtttttaatgatattgaacatttttatgtgctttctagggactgtttaagttgacttttgtatttcctcacacatctgtgtgacgttaggtacagattgagggcatctgtaacagctgaaatgttcccaaacaggtaaagctccagatggctctggaacttatgaggaaagagttggaggacgccttgactcaggaggccaacgtggggaaaaagactgtcatttggaaggtaagaccatgttggggctttaggaggcttgcctgtttgaaggatccagattcgggtcagtaattcttctaccatcttccattctccagcacttttgttccatctccatatatgcccaagagcacctcagagccatcctgggtcatcccgtcccctcaaatgatatggttcatttttgttctttttgtctctactgccatcacccaatccaaattataattaaatagctttgctagtttgatcttcctgtaaaacccactgctgtatccctgtcacctagaatagcatcttatactgttgctaccagtttgaaaatatttgttaggtgaatgaaataatgaatatttcacaactttgtaacagaagaagtgtagcccaaggtgatcatcttatatacagggtaataatctgaacgtttagccttttttttctatcatctatacatacacatattccatttttttatacctcactagctctttttattccatgtttcattcatgcacatgtgcgtgcacacgtgtacacacacacacagtgattcatacacacacagtgattcacatacacacacacacacagtgattctcaacctgaggcgatacctgccccccaagataacattttgcaatttctggagatgatatttttggatgtcacaactgaggaggggtgggtgcagtgcacctgtcatctagtagaggcaggaatgcagcttaacaccctgtagtccacaggacagttcccatatcttgtgaggaaaaaatgatctgttcaagatgtcagtagtgtcaagattgagaaactacgtatagaaactgtgtgtatagttctatatattcatataatgtattatataatatgatatataataggttatactttgcagaatattcctattctttctccttttccaaataacccttcttttctgatcactctatatatttataattatttccttcttgttttctttgaaaatttagtcttatactctgtctttatacagatattacataaagactttttaaactatatttttctttatttactacattactagattacaatatagatatatacggataggaaaagataacacttatcccagaagaaacatgtacattaaggccaggcgtggtggctcacacctgtaatctcagcactttgggaagccgaagcaggtggatcacctgaggtcaggagttcgagaccagcctgaccaacacggagaaaccccgtctctactaaaaatacaaaaaaaaattagccaggcgtggtggcacatgcctataatcccagctactcgggaggctgaggcaggagaattgcttgaacctaggaggcagaggttgtggtgagctgagatcgtgccattgcactccagcctgggcaacaagagtgaaactctgtctcagacaaaaaaaggaaaaaagaaaagaaaaatgtacattataggtaaatgatgtagatagtgataggaaaggataaaagttatcaatattaaataatattgatgttaataacattagtacctaacgttactcagatgtgtgaagaaatatttaaacttattaacgttgatactgacaaacttatcaatattattaacaaatatctttaaactagtagtgacagtataagatgcaattctaggtgatagggatatagcagtgggttctgcagtaagatcaagctagtaaagcatagtttcgattgggtagtggcaatggagataaaaagaacaagaacaaagctttacagtattaaataatgttcattacttgcctataatgtacatagtggtaggatgtacattatttaatattgtaatattgattgataatttttgttcttttcaggctgaaatacaagtcagttgttttcaatcctggcctgaccatagatctataaaatcagaatccccatatcggagagctgagttcctgcatgttttaagccctctacagattattcttaagtagggatgatactaagatccctgttctaagccaagtaaacttgcatgatcattaccatcaagaatgtctccatgtgagccaaatgcagcaaacacatctttggtcaaaagttattctaaatactgcaaaaccacctttcctttttctctgtctgcagatatagttgtgctcaagagggtggtgtgaaaggaagatggattgcaggcaaatcgcttcccaccttcccacctcacaccccctcgtgccccaggtatgactctacccttctccagtggctgcgttatttgccccaccccacgacagcacagcctctgatatgaagagagcttctcatatttacatgagttacactttcaggaatcagtgtatggaattcagacttggctgatttcagaaagaagatgaagttttctgaatctggtgatttagaaaatggtggaaggaggtagagatggaaaatggaaggaagtagttaagtcttaggggatgtttagtttaaaaaggtgatagctcatgccttttagtcaaagcaagaagttatcacgtttaaaaacaggcaaataggctgggcacagtggctcacgcctgtaatcccagcactttgggaggccgatgcgggccgatcgtgaggtcaggagtttgagaccagcctgaccaatacggtgaaaccctgtctctactaaaaatacaaaaattagctgggcatggtgctgcgtgcctgtaatcccacttactcgggaggctgagacaggagaatcacttgaacccaggaggaggaggttgtagtgagccgagatcgcgccactgcactctagcctgggtgacagagcgagactctgtctcaaaaaaaagattaaaaaaaaaaccaggcaaatgacttcacctacaaggccgtataacaatgtaacaaaactgcatttgtaccccatgaatatatacaaaaaataaaataaatcgataaaacaggacagagaatgggaggtatagatactttgagggaataatttacctctcgtactcagcttaaagttagttttcgatatacttatcttgagagaagaaaatctagaaactaagcctgggacgaagtatgttccttaggtctattcagaaactgaagacgtgagattcaggtagaaattgggattaattctctgacgtgaactctgaaatcagtggcctgagcatcacttagttctttcttggctttgtagagaatgttaggcttatggttgtgttcactattaccatattatgaaacagcattcatattttctcatctctcagccttttcttattcaaacaaacatttcttcatcattcagttgtttctagtggttctagcgactgatctagtagtaaatagtaacttctgctgtgtgactgctctatgctaatcactgttcttgtagtttaatagatatttagctgtaatccacatactcctctttttccccacattttttaagagatggagtcttgctctgttacccaggctgaagtgcagtggtgcaatcacagcttactgcagcctcgagctcttagacaagtgatcctcccacctcagccttgtgggtagctgggactacagggcttaccaccatgcctggtcggttcattttaatttttttagagatggggtcgcattttgctttgttacccaggctggtcttgaactcctgacctcaagcactcctcttgcctcgacctccccaaaacctcacattttgtatatggtactgaaacttcagtataaaagtgccttgcccccaagcctgtggcaaaatgggaactccagtccaacagtattttttaaacttaatttgaaaactctcctgggctacttcttatatgaatggactccagtctgtgcatgttgttaggatgcaaccagtgagtccacagagttacggagcccggggaagtctggacattaccttctccagcactgtcctgtacatggctgctggaggccaagcactgacgatgtgatccacggtgtcacctcaggagaaagtggaaatgcagaggcagcgcttcagattggagtttgagaagcatcgtggctttctggcccaggaggagcaacggcagctgaggcggctggaggcggaggagcgagcgacgctgcagagactgcgggagagcaagagccggctggtccagcagagcaaggccctgaaggagctggcggatgagctgcaggagaggtgccagcgcccggccctgggtctgctggaggtgaggccgggtgccagaaaagcaggcagatgtgagactcaggtgacagagactagtacaatggctttcagagacaaacactttggcgtttatgttctttaggaaaagggcaccctcaaatttactcagaaggcagcttaaacaccctagaatttactcagaagccattcctggcatcagaatcatgagattctagagaatcatatagtttgagtctggcatggtggcacatgcctgtagtcccagttattagggaggctgagacaggaggatcgcttgggccaaggaaatcgagaccttcctgggcaacatagcaagaccctgtctcaaaaaacaaacaaacagcatatagtttgttttaaggactaaagaattcttaaaattaatgatttctgaaaacttaaacagctagggaaaggacaagctacactctgctggctgagaagtaattcctaaaacctcagagtcagtttgtccatgatagcattgctgttttttagggatggctagcacagaaagtctgcataatacatttcagtgtcactggccagaaggatgaataatgatttaaattgtccagcttgaaattgttatattggattgtaaagcaaacactgatttcctggcccacattgcatgcccgttccaggcatggcgaggagggattacgtggactcccgtgcagcttcctcccagtctgtttgggattagagagcagaaagacgagtaagagtgaaaggaaatctttgtttttaatcctctgtgaggcatcatatcccaagtgaacagggaaagccaaagttgttgatagatccatgttttcttggtagaaccaatggcaacagaaatttatctggaccgactcctatctcctccccagtgactcacgcaggggattctaaactaagtgatgcatgttctcatttaaaagctgacccacggattccaccttttctgactcagttctaggcactgaaagtaccatgaatataaataatcctattaactgtctgtataatatttgcaagtacaatgactaaacaggactgattatgaggcaggggaccattagatgaatttataaagccatttaatttgtctcattttatcttatatatattaaatttatattttattattattgctatgttcatttccttgttagcaaactaagagtcagaaaggaattaattttccaaatagcagagagcaaaatacaagaactttgacggtttcttttcttttgtttttttgagacagagtctcgctctgttgcccaggctgagtgcagggtgcagtggtgtgatcttggctcactgcaacctctgtctccttggctcaagcgattctcctgcctcagcctcctgagtagctgggattacaggcatgtgccaccgcacctggctaatttttttttttgcgtttttactagagatggggttttgccatgttggccaggctggtcttgaactcctaaccttaggtgatccgcccactttggcctcccaaagtgttgggattaaaggcgtgagcccctgtgcccggcttgacaatttcaacaatagtatttattgctctgcctgccttggcctcccagagtgctgggattgtaggcatgagccaccccgcctggcatgggaggatatattcttaaataaggtatcttatctatctatttttctaaaagggcaggatctcactctgtcactcacgctggagtgcagtggctcaatcatagctcactgcagcctcagtctcctaggatcaggtgatccttgtgcctcagcctcccgagtagctgggactaaaggtgtgcaccaccacgcccagctaatttaaaacaaatttttagtagagatgaggcttggttgtgttgcccaggctgtatatttttatactttcctttccctttcttccctggtactaataagctacattttacccctgaaggccaagaccaaggcctgacattcccatacagggtaaagcaaattattcccctgcttttatgtcattaaaacttatctgactggcaactgtttttaaggggagaggggaaatgtatcccaaatacaattattaatataataaatgtatcacagatatatttatttaataatctactttgagaaaataatgttactagttattaaaggcttcctttattaatctatttagataacctcctcataggaatagctctggtacgttggttcagagaattaggaatttataattcctataaagatatttagggaaacattttgtgtctttatttgaggaacctatccatgcccctcaaataaattctatgagtacttaggatctattttatcctgttccgtctgaattacatgcagaatgttactctgttacaatatccaagtagcagaattattaattcagaagataattaaattgataggtgttgcaggaattaacctaaactttgtatagctttaaagaaaagagatttgtctgagtgtggtgactcacgcctgtaatcccagcactttgggaggctgaggtgggtggatcacctgaggtcaggagttcgagaccagcctggccaacatggtgaaaccccatctctactgaaaatacaaaaaaataaaaaaaattagccaggcgtggtggcgggagcctgtaatcccagctacttgggaggctgaggcagggaggtggaggtcgcagtgagccgagattgcgccattgcactccagcagcctgggcaacaagaacgaaactccatctcaaaaaaaaaatagaaaagagatttattgtcccctataattttatctcaataatgttttgcagtagtttctaaggaaatttttatggggtcttcagtctgactgtgaaaagcagttcagagtccaactcacactgtgtttttctttccttttcagggtgtgagaggagtcctgagcaggtatgtgtgctttctgaattggtgaagggattgggagaggcagaggagctggtggagaaccctgctgacttctgtggtttctgtgctcttcccagaagtaaggctgtcacaaggctggaagcagagaacatccccatggaactgaagacagcatgctgcatccctgggaggagggagctcttaaggaagttccaaggtagttgcatcttagagactgggaattaggctgcctggggtttgaagaagttccaaggtagttgcatcttagagactgggaatgaggctgcctggggtttgcctcgtattgtggtttgtcactatgccagtcagctgcagtgaccaacagaacctaaagtcttagtggcccagatcagcagaaatttattttgagagtgtgctgttggtttgttcctaggtgtggggacttctgtgccacatcttctcactctggtacccatactgacagagctctacctccctcttggtgctgggagccatagaaaagggcagggttattgaagagatgggggaagaagttctcttccagagtcaatacaacacatcacttctggtcaccaaaatgtgtggggatttctctccgcaaacagccaatcagttctccagcagatactccagccagatgtccttccatgcaatttgattttgacactatctatctggagatagcaccaggttccccgggttgagggctttgtcccacaagactgaccccacttcagatgctggtcacaagcacaggttgtggtctgtgattctgaccaactgactgtaaactggggttcccacaaccctcttcttgagttcacttaatttcctgaaacagctgacaaaacttagggacacatatttactcatttattataagggcgttacagaggctagagatgaacagatggaagagattcttagggcgaggtttgtgagaaggggtacggagcttccacgccctttctaggcctgctacctttggaacctccgtgtgttcagtgatctggaagtcctcaggactcagttcttttttttgtgtgtgtgatgaagtcttactctgtcgcccaggctggagtgcagtggcgccatctcagctcactgcaacctccacctcccatgttcgagcgattctcctgcctcagcctcccgagtagctgggattacaggcacatgccaccatgcctggctaatttttatatttttagtagagacggggtctcaccatgttagccaggctggtctcgaactcctgacctcaaatgatctgcctgcctcggcctcctaaagtgctgagatgacaggcgtgagccactgtgcctggccaatgaactcagttattttgggtttttatggaagcactatgtagacgtgattgattagatcataggccattggtttaccaacccacccttaagcccctctccctcttcagaggtgggggggggtgaggcgtgaaggactgaaagtttcaagcctctaatcacatggttggttcccctggcaaccacacccagtgggaggctttctgggtaatcaccaaccacaattcatcttattagcttacaaaagacactcttgtatttctggaaatttcaaggattttaagaactgtatgtcagtaaacaggatatagaccaaatacacacttcacagtatcataggcatggtgaatgtagaccaaatatatacttcccagtgtcataggtatggtgcctcctgcactgtagaccaaatacgtacttcacagtatcataggcatggtgactcatgcactcctcttaaaggtacccatgctgaattagagcatctggccttcctgagatttcatggctaagtcaaactatcaaggagacagtgtagggggcaagggaaaactttcccctttccctatgaatgtttgctgaaaatcaactgaccaaagacaaataggaacaaaggcatagaaaaagtctaacattcatagcacagtggaatcgcaggagagtaatgacccaataacgcagtgggatacagatgcttatatacctttctttattggaggaaagggagatggggaggtgtggatgattttagggagatagtaaatgattttttggaggattcattgggcttggagtgcatacagtggcttgggacaaagtgttgaaaagtagacagtggtttgtgactaaagtctgtccaggtgtattgatagacttgtctgtcttcctgcaatatgagctaaattaattaaaatgcagggacttcaggcagataaatgagtgttagaataaagcttcttacagtgtgtgatggtctccaagggcctttaatttaaaataatgggcataccagggtgccatattttagggtaaaattccctggtctccttccgtgggagagtgcaccatgcccagaaaaattaggattggtatattcatgagcagtatcagagtcacggccacccatagagcctgcaccaccatgcccagaagaacgaggattagtatattcatgagcagtatcagagtcacggccacccatagagcctgcaccaccacgcccagaagaacgaggattagtatattcatgagcagtatcagagtcacggccacccatagagcctgcaccaccacacccagaagaacgaggattagtatattcatgagcagtatcagagtcacggccacccatagagcctgcaccaccacgcccagaagaacgaggattagtatattcatgagcagtatcagagtcacggccacccatagagcctgcaccaccacgcccagaagaacgaggattagtatattcatgagcagtatcagagtcacggccacccgtagagcctgcaccaccacgcccagaagaacgaggattagtatattcatgagcagtatcagagtcacggccacccgtagagcctgcaccaccacgcccagaagaacgaggattagtatattcatgagcagtatcagagtcatggccacccatagagcctgcaccaccacgcccagaagaacgaggattagtatattcatgagccgtatcagagtcacggccacccatagagcctgcaccaccacgcccagaagaacgaggattagtatattcatgagccgtatcagagtcacggccacccatagagcctgcaccaccacgcccagaagaacgaggattagtatattcatgagcagtatcagagtcacggccacccatagagtctacatttggttagactatgggcttaaaactgtaggtcatctcttattagctgatatgagtaacgttacttccagtaaatttacatttccttgcttataaaatgctaaaaataaattgcttggaggacaaaatgaaacatttgaaagcaccccacctcctaaaagtaatcaatatgaaagcactgcaaagttatcaattagcaagaagtttggtttaatttattggctgagaatttgatgagttgcttgaattagtgagtcaataaagccaaaaatattgtcagttattttcatgtaggaataagcagtgtcacaaaaaattagtgtgtttagtctgattgtattattctttaaaacagtatagattcagtattgtttacaatttcattttaaaatctaatttatcccaagtaatgaaaactatgtctaaatagtgacttcactacttagagggaaagagtgtaaagtcccttaatgagaaaacccatctctgcagcatagtacccacgttctcctgggtagatgaatgtatgctaaatgcccaacttgattaaaatcgtcatggcaccctcagactcagcaacctcatatccatatttgtttttatggaatgaaatcattcaaaatgtgtgattaattttatctcacccattcttttaaacattggaatatatcattcaacaacaacaacaaaatactctacaatccgtagctttgtgttgcagatatgtacttcaccaaaatacacaggctgtaagtggctgacacagaatattgaagaaaatcaaaaagagtatgcaaagggtaatgagaagttctagttttgaataaggtgaccaggaaagaccccgccctgcaggggataacccagcaaatatatgatctggaagaaagcattcaggcagcagaaatgagcgccaaggcctgacgtggaggatggcaggtgtgttccaggagctgtgaggatgtcagtgtgaggactctgtggcagagtaaatgacaggagggtcggagagaccaagaaagggctagataggcaggccatgctgagcatgatactttatccctgagcgaaataggacatagttgaaagttgtacctagaaaaatagtttgattggactaatgttttatgaggatcactctatatgctttcttgtaagtaaattacagagaggagaagattgacatgggaaaagcagttaagggtctttgcagtaatttgatgagagatgattatgtgttggaatagatgttattacggaaggtgccgcaagatggacagatttttgttatatactgaaggcagagctgttaagatttgctgttggattatatatgatgtgctataaacaggaagagccatgaatgattccaaggttttggatcttgcgaactggcaaaatgtgattgccacttatattgatgaggaaagcgacagttgaagcagaagaagggcacagggttttggatatgtggatgttgcgatgagtgctaaatattcaaatgttgctatcaagtgggcagatgaatgtacaatagggagtttcagggtaaagttcaaagctaagcacatgcattgggaatcagtcagcatatgaatggaattttatcaaagcaatgaaccagccagcacccgggtagatagggagtgaggtgagagagagagaagaagtccaagtcttgggactataggtttctccagtggtggtggtggaggagaagagaacagcaaagaggatcaaggagtagtgagcagtgagggaagggaaacatggatgagtgttacctttggaaaagggagattttccagcacaagtagattctcagtgttgagagatacagaaaaatcattgaagatgaactctgggccgggcgcggtggctcacgcctgtaaatccctgcactttgggaggccgaggcgggcagatcacctgaggtcaggagttcgagaccagcctgatcaacctgaggaaaccttgtctctactaaaaatacaaaattagccaggcgtggtggtgcatgcctgtaatcccagctactcgggaggctgaggcaggagaatcacttgaacccgggagatgggggttgcagtaagccaagatcatgccattgaactccagcctgggcaacaagagcaaaactccatcttaaaaaaaagacaaactgacaagtaaccattcatcaacacggaggtccctgggaagatggacatgcgcagtttggttggggtatggtcacatcatgatgaagaattgagtttaggagagaaggggtagggagaggaatgggatacagaccatatcaaaagccatttcacagatctcttttgttagaaatgaagcagaccactgtgccggaagaggaatggcttgggaatacatgacctgttagattgtgttaaatgcacaatccatggagacctacctttcaatctctgttatttacctctagagtttgggaagaccacataaactctttgactctgaatctactcttgtgtaatgtagggatgacaatggtgaccctcagggtggttacataataaaaataatgcaatgcgcagttacgtgaccactcaggttgggtatcaataaaaattcactagaccgggcgtggcagctcacgcctgtaatcccaacattttgggaggctgaggcggatggattgcttgaacccaggagttcgagaccagcctgggcaacatggcaaaaccccttctctacaaaaaaatacagaaaactagctgggcatggtggtgtgtgccttcccagctactcagagggctgaggtcaggggatggcttgagtctgagaggtggaggctgcagtgagctgtgattgcaccactgcactccagactgggcaacagagcgagactccgtttcaaaaaaaaaagtagttcactgtaagtgtttaaaggcaaataagtatagtggtagtggtagtagcagtagcagtagcagtagcagtagaaacagtatttgttctgatattaaaaatcaaactatattaacatgttagtctgattttgcattgctataaagaaatacctgaggctgggtaatttattaatataaggaaatatgctttattttggctcatggttctgtaggctgtacaggagtcatggtgctggcacctgtttctggtgaggcctcaggacacctacagtcatggtggaaagcaaaggaggagccagcgtatcacatggcaagagggaagcagtgaagtggggaggccccaggttcctcttaaacgaccagctcttgcatgaacggataaagaactcacttatcaccagtgggatggcactaagtcattcatgggggatctgcacccatgatccagcaccccccactaggccccaccttcaacattgggaatcacatttcaacatgagaccgggaggcgatacacatccaaaccatattatttattaacttactacttataagcaatgctaataaggaaatgcactgaatattttacatccccccttcactgaggtttcatatctagatgtatttatttattatgtatatgggtcaaatgtctcatcaatctcactgggacttcagagtatcagtattttttattgttatataacgcataactacaagcttatgtgcttaaagccataccatttagtagctcatggttctgaagaccagacatccaagtgggatcagctggctcctctgcttaggttttctcaaggcccaaatatgggtgttggccaggccaggccaggcttctgtgtaggtcgggggaagaaccttacctccaaccttattcaggttgttggcataatacaattctgtgcaaatgcggtactgagattcctgttttcttgctggctgttggttgggggctattctcagctctggagatcactctcagctctagaggtcactcgtttgtctcttcatgtgacctttccattttcaaagccagcaaagagatatcaaatccacatcttattgacctttcctgctgccaccaacccaatagccagagaaaactttctgattttacaggacttgtgggatttgattagacgcaccttgataatctctctcttgtcatatagtgtaacatactcatgaggctaacaccagggtgtgaaggtcatggggtccatcttagaattccgcctaccacagtaatataactttggaagtagtggatttaatattaataaaattctatagatttttaagaaaaaaattcctaaggggtttataaattttatgttaaatgcagaagatcctcctaagtgcactcaaatgctttggatgtaagccagacatggtggtgtgcacctgtagtcccagctgctggggaggcagacacgggaggattgcttgagtccaggagtttgaggctgtagtgtaccacggctatgcccatgaatagctctgcactccagcctgggcaacatagcaagaccccgtctctctgtctctctctctctctctcacgcacacacacacacacaaatgctttagatgtaaatgaaaggaaactaaatgataattcacttggtttgtcgtcatcaatagttgtttttttttgggaaagttaaagagttctgggttacgcagaggtaacagtggaatataccagaaagttataaagaataagaataataaagtaataaagaagatttcacctgtaaggtgaaatactgatttgttttctctaggagttaatagagagagaaaagtgaggaactgtgggactattcttttcagtggtttcctaagtttctaccagtcctttctttcctttcacctggtccaccacattctttccgcagtggatgtaaagctggatcccgccacggcgcacccgagtctgctcttgaccgccgacctgcgcagtgtgcaggatggagaaccatggagggatgtccccaacaaccctgagcgatttgacacatggccctgcatcctgggtttgcagagcttctcatcagggaggcattactgggaggttctggtgggagaaggagcagagtggggtttaggggtctgtcaagacacactgccaagaaagggggaaaccacgccatctcctgagaatggggtctgggccctgtggctgctgaaagggaatgagtacatggtccttgcctccccatcagtgcctcttctccaactggaaagtcctcgctgcattgggattttcttggactatgaagccggtgaaatttcattctacaatgtcacagatggatcttatatctacacattcaaccaactcttctctggtcttcttcggccttactttttcatctgtgatgcaactcctcttatcttgccacccacaacaatagcagggtcaggaaattgggcatccagggatcatttagatcctgcttctgatgtaagagatgatcatctctaaaattctgttcccaagatgcagtcctagcgtagcgaacgttcctggagtggggtgaaggatatcaatatactaagttttaacagataccccatttaggtcagcacttgattcgttgttgctgtgaaatatgtccatgggacaaaagagggaatatgaaatatttgcatatgggaagattatagagcataataattttgtaaatggagcaatctcaacctctatttctagatcacattttcttgatgtcttccttcaaattaatgaccttggattacataaggatttctatgcattcattataatttgttattcctttcaatatccttgtatttcaaatcttccatataagaattagacatggcaattcttaaattgattcagaatggtctgatactattccagtatcacctccttaattctgtttctcctcgttttcctgattttccttctcattctctccttccccgctctgtctctctctccctgtcactctctctctcttgttccttattttttgtttcttacctcttactgtttaacctgttgcttccttctggattaatacatttagagccattcctttatatggtcacatttcctatgactttactcaattacttttaaaatcctttctattctgagactaatttttaagaattacaaagctcattcttctgaatctaatatcactaactcctagactttttccgttttctttggatacactttaagtaggaatttatcagaattttcattcaactcgttctttaatgcagatatttactagttataagaccttaaggctgggtgcagtggctcacgcctgtaatcccagcactttgggaggctgaggcgggtggatcacaagctcaggagttcaagaccagcctggccaacatggtgaaaccctgtctctactaaaaaaaaaaaaaaaatagaaaaattagctgggcatggtggcaggagcctgtaatcccagctattctggaggtggagacaggagaattgcttgaaccctggaggcggaggttgcagtgagccaatatctcaccactgtactccagcccagtgcgagactccatctcaaaaaagaaaaaagacctcaaacaacacttctctctctcttttagctgcttgttatggttcctatacatggaacaattatactggcctcactgtgttatggtaaatatttaaggtcatatttgatattgctggtttgaattcagcttttccatttaaatacattataatgatgatgatgaaatcatgataatatttaacttatttttaaagtatattctgtacctttccaacaaaaaggttaaaagtcattgaaggctaaccttactgccttctttgtatcactgtcttctaaataattattatgtctgggtacagtggctcacgcctgtaatcccagcactttgggaggccgaggtgggcagatcacgaggtcaggagattgagaccatcctggctaacacagtgaaaccccgtctctactaaaaatacaaaaagaaattagctgggcgtggtggtgggtgcctgttgtcccagctacttgggaggctgaggcaggagaatggcatgaacccaggaggcagagcttgtagtgagccgagatcgcgccactgcactccagccggggcaacagagcaagactccatctcaaaaataaataaataaataaataaataaataaataaataaataaatattacacaaatgctaaaatgtttaaatggtaaatgcttcaatgctaaccaaatattaattaatggcaaattatttaacattatctgataataatctgcagaaggtttaattttcctcctcaatttgaagttcaagatgtttttctcttccagggagattttttcgactgacatctttaacttaccttccaatcatattactaacgtagccttcttcctagattttttaattgtttgatcatgagcgaacacttctactctctgtgatagatttgcaaacagaggaaataacgcatcctcgtgtccctcttcttggtgttccacaggccatgtgtgccctagccctcgttcatgcaaggtctgtgtagggaaggtggacttcagctcagcaacagcatcccttcccacagggatcaggtgggtggcttgagataccccttccatggggcaccacccattcagtgagacggggaagccctgggtgggagggagaacacctccacatgtcttctactctctccataggatggaatgagtgtcccagtcccaggagtatccatttcccactgtgtagcccagtactctggtctcactgtctctgctgaatcctgtctcactgtgcatattattgtggtttatatcagtcagtaaaccaatgtgagtcttcatctcttgcattcttaggttcatagttttgtgtgtctcctgtaatgactcttctctttccctttccaactcctgaaagattgccactatttcctctggaactttgtttcgttaccagcaaaatcctcgacatccatacccgtttcctggctttccctctcctttcctctgaatggtagtcttttatattcagctgtccacttgacatcaaaatagacattttgaactcaatttgcctaaaacttacccacaaatttctccccaagtctctccctaactgcaacaacaaaaaccacaggcttctccctgtcactggatggcaactccattcttttgattgcttaagccaggcatccgattgagtactttcttgatttctccagcccacatccagtccatcggcaagccctgttggtcctaccttcagaatatgtccggggttcagttgtcctggccaccctgctgctgtaaccatggtcagaactccatcctgcccctctggattatgactttcgtttcctcacagtggtcctgcttgggctctaggcccttccactcccattctctctacagcagctgggctgattcctttagcacccaaggatatgttggcatcacagtgacttagataccatcacaaagacctcccattcaacttagagtgaaagtcagaatcctcacagtgaatccccaggccctagaggatgtgaacccccaggccctagaggatctgaacccccatccctcctctgattatctctcccacccccacttccctttgcattctgctccagctgccctggcctcatggctgggtttccaccaaagcaggcacttcccatcacagggccatttccccgcctgtggcttctgcttgacattcccttttccctgatatccccttgactcattattccctttcttccttaactcttctgagatccagcttctcagtgataccacacagccctactccccccagagcccatctagagctcacctttccagtcgcccttgccaggctcagtggaggctctttgttccccatacagtacgtgtcgtcgtactatattgttaggcttatttaatttatgtatgttttgcctttttgtgctaaatgtaaacaccacaaggggaggtatctttgtctgttgacaatgatacattcaatgtttctcaagcacccccaatgctggtttgtatgtggttatcattcaatctgtatttgttgaatgaataaatgattgactatgtggagagcaa

SEQ ID NO: 1995 - DNA, 931 bp, Homo sapiens
tttactttttggtgagctttccctttatcaacatccccagagccacctttatggccttgtttctcaaactgtatataatgggattaaaggttgggggcagcatagtgtagaacacagaaattacagcatccaaaatagaaggagactctgaagctggcttcagataagcaatgaatccagtggaaagaaataacacaaccagcaagtgtggaaggcaaatagagtaggcttttgactggccttctgtggaagggatcttcttgactgtagagaagacgtggacataggtaatgatgatgacaataaaacagcagaaatccaaaactacattaataaggatgagtgcaatttctcttattaaattttctgagcaagaaatagctaataactggggaatgtcacagaagaactgatggaccatgttggacccacagtaggataaggagaaggtgccagctgtgtgcatcacagcaatcagacccccatacagccaagacacagtggctctttggacacaggtgctcctgtccatgatgacatcatagtgcagagggtgacatatagcagtatagcggtcaaaggacatcaccgtgaggaggagcagctctgcagatgctgaagaaagcaacaaaaagacctgggaaacacagccaaggaatgaaatggagttgttgtgtatcaaagaattggcgatagatttgggagccgtgactgaaataaggcagagatccaagaaagatagattcttcaagaagaaatacacgggggtgtggagatgatggtccaaagttgtgatcatgataatgaggacattccccatcagggcacacaaataaatcaacaagaagagaatcgaatgcaaaatgcacatatttttattggtagaaaaccccataaggataaattcagtcacgattgtgagatttgccat

SEQ ID NO: 1996 - DNA, 970 bp, Homo sapiens
cctaataaaggaacttccttttacttgtactccatagaataccacatttccttctcatgacctttctaacagcttctttgaagtctttgttcctcaagctgtagataactgggttcagcagtggtgtgaccacagtgtagaagacagaaatgatcttgttgatttcaggcaacaggtggggactgggacacacatacatggagatcatggtcccgtagtagagagtgacaacagccaggtgggagccacatgtggaaaaggtctttctccggccagaggtggaagggattctcaatatggaggacacaatgaaaacatagggccccagtgtcagaaaaaaacaaatgcacagcacggcaattgacaggatgaagatggtcacctcggtgatataaactctggaacaggagagctgcatgagtggcgggaggtcgcagaagaaatggttaatctgattgcgcccacagaagtccaacctggaaatcatcagggaaggcagaaagcctgtgctgacccctgtgcaccaggagaccaccaccaacctggcacagagcccacgatgcatgaggaaggggtagcggagtgggctgcagatggccaggtaacggtcataggccatgaaggccaggagaaagcactcggtggcgccgaggaatacgaagaagtagagctgtgccatgcaggcagagaaggagatggcttggccccaggacagcaggttggctaggagaaggggcacagtggtggacgtgtaccagacctccagaaaggagagatgctggaggaacatgtacataggggagtgcagtcgcaggccctggctcaccacggtgatgatgacaacattccctataatggtcaggcagtagatgagcaggaaaatgacaaagagcagggcctgccattcaagaaggttctggaatcctaacagctgaaagttagtcacagtggaggtattttggggctccat

SEQ ID NO: 1997 - DNA, 946 bp, Homo sapiens
gatggatggaaccaatggcagcacccaaacccatttcatcctactgggattctctgaccgaccccatctggagaggatcctctttgtggtcatcctgatcgcgtacctcctgaccctcgtaggcaacaccaccatcatcctggtgtcccggctggacccccacctccacacccccatgtacttcttcctcgcccacctttccttcctggacctcagtttcaccaccagctccatcccccagctgctctacaaccttaatggatgtgacaagaccatcagctacatgggctgtgccatccagctcttcctgttcctgggtctgggtggtgtggagtgcctgcttctggctgtcatggcctatgaccggtgtgtggctatctgcaagcccctgcactacatggtgatcatgaaccccaggctctgccggggcttggtgtcagtgacctggggctgtggggtggccaactccttggccatgtctcctgtgaccctgcgcttaccccgctgtgggcaccacgaggtggaccacttcctgcgtgagatgcccgccctgatccggatggcctgcgtcagcactgtggccatcgaaggcaccgtctttgtcctggcggtgggtgttgtgctgtcccccttggtgtttatcctgctctcttacagctacattgtgagggctgtgttacaaattcggtcagcatcaggaaggcagaaggccttcggcacctgcggctcccatctcactgtggtctcccttttctatggaaacatcatctacatgtacatgcagccaggagccagttcttcccaggaccagggcatgttcctcatgctcttctacaacattgtcacccccctcctcaatcctctcatctacaccctcagaaacagagaggtgaagggggcactgggaaggttgcttctggggaagagagagctaggaaaggagtaa

SEQ ID NO: 1998 - DNA, 16895 bp, Homo sapiens
aaaaataagtaatcttatatttaaaaaaccataaacagtacattaaaacctctctaaactaataaatacactcagtaaattagcaaaatataaaattaacatacaagtatatctatggtttcatacacttaaactatctgacaaaatagaggaagaaaattttattgactataccttaaataataaatttctgaggaaaatattaaccaaggaggtaaatctttacaataaaaaaaggaaaagttagaaaagatacaaataaattttaaaatattttgtctatgaattgaaaacatgaatattattgaagtgccatattatccaaagtaatctatagattcaataaacttcctattaaaattgcagtggtactattttcacaataatggaaaatacaattcaaaaatttacatgaaactaaaataaactttgaatagccaaagcaatcatgaggaaaataacaaagaggaaggatgtcataatttcaaactatatatttcaagcctagatagtaataaaaacagaatggactgtgcagaaaaatgaacaaaaaaaaattcaacagaaactattactctcagacatttcagatctgatgcaaagagaactttgagagtaattttagtttctcaaaatcatgcagacatttgtgcgtcccaaaaattatggaaaagcagccacactgtgcagtctcttatatgtcatgaagaggactttggctctcactgtgaacttgaaggaagctcactgaaagaaaaggaaaatccttagagaatttaaaagcataagacagaagatgcccctttgtaagcaaaattaaaaaagaaaaaaccaaacaaacaaacaaacaaaaaatagctgcccaagaactatttcctttggaacacagctccccaaatcacactttaaggactggctttctctttgaccttgggaccccttatctgtgtcatctgttgtattcattttcactcacacctacctgagggtttggctatcatctcatttctcttcatggtcaaaggttttcttccttgctccagacaggtgatcaggtctggcttagaaacagtaatacctgttttattaaaaataaataacataaatcttgcttatgttctccaattacaagctagtaatgtgctcagcacagaggatgtgataaaatattctagtaaattaatacaaaaatactaagttgtaacagaaatttttaaataattagaaaatactttcaatttgtaggtttcttaattttactacctggtgctactgaatcaaaaattggtggtggcaattagattttcaggtggagcaacaatattttatgccactaaatttctggaattaccactaatttagagtgaaaaatacagctcaactcaggaaagtggaaagtttggattaagataaaacatgttgaagaaattcttttctaaacgaacaaattctgaagattttctggaaaatggggatctgaaactcttttatgcaaagaataaattactaaaaaacattctacaaaaaataaataaataaaatctatagggtatattatgtactcaagttatcctcaccaaggaagaccaggttactgtagttctctaacatcacattcctatataaattccgctgtgcagtgtccaggcaatgccactcctccagagagaattctatggccacatctctaaattgcaatggtccctgaaaaacacacacacacacatttttaccaagtggccatgggcggaatttttaatttgacttaaggtgaaataagagagtaaagagaactggttctgacttataggactgactaaaattatccaataaaatgatttcaaaacagaaatattctctaatgtattctctaactctgagaagaaagagcagcataagatccacaacatcaattcatgtatgtttctagataataaagtataaaattaagggcaagaacaggaacatgtaaatttttcagtgctatagttacattatacagaatgagttgtgaatatttttcagatggaaaagacatgtttagttagaaggcatctctaaagttttaatatgtacaataagctgaagacatcgttatgcaggttttttttcccccagaagatctggaataaagtctgatttatttatttatttatttatttagagatggagtttcgctcttgttgcccaagctggagtgaaatggtgccatctcagctcaccgccacctccgcctcccgggttcaagcaattctcctgcctctgcctcctgagtagctgggattacagacatgcatcaccgcacccggtaatttttttcgtagttttagtagagatggtgtttatgttggtcaggctggtcttgaactccctacctcaggtgatctgcccactttggcctcctaaagtgttgggattacaggtggagaaaccacacctggccaatgtggtgaatttctaataagctcaacagtaatgccaatgtctttggcccaagaaggatattttgtcaaacatttagtaagtggaacagcctgtgtttttcccactttttctagcctgtaaacaaacagccctcatttaccaaagaaacatgtgtagaaaaaaaaataaggacagttgccagattaaatgtgatggtttatgcacatcagctgcataaagatacgtaataataaagaggaaaaataattaactctatagtgaaaaaaatatgtcccagagatctttaaccaattaattaatggttaatgcattaactgttaactgcactaggacaatggttttttttttttttttttttgagacggagtcttgctctgtcgcccaggctggagtgcagtggcgcagtctcggctcactgcaagctccacctcccaggttcacgccattctcctgcctcagcctcccgagtagctgggactacaggcacccgccaccatgcctggctaattttttgtatttttagtagagacagggtttcaccgtgttagccgggatggtctcgatctcctgacctcgtgatccacccacctcggcctcccaaagtgctgggattacaggtgtgagccactgcgcccggcctaggacaaatttttatgatgtgctaatgcacacagaagaacacagcatcactgttgtaatattcctcccaaaaaaagtaaattatagtccgaatgtaaccataaacatcagttttaggccaggcatggtggctcatgcctgtgatagcaatttgggaggctgcggcgggaggatcacaaggtcaggagttcgagaccagcatgactaacatggtataaccccatctctattaaaaatacaaaaattagccgggtgttgtggcaagcacctgtaatcctggctactcagcatgctaaggcagaattgcttgaacctgggaggtgaaggttgtggtgagccgagatcatgccactgtgctccagcctcagtgacaaagccagactccgtgtcaaaaaaaaaaaaaaaagaatcatcagttgtatacaaactttaaaatacagaaaactctatgttcagtaacttttagtagtaattttaagtaggcttcatttagcatcctaaagagcaggtatctcctaataatttttttcagaactttctgggtaataaatgccatcccatttaaataagcattttcttcttcttcttcttcttcttttttttttttctgagatggagtctggctctgttgcccaggctggagtgcagtggcgcaatctcggctcactgcaagctctgcctcccaggttcacgccattctcctgcatcagcctaccaagtagctgggactacaggcgcctgccaccaagcccagcaaattttttgtattttagtagagacagagtttcaccatgttgaccaggatggtcttgatctcctgcatgatccacctgcctcagcctcccaaagtgctgggattataggtgtgagccacggcacctggcctaaatcagcattttcttaatcctcttctgcatagagctaatggaacacacagctggagcctcaacattacatgttctccatctttactaaggaccacagttttccccaatagaaatcttgagtatccacatctttccatgttcaacagccacaaagggaacatttttaatattgcagatcataaattcttgctgagaattctgcatggcatataagaagctatgatgcggagaataaggagaaggctctgaaatataggaaagaaatatttttcagactcttgactatcgtaagaatttaaagaagtaattaagccaaactcattagggaggaaaaacacaagtagacaagtaaaggtttgtgagtactaaacgcatggcagtccaggaggcagagtcgacatagctcttcatctgacacatgtttacctgaagaaaagccacttttttttctttctcctccttctctggattccttctcagatgagattctctagacaagttacacctgttatcttgagactatgtctttaaaggtgtcagtaccacatgtttacctgctagcataacatcaactggcagaaaaataaagacagaaaaagtccacccatttctgtcctttacaacagaagacattcaggaacaatgagctgctccatgaagataaaaatataaatttctctttgctgtcctcagatgctctcccctgccacggacaccagccatttctgctacagtaatggaaataagcgccacactgacttgtccctaccaaacgcaaacagaacaggccctgtgaccaccctttagggcaaaggtggaacttaactctcatgaatgtattttgaacccctcatacttggttctggtctcaccttagagtcacataagggactccatggatgcttccacccagaacaataaacagaagctgtgcggaggacacaaggaatttctgcaaattggccatgtgattctaatgagaagcctgggttgataaccacggagctaagcattttctctcaagctttaatgagcttataaatcacttggtaattttggccccaatttatgtaatgtgactctggaggtttgaaaagggtccatgaatgggtgttttaaacaagttccctttcaatgctgatgttgctccccccgccccttggcgcattagcattagttagagaaagcaggtacagcacaaggtctcttattacttagcactcttgtcacaaccaaatacttctcgtacaaataaggacaacccatctccatccaaaagttttatatcctttgctggttctttaaagtttacagaaaaaacagaaggcagcaatgtctgaagaagtctggatttaaaaaacaacatgtacacacgtactaatgcaatgtttattaagcaggtactatgtgctcaagagtatgatacagagcactgtgctgggcgtaacatattacgtgatttaattctcataacaccctgggagccggtactaagtgtatgataattttcaggatttaggtaaagggcccaggatttttattgcttcttctgtttctctgccatcaaatttgttaaaaaaaaaaaccataaaaaattaaaactaaatatagacagatgaaagaaatatggaaggcaagagtttaatgtagttcagagaaaattttattctgtttatatttacatttttgtgacttgtggagcaattactggatatgcaagaatggaaaacaagtccctaaatagaatgtctctgcaaacactggttttaatataaaatttaaaaactaagaccctataacacataatttatttttcccatttatctgcttttggatttcaggaaattctaagcaccagctctagaaagacaacaggattcaccagccaaaactctgacctcttctacctgtgagacaagactccagggtagggtcagacgtaaataaggcctccaaaaagggtgaatctcaacagaactgggtcaggaagtggaccctatgtagaattctgttctctatgtcactggggtatttccagttttgttttttctaaacttacctaaaataaacttaaatcccagagtctgtgtaattttaatcttttccagccactgccctgtcaactttatattatatgctaatatgcaatttaaacaaatcccttaaggttttcaagggtaagtttattaggaaacaaatatgttcacttaacaggatgaaagaaatagaaatacggctgggcctggtggctcatgcctgtaatctcaacactttgggaagctgaggtaggtggatcacgaggtcaggagttcaagaccagactaaccaagattttgaaaccccgtctctactaaaattacaaaaattagctgggtgtggtggcaggcacctgtaatcccagctacttgggaggctgaggcaggagaatcacttgaacccaaatgtcagagtttgtggtgagtcgagattgtgccactgaactccagcctgggtgacagagggagactccatatcaaaaaaaaaaaaaaaaagaaattataacaacaattcttctgttcataaatatcctttcaagtacagacatcagaagtcacaacaatataaagtggcaaataatgtccaatattttggacatatctatttgttataccaaccatatgatgcataattcaagtatttatctagttgctagtctagactaagtttctggattgtaggaaccatggctgcttcatgttttattttaacggtcatatgaaatggaagctactagtttatctgtttgggtctccagatctcctccttgtttatcatcccagtaccaggaaactggagaaactctcatctgggtaccaacctaagacacctcttgtatgaggggatgaacaaacaggatgattcatttctcttacactgagaaagaagcagaattaaccactcttgtcagcctgacacaattctgctctggacatcctcaaatgtctcaaagaccactagatgattgtgagagaattcccagtgacctggggctggtggcccaatgataagccaggctagagactcaggctgattctaaataggaaatagaactgccttggtggagctacagaacctggatcacctgtcctgatttgctagctcttgtgtaagagaaagaacacaaatactctactccagtatcacattttacaggtaaatatagttgtggtcataactggatattttgtggccttgttctctcactcttaagatgctttttttttacacttacacatattctgtcatcagattctatttccttctggaggttctcacatcactgtagcaggtcaatgaacaagatgtgaaaaatctcacagaaccacactcccaaatgggagctgtaagctgtctaggttgacatctcacaatgcagaaaatgccttttcttagttttctgtacattctctatccaaagtccggtccttttttgtaaatcccaggcagaggccagatgttatctgcagattctaggtaggatccacctggctctgcatcctttggtgttacagcaagtggagtacaaacgaaggagagatcccccccatagaggctgctctagcacattctaaatgataagtctacatgaaaaaaaaaaaaaagctgacacaacatgaatataagtagacagtttatttgggtaaagtttacagattatatataacctgcgagcaaagattaaagttgcctggaatctacactttgagtagcagcatttacaagaagatttgtaaagacaataagagaaacacagagtgggcaaaattgtttgtcagaaatttctatttatttacaaaaataacattgattattgattagatacatatcattatagtttagggtatgggatatagtgtccaatgtagcattattagtttaatttatagctacatgtggcaatagtgaacagtctcaaaagatgaatacagaattcaaagggaggagaaagacataattgcacttttattttaacgtctctgagtttgataactaaaaggacttgcatttttcagataaaagttttttaattcccaaatctcaagacctggattcaaaatatggagctgcagatttagggcttgagtggctggagtagcacgcatgttacctgcacatttgtgagctttttagcaagagaaggaagaaagaaatggagattttcttgtctacatgtctactcactacacacgttactctacttgggtttgttggccccatggtctctgaatcagtttcaggtttgaagataaaagagtcactgaaagaggtaaaatgattgattgctgccctgtgaaatttatagaaatctgatctagactctctagaagtgactgtagaggactatagataagaaataggcagaaacacaattcggcctgcacatttagggtatggcatgcacttttctgcacaagtgtgaatttactggaagcctgagagggaatgtcccctcgagtaaattctggttggcccttatgtgtttatatcatgtctggtaattctagactgtttggaaacaataattaaaagaaaaattttctccagccccagagaaactccacaataacagaacagaaagaaaatggttttattacacaattaaacttgaatgtgacatgcatcagtcaatctgcttaagagactgcaaagatagaaagatggtcaccataattagttcacaagtagaagaatttccagcaccatgtcatacatagttcatcctaaattcacctggagattgaagaggacatctgtgtatgctaattacttatattcaatgacaaataaacttttcacctctttataacaggtggtagtttagcaggataatcgcttgaacctgggaagcagaggttgcagtgagcccagatagcaccactgcactccagcctgggggacagagtgagactctgtcccctgccctcccagcaaaaaaaaaaagaaaaagaaaaaaagaaaaagaaaggaaaagaacagggacatattttcagaagaattttataaagtttcatttccatctctgctgttctctcctctcctagccattgaatgggggtctatattgaaatacatcttacaacttccaacaacacattttgatgaaaaaatagaatctgactgtgttcatatactggaatatattagaacttgcaacatagctaattgaagagctactatagtttttgggtggccacatcacctgtctttatttgtcctgtaacagcagcatacaaatttagtgaaataaaagatactaaaattgtgtttcctcataattatcctgaatgaataaagtaataaacatgtctgactaatatctactaactgtaacaatttggttgtaaatattctttggatattagatataaatatctaagtatgaacaattttaatgaactagtcataatgtatgtagcattaaaaaaattaaaaccatacatcagttaggctgggcgcagtggctcaagcctgtaatcccagcactttgggaggccgaggcaggtgaatcacgaggtcaggagttcaaaaccagcctggccaatatagtgaaaccctgtctctacaaaaaccatataaaaaaattagccggacctggtggctcacaactgtactaccagctacttgggaggctgaggcaggagaattgcttgaacctcggaggcggaggttgcagtgagccaagatcgcaccactgcactccagcctgggcaacagaggccaggcgcggtggcttacactgtaatcccagcactttgggaggctgaggtgggcggatcatgaggtcaggagattgagaccatcctggctaacacggtgaaaccccgtatctactaaaaatacaaaaaaattagctgggcgtggtggcaggcgcctgtagtcccagctactcgggaggctgaggcaggagaatggcatgaacccgggaggcggagcttgcagtgagccaagatggtgacactccagcccggacgacagagtgagactccggaaaaaaaaaaatccatacttcagttaaaacattttatatttcaaaagcataaataacagtattaaaataaccatttaagtgattaattcaaagtaaatattgtggctttgtattcatactattttagaaaatactgtttatggctcacgcctgtaatcccagcactttgggaggctgtggtgggtggatcacctgaggtcagcagttcaagttcaagctggcaaacatggtaataccccatctctactataaatacaaaaattcagccaggcatggtgatgcatgcctgtaaacccagctactcagggtactgaggtaggagaatcacttcaacctgggaggcagcagttgtagggagcagagatcacacaactgcactccagcctcggcaacagagtgagactgtctcaaaaaaaaaaaaaatgaaaatatggtttaatttatatgaatgcagattatctacaaagataactgctaattgctctgaaataataaacagaaagcaaggtacaactacagactcaactgttcagtttataccctgaactgttcttgctttcgcagtataagtacttcagcctgcaaatattggatagttaccttggattatcaggtttctgtcaaagaaactgagtatcatttagtctttattattctgtattgctacctttactcctatctttgtgctaagcttctgtgtgctcttaaaatgagcttgtatctaaacaaatctgtgtctaccttaaaggaataaaaatcaaaaaaataaacttttcggaaccaaaaacaaagcaatacatcttaagtacttataataatctggagtcagaaaaaatgacaaaacttttatttagctgttgacatgatttacatatatttcaaacaagcagagaaaaatatctacatatattctaaatcccttaagaaaagagggaatagcggccaggcacggtggctcatgcctgcaatcccaacactttgggaagccaaggcaggtggatcacaaggtcaggagatcaagaccatcctggcaaacatcgtgaaaccccgtctctactaaaaatacaaaaaaaagaacaaaaaaattagctgggcatggtggcgggtgcctgtagtcccagctacttgggaggctgaggcaggagattggcgtgaacccaggaggcagaggttgcagtgagccgagatcgcgccactgcactccagcctgggtggcagagcgagactttgcctcaaaaaaaaaaaagaaaagagggaatagcaaaatttttttttggaactttttgaagagtttgaactcttggacatctgaaattagcacactgtatgcacttgaaataatgtttacaggggaaaaaccagaagagagaaagatatatgaaatccgtaagtgcacaagaccaacacaacagaatagagagcccagaaataatgtcaccctcctacactcatcagatttttgacaaagctgacaagaggaatatgggaagaattctctctttaataaatggtgcaggaataactacctagcactatgtagaagactgaaactggaccccttcattacaccatatacaaaaatcaactcaagataaattaaagacttaaatgaaaaacttaaaattataagaaactctgcaagataacatagagaataacattctagatatagacactggcaaagacttcatgatgaagctaccaaaagcaattgcaacaaaagcaaaaactgacaaattggacctatttaaactaaagagcttcttcacagcaaaggaaactataaatagctcaaacaaacaacctacagaataaaagaaaatatttgcaaacgttgtctatgacaaaggtctaacatacagaatttattaagaatttaaacaagtttacaagaaaaaggcaaacatctcattaaaaagtaggcaaataacacgaacagatgcttgtcaaaagaagacatacatgtggctaacaagcattattaaaaaaaaaaaaaaggtcatcgctagtcattagagaaattaaaagaaaaaccacaatgagataccacctcacacccatcagaatggctgtttttcataagtcaaaaaataacagatgctggcaaggttgcagagaaaagggaatgcttatactcttctggtgggagtgtaaattagttcaacaacagtaaaaagcagtgtggtgattcctcacagaactaaaaacagaattatcaatttgacccaggaatctcataattgggtatatagccaaagaaatataaattattatattataaagacatattcacatgcatgttcattgcagcactattcacaatagcaaagacgtagacaggccctgaatgcctatcactggtagacaagataaagaaaatatggtatggtcagatgcggtggctcatgtctgtaatcccagcattttgggaggccgaggcaggtggattgcctgagcttagaagtttgagaccagcctggtcaacatggcaaaatcctgtctccacagaaaatacaaaatgaaaaattggccaggcatggtaatgcatacgtgtgtagtcccagctacttgggaggatgaggtaggagagaactgcttgagcctgaaagatggaagctaaagtacgccaaaatcatgctatggcactctagcctgggcaataagcctatctccaaaaataaaataaaataaaagatttagtaaatacaaaatatggtacataaacatcatggaatactctgtggccattaaaaaaaaatgaccatgtcctttgcaataacactgatgaagctggagacaattattcttagaaaactaatgcggagtccaggcatggtggctcacgcctgtaatcccagtactttgggaggccgaggtgggataatcacctgagttcaggagtttaagaccagcctgaccaacatggagaaacccctctctactaaaaatacaaaattagctaggtgtggtggcatgcgactctaatcccagctacataggaggctgaggcaggagaattgcttgaatccaggaggcgaaggttgcggtgagccgaggtggcacaattgcactccagcctgggcaacaagaacaaaaatccatctcaaaaaaacaaaacaaaaaacaaacaaaaaaaagaaaattaatgcagaaacagaaaaccaaatgcatgttattatttataagtaagagctaagtaataagaacacatgaacacaaacagaacagacactgaggcctagttgaggggggagggtgggagcagtaagaggatcagaaaacatacctgttcggtggtatgcttagtacctcagtgacaaaataatctgcacttcaaacccccatgacgtaattttagttgtataacaaacccacatgtgtacacccaaccaaaaatcaaagctaaaaaaagaaaaaaaaaaaatccctgcgtgggagagagtgcaatgtaggtgaatggactgattttcattacagatagtggcccaggtggggctgttttctgatttatctttgtttgcatgcagacagatgagattataaccgggaggtccagaaccttaggttggtggaaaaaacaggttggtgcggcagattctgtatctaggggtggggatatgccaggagacctgtagagacttttgggttcttggcaagaaacgctaggatcaaaaatgccatggtgaagttcctgagggtggtgcccagtactgggaggagtgaggacatgtcaatgtctactgtgtgtgtttaggagtgggtgggaatcctgtggtggcagctacaagaaaacagggtctgtcatcagaactctttcctctaagttttcagtcttctgtcaccctggaagaagaccttaaatcacaggacaacaggcagtgtgacagcctgtgtacaggagagcagagcctcccattttcaaatacccagagctttgttccaggtctggccccagtgatatcttttttctggcaccaaatctatagagtttgctgaatatcaaacaattctccaacaccaactcattgcctaataattgaattctgacaccacctagagacagcacagaccctgatccagggctgggtcccacaacattgtcctcactgcagaggccaatcaaaaaccccataggcccatctatgcttctgagctactgtttgaaaactgaggactcccaaaacctccctgaagttcaataatttggtacagctacttacagaactcagcaaaacattgtagttatgtttaccggtttcatataaaagatgcagcccaggaaaagccaaatggaagaaatgcatagaacaaagagatggggaaagatgaaacacatagaaaatcctggaaaatatttgtgattaataaaattctccaccttttgtgtgctccaggaacagtatacggaaagaaacgcctttctcattatgacttagatggtgctctcttttcttacctatcacacagccagacacacactctgtacattttctcctttttctcattaagaaattcagctgaatttgtcttcagtggtcaaaataattttttttttttgagatggagtctcgctcggccacccaggctggagtgccttggcaccgtctcagctcactgcaacctctgtctccatggttcaagcaattctcctgcctcagcctcccaagtagctggcattacaggtggccaccacaactaccagctaatttttgtatttttagtagacacagggttatcaccatgttgaccaggctggtctcaagctcctgacttgcggtgatccgtccgcctaggcctcccaaactgctgggattacatgcctgagccatggcgctcagcctaaaatatttcttaatcaaactttacttaagtttatctccatccctcaggctagtgagggatggagataagccatctccaatgtaggagaaaagcccttttctgcctacatttttgcaacccatgaagattttttagttagctggtacttcttcctgttgcaatacttcttaggaattcattttttttttacataaatctaatattcttattttagaaagcgtaaaaagtgcctcaaaaccataacaacttcattaccagtaagaccctcccagtttcctttcatcttaatcttgactgcatctgcctgtggggccccagctttccaaggctttgtagcttctttcagaatgaaggctccttccgtggctggggtgagcagtcttgagatatccgcaagggagactccccagaaaaaaataacagggcctttaataacctcctgttggccgggtgcggtggctcacaccgataatgccagcactttgggaggccgaagcgggtctgaggcagagagttcaagaccagcctgacaaacatggagaaaacccgtctctactaaacaccaaaattagccgggcgtgatggtgcatgcctgtaatcccagctactggtggggctgaggtaggagaatcgcttgaacccagtaagccgagatcacgccattacattccagcctgggcaccacaagcgacactgtgtctaaaaaaaaaaaaaaaaaaaaaaaaataccctgttgcaggcttaatattagccttagcttggagtcactaggttcaagctttaatgtccacatcagttattcacttggtttttgaaactaagtgttagaaactccagtgaaattactcacaatgtttacataaaggaatttttaagatgcttactttttttttcttttttttgagccggagtctcgctttgtcacgcaggctggagcgcgatgattggatctcagctcactgcaacttccgcctcccgggttcaagcaattctcgtgcctcagcctcccaagtggctggtactacaggcacgtgccaacacgccgatagttttcgtatttttagtagagacgggtttcaccacgttggccaggctggtctagaactcctgaccacgtgatccacctgcctcggcctccgaagtgctgggattacaggcttgagccaccgcgcccagcaagaaaggggttttgaaccctaatgcagttcctgtttttgtttccatcccctattggctgggatcagaccgcacaatctaagctgatcctggtaagcttagacccaaactttttccaaataaagtaaatgcgcgatttgcgagaaaaggaaaagggggtagaagaagaggtagggttgatttacaacttttacaacttatgaccagaaagttgagtcatttaaaaggaacttagttgtcctaacacctctttacctcaagtgatccgcccgcctcggcctcccaaaacgttgggattacaggcgtgagccacagcgtccggccccatacatttttaataggagaaaagagaaactgtaaacccaaaggaacaaagctcttcccattcatgaacccgcaccccgagtcaggattctcccctgcccaccctcccctggtccctgcacaatctgggagagacgccacgctgcgggtgcagagctgcccagagagggctccaggccagggtagtcaccgcgcagtgaagagacaagacgcccgggtgccggctgtcagcgcagctgccattttatggctgaacaggactgaggccgagctgagcaaggagaactgggggagcagactgtggagctgactgcggggaggcctgagtcccgccacagccacttttcaccggttccaaccagtccctctcctctctcgggatgtcggaccctcactctcaccatttttggcttccaggaggtcccggtgtcttagctgtggatctcccaatacctgcaggacacggggccacacagcctgggcctttaggagaagaaccagacctggagctctgactgcagcgagagacaaaggccgcaccaaacccggaaacc

SEQ ID NO: 1999 - DNA, 41659 bp, Homo sapiens
ataataactactttccagttttattcattacaaatattaactaacatctttttttctggcttaaattattattcctttatgtgtcattttatacattcacacacacatagaacaataaaaatgtatccaattattcaattttggttaaatttttattaaaataagcgttaaaaataattttttgagtgtgtttgaagagggcttttattgttgtactcaagagtgttatttctggagacaaagttgcctgtgctttaatacacggattctggggagaatccgagccataagccataaaattttatattaataaattccatacaaagcagaaagtatacatttgctttcagcatattcaaggtgtttagttttccattaatcacctaaaaacttattttgttccaataattgcgttttcttctgaaaatatgtacaaatgcatatttaccaaacactcatttcataattttcttacacctaaggtttatcttcagaggaatatgtgtatatttcactctatgaaaattaaaagtctttacgtttgcaggcagagtgaccacatgttcaaagaaactatataacaaatatttattaataatttttcaggactcagaaatgtaattttttttcctttgaggagtctcatcactctgtcacccaggctggagtgcagcagcacaatcttggctcactgcaatctccacctcccaagttcaagtgattctcctacctcagcctccaggtgtgcgccaccatgactggctaatttttctatttttagtagagacagggtttcaccacattggcgaggctggtcttgaactcctgagctcaagcaacacacctgcctcagcctccgaaattgctgggataataggcatgaggcactgcacatggccgtattttttctttttttttttgtgacggagtcttgctctgttgcccaggctggagtgcagtggcacgatctcggctcactgcaacctctgcctcctgggttacaccattctcccgcctcagcctctggagtagctgggactacaggcgcccaccaccacgcccagctaatttatttttagtagagacagggtttcaacgtgttagccaggatggtcttgatctcctgacctcatgatccacctgcctgggcctcccaaagtgctgggattacaggtgtaagccactgtcctggcttttttctttctttttgagatggagtgtccgtctgtcacccaggctggagtgcagtggtgctatctcagctcactgaaacctccacctcccaggttcaagccattctcctgcctcagcttcccgagtagctaggaatacgggtgcaccaccatgcccaactaatttttgttgttttagtagagagtttcacaatgttggtcaggctggtcttgaactcctgacctcatgatctgcccgacgtcgcctaccaaagtgctgggattacaggcatgagccactgcgtccagcccatattctatttatatttctgtataatttttattatgaccataaaaatcaccctgtagtcaattacaatttaattggacatttaaaagtaactaaaagtgtataattacactgtttggattagaaaggataaatgctagaggtgacagataccttatttaccctaatgtaattactacatattgtatgcctgaatcaaaatattctctataagacatatatacacatactatatactcacagatagtaataataaattaagaaaaaagattaaaaatttaactaacgggaacaatattcttcatttgcagtttactggcaaagtgattactagtgatgacattccactacataccaaatagtatacttcttccatcttttgcttacaccatttgagtaaggccggataggttaaagttagtggcataataatgcttcattaaatgcacaatagttttaagatggtaaaaaataaaataaaattaggctggacatattggctcacacctataatcccaacactttgagagcctgaggtgggtggatcgcttgagctcaggagtttgagactagcctgaccaatatggggaaaccccatgtctattaaaaatataaaaattagccaggcgtggtgtcacgcacctgtagtccccactactcgggaggctgaggcaggagaatttcttgaacttgggaggtggaggttgcagtcattgtgctgagactgcactgctgccctccagcctgggtgacagagcaagactccatctcaaaagaaaagttaagtaagtaaataaaatataagttaagttcacacatcatctaacaatttttaaatatattgcattttattacgtaacagtaaaattagtaaaataattgatatactttaatttataatttctttctctcagtataatgtagaaaagtattactctgaacacctaccttaaacattacttaatataggttaactacaatgagcctctccacttatattttcgtcatgcatcttacattttaatgtccttactgttttatagaaaaggtcataaagaatgcccaactcataaagaatctctaatatctctgatgcagcaacaattgatcacatactttcacgtgaatataataaagtaacagcataatttgaaagctgtattacatcattcacttttcaaaaaaattgttttcaaggaaacaaatatactttcaatgtaaatacaaagcttcaaaaaatctccttttaaagttatatactaatttatacaaacttatatacaaatttaacaactttagttgtgaattcatttatatactcaacactcttatttaatgtaatgtctgaagtgtcagtgccttagttattctgtaaattctgatatttacatacaattaattttgaattaaatattttttcatgtttactgcatctgcaaaaatatattttagtataaactctgctgttttctaagctgtagttttttttttttaaagtgtttccaaattcattacatttgcaggacccttctccaatataagttctctgatgttgagcaaagcttgagcaactgcttcaggattttcctctagtacaaaatgtgtgtaataaacctcctgtatatttgtaatggttgtcttcagaataaatactcttcttcactttaaaggcttatattttctgaaagattttttgacagtaattgcacttttaatgctttcattaactatgaaccttcttatgttgagtaagatgtgagtaggcattaatgggttttccatattctttatatttgtacaatttttctcaaggataatagctttcctgcaaaataagatgtacacattgattaaaggttttgccacattcttcatgcttgtaggaattttgccagtatgaattatcttactatcaaatgtggcaaccatataaaggctgtttcacattttatatatttctagggtttcacactagtataaattttttatgtatagaaaggatggaagtgttgaaaaaagcactgtcacatctttcaggtttgtagagttcctcttcagaatgaattatcaccatgtctcttaatagtaagaacttgtggccaggcatggtggctcatgcctgtaattgcaacactttaggaggctgaggtgggtggatcatgtgaggtcaggggttggataccagcctgacaaacatggtgtaaccttgtctctactaaaaatacaaaagttagctgggcatgggggtgggcacctgtaatcccccttacttgggaggttgaggcaggagaatggattgaacccagaaggcggaggttgcagtgagccgagactgtgctattgcacaccagactgggtgacaagagttgaaactccatctcaaaaaaaaaaaaaaaaagacagaacttgttatatgctttgccacattcttcacacttgtagggtttctttccagtatgaattatgtgtaataaaggttgagaagttccttaaaaaatctgtcacattctttatatttgtagagtttatatttcatatcaattcttagttagaaattgagggctggttaaaagattttccccattcatcacattcacatggtttctctccagtatgaattatcttatgtgcagtaaggtgtgaggataggtgaaaagctttaccacattattcacatctgtagggtttctctccagtatgaaatctcttatgtgtagtaagtttagaggagtgcttaaaggctttgccacattcttcacatctgtagggtttttttccagtatgaattttcttatgtgtagtaaggttagagaaatgcttaaaagctttgtcacattcttcacatttgtagaatttctctccagtatgaattatcttatgtgtagtaaggtgtgaggaccgcttgaaggctttgccacattcttcacatttgtagaatttctctccagtatgattctctcatgtgtagtaaggattgaggactggttgaaggctttgccacattcttcacatttgtagggtctctctccagtatgaattttcttatgtgtagtaaggttagaggagcacttaaaagctttgccacattcttcacatttgtagaatttctctccagtatgaattctcctatgtgtagtaaggattgaggactggttgaaggctttgccacattcttcacatttgtagggtctctctccagtatgaattttcttatgtgtagtaaggttagaggagtacttaaaagctttgccacattcttcacatttgtagggtttctctccagtatgaattatcttatgcgtagtaaggtctgaagaccgcttgaaggctttgccacattcttcacatttgtagggtttctctccagtatgaattctcttatgtgtagtaagggtagaggagtacttaaaggctttgccacattcttcacatttgtagggtttgtcttcagtatgaattcttttatgtgtagtaagggtataggagtacttaaaggctttgtcacattcttcacatttgtagggtttttctccagtatgaattatcttatgtgtagtaagggttgaggaccggttgaaggctttgccacattcttcacatttgtagggtttcttttccgtatgaattatctcatgtttactaagggttgaggatgacataaaggctttgccacatttatcacacttgtagggtttctctccagtatgatttctcttatgtgtagtaagagtggaggagtgcttaaaggctttgccacattcttcacatttgtagggtttctctccagtatgaattttcttatgtctagtaaggctacaagagtggttaaaggctttgccacattcttcacatttgtagggtttccctccagtatgaattttcttatgtgtagtaagagttgagaactgcttaaaagctttgccacattctatatatttgaaaggttttttcccagtatgtcctctcttttgtccgtttgaatttggaaattgatgaaggactttcacatatttatcacattgacatatttttcttggggtagttgtcaaacattggttaagttcattataaccttctttgtgcaccttacactcatccacacttatacatcctttttttaactgtaaattgtcatgttcacatttttcatatcttctcagtaccactttttggaaagaatctttcatgctctgctctggccaaaggtcttgggcaaaatgagaacacattactgaaagaaacaataaaaacacattacttcaattggtagactcagataaatataaatatatatatgcagtttgtatagttttatacaaactacataagcaagatgacacaggaaaataccacaagctgtaatttcttcctggacatatgaatttaacaaaaacatactgatcaaaatacatttgtaaaaaacttataataagttgtgaagggccccaggtgagcacaatgcaaacggccaaatagaagaaatagaaaagtctgttacttatacacaacacagctggttttgctctccagtataacattgtgcctttaaaagtaaattgttgactggctggggtgacacacgcctgtagtcccagcatgttgggaggctgacgtgggtggatcagaaggtcaggagttcaagaccatcttggcaaagatgatgaaattcaatctgtactaaaattacaaaaaattagctgggtgtggcgatggggcacctgtaatcccagctactcagaaggctgaggcagagaactgcttgaacctgggaggtggaggttacagtgagctgagattcccagaatctctagttaagacaattgatttcagactatgccaggacacagctacattataaagattgtaacaggtagcattttgttaatgtaaaaatctcaaagattacaataaatacaaaatagtagagcaacgtgatcccatcaaaaagttataaaatttttaaagcaaccataaaatgtatatgaggtaatttaaaaaattcccaataagttgtacaggtcaagcttagtggctcattcctggaatcccaacacactagggggccaaggtgggaaaaccacattaggtgagaatttgagaccagcctggccaacatggtgaaaccctgtatctactaaaaatacaaaaactagctgggcatggtggcatgtgcctgtaatcccagctacttgggaggctgacacacaacacaagaattgcttgaacctgggaggggacagttgcagtgagtgaatattgtaccactgcacttcagactggatgacagagcaagactgtctcaaaaataaaataggctgggcgcaatggctcatgcctgtaatcgcagcaacttaggaggccaccttggcctcctaatttgaggtcaggagtccaaaattagcctggccaacatggtaaaaacccatctctgctaaaaatacaaaaaattagctggaatgctggcagccacctgtaaccccagctacttgggagacagaggccggagaattgcttgaactcgggaggcagaggtagctatgagctgagatggcgccactgcactccagagcctgggtgacagaaaaagactccatctcagaaaaactaactaaataaataaatttgaataacattaggtaagtgaaacaaacaagtactgaagataaaaatgaggataataataagaaatattgaaatagcaaaaaaacaaaaattgtggatataaaaaatgcaaaaaacaattgaaaaatttcttaaaaggaaaaatgatgtaaacatgaaaaagctgaagaaacaaactaggatacacacaaagatatttgtaacaaacacacatacaagcaaaccttcaaaaatcatagataagaagagaattttaggagctgtaatgtaggcagatgtaatgatgaagaatttttgtattcaactgaagtttattttttaccacattcaaatatattgttggatcttttagaggttttatgtaatctcccaaagtaccactaagaaaatatttgtatggatacacaaaagaaaatttaaaaaatcctggaaaaataccaatacaaaaagcaaaaaaccacgaaaaccacagaaagaaaaggaaagacaaagatataagaatcaaataaaacaaataataaaataacattagtaagtttttctctttcagaaaaccatttaaatatatatataattatctttccaatcaagagatatactttcaataaacaggtttattaaaaaattttaaaaatcaagagtcaacttgcctttctacaggagtcagttgagatctactgacaaaaaaagactgaaagtggcaagacagaagtagaatttcatgtaaatatatttttaaattttattattattacactttaagttttagggtacatgtgcacaacgtgcaggtttgttacatatgtatacttgtgccatgttggtgtgttgcacccattaactcgtcatttagcattaggtgtatctcccaatgctatccctccccctgcccctgacgccacaacagtccccggtgtgtgatgtttcccttcctgtgtccatgtattctcattgttcaattcccacctattagtgagaacatgcggtgtttggttttttgtccttgcgatagtttgctgagaatgatggtttccagtttcatccatgtccctacaaaggacatgaactcatcattttttatggctgcatagtattccatggtgtgtatgtgccacattttcctaatccagtctatcgttgttggacatttaggttggttccaagtctttgctattgtgaatagtgctgcaataaacatacatgtccatgtgtctttatagcagcatgatttataatcctttgggtatatacccagtaatgggatggctggatcaaatggtatttctagttctagatccctgaggaatcaccacactgacttccacaatggttgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtaattatcagcattttttcatctgtttttttggctgcataaatgtcttcttttgagaagtgtctgttcatatccttcgcccatcaaaaagatggggctgtttgtttttttcttgtaaacttgtctgagttcattgtagattctggatatttgccctttgtcagatgagcaggttgcaaaaattttctcccattctgtaggttgcctgttcactctgatggtggtttcttttgctgtgcagaacctctttagtttaattagatcccatttgtcaattttggctttcgttgccattgcttttggtgttttagacatgaagcccttgcccatgcctatgtcctgaatggtactgcctaggttttcttctagggtttttatggttttaggtctaacatttaagtctttaatccatcttgaattaatttttgtataaggtgtaaggaacggatccagtttcacctttctacatatggctagccagttttcccagcaccatttattaaatagggaatcctttccccattgcttgtttttgtcaggtttgtcaaaggtcagatagttgtaggtaagcggcattatttctgagggctctgttctgttccattggtctatatctctggtttggtaccagtaccatgctgttttggttactgtagccttgtagtatagtttgaagtcaggtagtgtgatgcctccagctttattcttttggcttaggattgacttggggatgcgggctctttttggtttcatatgaactttaaagtagttttttccaattctgtgaagaaagtcatcggtagcttgatggggatggcattgaatctataaattaccctgggctgtatggctattttcacgatattgattcttcctattcatgagcatggaatgttcttccatttgtttgtatcctcttttatttcactgagcagtggtttgtagtcctccttgaagaggtccttcacatcccttgtaaggtggattcctaggtattttattctctttgatgcaattgtgaatgggagtttactcatgatttggctctctgtctgttattggtatataagaatgcttgtgatttttgtacattgattttgtatcctgagactttgctgaagttgcttatcagcttaaggagattttgggctgagacaatggggttttctagatatacaatcatgtcatctgcaaacagggacaatttgacttcctcttttcctaattgaatacactttatttccttctcctgcctgattgccctggccagaacttccaacactatgttgaataggagtggtgagagagggcatccctgtcttgtgccagttttcaaaggacatgcttccagtttttgcccgttcagtatgatattggctgtgggtttgtcatagatagctcttattattttgagataagacccatcaatacctaatttattgagagtttttagtatgaagtgttgttgaattttgtgaaaggccttttctgtatctattgagataatcatgtggtttttgtctttggttctgtttatatgctggagtatgtttattgatttgcgtatgtcgaaccagccttgcatcccagggatgaagcccatttgatcatggtggataagcttttttatgtgctgctggattcggtttgccagtattttattgaggatttttgcatcgatgttcatcaaggatattggtcgaaaattctcttttttggttgggtctctgccaggctttggtatcaggatgatgctggcctcacaaaatgagttagggaggattccctctttttctattggttggaatagtttcagaaggaatggtaccagctcctctttgtacctctggtagaattcggctgtgaatccatctggtcctgaactttttttgattggtaagctattgattattgcctcaatttcagctcctattattggtctattcagagattcagcttcttcctggtttagtcttgggaggatgtatgtgtcgaggaatttatccatttcttctagattttctagtttatttgcatagaggtgtttatagtattctctgatggtagtttgtatttctgtgggatcggtggtgatatcccctttatcattttttattgtgtctatttgattcttctctcttttcttctttattagtcttgctagtggtctatcaattttgttgatcttttcgaaaaaccagcttctggattcattgatttttttgaagggttttttgtgtctctatttccttcagttctgctctgatcttagttatttcttgtcttctgctagcttttgaatgtttgctcttgcctctctagttaattgtggtgttagggtgtcaattttagatctttcctgctttctcttgtgggcatttagtgctataaatttccctctacacactgctttgaatgtgtcccagagattctggtatgttgtgtctttgttctcgttggtttcaaagaacatctttatttctgccttcatttcattatttacccagtagtcattcaggagcaggttgttcagtttccatgtagttgagtggttttgagtgagtttcttaatcctgagttctagtttgactgcactgtggtctgagagacagtttgttataatttctgttcttttacatttgctgaggagtgctttacttccaactatgtggtcaattttgaagtaggtgtggtgtggtgctgaaaataatgtatattctgttgatttggggtggagagttctataaatgtctattaggtcctcttggtgcagagctgagttcaattcctgggtatccttgttaactttctgtctcgttgatctgtctaactttctgtctaacgttgacagtgcagtgttaaagtctcccattattattgtgtgggagtctaagtctctttgtaggtcactaagaacttgctttatgaatctgggtgctcctgtattgggtgcatatatatttaggatagttagctcttcttgttgaattgatccctttaccattatgtaatggccttctttgtctcttttgatctttgttggtttaaagtctgttttatcagagactaggattgcaacccctgcctttttttttgttttccatttgcttggtagatcttcatccatccctttattttgagcctatgtgtgtccctgcacgtgagatgggtttcctgaatacagcacactgatgggtcttgactctttatccaatttgccagtctgtgtcttttaattggagcatttagcccatttacatttaaagttaatattgttatgtgtgaatttgatcctgtcattatgatgttagctggttattttgctcgttagttcatgcagtttcttcctagtctcaatggtctttacattttggcatgattttgcagcggctggtaccggttgctcctttccatgtttagtgcttccttcaggagctcctttagggcagacttggtggtgacaaaatctctcagcatttgcttgtctgtaaagtattttatttctccttcacttatgcagcttagtttggctggatatgaaattccgggttgaaaattcttttctttaaaaatgttgaatattgatcctcactctcttctggcttgtagagtttctgccaagagatcagctgttagtctgctgggcttccctttgtggataacccgagctttctctctggctgctcttaacattttttccttcatttcaactttggtgaatctgacaattatgtgtcttggaattcctcttctcgaggagtatctttgtggcgttctctgtatttcctgatttgaatgttggtctgccttgctagattggggaagttctcctggataatatcctgcagaatgctttccaacttggttccattctccccgtcacttttagatacaccaatcagatgtagatttggtcttttcacatagtcccatatttcttggaggctttgttcgtttctttttattcttttttctctaaacttctcttctcgcttcatttcattcatttcattttccatcgctgataccctttcttccagttgatcgcatcggctacagaggcttctgcattcgtcacatagctctcgtgccttggttttcagctccatcaggtcctttaagaacttctctgcattggttattctagttatctattcgtctaattttttttcaaagcctttaacttctttgccattagttcgaatttcctcctgtagcttggaatagtttgatcatctgaagccttctctcaactcgtcaaagtcattctctgtccagctttgttctgttcctggtgaggagctgcgttcctttggaggaagagaggcgctcggatttttagagtttccagtttttctgctctgtttttttcccatctttgtggttttatctacctttggtctttgatgatggtgatgtacagatgggtttttggtgtggatgtcctttctctttgttagttttccttctaacagacaggaccctcagctgcaggtctgttgaagtttgctggaggtccactccagacactgtttgcctgggtatcagcagcggtggctgcagaacagcggattttgctgaaccgcagatactgctgcctgatcgttcctctggaagttttgtctcagaggagtacccggccgtgtcaggtgtcagtccacccctactggggggtgcctcccagttaggctacttgggggtcagggacccacttgagaaggcagtctgcccattctcagatctcaagctgcatgctgggagaaccactactctcttcaaagctgtcagagagggacatttaagtctgcagaggttactgctgtctttttgtttgtctgtgccctgcccccagaggtggagcctaagaggcaggcaggcctccttgagctgtggtgggctccacccagtttgagcttcccggctgctttgtttacctaatcaaacaactaactcggcaatggtgggcgcccctcgcccagcctcgctgctgccttgcagtttgatctcgggctgctgtgctagcaatgagtgagactccattggcgtaggaccctctgagctgggtgagggatataatatcctggtgtgccgttttttaagcccgttggaaaagcgcagtattagggtgggagtgaccaaattttccagttgccatctgtcacccttttctttgactaggaaagggaattccctgaccccttgcacttcctgggtgaggcgatgcctcgccctgctttggctcgtgcacagtgcgctgcacccaccatcctgcgcctactgtctggcactccccagtgagatgaacccagtaccccagttggaaatgcacaaatcacccatcttctatatcgctcacgttgggagctgttgaccagagctgttcctattcggccatcttggctcctcccccctcatgtaaatattatcaaaacaagaggagaaggggtcaaaataatgttacacaagctacaagttaagttaaaaactgtcatactttataaagtgtatttaagtcaaaacttcaaaaagacaaagaaggacattagattcattcactgggaacctattacaaatttgtatatacatgtgtgtatttatgtgtgtgtgtctcatattggggtttcagctatataaagcaaatactaacaaaactgaataaacacaaagagagcaatacaattatagtaggatatttcaatactccactttctgtaataaaacaagagagaatattagtaaggaaacagaagactagaaggcagtaaaaaaacaattatttctaatgaaggtatagagaacactcctcgacaacatcaggatacacagccttctcattacctcatacaactttcttctttatagaccacctgttaggccaaaaacaaagccttaacacattttttaaaactgaaattttatagatcactttctatgacaaaaatggaattagagtataaaacaataatataaataattgataaatttaaaaatatttagaaatgatacaacacagtattaagcatgcacttgttgaaataactggctgggtgcggtggctcaggcctgtaatcccagcactttgggaggctgaggtgggtgaatttaactccatctcaaaaacaaacaatcgaaaaaggagtaatattgtgaagatgtctatactgttcaatttaatctacagaattaatgcaccatttttcaaatttctcattgcacttttgaataaaaacagcaaatccaaaagtatatggaatctaaagagttaataaagtactcaataatcttcaaggaataatgttggaggcattacaatttctgatttctaaacacatcaaaaagctacagaattaaaacaatttggtatgagtataaaagtgaaaaagtagaacaataaaacagaatgcagcacatatgttagctttcacataattattgcagcattgttactgaaagccaacaggttaaaacaatacaaatttctgtcatcaaatcattcagtaggtagaaaaatactggaatctcattcagttttcaaatagcagaaaatagtctaactattaagataaatattgatgacattatgcaaaataaaataagccagccagaaaaagacagagattatatgagatatgtaaagcagttatactcctagaaacagaaaacagagtggtgtttgaaaagtgccacgaaattggatgaattggtagttgtttaatgtgtagtgagatttagctttgcaagataaaaacattctagtgatgttgcataacaatgtctatataattaatatgaccaaactgaatatttagaaatatatacttgtcactctaactctcaggcaaaactgcagtggcattatctcagctcactgcaacctccgcctcctgggtttaagtgattcctctgcctcagccttctcagtagctggaattacaggtgatcaccaccacgcctggctaattttttgtattttagtagagacagggtttcaccatgttggccaggatggtctcaatcttctgacaccgtgatccacccacctcggcctttgaaagtgacgggattacaggcataagccaccgcgcccagcctagaaaattttattgttaattttgttatgtgtttttgacacataacgcataagtaaaaataaacaataatacctaaaagagatacagagtaattattgtttttaaattatcttcaaatccaaaaatgtttctctggcacaaaattaatatagattcaaaaataaatagacgctgaaattgggagagattttatgactactcacctagacaggattaaaaaaactgttacaggccaggcgaagtggctcatgcctgtaatcccagcactttgggaggccgaggcaggcagaccacctgaggtcaggagtttgagaccaacctgaccaaaatggtgaaaccctgtctctactaaaagtacaaaattagccgggtgtggtggcacattcctgtaatcccagctactcaggaggctgaggtaggagaatggcatgaacctagaagttggaggtttcagtgagctgagatcccaccattgtactgcagcctgcataacaagagtgaaattccctctcaaaaaaaccaaaaccaaaaccaaaaccaaaaacctgttacaccatacctataaaacaaatatacaagtgacacaaagctacagggataatatttatacaggcaaagaaacacagaaacaattatattggcaatagatacatggctttttcatatttaattttgctcttcactgtcttaaattgtacagttaaatattgttacatacaattataaactaaaaaatatattgttatatacaattataatataaactaaaaaatcaacacataattaaatgatgtgatgtgacattcccaaaaatatataacacaaaatattaaattacaaaaaaattaaaacatgggatgtaaaacaagtagatcaatgtattcatgaaaggactcttaaaatataaggtaaagtaatacagaggttacttgaagatttaaaaaaaaaaagctgagaacttcccaaattttgatgtaacaacaacaaaaacttctaaccagtaatactcgattcaaaattattttacttcaaaaagaatataaaaataaagactttccaaaataaaagttgagactgttcatcaccattggcacagtcctacaagatataatatacagggttgtgctccctggctcacgcctgtaatcccaacactttgggaggccaaggtgggtggattgtctgaggtcaggagtccaagaccagcctgaataacatggtgaaacaccgtttgtactaaaagtgcaaaaattatttgggcatggtggcacattcctgttgtcccagctactgaggaggacaaggcaggagaatttcttgaatcaaggaggtggcgactgtaatgagccaaaatcatgccacggtactccagcctgtgacagagaaagactccatctcaaaaaaaaaaaaaaaaaaaaggcccagtgcaatggtgcccaccacactccatcctgggccatagagtgagactcaatctcaaaaaacaaaacaaaacaaaacaaaaaacaaaatcgaaatgattattcataaaacctttaaagttcttttatagaatataaaaaacaatatgtaaatgtgcataaatcggctgggcgcagtggctcatgcctgtaagcccagtgctttggaaggccaaggggggaatcacaaggccaggacttcgagaccagcctggccaacatggtgaaaccctgtctctactaaaaatacaaaaattagccgggcatagtggtgcacacctgtaatcccagctacacgggaggctgaggcaggagaatcacttgtacctgggagatggaggctgcagtgagccaagattgtgccattgcattcctgcctggacaacagagtgacactctgtctcaaaaaaaaaaaaaaaattctgcctaaatttgttaatataccatataaaataattttaatatcaataaaaaactggaaaatgtagagacatagtttttgtattaaattgaagttgttataaaattaaaacatattgttttaactttaagatgtatgtaatctccagctttcaagatgattacaaagataatatttatagaaagtgtgcaaaagaaaataaaaaataatgcatgccagtacaaaattaaataaaaattaagaaagtaaaacaggaaatgagaaaaataaaactactagaaacacacaaaacaataataacgtaactggaaataacaacttcatttctttaagcaatcattttaaatataaattaattaaactacttaataaaataaaatgtaatcttaggactttggaaggccaacgtaggctgatcacttgatcccaggagttcaagaccagcctgggcaacatggcaaaactctgtctctacaaaaaatacaaaaaagctatttgggtgtgatggcacatactagtaacccagctacttgagaggctaaaatgagaggataatctgagtttgggaggtctggatagcagtgagacatgcaaatcagcctggttgacagagtgaggccctatttcaaaaataaatgaggccaggcgtggtggctcatgcctgtaatcccagcactttgggaggccgaaatgggcagatcatctgaagtcaggagttcaagaccagcctggccaacacggtgaaaccctgtctctactaaaaatataaaaaaattagctgggcatggtggcgggcacctgtaatcccagctactctggaggctgaggcaggagaattgcttaaacccaggaggtggaggctgcagtgaactgagattgcaccactgcactgcagcctgggcaacaagagcaaaactgcatgtctaaataaataaataaataaataaataaataaaattatatagagaaaaagaaatagaaagcctgagtggtttttttaaaaagcaatcagtatgctgcctataagagactcattttagcattcagtcaaataggctgaagtaacagaatggaaaaacgtatattccatgaaaatagtaaccacaattgagtggggtagtcataattagacataacatgctttaagtcatgtactactatgagacaaagactgatattatattatgacaaagttagttgatgtagcagaaatctataactataatatttatctttctatatgtatatgtgtatataacatcagggctccaaaatacataaagcaaatattgacaaaagtgaaggaagacatacatagcaacataatcattgtagacatcaagaccccatttgcagtaaatggaaaattcagaaaaaaaataagaaacaggaaacttagaaaacattatagactatgttatttattttgcaaatagaggaataattgagagtacgttatttataacaaaaaggggtatatttggctcacagtttggcagactgtataagaagtgtgtgtcaacaactgcttctggtgaagatctcaggaaacttacaatcatggtgaaaaataaagagtaactggatgtattatatggtaagagacagagcaagtgtgaggtgaaggagccaggttcttttaaggaacctactctcatttgaatcaatagagcataaactttttggttaccaagaaaatgtaccagccattcatgagaaatttgcccctgtgacccaaacatgtcccaccaggtcctacatccaacattaaggatttatactgcagcatgaggtttggagaacatggatatccaaaccatattatagaccaactaggcttcacagatgcatacaaaactttccagtcaaaaccaagataatacaaaatattcttatttgcatctggtgtattctgttaggacacataccaagttttattaaattcaaaaatactgattgggtgaaatggctgttgcctacaatcctaacactttgggagatcaaggtaagaggatccattggtgccaaaagtttaagaccagcctgggcaacgtagtcagatccgaacactacaaacaaaccaaccattaaacagacatctagtgcgtatctgtagtcctagctactcagaaaactgaggtaaaaggatcacttgagcccaggaggctgaggctacagagagccaaaattatgccactgcacttcacacgaggtgacagtaaaatcttgcctcaaaacaacaaaaacaatcatttaaaaaagactaaaattacacactgtgtgttttctaataaaaactgaatgaaactaggaattaaaagcaaaagtcaaactggcaaattcaaaactgtgtatatgaaacacactcttcaacatattcttgctcaggggtcaaaaaatttcatttttcacaaaatgtcaataaaatctagagttaaaagctacagaacataaacaatgtgatactgacacaaagataaactgatgaaagaacagaatggagagctcagaaatgaacccttctgtatatgatgaaatgatcttccacaaagttgccatgagtaaaaaatggagaaaaataatctcttcaaaaaatgatgttgaaaagtgaatatcaacaccgataaaataaagttggattatttccttgaatgttacaaaaatatatttttaataaaatattatttaaaatattttaattttttaatattaaattcaattatttaaataattaaattattaattttaattattaaaattattaatttaattattaaaaatagtttaataaaataactaacaaatcttttaggaaaaaatacgggaaaaagacatgacactggtttggcacaattttcttagatacaaaattaaatgcctgagcaacaaatgaaacagaaaagtttacactagacttcaaaatttctgcatattagaaacaattcaagagtaacaacatcccttagaaaatgggtaaaacatttgcatattacatgtgacagaaattaatattcaaaatatataaacaacccttaaaactaaacaatgatgaataacttaatttagaaatggacaaatgaaatttttattagaaaagtacacaaatgagaaaaagcatttgaaaggacacagaaaattactagtttatagagaaatgaaaaaaaaaaacacaatgacaaacaaaatcacctcacacacattagaatggccactataaatttttttaaaaacaccaaatctgttgatgatgcaataaaaatgaaacctaagttgaatgttggtggataacaaaggtgcagtcattattttaaaaagttataaatgtttctcatttataaatctatatccaaaatacgtaaaaaaagccaggcacagtggctcaagcccgtaatcctagcaatttgggaggccaaggtaggggcagatcacctgaggccaggagtttgagaccaggctgtccctgtctctactaaaaatacaaaaaactagctgggcatggtcgtgggcgcctaaaatcccagttacttgggaggctgaagcaggagaatcgcttgaacccagaaggcagagattgcagttagacgagaccacaccactgcactctagcgtgggtgacagagtgagactccatctcaaaaaaaaaaaaaaaaagcaacacaggacctggaagacatatttgaaaatctatctttattataccagtattcaaaaaagccaaaaggctgaagcaacccagatgtctcttgatttaaaaatacgtcaaaaaatataacatatacataaaatggaatattattccaccttaaataaaacaatcttgtcacattttaagataaacattgagaatattatgtcacttgaataatccagtaacaaaattatggatactgtacgattccacttatatgagataccttaagtagtcaaaatcataaaaatagaaagtggaaattttgtctgtcaagggctggagagagggtaaaattagcagttgttatttcatgggtattgagttttagttttgcaagatgtaaaatttctaggagtcttttgcataacaatgtgaatatacttaacatgcctgaaatgaacagcttgtttattttgagacagggtctcactctgtcacccaagctggtgtgtagtggcacaattttgactccagctcaatctcccatgtagctgggaccacagctgcacaccacgatgcctgactcttattaatttttttttttatagaaaggggtctccatatgttccccaggctggtctcaaacttctgggctccaggaatcctcctgtcttggcctcccaaaatcctgggattacagaagagagccacaaccatgcctggccctgaaatatacacttcaataaatttaagatggtaaatgttatgttacgtgtttttaaaacaatgtttaaaaaaaaaaactgaaaaaaatccagaattattaatctttttgaaaattaccttcaaatcacaaaactgtttctctcacaaaaggaaatatatattcatcattaaacccatgttgaaaataagactatcttcatgactactcacttagacaagataaaactaccatcaaaaatcagctaagaatataagataagccataactaaaactggggtcatatttatagataaacacacacatacatatgtaatctgattgtgatagacacgtgcaatttatctcttaagcctcaaatggacttaaagtgtacaaacagaattgcaaattctctaaaattataatacataagtaaaaccaataggcacaataaactgatgttaagaaacctacactgagaccaggcgcagtggctcatgactataattgcagcactttggaaggccaaggtgggcagatcacaaggtcagaagtttgagattagcctgaacaatatggtgaaacaccatctcgaataataatgcaagaattggccgggggtggtggcgtgcctgtagtcccagctattccggaggctgaggcagaagaatggcttgaacttggaaggcggaggttgcagtgagctgagatcgcgccagtgcactttagcctgagcaacatggcgaaacttcctctcaaaacaacaacaacagcagcaacaacaaacaaaaaaactacactgaagaaacatgctaatacagaacttcaaacaataagacaaatgtttactcataaaatctggtgtaacacatggaagtatcattacgaaaatttgtcaggccaggcgcggtggctcatgcctgtagtctcgcactttgggaggctgaggcgggcggatcacctgaggtcaggtcaaccagtctgtcaacatgatgaaaccccatctctactaaaaatacaaaaattaccaggcatagtggcacatgcctgtaatcccagctacttgggaggatgaggcatgagaactgcttgaacccggaaggtgaaggttgcagtgagccaagatcgcaccactgcactccagtctggatgagagagggtaactccttctcaaaaaaaaaaaaaaaaaatttgttgaagtaactgcaatctttaactagtattatgtactcatcatatacaggtattttgaatcattggcatgcactgtgtagcagtaaaattttgagaatatgcagtataattataaatagattctaatgagaaacttaataaattagcatttaaaagaaactggagtttctttttatgttttaaatatatgctattcttacacaaaacgaaactgctgtattctaactttagaagcaaagaatagccttacattgttaaacacagaaaaaaatatatatatattttggagaatagggttagaccctctgatatgtaaaacaaatattaggaaataaactcattatttatatacagggtgaagaaagtagatgaaaattccataattttataactacttataactagtaactatgtttatatttagtaactattttcataaatatggagtgcttactaattatctaatttactttcagcataccatgcaaattctagcatattatcctaaataactgaatctaaaattacaaatttgaaatagaatatagaaagaaaaaaggtataaggagagtgacatcagtaagatgaaaataataaaagtgctctattttcatatccccttatagcaaaaaaagtcagccatccctgaccaaaaatgactttatgagacaaccaggcattatggttcacatctgtaatgacagctacatggtacattactgttggagagaaatgcttcaggccaggattttgagaccagccttggttatgtagcaagacgtcatctccaaaataagtgcctctaagagagatgtgagatccagggatgcagttgtgaaaccctattaaagctgaagttcgagacgtgttctattcagaaggcaggccctcattcaggtgggaaattacaggacccctgttcttggctacagaccaggatagggttcacccaacttggtcccactgagaattctgaacttactctgtagccaccacaaactcctcccaagccagagtctggcagaggtcctgctattccagagacctggaggaaggcatctatttacagccatgtaggcaggcctgcataccttggcctttaccatggtccctgaaacagttcactgactcagtttccgttacacgagccacagttcatggtcagtcctgcctatatagaaacccacacagttacctgaggaaatgctctctggtactcactgaaagccacactcatccacatcctgatttaaggcccagcatctgcagacctgactgcaaaaacatgccctagtgtctgccctacagagcaaagtcccgaaggatatgcagtctgtccaaaaataaaatggaaattacaactacccaagcccctgtaacaagccaactgaagatgaaacctaatggagacccagcagccttgtgaccaagctacaacccctcttcactacaaattcagagggcatctcatcaccctaagggcccaataaaagaaaatctttacaatctaaaatcagtttatgaaaacttgaagaggtgtctgctccatcaaattcaaacaccaatacaaaactatattgtgcccattttcaatgcttctattttaatgtagcactggaagtatgggcagaagaattagtcaaagaaataaataaatccattgaaattaaaaaataagtaatcttatatttaaaaaaccataaacagtacattaaaacctctctaaactaataaatacactcagtaaattagcaaaatataaaattaacatacaagtatatctatggtttcatacacttaaactatctgacaaaatagaggaagaaaattttattgactataccttaaataataaatttctgaggaaaatattaaccaaggaggtaaatctttacaataaaaaaaggaaaagttagaaaagatacaaataaattttaaaatattttgtctatgaattgaaaacatgaatattattgaagtgccatattatccaaagtaatctatagattcaataaacttcctattaaaattgcagtggtactattttcacaataatggaaaatacaattcaaaaatttacatgaaactaaaataaactttgaatagccaaagcaatcatgaggaaaataacaaagaggaaggatgtcataatttcaaactatatatttcaagcctagatagtaataaaaacagaatggactgtgcagaaaaatgaacaaaaaaaaattcaacagaaactattactctcagacatttcagatctgatgcaaagagaactttgagagtaattttagtttctcaaaatcatgcagacatttgtgcgtcccaaaaattatggaaaagcagccacactgtgcagtctcttatatgtcatgaagaggactttggctctcactgtgaacttgaaggaagctcactgaaagaaaaggaaaatccttagagaatttaaaagcataagacagaagatgcccctttgtaagcaaaattaaaaaagaaaaaaccaaacaaacaaacaaacaaaaaatagctgcccaagaactatttcctttggaacacagctccccaaatcacactttaaggactggctttctctttgaccttgggaccccttatctgtgtcatctgttgtattcattttcactcacacctacctgagggtttggctatcatctcatttctcttcatggtcaaaggttttcttccttgctccagacaggtgatcaggtctggcttagaaacagtaatacctgttttattaaaaataaataacataaatcttgcttatgttctccaattacaagctagtaatgtgctcagcacagaggatgtgataaaatattctagtaaattaatacaaaaatactaagttgtaacagaaatttttaaataattagaaaatactttcaatttgtaggtttcttaattttactacctggtgctactgaatcaaaaattggtggtggcaattagattttcaggtggagcaacaatattttatgccactaaatttctggaattaccactaatttagagtgaaaaatacagctcaactcaggaaagtggaaagtttggattaagataaaacatgttgaagaaattcttttctaaacgaacaaattctgaagattttctggaaaatggggatctgaaactcttttatgcaaagaataaattactaaaaaacattctacaaaaaataaataaataaaatctatagggtatattatgtactcaagttatcctcaccaaggaagaccaggttactgtagttctctaacatcacattcctatataaattccgctgtgcagtgtccaggcaatgccactcctccagagagaattctatggccacatctctaaattgcaatggtccctgaaaaacacacacacacacatttttaccaagtggccatgggcggaatttttaatttgacttaaggtgaaataagagagtaaagagaactggttctgacttataggactgactaaaattatccaataaaatgatttcaaaacagaaatattctctaatgtattctctaactctgagaagaaagagcagcataagatccacaacatcaattcatgtatgtttctagataataaagtataaaattaagggcaagaacaggaacatgtaaatttttcagtgctatagttacattatacagaatgagttgtgaatatttttcagatggaaaagacatgtttagttagaaggcatctctaaagttttaatatgtacaataagctgaagacatcgttatgcaggttttttttcccccagaagatctggaataaagtctgatttatttatttatttatttatttagagatggagtttcgctcttgttgcccaagctggagtgaaatggtgccatctcagctcaccgccacctccgcctcccgggttcaagcaattctcctgcctctgcctcctgagtagctgggattacagacatgcatcaccgcacccggtaatttttttcgtagttttagtagagatggtgtttatgttggtcaggctggtcttgaactccctacctcaggtgatctgcccactttggcctcctaaagtgttgggattacaggtggagaaaccacacctggccaatgtggtgaatttctaataagctcaacagtaatgccaatgtctttggcccaagaaggatattttgtcaaacatttagtaagtggaacagcctgtgtttttcccactttttctagcctgtaaacaaacagccctcatttaccaaagaaacatgtgtagaaaaaaaaataaggacagttgccagattaaatgtgatggtttatgcacatcagctgcataaagatacgtaataataaagaggaaaaataattaactctatagtgaaaaaaatatgtcccagagatctttaaccaattaattaatggttaatgcattaactgttaactgcactaggacaatggttttttttttttttttttttgagacggagtcttgctctgtcgcccaggctggagtgcagtggcgcagtctcggctcactgcaagctccacctcccaggttcacgccattctcctgcctcagcctcccgagtagctgggactacaggcacccgccaccatgcctggctaattttttgtatttttagtagagacagggtttcaccgtgttagccgggatggtctcgatctcctgacctcgtgatccacccacctcggcctcccaaagtgctgggattacaggtgtgagccactgcgcccggcctaggacaaatttttatgatgtgctaatgcacacagaagaacacagcatcactgttgtaatattcctcccaaaaaaagtaaattatagtccgaatgtaaccataaacatcagttttaggccaggcatggtggctcatgcctgtgatagcaatttgggaggctgcggcgggaggatcacaaggtcaggagttcgagaccagcatgactaacatggtataaccccatctctattaaaaatacaaaaattagccgggtgttgtggcaagcacctgtaatcctggctactcagcatgctaaggcagaattgcttgaacctgggaggtgaaggttgtggtgagccgagatcatgccactgtgctccagcctcagtgacaaagccagactccgtgtcaaaaaaaaaaaaaaaagaatcatcagttgtatacaaactttaaaatacagaaaactctatgttcagtaacttttagtagtaattttaagtaggcttcatttagcatcctaaagagcaggtatctcctaataatttttttcagaactttctgggtaataaatgccatcccatttaaataagcattttcttcttcttcttcttcttcttttttttttttctgagatggagtctggctctgttgcccaggctggagtgcagtggcgcaatctcggctcactgcaagctctgcctcccaggttcacgccattctcctgcatcagcctaccaagtagctgggactacaggcgcctgccaccaagcccagcaaattttttgtattttagtagagacagagtttcaccatgttgaccaggatggtcttgatctcctgcatgatccacctgcctcagcctcccaaagtgctgggattataggtgtgagccacggcacctggcctaaatcagcattttcttaatcctcttctgcatagagctaatggaacacacagctggagcctcaacattacatgttctccatctttactaaggaccacagttttccccaatagaaatcttgagtatccacatctttccatgttcaacagccacaaagggaacatttttaatattgcagatcataaattcttgctgagaattctgcatggcatataagaagctatgatgcggagaataaggagaaggctctgaaatataggaaagaaatatttttcagactcttgactatcgtaagaatttaaagaagtaattaagccaaactcattagggaggaaaaacacaagtagacaagtaaaggtttgtgagtactaaacgcatggcagtccaggaggcagagtcgacatagctcttcatctgacacatgtttacctgaagaaaagccacttttttttctttctcctccttctctggattccttctcagatgagattctctagacaagttacacctgttatcttgagactatgtctttaaaggtgtcagtaccacatgtttacctgctagcataacatcaactggcagaaaaataaagacagaaaaagtccacccatttctgtcctttacaacagaagacattcaggaacaatgagctgctccatgaagataaaaatataaatttctctttgctgtcctcagatgctctcccctgccacggacaccagccatttctgctacagtaatggaaataagcgccacactgacttgtccctaccaaacgcaaacagaacaggccctgtgaccaccctttagggcaaaggtggaacttaactctcatgaatgtattttgaacccctcatacttggttctggtctcaccttagagtcacataagggactccatggatgcttccacccagaacaataaacagaagctgtgcggaggacacaaggaatttctgcaaattggccatgtgattctaatgagaagcctgggttgataaccacggagctaagcattttctctcaagctttaatgagcttataaatcacttggtaattttggccccaatttatgtaatgtgactctggaggtttgaaaagggtccatgaatgggtgttttaaacaagttccctttcaatgctgatgttgctccccccgccccttggcgcattagcattagttagagaaagcaggtacagcacaaggtctcttattacttagcactcttgtcacaaccaaatacttctcgtacaaataaggacaacccatctccatccaaaagttttatatcctttgctggttctttaaagtttacagaaaaaacagaaggcagcaatgtctgaagaagtctggatttaaaaaacaacatgtacacacgtactaatgcaatgtttattaagcaggtactatgtgctcaagagtatgatacagagcactgtgctgggcgtaacatattacgtgatttaattctcataacaccctgggagccggtactaagtgtatgataattttcaggatttaggtaaagggcccaggatttttattgcttcttctgtttctctgccatcaaatttgttaaaaaaaaaaaccataaaaaattaaaactaaatatagacagatgaaagaaatatggaaggcaagagtttaatgtagttcagagaaaattttattctgtttatatttacatttttgtgacttgtggagcaattactggatatgcaagaatggaaaacaagtccctaaatagaatgtctctgcaaacactggttttaatataaaatttaaaaactaagaccctataacacataatttatttttcccatttatctgcttttggatttcaggaaattctaagcaccagctctagaaagacaacaggattcaccagccaaaactctgacctcttctacctgtgagacaagactccagggtagggtcagacgtaaataaggcctccaaaaagggtgaatctcaacagaactgggtcaggaagtggaccctatgtagaattctgttctctatgtcactggggtatttccagttttgttttttctaaacttacctaaaataaacttaaatcccagagtctgtgtaattttaatcttttccagccactgccctgtcaactttatattatatgctaatatgcaatttaaacaaatcccttaaggttttcaagggtaagtttattaggaaacaaatatgttcacttaacaggatgaaagaaatagaaatacggctgggcctggtggctcatgcctgtaatctcaacactttgggaagctgaggtaggtggatcacgaggtcaggagttcaagaccagactaaccaagattttgaaaccccgtctctactaaaattacaaaaattagctgggtgtggtggcaggcacctgtaatcccagctacttgggaggctgaggcaggagaatcacttgaacccaaatgtcagagtttgtggtgagtcgagattgtgccactgaactccagcctgggtgacagagggagactccatatcaaaaaaaaaaaaaaaaagaaattataacaacaattcttctgttcataaatatcctttcaagtacagacatcagaagtcacaacaatataaagtggcaaataatgtccaatattttggacatatctatttgttataccaaccatatgatgcataattcaagtatttatctagttgctagtctagactaagtttctggattgtaggaaccatggctgcttcatgttttattttaacggtcatatgaaatggaagctactagtttatctgtttgggtctccagatctcctccttgtttatcatcccagtaccaggaaactggagaaactctcatctgggtaccaacctaagacacctcttgtatgaggggatgaacaaacaggatgattcatttctcttacactgagaaagaagcagaattaaccactcttgtcagcctgacacaattctgctctggacatcctcaaatgtctcaaagaccactagatgattgtgagagaattcccagtgacctggggctggtggcccaatgataagccaggctagagactcaggctgattctaaataggaaatagaactgccttggtggagctacagaacctggatcacctgtcctgatttgctagctcttgtgtaagagaaagaacacaaatactctactccagtatcacattttacaggtaaatatagttgtggtcataactggatattttgtggccttgttctctcactcttaagatgctttttttttacacttacacatattctgtcatcagattctatttccttctggaggttctcacatcactgtagcaggtcaatgaacaagatgtgaaaaatctcacagaaccacactcccaaatgggagctgtaagctgtctaggttgacatctcacaatgcagaaaatgccttttcttagttttctgtacattctctatccaaagtccggtccttttttgtaaatcccaggcagaggccagatgttatctgcagattctaggtaggatccacctggctctgcatcctttggtgttacagcaagtggagtacaaacgaaggagagatcccccccatagaggctgctctagcacattctaaatgataagtctacatgaaaaaaaaaaaaaagctgacacaacatgaatataagtagacagtttatttgggtaaagtttacagattatatataacctgcgagcaaagattaaagttgcctggaatctacactttgagtagcagcatttacaagaagatttgtaaagacaataagagaaacacagagtgggcaaaattgtttgtcagaaatttctatttatttacaaaaataacattgattattgattagatacatatcattatagtttagggtatgggatatagtgtccaatgtagcattattagtttaatttatagctacatgtggcaatagtgaacagtctcaaaagatgaatacagaattcaaagggaggagaaagacataattgcacttttattttaacgtctctgagtttgataactaaaaggacttgcatttttcagataaaagttttttaattcccaaatctcaagacctggattcaaaatatggagctgcagatttagggcttgagtggctggagtagcacgcatgttacctgcacatttgtgagctttttagcaagagaaggaagaaagaaatggagattttcttgtctacatgtctactcactacacacgttactctacttgggtttgttggccccatggtctctgaatcagtttcaggtttgaagataaaagagtcactgaaagaggtaaaatgattgattgctgccctgtgaaatttatagaaatctgatctagactctctagaagtgactgtagaggactatagataagaaataggcagaaacacaattcggcctgcacatttagggtatggcatgcacttttctgcacaagtgtgaatttactggaagcctgagagggaatgtcccctcgagtaaattctggttggcccttatgtgtttatatcatgtctggtaattctagactgtttggaaacaataattaaaagaaaaattttctccagccccagagaaactccacaataacagaacagaaagaaaatggttttattacacaattaaacttgaatgtgacatgcatcagtcaatctgcttaagagactgcaaagatagaaagatggtcaccataattagttcacaagtagaagaatttccagcaccatgtcatacatagttcatcctaaattcacctggagattgaagaggacatctgtgtatgctaattacttatattcaatgacaaataaacttttcacctctttataacaggtggtagtttagcaggataatcgcttgaacctgggaagcagaggttgcagtgagcccagatagcaccactgcactccagcctgggggacagagtgagactctgtcccctgccctcccagcaaaaaaaaaaagaaaaagaaaaaaagaaaaagaaaggaaaagaacagggacatattttcagaagaattttataaagtttcatttccatctctgctgttctctcctctcctagccattgaatgggggtctatattgaaatacatcttacaacttccaacaacacattttgatgaaaaaatagaatctgactgtgttcatatactggaatatattagaacttgcaacatagctaattgaagagctactatagtttttgggtggccacatcacctgtctttatttgtcctgtaacagcagcatacaaatttagtgaaataaaagatactaaaattgtgtttcctcataattatcctgaatgaataaagtaataaacatgtctgactaatatctactaactgtaacaatttggttgtaaatattctttggatattagatataaatatctaagtatgaacaattttaatgaactagtcataatgtatgtagcattaaaaaaattaaaaccatacatcagttaggctgggcgcagtggctcaagcctgtaatcccagcactttgggaggccgaggcaggtgaatcacgaggtcaggagttcaaaaccagcctggccaatatagtgaaaccctgtctctacaaaaaccatataaaaaaattagccggacctggtggctcacaactgtactaccagctacttgggaggctgaggcaggagaattgcttgaacctcggaggcggaggttgcagtgagccaagatcgcaccactgcactccagcctgggcaacagaggccaggcgcggtggcttacactgtaatcccagcactttgggaggctgaggtgggcggatcatgaggtcaggagattgagaccatcctggctaacacggtgaaaccccgtatctactaaaaatacaaaaaaattagctgggcgtggtggcaggcgcctgtagtcccagctactcgggaggctgaggcaggagaatggcatgaacccgggaggcggagcttgcagtgagccaagatggtgacactccagcccggacgacagagtgagactccggaaaaaaaaaaatccatacttcagttaaaacattttatatttcaaaagcataaataacagtattaaaataaccatttaagtgattaattcaaagtaaatattgtggctttgtattcatactattttagaaaatactgtttatggctcacgcctgtaatcccagcactttgggaggctgtggtgggtggatcacctgaggtcagcagttcaagttcaagctggcaaacatggtaataccccatctctactataaatacaaaaattcagccaggcatggtgatgcatgcctgtaaacccagctactcagggtactgaggtaggagaatcacttcaacctgggaggcagcagttgtagggagcagagatcacacaactgcactccagcctcggcaacagagtgagactgtctcaaaaaaaaaaaaaatgaaaatatggtttaatttatatgaatgcagattatctacaaagataactgctaattgctctgaaataataaacagaaagcaaggtacaactacagactcaactgttcagtttataccctgaactgttcttgctttcgcagtataagtacttcagcctgcaaatattggatagttaccttggattatcaggtttctgtcaaagaaactgagtatcatttagtctttattattctgtattgctacctttactcctatctttgtgctaagcttctgtgtgctcttaaaatgagcttgtatctaaacaaatctgtgtctaccttaaaggaataaaaatcaaaaaaataaacttttcggaaccaaaaacaaagcaatacatcttaagtacttataataatctggagtcagaaaaaatgacaaaacttttatttagctgttgacatgatttacatatatttcaaacaagcagagaaaaatatctacatatattctaaatcccttaagaaaagagggaatagcggccaggcacggtggctcatgcctgcaatcccaacactttgggaagccaaggcaggtggatcacaaggtcaggagatcaagaccatcctggcaaacatcgtgaaaccccgtctctactaaaaatacaaaaaaaagaacaaaaaaattagctgggcatggtggcgggtgcctgtagtcccagctacttgggaggctgaggcaggagattggcgtgaacccaggaggcagaggttgcagtgagccgagatcgcgccactgcactccagcctgggtggcagagcgagactttgcctcaaaaaaaaaaaagaaaagagggaatagcaaaatttttttttggaactttttgaagagtttgaactcttggacatctgaaattagcacactgtatgcacttgaaataatgtttacaggggaaaaaccagaagagagaaagatatatgaaatccgtaagtgcacaagaccaacacaacagaatagagagcccagaaataatgtcaccctcctacactcatcagatttttgacaaagctgacaagaggaatatgggaagaattctctctttaataaatggtgcaggaataactacctagcactatgtagaagactgaaactggaccccttcattacaccatatacaaaaatcaactcaagataaattaaagacttaaatgaaaaacttaaaattataagaaactctgcaagataacatagagaataacattctagatatagacactggcaaagacttcatgatgaagctaccaaaagcaattgcaacaaaagcaaaaactgacaaattggacctatttaaactaaagagcttcttcacagcaaaggaaactataaatagctcaaacaaacaacctacagaataaaagaaaatatttgcaaacgttgtctatgacaaaggtctaacatacagaatttattaagaatttaaacaagtttacaagaaaaaggcaaacatctcattaaaaagtaggcaaataacacgaacagatgcttgtcaaaagaagacatacatgtggctaacaagcattattaaaaaaaaaaaaaaggtcatcgctagtcattagagaaattaaaagaaaaaccacaatgagataccacctcacacccatcagaatggctgtttttcataagtcaaaaaataacagatgctggcaaggttgcagagaaaagggaatgcttatactcttctggtgggagtgtaaattagttcaacaacagtaaaaagcagtgtggtgattcctcacagaactaaaaacagaattatcaatttgacccaggaatctcataattgggtatatagccaaagaaatataaattattatattataaagacatattcacatgcatgttcattgcagcactattcacaatagcaaagacgtagacaggccctgaatgcctatcactggtagacaagataaagaaaatatggtatggtcagatgcggtggctcatgtctgtaatcccagcattttgggaggccgaggcaggtggattgcctgagcttagaagtttgagaccagcctggtcaacatggcaaaatcctgtctccacagaaaatacaaaatgaaaaattggccaggcatggtaatgcatacgtgtgtagtcccagctacttgggaggatgaggtaggagagaactgcttgagcctgaaagatggaagctaaagtacgccaaaatcatgctatggcactctagcctgggcaataagcctatctccaaaaataaaataaaataaaagatttagtaaatacaaaatatggtacataaacatcatggaatactctgtggccattaaaaaaaaatgaccatgtcctttgcaataacactgatgaagctggagacaattattcttagaaaactaatgcggagtccaggcatggtggctcacgcctgtaatcccagtactttgggaggccgaggtgggataatcacctgagttcaggagtttaagaccagcctgaccaacatggagaaacccctctctactaaaaatacaaaattagctaggtgtggtggcatgcgactctaatcccagctacataggaggctgaggcaggagaattgcttgaatccaggaggcgaaggttgcggtgagccgaggtggcacaattgcactccagcctgggcaacaagaacaaaaatccatctcaaaaaaacaaaacaaaaaacaaacaaaaaaaagaaaattaatgcagaaacagaaaaccaaatgcatgttattatttataagtaagagctaagtaataagaacacatgaacacaaacagaacagacactgaggcctagttgaggggggagggtgggagcagtaagaggatcagaaaacatacctgttcggtggtatgcttagtacctcagtgacaaaataatctgcacttcaaacccccatgacgtaattttagttgtataacaaacccacatgtgtacacccaaccaaaaatcaaagctaaaaaaagaaaaaaaaaaaatccctgcgtgggagagagtgcaatgtaggtgaatggactgattttcattacagatagtggcccaggtggggctgttttctgatttatctttgtttgcatgcagacagatgagattataaccgggaggtccagaaccttaggttggtggaaaaaacaggttggtgcggcagattctgtatctaggggtggggatatgccaggagacctgtagagacttttgggttcttggcaagaaacgctaggatcaaaaatgccatggtgaagttcctgagggtggtgcccagtactgggaggagtgaggacatgtcaatgtctactgtgtgtgtttaggagtgggtgggaatcctgtggtggcagctacaagaaaacagggtctgtcatcagaactctttcctctaagttttcagtcttctgtcaccctggaagaagaccttaaatcacaggacaacaggcagtgtgacagcctgtgtacaggagagcagagcctcccattttcaaatacccagagctttgttccaggtctggccccagtgatatcttttttctggcaccaaatctatagagtttgctgaatatcaaacaattctccaacaccaactcattgcctaataattgaattctgacaccacctagagacagcacagaccctgatccagggctgggtcccacaacattgtcctcactgcagaggccaatcaaaaaccccataggcccatctatgcttctgagctactgtttgaaaactgaggactcccaaaacctccctgaagttcaataatttggtacagctacttacagaactcagcaaaacattgtagttatgtttaccggtttcatataaaagatgcagcccaggaaaagccaaatggaagaaatgcatagaacaaagagatggggaaagatgaaacacatagaaaatcctggaaaatatttgtgattaataaaattctccaccttttgtgtgctccaggaacagtatacggaaagaaacgcctttctcattatgacttagatggtgctctcttttcttacctatcacacagccagacacacactctgtacattttctcctttttctcattaagaaattcagctgaatttgtcttcagtggtcaaaataattttttttttttgagatggagtctcgctcggccacccaggctggagtgccttggcaccgtctcagctcactgcaacctctgtctccatggttcaagcaattctcctgcctcagcctcccaagtagctggcattacaggtggccaccacaactaccagctaatttttgtatttttagtagacacagggttatcaccatgttgaccaggctggtctcaagctcctgacttgcggtgatccgtccgcctaggcctcccaaactgctgggattacatgcctgagccatggcgctcagcctaaaatatttcttaatcaaactttacttaagtttatctccatccctcaggctagtgagggatggagataagccatctccaatgtaggagaaaagcccttttctgcctacatttttgcaacccatgaagattttttagttagctggtacttcttcctgttgcaatacttcttaggaattcattttttttttacataaatctaatattcttattttagaaagcgtaaaaagtgcctcaaaaccataacaacttcattaccagtaagaccctcccagtttcctttcatcttaatcttgactgcatctgcctgtggggccccagctttccaaggctttgtagcttctttcagaatgaaggctccttccgtggctggggtgagcagtcttgagatatccgcaagggagactccccagaaaaaaataacagggcctttaataacctcctgttggccgggtgcggtggctcacaccgataatgccagcactttgggaggccgaagcgggtctgaggcagagagttcaagaccagcctgacaaacatggagaaaacccgtctctactaaacaccaaaattagccgggcgtgatggtgcatgcctgtaatcccagctactggtggggctgaggtaggagaatcgcttgaacccagtaagccgagatcacgccattacattccagcctgggcaccacaagcgacactgtgtctaaaaaaaaaaaaaaaaaaaaaaaaataccctgttgcaggcttaatattagccttagcttggagtcactaggttcaagctttaatgtccacatcagttattcacttggtttttgaaactaagtgttagaaactccagtgaaattactcacaatgtttacataaaggaatttttaagatgcttactttttttttcttttttttgagccggagtctcgctttgtcacgcaggctggagcgcgatgattggatctcagctcactgcaacttccgcctcccgggttcaagcaattctcgtgcctcagcctcccaagtggctggtactacaggcacgtgccaacacgccgatagttttcgtatttttagtagagacgggtttcaccacgttggccaggctggtctagaactcctgaccacgtgatccacctgcctcggcctccgaagtgctgggattacaggcttgagccaccgcgcccagcaagaaaggggttttgaaccctaatgcagttcctgtttttgtttccatcccctattggctgggatcagaccgcacaatctaagctgatcctggtaagcttagacccaaactttttccaaataaagtaaatgcgcgatttgcgagaaaaggaaaagggggtagaagaagaggtagggttgatttacaacttttacaacttatgaccagaaagttgagtcatttaaaaggaacttagttgtcctaacacctctttacctcaagtgatccgcccgcctcggcctcccaaaacgttgggattacaggcgtgagccacagcgtccggccccatacatttttaataggagaaaagagaaactgtaaacccaaaggaacaaagctcttcccattcatgaacccgcaccccgagtcaggattctcccctgcccaccctcccctggtccctgcacaatctgggagagacgccacgctgcgggtgcagagctgcccagagagggctccaggccagggtagtcaccgcgcagtgaagagacaagacgcccgggtgccggctgtcagcgcagctgccattttatggctgaacaggactgaggccgagctgagcaaggagaactgggggagcagactgtggagctgactgcggggaggcctgagtcccgccacagccacttttcaccggttccaaccagtccctctcctctctcgggatgtcggaccctcactctcaccatttttggcttccaggaggtcccggtgtcttagctgtggatctcccaatacctgcaggacacggggccacacagcctgggcctttaggagaagaaccagacctggagctctgactgcagcgagagacaaaggccgcaccaaacccggaaacc

SEQ ID NO: 2000 - DNA, 1502099 bp, Homo sapiens
  misc_feature (369735)..(369735): n is a, c, g, or t
  misc_feature (455030)..(455030): n is a, c, g, or t
gttgcagcagagaaggaagtttaatcataaggctgccgaataaggagacagggggaaacctcaaatctgcctgtctgagccgtttaggtctaggtattttaagggagttggagtgaccgaggtgggggatcactggttgaagaatacaggatggtgagatgaagaaactgcattttcatgctgattcagttcctcttggggagaggcggggggcggtcttcaaactggttggcaatagctcttttgctggaattcaggatctgaaaaacatcttaagccatttttaaacaaacaaaggccttatgattctaacatcagaaatcttctctgtaggaacaatgaggaggcaaatggttagcatctggtgctctgggacttttggttacgaagaagtgggccaaagtgcagcctgattaatgcttaattacaactatatttctgtccagaacccagcatctaattcttgttaaccctgtgaggatggtttcaatagaatgtttccattgtccttaaagggaggtatagttagtcccattatactccaggtaatgatgacagtcttggcaaaatcttaggaccctaagttgtttgccacctcacaacctatattatccgtcctagtcttagttaccacatctgactgctgggaagactgagggtgatttgtttggtctgtgcacaaaacctttaaagagaaatacacatgttagttaacttaaaaatccacaggtactgtggcaatagtttgtgtaacaagttagggtaaatatctttctggtaagatgtacaagggaagtcaatttacctggaagacaggaggtgtcaggcctccaggcaagacagaagcaaaaactgacaaaacaaagcctacaggaaatttgggtaataagtttgaatcttcttaaagttcttaaagtgtctagaaaaagcattctaagacaaaactcctacaattcagcaagccttgggaaaaaggctaaagctttctagcctctacctgaaaatacccactgcatagaaaacccaggagaaaaaattcaacctaggcagtcaagtctgaggtattgtcaccccatttaaatttgaacagggcactctaaaatgacatactggccttcataagaggaacagaaagaggtttgtagtcatgcccataggcctatgttcttaggtaaactaaactagcttgatccttaaaaaacgagagagagatggtgaacagtggaaaaggttcaaaataaaatatgaaagacagcctctgttatagcacttgccatatccccccaggcaactgagtgcagagctgacaaacttatgacatgggagaatgaaataagctttctagaatgcaaggatctgagtacaacaccatatttgaacaacaatagggggcaaggtagtctgggtctttaactatttagaatactctaaaaagagggctggggagagaaaggccaagtgcacatatatttaaagctatccagtaaagacttacttacatttcaaggtgaaatcagaatacaatgaatgtgttttctagctaaaaatcatgatcactaagtggttgatacaattttttccaatcaattgctaacagcatttattcactaattttgttttttatttgtgtctgatctacttctgcaacttataacatgaacatatttattcacaggtcagatgaagaattgcctaattttaatttggaattatctaattctaaaaacaaaaaagaaactatttataggagaggatctgtaactggggtccatgggagtttattaacaggtttgccagaaaaaaatacaagataccagttaaatttgaatttcagataaacaagtaatttttttagtctagatatatgccagtattgcatggtaaccctatatttataaacaaatttcagagagatagatacatttctctctctctctctcctgtttttttgaaactgagtcttgctctgtcacccaggctggaatgcagtggcatgatctcagctcactgcaacctctgcctcccaggttcaagcagttctcctgcctcagcttcccaagtagttgggattataggcatgagccactgtacctggccttctttaacactttttgtttacaggccaaacatcaccctcagtcattccagcagtctactatgtgaactgagactaggagggataatatagattgccagatagatctaggcatgagctcgttagacactgcataaaaatttggagtagaagcattttgacaaggaaattggctatagctatctttctaccagagtcttaaacctatgatctctcaacagttagtcatcattaagacaaagattaattctatcaagccttgacttttccctgtggcctgagcttcctaggagccgaacataaagggaaacatgaagggcaatttaccaaatagcaactgaagagaagagtccactcagtgaaagcagaggagtttgcccgggggcgtgttagggaggcagagaaagctggtttacagggctttgcagacagacttgagcctaagggccatgtcacacctttaagttaagttggggttgaccttttaaacaagaagttgtgcatgacagaaggtctgctttgtgaacattggattctggaggagcaccaccgcaggaaagactggagaaaggtggtggtgggctgggggcactggcttggaagaagagagtgaagaggcaggagagttggaagagactgggaggctgggaatacagtactcaagggccagggttttctcccctccagctctttgtcctttgcagccaccacccaaggatgctggtgaaggtgtttttgtgcatccccattctgagagtgcagcctctttcctgaggcccacgggagggtctgggtaatgacgaaatgcagtctttacctgtgtcactgaaagtagacccgcagagctgcggcttctgctgccatttcctcctctgatctccaagaggcaggaaagtcctccttgtcatgtttctggagctttggagaaaaaaaaaggaagaggctctttcatgggcccttgggatctccttgaacaaatttcggggggctgggggagactgaacaaaatttgcaaattagaggccagtaggtgtatcttttaattgtttcagttgctacaacttgcaaataggctttatacaagaatccacatttaaaataatcagatcatttgccatcttgtaatcatctactgaggctgaggggggtgatgatatgatataggtctgtgtccttgcccatatctcatgtcaaattagaatccccagtgtcagaggtggggcctggtggcaagtgactggaccatcaaggcagaattccccattggtgctgttctcatgatagtgagttattgggggaccttattgtttaaaagtgtgtagcacctccctccactctctcttcctcctgctccagccacagaagacgtgcctgctttcccttccgccatgattgaaaggttcctgaggcctccccaaccatgctttctgtacagcctgagaaaccaggagccaattaaactgctgttccttataaattacccagccccgggtagttccttatagcactgtaagaatggactaatacaggtgatcacagattgggatgaagtgggggaatggggagcatttgccattcccagaatctcccccacactcttctaattttcttatgtttaacaggcatcattcatttattttacttcctggattttgaaggcattgagtttgccaccaacccataatcccctccttcaaggtggcctgtggtttacctcctactctctttggtttagactctcttgcatgagctctgagcagttttgttcagtgaaccaaatttatgataatgacacaagggccatgagaactgagtaagtaataagtatttccattaaaagagggttcaagcagggaaacagtaaaaaagagattaaatgagaaaacaacttacaaaaaattaacaatttgtctcaaaattaacacttgaatcatttaaattcctcctcagattacaggcatatttaaaaaattgtgtgtatgtctcagatttacatatagagtgaatacaatttcaattctatcagagaggatgttctcagaactctcttccttagaaatgctcaattttctcccttaacctcctattatgattcaatttcattaactaaatttattgttcctgtgtgtggctctatacattgtaaaatgccgcaggttatccgttcattcttcatgggaatgcacagtgtagtattttgtgttatgtgttaaaagtcatttgggattgagacaatttaatagcaccaatgatagctagcatttatgatgtgaaaggcgcacattatttctttgatatacattatttcgtttaatccttacaataactcataaaactgacgctacttaaccccatgttactgtggaggaaactgagttctgaggaagttcataccccggtccaaagatcacccagctaggtagtggggtaggtgccagtattatccccaacaacttttgcctttttattcatcctgagggatctacagtgtccctaaagagcatcccacagatactgttccactccattttgaaaaaggtcaacttaacgattaaaatatcgactttttaaaagttgatcctttaaaaataattttgccaactcagcaaaaagtctatcaactaataaatgacttttgctatctcaggccccaaactctaaatctaacctagaggcctctaccctggcagcttgcagcagatggagaaatttccccatttattgcagctcaacattgatacagaaggcaaaacagtgagggaaccatagcctcgcactcccgctgagctgtatttccactcctggtaagtaagtttgagcctaaatgaggctcattagcatataaccgggccacagatacatttatgagggtcatggatcttcccttcagaatttggctgccagcacgctgattttacattttgccatgtagatttaattctccttagtgaaagaaaaccacattaagaagtcatttcctttcttgcagaggcaaacatgctgcagttgctacaggcaaggcaaacgggattgctattcttctactcaagaactaattttcattttgatactaccttgacgtctgttataaatccatcttatcttataacaattcaataggatgacaaagagatatgcaaagcccaggaaatatggccttcccacttctgctactgccattggaagacacagaaataaagcattaagtggcctcaacaacacagatcataccagaggaatccaaataatttagagcctgtgaatgttaatgccttcctggttattaggcaaccgtctgttattgtcatatgccttacagatggcaacattgtgccaatccttagaagaagtttttgggaaataataggaaataaataaaacaaaaactaatcatctttgcaaaaactctgttgtacctagcttttaaaagttatgagatttccctcctaaaagccccagatggaagcatgtggttctgtttagaacagcggcactcaaccctggttggttgcccactgtaatcatctaggaagctttaaaaaataaaacccaccccagggattctgatttaattggtctggggcagcctgggtttggggatttaaaacaaaacttctcagccaattctaaggtgcacttactgttgagaatcactgctttttgggagaagtgtgtagatagagcccacacacatatagaaagaatccgcttgcctttaagcacattgcttgtgatcctatcaacagtactactgctgtcctttgcaaaccttgccctagaactgcttttcttctgtttatgctctgtccatgggatgtctggcctacaaggcttgtcttagcaacactaacatgcggatgcagttcagcagcctttgaatgtttttaatctctgcagaaatagggagcctgggaaaggccctggtgggcaagacttgtgtcctagaagatccatccaggtgacttgaagactaaaaatgctacagtttggagtaaagttccatttccctaaagcaacccaagaacctggtggctgcaacttcttgcctggctaacggagagaaagccctaatgatcttaaatagtagtttatccaaaaggcagtatttgccgtgggtgaactttaatggaggagtttcacttctgataagccttctagattactttggctgcccacaggggagggcggtgactacttgttaacacacaagacagttgctctgtctctgtaatgccaggggccagacctagcactggaacactgaaccagacagactcctttattgttctcctggggcacccaggtagggaggttacacaccaaacggctgattcttagtgagatgggattacaaaatgggaaggctgctggatagagctagcctcattgcaaaggcttttgagtatcaccttggtttcacaaagaaacgttatgaaaaacagtgatggagggaaagaggttatctacggatcatccaaaaatggctctccaagaaggcgagagttagttaggtctgagcttgaacaatgagaagaacaaaagttcctttaatctctttgtgtctcagttttcccctttgtaaaatgggagtaggaaaaagagtggtgagcagtgccgtgcctgacacatagttaagtggtatttaatattccctgctgctgctactactgtcagtcattagcattatttttaggctaaataacactgacctaatgacagcgagcactaaaaattccacagaggttgtttctaggagtaaaagtatttttcatctccatggttccccagtgatctgtatcttttggacctaactaactactttgtagaaggattaaaagttatgatcagaattcagatccaaaacaacttattataatgagacactcaaatctggggaggaaatgtacctccttcagctctaaagtgaccctcactaatccctaatcctcagagctgtcctaaggagtgagtaaggtattaatcgaggcttctcatggtaaaagctaaggtcctatggtaaaagaatgtggtggaggtcaaaggtagtcaataccccaggagtatggttgccagatttagcaaacaaaaatacaagacactcagtgacttgttttaggataaggatgtctcatacagtattgagacgacatcctgatatgaaacaatgatttgttgtttacctgaaatacaaagttaactgggattcttgtattttatttgacaactcaacatagcagaccccttaaaaaggtgtcacaggaagaacttggcttgcatttggtaactaggttgttcccaaagttgcctggctgtgaatcctggaaaaaacagaggggatcatgtgcaggaagataaaattcaaggccatcattttgtgcactccagggcttattattattgcatggtcttattgcacggaatgcagtgtaaatcaacctgcactattttaattccttagttcaccagttctaaggtgcacattttttcatattttaacatctttgaaatcaaaacatgtcctataaccaaaagtgtgtcatagtttaattggcagtgtttttctttcttagtagtacataaaataacagcacttccaactgactgtgtctgggattcagtgcactatatttctccatctctcctttctgcaggtaagtcacgtaagttaaatgtgactctgcttgctctgaaaatgctcaacaccaacgctgatgtattacatactggtttccttctgatgcaacaacaatagtcaaaacggttttcacagaagctttgttctttagaggaaagtgcacgccaaagtgacaacgtttgcaaaaacttgaaccaaagtctttattcacattcaacagactgaagtctgtgatggcctctccaagcaaattctatttctgcacagctttgaaaagagatttaaaacaaaaaatctatcttcagtcatcccactttatctgctagaaatggtttttggggaaggtagtgttaacaggatttctgactgaagaactgatacgtgtcgattttgacactgtgctccctcctgtgcactgagtgtgttatcacaaggtatatggggtaatgatgaattccctgctgtattgctcaaaccgcctttgctattgacatctttagagttctgtaatggaatgcagtaggaggaatggttcacaataatttaaatgtttttcagaatttggaacgaacctggagtaaaatgccaaattgtcttcaaacgggggaaaactactttaatgctcttcttacagaagcaaacggctgaatataaacttggatgtttttataaaaacatatttcattattatcacttttataaaacaacatacagaagcagagagcttaaataaaccatttcttatgggttgacggttctgtttacacaggggtttatataaagtctcaaaaggaaaataactgtattgtttttttagatctgatcctctcttattactttctattcaaccaagttttgatgaacacatgatatattccaggctctgttctaggtcttatgaaagatgatacaaagataaataagcccaagatctttgcctcctcaggttcaccatgcaataaggcagacagattcatgcatagataatttaatactggcctaactaccgaactagaagttccatcaaagtgttcttggagtatctggggcagggggagacaaaataattcttgctggaattcaggtctgagattgacttttaaaaatcaaggacttggactgggcttaaaagatggtaatgagattttgaagaaagggtaattctgggcaatgggaacagcttcgttaaacacatgatgcgagtaccagttccccagcaaggcaacttgtacccatggtcagcttcaccaactaattacagcactgttccctgatgaatcctgacctggcttctaggcagctactaacaaacatgtatcagagttagcaagagagctgaaatttgccactttgagaagccttaacattccattgtttaaagatggaataggcacgcacaacaggggtctaaaagatggtctccggccctacaaatgcaaagctgcaaacagctttgaatcttactgagagaaacttattcccttttcagtgatctttcagtccctctgactgttcaagaataaagtctcagcggactagtacgtccttgataaggcatcaacaacacctctaagagaaagagaagagccatccagactggctagaatataataagattgttttgtttagatcatatttatttttagggacatctctcatttatgacaaatcatgtcaagtctccttttaaagtaaatttaagttaaacataaaagaatcaattttaaaaatatatgaaatgaaatggtgtgaaaatatggcattaacagcttgagaaatggcccctggggaaggaagtacaactgaggtgggaaagggtgactcaagatgtgagggtgatgcattggcctttaatgcttgtgggtggcagtttctactgggctgagttctagaaagctacatttttcatggatgcatgggagtcaaaataatttcatgttataagaactccgtcaaaaaatggtatgggggatggtagaactttgggtagggcaggcttttaaaggaaggcttcactgaagatgtagcatataagttgaggtgtgaataatgagtatttaagtaaaggggcaggaaggaatatttcaagcagaaagaacagcaagtgcagaccttcaaggaagtgtggtggttgggtaacaggctggaagagtgagagagaggacttggggggatggcagatcatttgcaccctgtgggcagggctgagaagtttggattttatttttggtgtgatgagaagataggcaaggaagtaaaaggactagaataattgctcataaagaatgtcctggaaggataatgaattaaagggagaaagtgatggcaacaatcagaagagaaagtttgggagagggggctcatttgccccataggctagttagcgtcatggccactaagtgagaggacttggcccctcactatagatggaccttgtcatctggcagctttctccctggtgcttgtctgtaaagcacacagagatcctggcttccctgccaagattgctctgaactagtgtgaaaatcactcagtttttgcccaatatccattctgcctctcttctatcattcacttctcaaagttcccgagaagccttcctggaccattctgattgagtcatatttcacgattctggatgctttcatgcttctggcacctccctggcactgtcctttcagtacatgtttcctgccagacatggagcttcctttgtctatgtgctggttactgagcagactggcgcccacgctggactttcttggtggcccaatgaatcaccaggtgctttcacttgaggcagaaaatggtcttggaccacaaacctctgcctgccacttgtgataccttagaacgctgaagttctttgaatattacttagtagaaaaatatgttcattgcttcccttctctatcctgtgaactggaccttggactaagcactagactgtgagatatctatgtgcaaacaaattaccttcaggtccttctacttactgtgaaagttcaaaagcccagttcctcctccttttctgaacagaaattcaagtaatcaatggagcattaatcatttgattagttgccaaagctttgacttaagcataacttacttgagtaaaagcaagtatttttagtgctgcctgtggggccaaaatgctgaaataagctcttatattaattagtggcatcccattttcaaggggtatagagtgttggatgtttaagaatttgtaacccccaaaagtaagtattaactagaaaatcacagtgctggaaaataattatgccaaaccactgtactataacagaccccaattgcttatccaattatacattgaagtatcacattgtcaagccgattgccaaagcggcaaatgagactttgctagcatcataatttggaccagatattactccactaactacactatgaatagtctttggaacatgctatgtaccctatataaacctccacgaaccaaggtgggcatttcaggtttgttggagtacgcccatgccatcaaaaaaaaaaaaaaaatcactggaattgattagacatgaaagttcacagttttccattgaaagcctgttaggagcatctcagcaaagagcaactgcagctccaggttctgagcagagttgatttcaattaaaatatcaaaggtagtcacttcctgtcagggagaccatcagtaattctatcctcaaatgtgtatctgagaaaaacaaccccagacactgcctcctggatctgcaacactgctccctgattgattggccaccatttagaggtaatttttttttttttcgagacaaggtctcactctgtctggagtgtagtggccagctcactgcagcctcaacctcccaggcttaagtgatccagccacttccgcctcctaaagtgccggggttataggcatgcaccactgtgctcggcctagaactttcttacaacacaacatcaggacagctgaagaacaggagcctggaactgggctgtgaggagctactaaggggttgatattcttaggacaccccattgctatgattttcttctcaaccttgtaagggattggaacgatcttgcccaacagttgggtctgatatgtcagacgaaaatcccactgtggcaagagcctgactcccagggttcagtagagaaataatttgcactcgcccagtagttctttgcttttcaagtaatagtaagccctaaacaatatcaaacttggtaaaaacaaaatcttcctgtctagtccccacattgcccagtcagagtaacatccatcttcgtatcctctcggctagctgtatctgataccagtataggaatcccccttcttcacccagtggatgcctgaaaccagggatagtactgaaccctatgtatgctctctgttttcttctacacatacacaaacctatgataaagttgaatgtataaatcaggtacaggtacaggttaagagattaacaaccaagaataaaatagaacaattgtaacaatgcactgttcacaattgcacaaacagaagatccctgcttgcagaggatcttagcaatttattttattttttttttttcgagatggagtcttgctctgttgcccaggctggagtgcagtggcatgatctcggctcactgcaacctctgtctcctgggtacaagtgattctcctgcctcacccttctcagtagctgggactacgggagtgcaccaccacacctggctagtttttgtagagatggggtttcaccatgttggccaggctggtctcgaactcctgacctcatgacctgcccgcctcggcctcccaaagttctgggattgtaggtgtgagccaccgcgccctaccagcaatttcatcatataatttgttttatttccttattaagtcaggaactttcaccttttctcttaaataccttatgtcctctttttggcatatctgaattgccagcatcactactcttatgctttggggctgttattaaggaaaatgaagggttacttgggcataagcactgtgatttcatgacagtcaacctggtaacagagatggctactcagtgactaacaggcgggtagtgtagacaacatggctacactggacaaagggaggatccgcatcctggccaggacagagtgggacggcgtgcaattttgtcacactgctcagaacgttgtacaatgaaaacttatgaattgtttatttctagaatttttcatttagtagtttcagactatggtaaactgtgaaaagtgaaactggagataagaggggactactgtagtaggttttcaataagcattggtcaaatacgtcactaaattacacttttcctcccaatatactggctatgctagctcatcatccccattttccacataaaacaaggaacttaaatcactcaaccaatgtaacatggataactcagagtggtatttgtttggatgagacacacaaacactggatccactagtggatccagacatgcagcaaactgtatgtctcatccaaacaaatttgctgtatgtctagtgctcttctgatccactctataaattcctgggaacgttctttcagttaacatagttgaaaacatgggtggtaaaacagcatagaaagcaaaactaacactgcaaatagggatcaacctctaagcccggagggccctgctggaaaacctcttctgaggggaaaattgcatctcagggcagttttcaggaattaatcgctgatcaccaacacctcaccccaggcgccatcatatctgaacccttctggtttttcagtgggtagaaaactggtgaggcaaaagggactagagatctctgccagtttgatttcctcaggcctctgtttctaaaaacatgctcactgagaaatgaaatgaaactccttctgaaaaggaggtttgtgatgaagcagacttcggagaaggaagcatttattcaaaaagcaatttccttggccagtcatgttctgtaagcctttttcccccccgccggtgtttcagatattggtgtttaagcaagactgttctcctttaatcctagagtgatgtcaacccacagtactcagaacaaggaatgggaagaggcatagggccaatttctgcctttgttggaatctcctgaacatttcatttcctatttgcttctgctacatatggcttcttttttcaaaggtaccttgcagagtcttcggaagcacagtgtaggcaaggaaactctccaaggagaaagaaaaatctgcactacaagatgctacgcaaacacacaactaagagagggaggcaagcacacagcacgcaaccaataatgcacagccacagaatccttctcaacacaacattgcaggcagcagcaactgggttgtcaagataaaacctatttgaagaagctgatctagctgggacctttgaacaatccagatccccaagcatttaaagcttgtttctctgcagaattcattcaattattcaacaaatatgaacatgtattcagtgtattttatagtgtaatagtaatcaagctggacaaggtagtgcctttgggaggcttacattctaggagagaaggcaggcagttagcaagtaatcatctatcactgccttgggagggaataaaagagggagctacctgagacaatatggtcagaaaagactgctctgaggaaaggacagtcagctgaggagtggcaagtgcaaacaccccaagggaagaaggaggcatctgtatggtctgtgcactggctgaaggcaagtgtctgaaggcgagtgaggaagttctcagatagaaggtagaagatgaggtggagaagtgggaaaatctcccttccctttagcactggaggcgaaagggctagaagacgagagactgaatgattctttcagtcacatcactcttttcaagcacctactttgtgctaggcgcagaagactattaaacaggcaaagctgtaataaatccaaactcagtgagctgaaggtagaaaggccgtcccagaacagctggacccagcactgcctctgaacatgggcaatgacactttggggctcaatgtttgcttactgggtctctcacacaccctaacatcagccctgcctataatgaactttccccagaaaagcaggtgagcagcaagctatttgcacatgtggtgactaccatggagcagcaaggatgcaggctgacctcacagacttctttctgaatgcataccatatgtttggcagagctaaaagagctatcccagcaccatctagccaggtgcttggcactggatctcatatgctggcagatgaaaaatgactaatatgaaaatctatattccaacggtactcaccagtccactggattggtcacgattccttctttctacaataggatcattctgcttctgattacaaaactgcaccctctgaagctgctactcacccgttggaagttacatgccctgtgcagcctacaaatccattaagttctgatggagctattccaacgcccttcaaagaacctggcccatgtgagttgcacaaacaaattggagccaacctttcccaaatgcctctctctatttcatttaaaaaccctctttaatgaagacataaagccttgaatgcatctgaaacgctatgcttaccatgcatgacagcagatcgtcacagaggatttcaaatgcttttttttttctaaccagaatacttgaaagaaactgagatttccttgttatgagttcaactgttcattttatatgccctataattgaccattctccagaagtcagcataggcaacagagatgtaaggcaactgcaaacacacacacacacacacacacacacacacacacacacacacacacacacacacacagctttggcacagtgaaaaattaaaatgcaatgccaggcttgggactattttgaagcctcaggctaggaaagcaataccctcacctttctcagctgcctactatgtacctaaccttccaattatttatggctgagatgcttaagatgtactggagaaacagccatggctgagagatacacaaagctgaaatattatagagagttataacttcatgaatgaaaaacctataaaaatcacttaagggtcctaatctttcagttaatctcacctcagtgccactcaagggtttaaaggagtttcactgattggtttttaaaggacaacgataaaaatgctttgaaataactaattataatttcaggtatctatgtaaaggtccagacacaaatatttgaaaatggactgttcctagaatcagggattgacacagatctttaaaactttctagcccaaacatccatgtgacatttgtatccctttggccatattgctttcaaggcttcaatgctctaggaaagaggatcttactgcagtactgctagatttaggtggagatcaaaattaccaatgtttgaaagtgatatttttacattaacttgatcaagagttagaacttggacttattactcagacagtctgatccttcattgacaagctgtgctgagaaaccattctgtgggctaaagaggatatggactcccaggattgctctggcattgcggttgagaagatatactggaataacctcttttgaaaacagtttagcattacctcctaaagttgacatctacaacaatatgactgccaggtatattaccaagagaaattctcatatgtgtacaagaagacatgcatgagaatgttcaaagaaactctgattaaaatagatagaatctagtaatgaccaacatcccaccagggagtagatgaataaaccctgatatgttcacataattaaataccatggctcaagcaaaacaaatgtttgatagtgacacacagctcatagggagaaatcttaacaatatattagtttaaaaaaattccctaaagacaataaaaatatacacactttaggaatccatagagatgcctaaaactatatgaaaagtcacaaagcaatggtgagcatagattgaggatgctggactgactccatgtgaggagacaaggggatggttttttgtgtgggactatcatactgttagatgtgggatagtagcaaaatcataggttttgttctgggcaatgggtttgcagatactcattaacatcattaaacataactacttacacaactaaagaaaaggaggctatgatggaaaacaaagagaaatgatcatccttgagaggcatgtaagattacaacatcggatgaccgcagttttcctcaagataggaatccagctcccattccaaaatgtccaccaaagttgcaacatagtagcatttgccatataaaagtactggagttattaactggattccagatgtctgaaactgatgtatcccttcactgaatcccgactaggatctattttgggtatagcacttcacacaggttgctgttcttaattaaaacttctctgccttaagagctttatgtctgtgagatagtcatccaaatgttctcctctccataaatgtgctcttatgttttattttcacagcaaaatgcttgcccagattttaataaacatgtccgcagtagtaatatacatttcgcatgctttccacatttcataatctctttagtccttttgtttatgttgattcccacaccaagaaggctgtttggaaggctttgcagctctgtctccatttcttctgcctatcattggggaatgaaacagcacactgattgctatttgggtaggaaacacagacaagacgttgaaagaagtaaactaatttccaagcaattttgctcctttctctctttttgattgattttggcaataactcaccccagttcattgacattagagtaaagcctagtagccaatttattgcttcaaaatctgtgagagttcctaattggttatcagactgtgtctaccagatgccaaaattaaatttcttttaaatcaagaaaaaagtgattttctggcatcccagatgcaaaacaaccccgattaactgttctttcacattgcaaatggctatttgggccttgggtggagagaaaactcatctacttacaacaggagggggtcagattctggactcgatccttcagccaaaatgcagataaaccacaaggaacaaatactactctatgaaaaatggagagctgggccgggcgcggtggctcacgcctgtaatcccagcactttcggaggctgaggcaggtggatcacctgaggtcaggagttcgagaccagcctggccaacatggtgacaccctatctctactaaaaatgcaaaaattagccaggtggggtggtggacacctgtaatcccagttattcgggaggctgaggcaggagaattgcttgaacccgggaggtgaatgttgcagtgagccgagattgtatcattgcactctagcctgggcaacagagtgagacttggtctcaaaaagaaaaatggagtggtgttcctggctgaaggagagatgccctcggtccaatgttggggaaatttttgctcccggaaagtggaaacatcaaaggactggagcccaacattaaggatggaataattatgttgttgttattgttatttttaatggagctctattgagtgcttgctgtctgcctggcaatgtgctcagtgccaagtacaaacatgatctcatttactcttcataagagtacctaccccatccatggtgctgtcatttccatttttagatgaagaagttaaggcttagagatgtgatctcatagctagtaggcagttgggactccagggtcccactccctttctgtctattccccctcctcatataacaatacatagcatttgctaagcaatacagactaaattgaggctctaacttaacttaaagctcttttgcatacagaatgttatttgatgaactctagggtaggtagaggcacaatattattatccccattttatagagaagggaacaaaggcccagggagattcagtgaattgcttgagtcttctgccatgttggactaaaagcctcagtgttgctctactaaaaaggtccctcaactaaatataacaggggtggcctgcatctagtctctgaattggaacatcacaactgacagagcttatatcgtgggttctcttatttaaaaagcagaaattctaggtaatggtccagtgcaatttcgactccatctcctaatcctttgacatcaaatgctctggtcctgacttactggtcctggacatggttttcttggcacagtagcaggcctttaccattttacctgcatctctcaaccctttgtcctgtttccatctcatgtgagtaggagttattctttaaacaactgccttgtatctcactaccagccctttgcacatactgttctccctgcatggatggcatttcttcccctgatccaccagcactggacttaggtggccctccaagatggttccatttcaggacacttattgtacatgccttctaatttatcttccactctataggtttcctgggggcaaaatcatgtcttttcacaatagccaatcttttctttgacttcccagacatcaatgtcatatggttcaatctaataccttaaccatgaccttataaaaccaaagctaggcacataggagaggctcactaaatacttcttgcccagataaacttatcacagtagatattcagaaggatgacatagttgtacccatcctcagtcctcaaataagagtttaattatgttatgtaaaccatatgatatactagtgaggcaggaacagatacacattgtaaaagagatccagaacaaaataagatttctctgtggccttcgccaatcttaaaatgtaactatatttactgaatcaaactcttacagcataataaacttacttacaaagaatcagggtagacagcctaaccttgagtacctcaagtctttgcccctggatcccacataacaatatccttccctcttttaaggaaagctggaaagaaaaccactctgccagcagaagggcaaataaaaggtatgtctgtgcctgcacacagaggttggcatcctaccctgatttgtgacccataattaatgtcaatttcataatttcggaggatagaagatcaacaaggaagctgacctctggctgtctcacagctaatcatcttttgaggcggaaacttgagaggaaacagaaacgacaggctggagcaccaggctgtggctcggagtgtgttttgggtgatctgccaagcagtgagaacccatggtcacgtgccctctctgtgctggccccacagtgacacctgctcaccctccattgggtaaggtgggaacctgcatcccaccctgtagaaggcttggctggacgcctgctagtctctacaaagttccttctcattgtgtgcactcttctacatggcttcttaattatgtatgtgcacaggctgtgtcgaatggagttgcctttgcctctgctcaccacgtattacatttttaatcagtatatataattacttaccgcaagctgccaggccagattttctgagcattagtctaattaacttaaacttgataattatgtttcggataccatagcagtacacacggaacggcagactttgctgccagcttatttgattccaataacgtgttttctcaatactggactagttttgattttttttttttttttgaaaaaaatggccatctgataattactttggtttcaaaatttcccctcagataaacccattctgctatttaggacagcttctcaaatgatttacacggattgaactgttatagtatgtttctgtgtatttttacacacacaaatctgtttttactaatataaattcaaactgaggagaaatgacagtagaaggaattctgatggtcaaatgacagaattgtccatgtttcaactgctctatgcattgccttttccatttcaatttgggttgatgaaaaatgagagacaaggaaaagcaaaacaaaactaaacaaaacacagaaaaatgcccagacttgtaagggagaaaggtcagcttctggttgaacgagggcatgataagttcccacactaataaggctcaattcacctagggcttaccatgtgccaggcactgcaaaaagctcttttttgtggactatctcatcgaatcgtcctaacaaccctatgtggtaattagttattactataggttgaattgcatcctcctgaaatatatgttgaagccctaatccacaatgtctcagaatgtaacttggtttggaaatagggtctttgtagaggtaatcaggttaaaagaagggcattagggtcagccttaatctaatatgactggtgtccttatacaaagggaaaatttggacccagcagctgccatgcacgcaaagagattaagtgaagatgaaggcaaagattggggtgacggatctctaagccatggaatgccaaagatcatcagcaaactcccagcagtgaagtggacacactgaacagattctcccttagagccctcaggaggaacagctctgctgacaccttcacctcgggcttgtagttgccagaactgtaaaacgacaaatttccattgtttaagccacccacccaggttgtggtacttgattacggcagccctagccctctaatacatatactctggttaccactactccccgtttcacagatgccaaggctcagaaaagctatgtgatgtgtccaggtctgcacagctgtcaagtggcagggaaggagtccacaacaggcctttcggactcccatgctcaacccttgacctcacccatgcctgtgccactctgcttctgcccaggaggctgaaagaatcaatacaacaaatcccagaagtggatgaagcactatgaacactgtaatgcttctaaggtaaaagtcaagcttagatggtgcctgttttcacatttgcacatcgcctcttttatttaacacgtaaaatgactgcttgaaatacctgcactctagttttggagggcaacaacatggaatttaaattttcttagggtgagggtagcgggattattttgttctcttctcacataagacaataatggaccaaaaataccacttaccaattacaaaagacaacaaataacagagcacaactcaatgaatcgaattgcagaaggaagaacaggtgggctttcccaagatgtcataatagatggaaggagaacaagagagaatgaacctgctctataaaggccaaagacaggaaatgagaatcattctggggaaaagatacaacctttatccaggaggaaaagcatgggaatatgataataatttttaaaaaagacaattctccaagaatatctcctggaatagatccaacggaaagcttgacaccagataaagaagggaggtcaggttcattgagggcctattacatttggggtatgtttgagggtgaaaccccccatagagtgttgtgaagtagaagctatcgcctcccactttgcagatggggaaataaagttctaagcaattaaataattactaaagggcagctactccttggcccagcaaatcactggaaatgctgacatggaagaacagcaggaagggttgtcctaagaagaattactttccttcttcagactagtagtgtctctatgtctgtggggaacgtgcacaagctcacactcaagacacagacttctcgtcataaaaaaatttcacaaattacctctaagttgctctaaaacgggagtgcttatcatttttaggcatgtcagcactttttagaatctgatcaaagctatgtatgactcctttccctagaaaaatgtgtgcacacacataaatgcatacactttacttgaaatttctagaaggtttgtacaccctcagggatccatgagtcacagctttaaagcccacaaaggatacatctgcctccaaggagcccagcaactttatgacacactaaaacaaacacataacatgcactcgcacaaccttgaccaggacagtccccctccacagtcactggcttgtatctccatgttagcacacccacctccaccactgagggggagctctgctgtgcttcgttgatctgcattcactaatctacattccaggccccacataaagcaagtataaagtgaatgttaagtgaatttgaagttagaagacctggacttgagctctatcactccctctgggtcatgttgtttcatctccttgaatctcacttttatcacccacgctattaggcagaaatcaccccggtttgcctcaccttttctgaaggattgctgggaggaacatatgcagcaatgcaggtggaagccatttagaacagtaacagtgaacactgactgtgtgcaaacactgttttaaacactttacatttattcattaatcttcatgaccatcttatcagggtggcagtgttactatccccatttcagacatgaggaagctgagcacagagaggtcggggaactggcccaggtaggcacagggctgggatgcaaatgcaggcaggctggtgccaaggccagctctcgtaaccactgtgcatagtgcctcttcaggagaggcaatgccacaaaaaatgtctaaaattatcctaacgagaaggcaaaagaaccctgtgagccttctatgaacattagtggagtttggaggtgtggggtttgcagggctttagatttagaccacccagaagagctcgatgttacatataactgcaactagcttgtgcatccacaactccaaattcagccctgtggtggtcagcgaatatcgagggagaaaagcagcagcctcatgtaggaagtgtagggccagggccccctctcaaagctcattcacatgtacttactttgactgccacaacgaacacatttgtaggctttccggcttgtggcttacctgcctgtgaccacaaagctcatatgtaccacaagtcctctttttcctacttcaaacaaacaatgctcatctccctcctctgaatttttttgtttgagagtttccaccttaaggttttcaaggggtccacaattcagttgtatcttgagtggaaatcttattctgtaaggcccctgtcttcattctcacacagtcaaagcacactagctgacaagcaggcttcgagcagagccatgataaagcttcaagccctgcctgcccagagctcacagccccggtgggtgacccggaaaataagcaggcacctgcaaaaggcctgtaaagtgctgtgatgaggaaaatatgggcaactgtgggagtcacagaaagggggtacctaatccagcatggggagagggagacactagagggtccaaaaagctgcgtatcttctctgcctttgtattgtcacaaaaatctaggagtcctcatgagctcaatgttaagtggttgcatgctttgactcacttaatcgaaaatgtttttaaaatcctgcttagacctttttcctcccactgttccctgagttagctccttctcaccctctgggtctcaatttccaatgtaattaattccctcttttcacgaagccttcctggagcaccctacactgcctggcatctcctgtgccatcttcctgcactttcttcctttcttcccagggaggcaggcttcatcttgatgtcccgggtgtggactgcagaccaacatcacctggcggcttgttagaaaagcagaacataaggccccatcccaaatgattcctcaatactttaaagctgcctcgcccaggaccttagccatcagccccatgtgactaccaggcccctgtaaaacggcttgtctgaactgagaggtattgcaggtgtaaagtacataccagatttaggagacactgtgaaaaagactgtaaaatatctcattaataattatttcatgttaattacctactgaaataatatttatgatattttggattaaataaaatattacaattaattttatctgtttttttaatatggctactataaaactgatagtcacatgtgtggttcccattatgtttattttggacagggctgccctacagcgtgagatgcgctggtttggataatgatcaagaacaggcattggcagacgacagccactgggtcaaatctggccaggtgcctgatttggtaaaggggcttttattggaacacagtcacactcactcatttactgtctttggctgcttttgggctacagcagcagagctaaggatttgcgacagaaactgaatagcctgaagagcttaaaatatttaccatctggccctttttagagaaagtatgcagaccccagtcaagaacgttcattccagaactggaccgattgacttaaaatcacgtctctaccactttttggtgtgtgaggttcggcaagttacctcacctgcctgtgcctcagtgtttgtatctgaaaacagaagatgagcatacatacctaacagagttgttatgaagattaaatgagttgatatatgtgaacttccttaaatagtgcctcatccatagtaggttctcaataaatgttagccaccattaatattactgctagcagttatcacaaattgtaatgacacatttttgctttaactttttttcctgtctgtctccccatcaaattaaagacctaggagagtggcatcattttctgtcttgttccagctgtttaagcacagttaaacagcccacacgtgagattcaatacatatttgttgcatgaatcaagtgcagaggagggaagtaattttcctaaggctccacggccagaaagtggccaggacttgaatgtggttctatctgcttgccaaactcaaattcttaacttctcttgatacaccaagtgtagtctatagaccagcgacatcagcatcacttgggagcttgttaaaaatgccggagcttaggcttcatctcagaccgactgaactaaaaactctattttaacaagatcgccaagaaattcataggcacattaaggtttgagaagcactgctctgggctataattcccagtttcgactcatgtgcttatttgttcaacaagcaattaatttagcatcaatcattccacagagccttgtgtttggaccccctaattccagagctgatgatttctattcatcccgatcaggtcctgggggtgtttagggtttgcaatgaacggcaatgtgctgtgtcagaagtgccctttctcctaccaggttcaaaccactgcaatgctggagtgacctctctgcacagaaatctgcttaacattccttacccgcctgtagtgaccaggccacaggctccggcagatgcagaaggtctgaaaatctagttgtaagtaattttcctctaggtgcctacctcagtgaattggttctcctgtgcattttatacatcagtggtcgcaccactcaaacacacaatccattcccgagtttaacagctcaggcaccttcctttttgattttataaatgaatgcaaatcatctcccactcatattataaaccaattaaaattctcctcacacttttaaaaaaacttgttacctggctcaaagatccttagctcttttcttagaaactggcccttatgtggcctgtatgtgaggatgagggtgtttgaaattagcaggaaatcttagaatggtttcccctttgtcacagccagaagtttcagattgtggtcatcagatgaacgctttaaatgagaaaaagactgattagcataattcttaaaggtctgaactctacactcacagatggcctctgagaggatggatggtacagaaaggagattaggataaatctaattagtttgggggtgttctcatttctcaagtggtgagcgatggagaagaagtgatggatggacagatggagataatgaagccccattaaagccttttttgattctcattctccatgatggagcacattatcccattaatgtttctgtgagctaacacagccaaagtttggcgctgtcacctcgaaaatgaattcgaattgcctgcccagctccttacatgtgtccacaggagttaaatgagcctgaaaactgtattcctgctgagaagcccatcctggcagcatgggctggaagccctcccctttgggaatgggccttcctcctggctggtttctaacagcactcaggccagagtcccatagcttttctgctccggggttctacaactagaatttcctctgaaatgggctgtggcttgcacgtatttccagggtactgagacagaccgctgctgttctcttcagtggaggtgacagctacaagtgctcaccatcacactctgattagggacctgagggcagggtccaaaaacaaaaagtggcaagacaggcccatgactcagtcacagagatgtgacataaataataatacaggacattgcacaggctatgtgcaaagtaagggcctgactggctccactagctcagagaacagtgagacagtgatgggccatccaggaaacagcagggaaaggggagagactcctcggggtttgaaaaaagaaccatgtgccccctgatgacagcagcctcctaaatggaccccttgcttctactcttgactccctacagtccagcatcatttaagaacataaaccagatcaaatgattctccccttcaataataatcagagctgacatttattgagcacttacttatgtgtgctcagcgctgatccaagcacattgcatatattatttcatttcacaacagccctttgtggtattaatatcatccttttattacagatgaggaaattaaggcacaaacaggtgacctggcccagtaagtagcagaatttattgacaagctcaggtttcttgacttcagaactccgattcttaacctataactcctgttccatgttcattccatgccctcccaccacacatggaataaaatctaaactcctctctgacctcattttgttccagtgtctcccatgctcactgtgctctcgtcacattcttcaagaactccaagcacggtccatgtctaggccctgtgcacttgtagttgcctttgtctgcttagaaaggatttcccttctcccatatccaccttcgaaatgtcagggtggcccacgcttgattctcagctctcttactttattctactgctcttcccaaccaggtggtctcattcaaggccatggctttaaatactatctcctatgactcccacatttatgtttctagcctggaacgtttaatgagttccaaccatgcgtgtttaatggctcatctaatctttcctctcgcatgtgtagtgggcacctatatttatcacccaaagataaaaaaaaaacccctgacttgtaactctcctaccctacttcagtctgtaaagtaaatagcactatcatccagctggttactcgagccaaaaaccagcaattcttcttagcttctgagcctttgcacccaatccatgaacaaattctacctgcttccaaggcacatcccaaagggcctatttctctccacctccactatatcatctctgatataaaccactgtgataattttgcttgcacttttacctctctttaatccagccagggagtgacccttttaaaagttaaatcagatcatgtcattcccttgcctaataccttctaactctaatgtcatgctaggccctgaagacctctaggccaccgtctgcctctttaaccacaactcctctgcctgctcaccaatgctccgggcacactggcctcccttctgtttcctgaacatgccatgctcatcctggatgtatggcttttgcaatcactattcactctgcttagaaaactctctaccccaggtttccccgggcttacagcttctcatttagttatcagttgaaatgttacctccttggtgaggccttttctaacccctctaaccaaattcatatgcataaatactttctttatcataccaagtttcatttccttctcactctctgagatgtctgtgtgtttaattggttttttctgtctctcctactagagtaatctctttggcggtctgggtctgatctggtttgttcacccctctatcccccagtgcctggaactttatcagggatcaataagtatctactgaatgaagagcaccatttatttagaagctcacaaaatgctaatggaggaggtaagattgaagacagatgataaagctgggacttcaatcctatagtcagtgggaggggaatggataaagagtaaaagtgacgcaaacttgtagggagtgggaggaagtctaaaatcttccatttgttgaatgaccataacccaggaggccctggtaatacacaggtgaacaaaaccaaaatggcccctggcctcatagagcttgtattgtagcatgtagtttaaacttttttccccattttaggatggagcaggggtaagcaaatgttttactgtaaagggccagagagtaactatttctggctcttcaggccatatggtctctgccacaaatactctgccactgtagtgaaaaaggagccacagatcatacacagacttggctgtgttccgataaaactttatttacaaagacaagcagcaggtccaacttggcatgtgggccacaactggacaacccctgggacagagacttctgtcccttctaaagaactggggagtactttaggcttgtcatgtagagaaacaggctttgaatcataagaaccttaagggtcttgtggagaaaaacatagatttattatttaccttaagttttctaaagcgcttagaaaacagtgagtggacctggagctgctgacctggggttcctgctagtcttttgttttactccttcccatgaatcaactagcttttgtaagaaacctcacagttacatggatttgaatatacttaacctgacaaagactaactcaaagtggctaatgcctataccagatggtggacctgcccttattccactgttagaaaggaagagaatgggcactactgattacttgtactgatttaagtttaagctaatagcttggcattaccctgacttcagccagggaagaaaatcacatccaagtttgcagactccatgaaacattggccatatatttgttggctcattagcttggacataaagactttctagaaagagatgccatcattaggtgccactcagactctaggggtgcttttggaaaccactgtgatcagaaacgtatatattgttaagggaagagagagagttgttctggacaggtaccgagaggcaggttccaggaagctgaagccaacagaatcaaaccttaacgtacataagccattcctgggctttgtccatgggttgcctttgtggtggttgtctgcctggtttccagggagccttcaattagaattctgagctgagatgatttatcctgtgtgctacattagctccatttgccattaacataaataaggctttagttacatgaggcaggcataaagggtatgtatgccttccattcatgaaaacatcattttttcaaaacaccagtttcttcttataagctaagttacactacccaaatatgtagtaatcagtaatacagaacaataaaaggccttgatacactgatccgggcatacgaggttatcaggaaatcctcaagtcagtgtctctccccatgggaccaatcctgtacctctttttccttcacctccattttgacttgaaatgcagtagacaacagagccagttcagtgccttgccatgctcccagcacttagcactgttcgataaatacatgagggataaacaaattgtaaggaaactcccatcccatgagaggagaaggattctaaagtgcatgaccacacggacacacaggtaacatccatctctttgggaaaaggagtaaaatggactttcctgaaacaactgctaggcagaaggtgggtgaaagccacaagcatagcctgcctcatagtagttccacgaaagtccattttacccctcttcccatagaaatggacactatctatgggtccctgtgtgtggctgtctcctgccatgtcgctggattttctcaggatccctgacaagtagggatttttggtcaatctttcatagacactcttatctcctcaaatggagacaccatcactggcattgaaatgctaaggtgagaactcaccaagacacactgtaggtaaagttccagctcagcttagggtttgatatgtaacgggcccaataaatgatagtgattggtattaggattgctttgttcttgttacagatgaagaagtagaatgtcagtggattacagtgaacagtccaagctacaaaatgtgttgcaactggaatttgcattccatgtgtctggttccttctctatgtacaggaatgaatcaggagagcacactggctctaccttcttccactctgacttctcagctttaatccctggagttccagggtggtatggactgaatgtgtgtgcccccaccacttccccaaaattcattaacaccacaatccagttaagatatttgttagtagggccttcgcagaggtgattagggttagatgaggtcatgaaggtggagccccaggatggatttgtgcccttataaggacatgaaggaccagagctctttctctccaccatgtgaggatacctcaagaaggtgaaccagaagcagggtcctaaccaacaccccgaccatgttagcgccctgatattggacttccagcctccagagccatgagaaataaatgtttctgtttaacccgtttagtttatattctcttatagcagcttgatctaaaacacagatacctcaagatggctacaaattctcctctaagtgcttcagagaggattagaagataaattatatatctattttgttttctatgctaggcctctatgatataatataaatataatcatttgtattataaactagaatataatacaaataaaattgtattataaactaccttaaagaaagtcctccttacactgaaccaatgctaatgttggttaagccaatttcccttagaaaaaggcatgtaggatcttgaaggcattggtgggctgcattccctgcactgtgagcaaggcctgacctagaatgacctgtaacatcacccctgtcatgggtcccaagcgcacagccaaaggtcttcaaaacatatgggtatccttagcaaataagagcattgctaagtgcatgattaataagccagaaaggctatggcacttgacagacggatgaggcatttcagaaagataagtcaaagtgcactgtgaggtgagtgcctcccttaactttcttagctgtgctactcggttcataaaccagggattaagtccattttcatttcaattttttatttcacctttaagcaactcctaaggcttccaggagaattttgtttgacctttagctaaagttcaacttctaccaagttacgaattttggatggtccctaaatgatcacttaagacagatttcactataattcaaagaaaggataatccctggcccaagagttcacaaaggaaggattcccagtggtcccagagatggcaaaagttatggatttcatcctgctaatgcattttagtgatattttcattgtgcaacattaattaccaatgtcagcctggatgcatttgctgggtattgaaaccacgacatttttttatctctacctggtcccagatgaagattagcttagtgcttccttgtgtcctaggccctagagaaaagatgcagcctacgggatggggtaaccttggcaagttgccatttgcttctaaagttatgatagcagtgttgaagccgtcactgagactctggtgctcaagccaagtaggagccctttgctatcatgacatatgctctagatttgcatttgtctaaaatctagcttttaggagacctctcagagatgtctcagggaggaacactcagaaaatgtgaagaggagcaatggacagagacagagacttccaatttatagtgaagaacagacctttgaagttgacttgttacataacctgacttatctaccagatctgtctgattcctaaagaagtatatgaaaatctctcaatttatatttcaaactcctgaccttcaggtgatccacccgcctcggcctcccaaagtgctaggattacagtcatgagctactgcgcctggccatcaattttgtctaatcagagttttttttcccttgaattttggattttgtagttaactactgggttgttgtgtgcctgtaataaagatagagttatttttgtccacaaaagttgaaaacagagctgccagttgacatgaaagtacaactcatttccatccacagcctctacatccattaaataaagagaaactcagtgctcatctcactcatgaatcagaacaggatatctgcacatgccatttctctaacttcccaaatgcagcaggaacacctcagccccgctctctcagtatctcagtggactggaagcacgttcatttaagaggaagggctcatagctttctgcagacagttcaataccatgatgcatccgattcagtttcgtccattctatttcttattgatcagcatacctcaggctattagttttattaattaaatgataattttggggggtgagtacacaaggagataaatgtctcacaaacagactccaagcttgcaggcaggaggcatgcagtgatttacaaagtatttatctttctggcatttttttttcccccaggaaaaagtaatcatcactaccatcttctaaaaacagagatgcttgttttctgggcaggcttggaaactagccaagacagcaggaagattgctggaatttcaacacacttgctgtggtaccatggtgctagtgacctgcccttgcagatataccttgactccccacagaagtcacctcaaagtctctgctatttagcaaatccctaggtgtctggggagtaggggtccagtctggggctgctgcctcttctgattggctgcctggctctgactctgatcccagaatacccagaggaatttgtttccatcctcctggcccacaactcacacaaacctctaatagtacacaggttattaaaagcaaataatagctgggcacagtggctcatgcctgtaatcccagcactttgggaggccaaggcgggaagatcacgaggtcaagagatcgagaccatcctggccaacatggtgaagccccttctctgctaaaaatacaaaaattagctgggggtggtggcgcatgcctgtagtctcagctactcgggaggctgaggcaggagaatcgcttgaactccggaggtgtaggttgcagtgagaccaaatcatgccactgcactccagcctggtgacagagcgagacttgatctcacaaaaaacaaaacgaaacaaaacaagcaaataatagtgtcccaatagaagcacttgccctaccacagccctctctctctgccatcaccaggcactttctgacatttccatctttctgacagggtttctcaacctcagtctctattgaggttttgggtcagataattcttagttgagagaggtggtcctgtgcattgtagggtgtttggcagcatccttggtctccacccacttgatgtggtgagcacacacctccccatccacaaacatctccacacgttgccaaatatcctctgggggagctgatttgccacaacccccacaccccaccagtgaaaaaccaatgtcttgggacaagtggaaagtgatgggggaaactgaaacctccctgacgctttggttcctgtaaggaaccacaggagactacatcattgtcacctctccctggtttgcagacattatttctgagtcatgtgaatgaactagaaaccttaaataggaagtcagaagggaagctggggaggagagtggggaccgagttgaaagatgatattgactatttgtacttttcaattagcacaggtgcaacgcttcaggattcttggccaaaaaatgatataaaaatgattggaccgacctgctctttctagggtaaaggtctgtgagtcatatcactcagaaaacatttttgagcacctatgatatccctcatccagtcaatcaagagatttaacagattcttcttctctccctccctgcagccattcttctaggtcttgccactattttcttcctcctggattctcccaagagcctattctctaccttctaccagccttgtttctcagtatccattctctcactgaaggtgagtggtctttttgaaatgcaaatcagatggtgctagtcagagggtgctagtcagccatctgctagcttccctggctttccattcttttcggataaaatcccaactccttaacaaggcctagaaagccatacattgcctttgttatttcattacttacaactgtgtggtccaactccactggaccagtcttgcctggttcctcccagagtgtgggacactaaccaccactgtgtaggtaggcacagaaggtggctttacgtagaacgcagtcacgaccttaaaaaatgttgaatcacatagtgattctttaggttcaacatcctttttcttccttgtgctctctcctagagaaagtcagttcggtgctcctttgtccttcctgcaccaaggcttattgatcaaccttcttgtgttagaaaagaacaagcctcaggctccaacatagaatctagttggcatttaataatactattttatttttgattgtacttacttttacagttaccttttgtattagtctgttctggcactactataaagaaatacctgagacagggtagtttataaagaaaagaggtttagttggcccatagttctgcaggctgtacaggaagcatgatgctggcatcatggggaggcctcaggaagcttccaatcatggtggaaggcaaagtggaagcagacaggtcacatggcccgagcaacaagagagagagaggggagttgccgcacacttttaaacaaccagatctcatgagaactcactatcacgaggatggcatcaaggggattcatgagaaatctgcccccatgacccaatcacctcccaccaggccctacccttcaacactaggtattacaattcgacatgagatttggtggggacacatatccgaaccatatcacctatttatggcatattataaatgtttccagtataacattccagaagtgattagtgatgcaatcttgcctttttttttttttttgagatagtatctcactctgtctcccaggctggagtgcagtggcacgatcttggctcactgcaacctctgcctccagggtttaagcaattctcctgcctcaacctcccgagtagctgggtttacaggcgtgcatcatcatacccagctaatttttgtattttttggtagacgtggggttttaccatgtcggccaagctggtaattccaagctgaactcctgacctcaagtgatccgcccaccttggcctcccaaagtgctgggattacaggcgtgagccactacacctggcagcatctttcctttttcagtgcatgtattcaggtagaaaaagaaagtttacttgaagaaacataaatagtagtagcagtagtttctagacatggcaaataccaggattaatgcttggtatttgggaaacaaggagttacttaaatttgcagcatgctctcatatgccagacgtccttcagccaggctaagaaggtggagtgggcaggagtaggagacattggattgttccttgtaatctctcatgcaatctttggagtttgatgcagatgtcaccccgccaaaatttgagtcagtgccccacctatgcgctccgctaataccttcaacaccccgcttagaggatctgtcatggcgcctgtgagctctgagatcatgtctgttgtgttcactgttgtttctgcagtgtctgacatgcagcatggcagaataaacaagacaccaggtaaatatatcttggcttgatgggtgaaatgggggtaaggagggaaacttatcatccttttcagccaggtctgggccacaccaaaagtgaaaggcagaatgagatgcctagataatccgtgccaataaagatgctgacccacctcctcctggacaacagagacaaaagagttaataatgtgaattacttggggtgcagcttccatctccctcaccacttaaagtgtcagaatttgacccccactggctaatgcaaaaaacacacagaagctggcaagacatgggcttgcttgtccctcctctttctttctacctggagctttacctttacaaatttgtagcacttgaaggtatgtttccctagccatttctggatcataacaattcctttttcctactgacaaaatctgaaacttagccggaagcactctcttgccagggaaagaactgtgtcagacgtgcgatgcgtgataaaatactacggtaatgtggaataatgctttcaactgttgccagggtgagcatgcatgcagaatgatggaaattgcctgcaaatacaaatggttgctctgtggctcatctgtaacctcaatgtaggaaagcggagatattcttttccctcctttgcaatttgcacagcctcttgttggaaactatggagattatgccattgaaagtaactgccatgtttactcaacacacaatttttactaatacagtctccccatgtagtcatctgtcttgtgaggttccctcaatactccagctgttcctgtggctgctgctgcgaacacctcattgaagaaatcaaggtgccaaacccaaatgctttatgtgagggtgtggaggtcatttttgcattgctgaaaatgacatccactttctaccttagaaacaaaggctgcataactgaatgggattcagtgcacccctacccccttctcagtggtgaattcaatgggaattatcagagggctggtctgtataactagaaaagccaaaattgttgggtgtttactatgtgttaggtattttgccttcttttaggtgaacctcataacatgctatatcataaatattatcctcctcattttggtgttgaaaaactgagagtcagaaaggttaactaacatgctcaatatctcccagataataagtgaccaagccaggatttagtcccaggtctgtatgactctaaatcttgaattatttccatgacaaataatgttaaactaaagccagcatttttctctttgagttgtggttaaactttcattatctgtggcctttaagcattatttgttggttttcacgtacccataactatcaggatacatgaaccaatgggaagtcacgtcctcatgaagagccagtagcctaaatgtgaaatttctcatgcataccagaagcacaaggggcaaaacacacacacacacacacacacacacacacacacacacacacacacacgtcaaaggcttctccctctttatgaaaagtaaaatgccattttctttttctacaaagggaacaagataattcattcacggatctcttgattagctcaattgttctgagatgataatagttaccatggattaggtacttactacatgccaggaatcaagggaagcactttgcaagaaggataacataatatttataacccaatgatgtaggcactactattagtcccattggacaaatgtgaaaactgaggtttagagattatgtatcctgccaaggtcactcggttcagttgggattcaaacctaggcctctctggctctgcctccatgttcttacctgctatgttatcttgttttctacaaacccttcctagctaccatctatgtgctggataaataagggaatctttttaccgtagagtgaaaatgagaagttctgaggaagtgacatagtgttctaggaagtgccctcctttaagaacaaagtaggctggtttctcactgccaatcaaagtgtgacattggcccttctggggctcacctttctagtctgcaaattgatggtagcaaaggacacaatgtgtaaggacccttcctgccctaacgttctgtcattctattaaccacattttcccctctcccatcatttctcctgggctttgattttcactttttcatggccagtagaagtcacacatacccaaggcgaggctgccctcctctagtgaactgcaatcatttgaacatcctgcctcaattgaatcatcctgacagctatccctatggctggccagtcaactcccaagcacttcctggaaatgcagatgctgtatccagggcagaaagtacttcccctgtcatctcactccctctctgggctccagccccaaggccttttaggtcttcagactggctccgtgccacccttgcaccagtgcacatgctgttcctctgcctggaacacattttcttccctgcctcctgtggttaggggccaggcaggtttccctaaacagggctaaaggcaggctacgatcctcattctagattggccctctcctatacagtacttctctgaattggtccctatttattcagttggatcagtgtcttagtcttccactatactcacccttgtgtccctgcacccagcccagggcctggctcacaggaacctctcaaaacctgttggtagaagaatttgcacattaacctgccacccacatctgtgttctcttattgatgaggtacaagaaaggaagatggtaggccaatttacagtggggttatgaggctaggtctcctctcagcccactaatgtctcagaaccacgttctttgctgagttcatatgttttttttttttaccccatctccaaacagcaagtaatcttgcagatcaatgcctgagaccaaagagacttatgaatgttaagaagattatgcacataaatgtaccactatgacagccccgctaagaagaatagtgatatcgcactgcgtgctagtttatcaacctttgctacttaaaaaattcacagccaatttaattaaaaatataacagctctgaaagctgctaaaatgactatgacaacaatctatcattttgtaatagtgctgaagatccattagggactttgcactggatgccaactttttaaagcccagatagtaggggcatttcattctgcacaattaatgtcactgcatttaaaatattgactatctatgaagaagaaaataccaaacatctttataacccacattttttatggtcaaaacttgcttagaaaggtgctttgaatttatttgttataagctgcacatttcacgttcagaaaattaaaatggtttctactgactaactcatttaatcatttagttgatttaatgaaaaacactatgcatttttctcttctccgttgctaagattaatactttctgttcattagcaatcaaatattgcaggaaggtttacatcttattctcacttaactcattgccttttatttttaaaaaattctaatagaattgaaatggtatcttttaaatcaggaattttcctcttggtaactcgttttgtcttgtggaaaacacatggctagcctgtgacattgaggcatttatgtctgaattgtttttctagtctttttaggggatgcattatagggaggaaagggagtggacactttagaaaaattatgaatctagttttcagggcccctaactcattaatacatcagtgacattctagcatcctttgaaattctgttaagaagggccctttgatttattagtgggattttatgagctacctgggaaagtgaacccattaaaaatgttaactgtaagcatctggcttccattgaataaagaatcgaagccaccacataaaagtgactctgcacaaacatggcactcctctcccatcactcccaaagcttcccattgtaaatgccacttcatcacagcagtgccatttgcagttgtagtctcatctctgttatccactgctattttcaggagtgtataaatgagcagcgaaattcctctcccctggaaatgcctgtaagagcagattctaaaatgggaactttttgtgacaagattgggtacaaaatagtataattactgtaaattgttcaataatagggccagtagtttaaaagcagcatttccagatttcctttgcttccataccaaaaagcattttcttgaaccccaattgcttcataggaggaaataataaaaggcaggtgatagcattttgtacttagcatagatacaatggtttaaggacacggtgcactgagtcaagaccactaagaggtagagggcaaattaaccatttggacagtaggaaaaggaggcattttaaggtggcatgcaatgagccagccagctaattatagtaagagcagcttccctaacttttactttctatttcaaggtgttcattgcttctctctctctctctttctctctctctctctctctctctgtgtgtgtgtgtgtataaatcatctgtcttcatcattgcattattgatattgattgattgtaggaggagaaaacaagaatttttccattttatagttaggaaaactgaaacacaggcatcagtgtgctgtaaccctactataatgctcttctctttttacgcacttaggaaaaggataatttttttttaacatttgtgcaattatttaatatgtgtctccccaacactgtaatatctatgagagccaaatcactacctgtcttgttcatcatcacagtcccagcactaacatagtccctgctatatggttggtaggtgctaagtaaacttttttttaatgaatgaatgaatattattttctgaggtcattcctattggagcattagtaaagcaggacaaaactccaggtcacattcctgtactattgttgaacttctattcacccttcaggactctggtgaaatgtcagcatctttgggaagcctttctgagttctccctgactttgcctgggctccattaatgcttcgtacttaggcctgttgtgtgttgtttcttttgcttccttctcttcacggaactactctttcatgtgggtaattatcctgttcctcaggctttggatggggttgactccatttctaactggccttgggatgggttcataatccagatctggcctctcagggaaccctatccttctggccatggttattggctcagcaatgatcctgtagcttaacttgggccagcatggtctgtgcaaagtttttataggcattactgaagcagcgggggtggggtgggggaaacccacaatctttctaccataagctagtaggatgtgagcctccggctgctggtgttcgcattaccttccctgaggagaggttgcctgagagaagcagagagacacaaagcccctaatgacattgcttgtgcccctggatccagccgcgcctgaatcaacaatactattagacttttcagttacatgagctaataaactcgttctcattctcttaaggctcttaaggcaggttgagttgggtttctataacttgcaaagggtctctaatttctctatgttgcagtctattgagcatgtactccatgaaatgtgggtgattcatttctgtattcccaatgctgagtataggccttgtccttagtaaaggcttgttgaattaaaaaaacggtgcaattctagggcaaggacatttccacaaggccaggtattttggggatgaccctgtcaataagggctatgtatcttttggatcaaactctcatagaagaaggaagacctcataaagacacccagaaagtaggggcgccaaggtcaaccagaagagagaaaatggccttcagccagtcaaggagtagcttacggcagctaagaataagacagtgggagctgtgcagccccagaatggatttcccatgcctggttttaatcatggctatggtagtctatgtcttggttttaatcatggctatggtagtctatgtcttggttttaatcatggctatggtagtctatgtcttggttttaatcatggctatggtattctgtgtcaaatggaatgactaatcctaggtgctttggaaatgttaaattgttcataagtcccttagagctttgtttctcctttgaaccccatggagggttttgggcctcagaacaggtatattaaaccgtctccatttcaactggtaattgagggcctctcaaagtctacctagaagagaatgtcttctactatagaaagaaacagatgatgcaaaattttgattttttaacctaaagtttggtcctgtctggcaaaacaattgaagaaacatgactttccaatctatttggaaggtgagggttccaagtacaccctcactgtgatctgaaaattgtgaaaatctgtactaatgagaagcttaggaatcacctagacctgggtttaaatcctagatttgccacatttctggggtggtggggtggactgacaggccctgaacagacaacgtctatgagccctagtgttttcatgtgtaaaacaggactatactgcctcacaaagatttgatgacaattaaaggaaattacagatgttaaatgcttaacaagaatctagtacatagtaagagctcaatgtatattaactgtcattgtggtgacaacaatcatgataatttcaagcttttatatccaattttgtgttggatgcttcattaggtaggaatgaacatctcaaacatatttgtccatctatcattatttctatatatgttgttcacccaaccatcatatcaaattcctgttcctttagtttggaggtccttattttttgggggggggggtcatgaacctccttgaaaatctgatgaagtatgggtgatgtgctcctctctgaagctccaatagcacctcacaggttccaccttaccccactgtacctccatccgcctgcactgtgactgcttgtttattcctttttccaggctctgggaggtcagggagtgtatctgcccagatcatcattttctttaccttgcttagctctgtgcctggcagagaataggtgtttgatattcactgaatgcataaatgaaaattgcaaagccttccccctgaccccttaaaaattcacctacactcaagtttttgcatctaatttcagaccctgtctgaggactccaggtaagaagctactattaatgactacctattgtaggtcattaaaaatgcagtagggaaattttcaggccaaataatgaagcagcctgtttttcaggccaactaatgaaacagccttaccacaggccagaaagaaagtgtagatcgtcttctcaagagaggaaggacaaagtcagaattgacactgtgttcgtgatgaaggcaacctttgtccaggtcccttgttttaccaaagacgacaagaggagccagccttgcccaaggtcacatggccactggtaaagagacttgagcctcctggcttccagaccagtgctcatcaaactcaaaccttccccctcttcccctctcgcactgcctccccagaagctcagtccttgcgagaattcaatgaaaatttccttccaagcatggtccgaagacaatgtaaggaaatgcaggatttacatgactttggtcaagtgaggggacaggactttaaaccaaagagttgatttaaatcttttaaaacctacagagtgaagggcttgcctcattgcctcatttgaaagatgaaatcattctgtctttatttttcattgatgggagtttggctttggagggaaaaagatctggcacttgagagctggcccagtgaggataggggttgtcattttctcctcactgaggcttagcaatgcctttagctaaggcccggcccatgtatccccaaaagtgacaaaggtacagtatttcacacaggaacacttggggagcatttttccatgggacacggcgtgagaatccattaatctcactgccacatactcaggctatttctcacaagcttagccagacatttgggtttttttaaaccatgaaaaaaagagccttatcctcctcatcataccagattgctccagcggataaacatcagacatggtttttagagaaatatcacacgatctgagaacatctgcaattctctagaacgtaccgttgtcagaacttgacttaaacgaaacaacagacatcagactttctttcagacgttttgcactgaagctttccattatagcacgaatgcctccttctgaaatggcaccaattgaaaacgcaccaggacacgaacattaccacaactcaaattcagatactcgcatgttattaacaatggtgctaattcctgtttcagagatgaaacttacagaggagataccagtgggttttcctccattgctacttttcatttgctatggaggccacaaattcaagagatcactcattcttaaattaacaaaagtagccaccacctggcaaaacatcaggccctgtgcaggcgctttatatgcacctttatatgtatcgcctcttttaagcccctcagtggtcctcggagacagctgctgttatcttccatgtcatacatcagggcactgaggcccagagcccaagtgatattgtaacagcacttcctgtgtgctaagcactctccatgcattttatttatagtatctcattaaatctcaccaaatcctttgaggtcagagccatcataagctccaatctacagctgaagaaactgagacagctctcaaagctaggcctagtttcctccaaagttcagtcacatttgttccatttgacagtatgagggaaggcctttttttggttaagcgtatagactctgcagttaaacctcctggaccctacccttgttagcagtatgatcttagataagcacgagttaactttaccatggctcagtttcctcacctgtaaagtggcataataatggaacttacttacttacctcaaaggatgaagagaatgcaatgcaaagcatgtagcatggggtctagcatacagtaagttctcaggcagtcattagcagtattaaaaataatactggccagtggctcatgcctgtaatcccagcaccgtgggaggctgaggcatgcggattacttgaggtcaggagttcgagaccagcctggccaacatggtgaaaccccgtctctattaaaaatataaaaattagctggccattggtgggtgcctgtagtcccagctactagggaggctgaggcaggagaactgcttgaaccctggaggcagaggctgcagtgagccgagattgtgccattgcactccagcctgggtgacagagcaagaccctgtctcgaaaaaaaaaaaataccataacattttttcttcttatttttatataaaataaggctgtattcataaaggatacagggattaaagcaaaccaaaagagaagagtgagggtaagtttaattgtgtgataaggatttaggtaagacagcctaggcaacatggcaaaacctcatctctaccaaaaaatacaaaaatgagctgggcacggtggtgggtgcctatagtcccagctactcaggagactgaggtgagaggatcatcacttgagcccaggagtttgaggctgcggtgagctatgattgcaccactgtactccagcctgggcaacagagcaaaacccggtctcaaaaaacaaaaaatacaattaataaataaaaagtaaaaaattcaggattaaggtaagaggtgccccgctgtgcagcacagagctccatcggattggaaaaagtggctgccaggggatgcctccccttattagttcagacaggcttatgtaccggtctccttgcgggaagtcctgtgctgctcagcgttgatggaacacacaatgaacttttccttgcttttgtctctaccagaactcgactgagtgcgccctgctgtgtggttttatccctggtcttgggataggtttccatggctataggaaagaggtggagacagggaatgccaccttctgagttcatcagaatagaagtgtgcacctgcagcaagacatgattctccctaatttgctttcaagacaaaactgtgtctactgattgggtagatattgttgaggcaagatgcggtatgtctagcctgtgtccaacacatatggcgttaggtcattcctttcatctcctctaatggtgcccagtacaatgagaatgaaatgcaaatcccttaccctggctctgggccacccagacccatttgcgggtctctagcaacacccccagaccctctatctctcccttggtcacaagggcttcctttcctctttaaggtccttacaccagctcctcctttgcctgtgacactctgtttccaggtttttcatgtacgttcttcttctgttgggtctctcctcgaatgtcagtcttcaaagaggccttccttgtgactccataaaccactgcagctctctgattcacttccttactctgtcttgtttttctgtctgctaaaatagaactgataatcctcgtcctccttctctcacagcatttctttgatgagcaaatgagattcatgtgtatgtgtctatgaagatgcttttataactgtgagtaatcaccagggatgcaaaggagggttcaatttctatgtcagttcacactgggtgggtttttctgggtttttctgaagcacagccctgagatgaattccaagactgcagtattctcagtgacaaagggtgcagcaatcccttaatgatgtctgacttgggagagggaattagaggcgtgggtgtcacatatttgctatctgtgccaaaaataaagtcatatattaatagaagcccaaaatcaataatttacaaatagcttcctcaaactttcaatggtacttctggaaaagtgagatttgaaattttactctccttcctttgcactctaaaaatttattcccctgatattacttttatattaaaaactaattagaaaacttcataggtttcatcatatatttaacatcattgctaaagttctaacactatttttggaaatcatcaaaagagaaaagtgtaagacagacaaggaaaacagagaagttttccatgtttaatattataagtcaccacaaagtattattttgatattacaatttttttttttttttgagacagagtcttgctctgtagcccaagctggagtgcagtggcacaatctctactcactgtaacctccgcctcctgggttcaagcaattctcatgcctcagcttcccaaatagctcagattacgagtgcccaccaccatgcctggctaatttttgtatttttagtagagatggggttttactatgttggccaggctggtctcaaactcctgacttcatgtgatccgaccaccttggcctcccaaaatgttgggattacaggtttgagccactgtgcctggtcttaacaaattttaaaaatagtgataggcaaatacatctaatgaaactagagtattatttgtcatttctttggatgaaccaatgcatgtaaggaggatgtagttctgggtttctcctgtttcatcacacagtaacccaccgtggctctctcctccatgccgatattatataattgtcaaggcattgagacagattttaattcatttaataattaggtcaataaaaaccattattgctgacagtgccattaaaagtccataatgtcaccttcatgggggaaaaactaatatagttccgttggattttttccgtgaaattaatatgatagcatttcagtgggtgtcttaaatagcttaaatagacatttttattaacagaactaatcatagaattaaaacaaatgaaaatcgttacatttgctgtgatgaggtatccatgttcacaggattttatcagcctcattcctgtgaagaacctgaacatttactaccacaagaacagtatattcaacttgcctggagcactgcttagggtcccaaagaggctgcccatttgtgttttggtgatttcctcttcaacaccatggctccatttctcagagccaccctactgggaaacatgccagaaccataacctcctaaaccaaaaaccttcttcatgtcccctttttggctggtagtatttcatctagaatatctaagacagtatttcagctcagaaaaatactaaagcagaaggggttgcacctacgccgcccagcaatgttttatcacctctccttcctcagcttaatcactaacggtagatagatcttaacatgaactaaggtaaactctagtatagtgctatacgatttaggtaaattctcactagaagagcaagatagcaggaggaaagaagattataccaagagtttcctctcagacacatgaatgctatggttctgtgagttattcaaatgtgcaagtcactgtgtatggctgcatcattgctgcttgggtacctacaactcttcataatcagatataccaggattcacaagaattcaggggtggtcaatattgatcaaaggccaaggccacagatgtagctagcacattatacactgacagaacgcttgctaatgtacacaaagaagtagcggctggagcctgtgaggctgtgcaaacagtataggctttgggtttgggaagacccgcattagatcttagtaacttggttcccaacaggatgaccatgggcaggttagctcccttcagttttcagtttcagcatctggaaaatggattgatgaagtccacagttgtttgactctgtggtttttaggatggttcgaaagagatttcagatgaaacatatctaacaaacactgtggctggcagagagtaagggctattcttcagaggaaagagtcatctcagttggcattggacgtatttaaaatatgattgggagggtagcctctgctaacctccagccacgttggtgaactctcagaaagccttgtgcatgcccagacatgctgaatctaaacaaaccaaagggaagctgcacttctccactgattactccctttcctgccctttggaagattctagaaacactaggaaatctacttaaatattttttaactcagttttaaacaacatctctcagaaaataccattcttagtagaataaaccttctttgaaggcgtacatagacttacatatgtgatatttgcaaccaatcagcattttgggtgactgggcaggtcttgggaagtgggaggcacagtaaaaatgaaagactttgtttgacctccctgagttctaagcaagatgtggtgcctgagaaagcttatgcaggtcctactgggcaagactataaagccaagcgcaacagagaaaaaaataccttagggcacggacgtttggtttctcaaggcctgtgatggggaaggccctgaaactcccctaacagggatggaagaaatctgtggatattttgttcatgagaagtagaggaaaaggggaggggagaaagtggaaacagcaacgtgtctggaaaccagctggcacctgtgccttgaagtaaataaattgggtaaagaaatatgatagctagatagtcctagaaatgaacatcctgaaatcatcccataaactttattttggagggggatagggaagagaagagaccctttcttccatttatttcatttagttggtgatattattgggcattaacttgggattcactattcctgtggcaagtacttacctttgctgaaattaccaaatattctctgaaacagactcttatcagaaaattgatctataatacataacggtgtcttgcaagaaaaaagtcccttgtgggggcgattttttaaaatggttcactgcaggcctttcacaatcacatggaaatttggagattgctcagatattgtgggaagaggagaaagggaacaaagagagacataatacttgagactttacaggctcctaccattttctagtctattcgacaagagcagcagaggttcatatcaaggaagtgaaaaccattcaggaatacaaaaattgtttacaaaaaacagcctgtgctttgcattcttttctgttacttcgacaattgccaagaagtgtaactgtgcttgctcggtattatttaaattaaattatcaaatgcaaatgctaaatatgaacctctcagcaaagcactgggttataatgccatgtcctctattcagactaaaagctgattactggttctggagttacaaacatgtcagacaataatttaattgctttgcaggtagaggaatatgcagcgttcttgttctcattctggaactcaacacgactctttaatacaacataatgatcataaacacacacaaagtcttcgcctcacacctgctttatggtaaaaagaagctattgcaaatttctgcaaagctcaaagaatgaggcagtgccagattttttaatcactaagcaaaacaggtttctcaccaagtggcccgggcttttactcctggttcagagagttacaagacacattttcaaaatgagtttaaagctataatgaatttcaggtgcaaaggaccaccgtctaacagctaatttgcttcctgtcttcaactgagctgttaaccataggcagccagcatgtgcacccctttcttgggccactggtgaagacagatgtcacaatcaatactcattaactctgggatcagtgtgtatcttcctcaggaagagaaagggggtcttaaatgtaactaggaggactttgtaagcattttctgagcattgcagtggctgagtgttaaaccacaacaggacaggagtgcaggagggggagagaagaaaggggagggtgagagagggaagggaagaagaaaagaggccacatttcgtgatctcctctgtctctggagctcttttttatcagctcgtgaaattcccaaggatcctgatcatctcccccttcccagctcatcgcaaagagttgttgtacatttctttgcaattgggtagggaaagatcttgaaaggtggatccaacttgaacattagacttttgtgaaacatgatacagaaattgtagtgttgcagagctgtacctgctcatttgctgactatgatgacccaacatttattgagcactgtatgccaggcctgtgctacctcaatgcttcacctggagtaccttatttaatccttatggcaatcccataaccctataggaagcagtcatccttttatatatgatgcacataaaactgtctgaaatgatttgcacctaatgtaatgatggtaggcttaaatgctttcatttttgtactttgctgtgttttaacaagtttttgtgatggatttgttcttgtttttgcaaaatcaagaataacttaaaaataaaagactggatgccaatacaaatctcccaagatgttaaccttggttaattctgggtgatgagaacgtagatgattgttatttccttctttgtacatttctgaatgtttagtttccctatataagtgaaaatatagactttaaaaaagaaaaacaaaagaagaagcccttcactagtgccacagtgtgaggagaatgaagcctaagcctaaattttattaaacagcagggtgacccaatgctctgtatcaatgctagatacaccaccaagcattcgctacgcataatcccaccagctccttccaacaactctgggaggtaggtgtcaccaccctcactgtacagacaagcagagtgaggtttcgagtgggtaaaggaccagcacttgaggtcactcgggtatctggcctccacttacccttctggcctgaggctccatggcatgccctctgacctttgctcataccctggtctccagccgcctgagtccttgtctttttctgaccacaacctcaaagtccctaggtccatacctaatgttcacactctctcatttacttggaaagccattttccagactacacccattcttccaaacgtgtatcaaatactcccccttccacaaagattctctgagtcacctcagccttagtgtattcaccttggtgtagtatatgccacaggctgccacatggcaggtgccaggccagctcaggcacactgaatgctctgtatggcttatgcagtgtttaaaagatttaaaaaataattagacttgtattaaaaaaaaaaaatgtgtacctagtggctcaggttcccctaccctgcttggcaataattaactgtagccaaagcgtctgccctattcagacagaagcctgtgtgtgctctagttcccaacagtttccttttaatactccttcttatccttggcccatttctcttaattcattgttgtcaggcctctgagcccaagctaatccatcatatcccctgtgacctgcacgtatacatccagatggcctgaagtaactgaagaatcacaaaagaagtgaaaatggcctgttcctgccttaactgatgacattaccttgtgaaattccttctcctgactcagaagctcccccactgagcaccttgtgacccccgcccctgcccaccagagaacaaccccctttgactgtgattttccattacccacccaaatcctgtaaaacggccccaccccatctgccttccttgactctctttttggactcagcccgcctgcacccaggtgattaaaaagctttattgctcacataaagcctattggtttggtggtctcttcacatggacacgcgtgacaattgttttatgtgcccagcacatcacaggtgttcattgagggccagaaactagtcacttcactactgctataatcctagggagagagaatggtggtctgaattacaagcagtgagaatagagaaaagatattccaaagaatctgtcctctgaaattaggggctttatttatttattggaacactttctatcttgaactgtagtgatacgggtatacatcttacctattctacttgactgactgcatccccctgaagacacgtgtcaggtgccatgcctgccctgtgatatccccagcgctgcctagctgaatggtgcatacataccaggcacgggatgaatgttggttgactgatcattcattttaatcctgaaacctggcgtttatgtttccgctacatttaaaagctggcaaaacacatctccttccctcccactcactcaattaaaagctcagtacattaattatctgaattaaagtcaagagtctgagatatccctcccaatttataaagacagggacgaggtaaatttttttcccaagttgtagggacagaaagaagactaaagaatgaggaccttacaggcgagcacggggccagcgaaggattctgttttaagatcatctcctggtgctcattagtgctgttgctcttcacctgggtgagcgggcttgcttccatggagaagagacctccgccagctcctgctgcattaacggtctccgaatgtgatttggcggcagcacgggtctcattagagtgggggatgtgcaaaggcagaaggcctcactttgagaaaacactttgcgtatgaacaaaggtggaaagatgtcaggcttttaaagggaacctgcatctcgctcctcacttagcaaagtcatcaggagattctgctaagtaaagaagttctggaccttttcaagctattaaaggtgacccaacaaagcaaaatggctttgttccccaaatttctttttgtcagttgccttgaacaaccaagcctgaacgaaacagcctaagggagattgccaggtaataataaatccctatttgcttcagtaaaggacatctcaaagaagggataaaataaaaaatatcagaattaaagaggcacaaaaaaccctgaacatccggggcatgtagatgctcggtagcaatgaatgtattaggttggtgcaaaagtaatagcgattttcgccattactttcaatggcaaaaactgcaattacttctgcgccaacataatacttggggcctggttctcaggggtagggcttccagcattttaagtagcagtctgccatcaggcaagatgtgcatattcatcattgatgtggcttgatcatgacatattctgttttcttgagcaaggaaagaactcagcaacatctcgcagagcgaccatcaggttatgtccttgtctctggttcatttgaggagagtaggaaattatgaaacccacaagaagagtttatggctcctcctcacactcctacacttaaatccaggaagagactgccaggcgtcggtcaagtttgaagatatttaatggactatgcattatctacactgccccatttcaaggtcaatagctgtctgtctctttatcccataaggctaggttttcccttgaagaagaaggtactgctgttactggtagagggtgcctatgttcttggcatcttgaagaactggacaaaatgcgcaaacaaagcaaggaaagaatgaagcaacaaaagcagagatttattgaaaatgaaagtacactccacagggtgggagtgggcccgagcataggggctcaagggccccgttacagaatttttgggggtctaaatagcctctagaggtttccattggttactgggtgtatgccctatgtaaatgaagaggatgaagtaaagttatgaagtcatttacttggcgtatgccctatggagaggatagcccctgtcatagctcaagtgtgaatcagccttatgttccctgcctgcagaccctattttcctgtctcactgccacttgggtctcctgagaaggccctttgctgactctgccttctgggaactggcaagtcaggtgatctctggagctgccccacggtagaaagtgcagagcgaacagccgaggactgtcatgcactaagcatttggggaaaccaccctttctcccaggttggtgggctctctcgagacaggtacctgtacttacttggtattggagtgctctaatcttagagtctagtgtaggcttcaggggagagggagctaaggcggccattctgtttgctttgtttccaggccttgggtttgtctctagagggagaaagagtcctcctctgtctagcttgaagcagtgggaggctgtatggggcacggaataagaaactcaaagtgtccctttccggcgtgtcctgctctgtgggcacttactccttcagagcttgtgaagacagagataaaggtcagtcaagcccaggaccaggtgttgggattgttcttatccccaagttttctaatttcactaggaatattaaaggcaatttaatgcaatctgcattttaaagataaaagtgatggagttcaggacatgcttccccaaaatatggcaccttggcatagtgaatattttcagctaaaggaatgtgagaaggtaacagaagtaggaaggtctttctgactgttcgctccctgtttgtccttgcggcaggttagaagaccctcattggagaggtgccctgaagaaaggaatgttcttatctctgaagacaaagggtcacagagaagaatctgaacaaaactctgtgctaagtgtccccagtttattgccattagactacatcctttttgacctagaagctccaccttcaaagtttttaggtagccatgaccagtctaactgtagaaatggaatggaacattggaaagactgtaaacttggagctctaagaactaggttcagtttcctccacttatcagctttgtggccagagtcaaattttgcctctctgtgcctcagttaccttactacaaaattaggactattctgaggcttcaatgagggttaaccatgtactgagcatgatgctgggtatgctactctgtagacactacttctctcccctctcctctttggtgacttttaaagatcatggggaagctgggcgcggtggctcatgcctgtaatcacagcactttgagaggccgaggcgggcagatcacgaggtcaggagatcgagaccgtcctggctaacacggtgaaaccccgtctctgctaaaaatacaaaaatttagccgggtgtggtggcgggcgcctgtagtcccagctactccggaggctgaggcaggagaatggcgtgaacccaggaggcggagcttgcagtgagccgagatcacaccgctgcactccagcctgggagacagcgagaatctgtctcaaaaaaaaaaaaaagatcatggggaataatctacatgaaaatggatgttgtaaagcctaggacattacatgtgttatgtggcaagaggggtaaatggtagagttaatttttaggcctctcttaagcctcacaatggttctaattttgtaataaggtaactgaggcacagggagacaaacacttgactatggccacaaagctgataaatggaagaaactgaacctagttcttagagctctaaatttatactctttccaatgcttcgttccacttctacagttagactggtcatggctacctcaaaaccttgaatgtggagcttctagatccccagcggcaattcccatcaaggagaattttgcctgcttgactctctcctaccatccacagtcattgttactgcaagtgagttaaagcagttgagcaaatcatatatatatatatgggtacagggtttatatatatatatacatatatatgtatacatatatatgtgtatatatatgtatatacatatgtatatatgtgtatatacatatgtatatacatatatatgtgtatctccccagtgtatggggttagaatgcagctgtggaacatgggggtgtcctcttagtgactcaaaccaaattatcactggagaaacaatgagaacaacaaaatcaaatgcaaaccaccaaaatacaagtgtagtcctcatatcaagaaaaagataagggaaagatcttcagaaagcccctctattaattatttagtctcagctcagacagttccagaaacagaacagtgataaacaggaccattgccatacttctggagatgaggaaaacaccagaatagaaatcttcagtgggctagtatgggactctggctgtgatccctctcttatccaaaattctgctaagggacttgcctgagaacacacacagatttctctatgagagcaaaataagagatatatacataggttagataatgcaatgaagatcaaaaattacattttggaatgttgtattccatcttatggggcagcatttaatcaggatcctagtgcaatcttccatctggagccccaaatccaatgtcacacattgcgggttggggtgcggaagatctagcttaaccctagtgaggaagatgtcctgcctggttaacttccagctcagtgggtattagtagcatagcagggatgccaaacaggaacacactatggggtgtcatcagcaagaataaggtccagagctatgtggtgggttagaagtctgaaagtcagaaaaggctttggaagccctcttgtcttccattttacaggtgaagaaactgaggctgaatgatttgtttaccattcaggttacacagagagttaaagtcaggacccagaccttccaagtcccaggccaaagcaggtgattattctgtagcatgtgctgtccatattcctcggcagcagtatatcccagcagcagcataatttcagaaaaggaatgagaaaaggggatatatccattggagggtacccaggatcaggggtttcaaagatgcacaattctgggacacagggtgagtagtcatgagaagtggagatatggggtgggggtgcgtgatggtttccgcaaacacaggagaaagaaacattaacaacgtgggccgtggaaaaggaattaaacttgtttggtttcatggagcaggtagataactagtgggtggatcggaagaaagcaatttatatgtctgtggtgaaacatacacacataacgtaaaatccaccatttagccattttaaagtatatcgttcagtggcatttagtgcattcaacagtgttgtgcaaacatcaccgctacctagtttcagaacattttcattatcccgaagggaaaccctgcacccattaagtggtaactcccctttcccctacccccccagtccctggcaaccacttatctgctttctgtctctatcaatttgcctattatggatatttcatagaaatggaatcatacaatatgtggcctttagtgtctggggaagcagatgcttttttaacataatgaaaattgcaggatgaagagtgtggtttgaaagggggcttggtaatgacttaggatgcttgaattcaggccaaggctagaagtccacatggtagggatattgcggaggggcctctgaacaagaagtgggcttgaaaggctggctcttcagggcttttctgacctggagatggaggccctctctgacaagcccctgggactatctccctttttccccacaaccccacctctgccagtgatgaccagtctctaccctacggtaaaactcaggtccaaccacgtccactccttttgctaatttcccctcttttcattctcctcccacctccgggtctgttgacacttgcttgccaatttgcctgacacactgcagacaatcttctcactcaagcatgtttgacctgaacatacagctttctgctgagctgatctggagtttcagttggccgtttgggcagccagacatgaattaagaacagggataaacaaggatggcttgagctttaactacaccgatttggcccaataggctcggggataatctataagacctaacagctgagggcaataaaattagctacaaagggactgcggggtagaaacaatgtcttctgatacttcacacaacacacactcacacacaaaagacaccaaaaactctccgacagaagccttacaacagcttagaggagaggcattgtgcttgaaaaactatattttaaaaagcagagaggaaacccacggtgactgaagtatcattttcccggtggtgatcatggatttcatcccaagacctggaaatcatgttagaactacagtatcagcccagctttgtgtctagggcttaaacttgaaatgttgtttacataaatagttaaggaacacatactgggttgaagagtgtgctctccaaaaatgcatgtccacctagagcctcagaatgtgaccttatttggaaagaggtcttgggagatgttattagtcaagatgaggtcatactggattagaatgggccctaaattccgtgactggtgtccttataaggacatcaacggagggcagaaggccatgtgaagacaaagcggacactagagtgaatctgctgtaagccaaagaaggccaaagattgcggaaaggaaggattcttccccagaactttcagagagagcatgattctgctgacactttagttttggacatccagcatcttgaactgggagggaatgcattttggttgttttatgccactcatgttgtgccaatttgttacagcagtcctaggaagctaacataatacactcccaattccctcttcttttatacaattgtacaaccctatttgaaacatggaaaaggctcttagttctcacaaaaaaatctcattatatttggagttcaacttctgaacacgggtttagaaacaaatagggtctgatttcactgattttcaaagggctttctttgtaatgactggggtttgttttatttgtttgcttgtttccaggagaagagaagattggcctcagacacttccgtcttcagacctgtgcctctcctttgaggatcccttccccgaagctgccaaggagaaccttccctcacattgttcctcctttgttccccgctctccttttccaggctgagagacctggggccttggaagcaagcacacgctggctgagctgtgattcctccatgttgattataatttttatcacattatatgggatccctctggtggttactaggggatacgtcagttttgagagattggaacctaaccaaagaagcttcaaatctagaggataaggggactcagagtttacaagtcacagcaagcagatgctggtctgctttaggtgcctcttacggggattgtgagagggctcctggggcctgaggagggtcttctgaggtgtgaaaggctgtactggtggtccctgaaagccatcgtcatttgtgtgaggaggagtactggaggagctgtcttaccacatgaaaaacagcatggagcatcccagccacatcaaaggcacggtttgagccttgggctgtagaggctcagagagagtgacaaataagaccctggtgagagaccaatggggacagtatttccagactttggcatgaaacagatttctgagcacctcatgaaatgtctgcaagggcagctcctcagagtgaccctcccaaatcaatcaaagctggccccctatcttaattatgacttacaaatagaagcatgcacctggctggatgcagtttgccacatggtttacaatagcggtagaataagaaataacttaccaaacgagtacattttcttggctggctggggcactcagagttgacactggtaaggctccattaaaatgcctttatgttctgatatacacagatgtgttaatttatagcatattcatcagaagacataaattaattgctctctgatgaattttataacacctcctttatgcctctccaccctccccctccaaagtacactgaaaaggtcaacagcactatcgaatgcagcacacttcaacttccttccaagcttataattaaagctaattagtagctttggtaattagcgcatgtaagctttctgctttctgaattaataagactgagtcaggttttgagccaagtagacttttcactcactggttctgattcttgaactgtgtttggctggttaatttaaaacatgtctgttgaaagtggaatactagaaagaaaacatacttgtgatggtctgctctcaagccagtgtgatttatgaacaggccaaagtggaactgttgtcacaagagaaaatcagaatgctctgggtttccaataactgaccagtctcaacctctcagtgtgaaatgagttgtgcccagttactatgtcacatggacacaacacaacgtcaaggatgcccttgcacacttatgtcaccctctcataacacatctgtactaagcacatcaaatcctctttattttaggagaatgcagaggcaatggcagtggggtgccaagatataactaactgctcattttgattcaaataaaaatcaaagaggagaaaaatcattagtcaaatcagcttctgcttttgtgtagacaaagtgattctccaaatagcttcgtgtttctttttttagccagcatgtgggcatcctgcatgcccagacagaattaaaagtgcatgttttaaaatcaagaaatcaaatctatattctattaaaagaaaaaatgtgatttgttttcagactttagaaacagttgggataaaaatttccacgggtgagctcatttgctttttcttttcccatactaatctcagaaaatttatttttgttttttaaagaaagaaaggaaggaagaaaaagaaaatcacttagtgatttactggactccttataagtccaggacaatggtgggggttgctcacagcgctagtaattttgatacataaagaaaaggaaacagtcactgctgcagagagaggaatatataagacagctctgggtcactagagtaaatggttttcattttaatggcgcacttactgccactgtgatagccacatttggatctgtaaggggcagttaatactattcaagagcaaggcacatttggtcttgtggatggctgtgattgtgaaggtgacaaggggttatggattcccacagcctcacaggcccagctgaataggaagccttgtgcccccttggcagctcatcctaccccgtggcagctcatcctacctaggtggatacactccagtaagatctatacacagtggttctcaactgggggagattctgcccccaggggatacttggcaatgtttggcacagttttgattgtcataactggtgggagagggtagatgctactggcatctagtgagcagagactaggaatgttgccaaacgatcagccatgcacacgacagtcactcctcaacaaagatgatctggccccacaggatactagtgccaatgtcatggaaccctgatacagaaggtctaaacagggtctgaggccctccttgtctttgaggaagagttaaatgttagctttccagattgactctggactgatcttggccttatacaagtcagaaagaagtgagtgatagctcacccacaggggctagatctgagtcagactggaagaagtcggcacactcagggtaacggcagctgcctaaaagccaagcgctgggcatttttatgttgcagctaaggccagcatgctgcattatggatgagctcatgtgccatggcaaacagtttaagaacgatgcttatatttaatgaatcctaaatggtttattacagagggtcaagtttctgcttcctgtgggaatttgacatttatgaaaatgcacgcacattaattattcagtggagacgtccttcctatggaaattcactttcctgtacactcgacaggactacattccctgtctgcatgggctactttgttgttaatcctctaagcattaattaaataaaatttgcaaccgagccaggatgcatctaccctcaaatgttatgcaaaagacagttaaatgctgtttgatttttcctgctagtagccaatcattacccatagctatttatgttcttccttttgttctttaaagcataaacctggtatctcttcccactgagaagaaaactacgctcagtaattaaattacaccacattaaacttacttaagttcaccagcagggaaaattccgtgcccctgggtttaacagtaagtcctaatcacgcttgcaagccatatcttttctgtgagttgttatagttttcattcctggaattccattaaaaatggtaatgtcattactcctgttactgctcaaaaccaacagcataatcctgaattttaattagtaattacaattaatcattatttcattaatgaaatgtttagttggtaattgtctttgagcaccttactccctaggcttataagcatttcataacatctaatttgttgcctgtttctgatgaagtggcactgtcaaccttattttatgttaacactttgatggggctctgcatcccaggcctgcaccaccggctgcatatttacaccttggaaatgtgtggcttctggctctcgataaggttcgcctgaggacgtaccctcgcattctttcctgccagcttaagaaggcgactgtttgtgctcccagagagcacagcatgtgaagagagaaataataattcctggaacgcttacttaataataaatctgggatccaaattcatggatttttgagaggggatagagcaaggatttggaggtagtctttggaacaggaaggttgattttaaaagagcttaaagaattaagaataagctgggagggttgtcaagaatttaacacgaggcaagatttttgttgatccttttgcaatagcaaagatattcttatttattaggatggttttttaggggtgaggggaagcttgtcttccccaccaaaaggtcagggacccaagtatgccttgcacacagttgtattcctagctcctggtgcggggttgggcatacacgtgactcaataaacagctagataagtcattgttcctgcatggcctatggttaggctatgaagggggtaactgaggtacaagagttaatggtggtttggtgatggtagcagggtgtgggatgctaggagatgccaaatcagtgggctggtgtgctcacaaatgacctgatgtcatagttgtctgtcactgacaattctaaaaggacggattcatccgactgccctctatgtaaaaaaatttacacatacacacacacacacacacacacacacacacccgacggtgaattattcagggaggagaaagcctgctatccttggcaaattaaacaaggaggatttgagcaaagaaaagatgtgctgctgttatttcaaggaagtattcacagcttcagaattaaaactgagatggaacaacatcagacttgttggaaaatgctccgcgtctgtggtgtatttcagacaagttagtcagaaaattcaaaatatctggaagaaataaatgacggccaacagtttggtgttggccaccaggtgccagagcacgtatggtcttggcctaaggtgagtgaaagacaggtttctgggtcaagacaggtgtttccaaatggcaatttttgaggctgctgacattttacaaaataaaagaatgtgataaagcttaagtttttggttgtattttataaatgtctatatttaagaagttcatgctttagcacacataagacattcaacaagtcatttggaaataacatcaaatgtcgaaatttgagaccctttataattaggagtggaggaccaagtggactccatcccttgtccccacataggtcctatttctttcctaggccacacagcttttaaacataatatttctcccctattatccttcagtatttatagagcatccggcctgtgctaggagcttgaaaagacagtccctctctcatggagctcccaatatagaggccctttccctttggactttcttctactggaaattgccttttcttgtgtagttccctttgctgactctgcttgtcctcctgttctcacaaaggctaccatgcagtgggggaataaatatgaaaaaaaatataagatcattgcactgcagagtgaaggagcaaatcccttaacagtcatgagtacacattccagctcatgagcataaagccacactattcatagaaatgggtgatactgattgtacacttaccatgtgtgaatattgtgcttagtatatcacatggattacatcacttcacctgcttcggagaacctggattgagcataatggaaattaagagttggcccatccctagatccacatctgttacctgctttgctggctgcctgggaatgaggtcttgtctgtctgttttttgtttttttaacttcagctttggcctggagctgcagcccaggccactatggaaggaaagggaatgtagcctttataaaatcatctatagcctggtgggaatgtcaactagtacaaccactatggaaaacagtgtggagattccttaaataactaaaaggggaattaccatttgatccagcaatcccactgctgggtatctacctagaggaaaagatgtcattatatgaaaaaaaatacttgcacacacatgtttatagcagaataattcgcaattgcaaaaatgtggaatcaacccaaatgtctatcagtcaataagtggataaagaaattgtggtatatatatatacaatggactactactcagccataaaaaggaatgaatgaattaatggcattcgcagcaacctggatgagattggagactattgttctaagtgaagtaactcaggaatgaaaaaccgaacactgtatgtcctcacttataagtgggagctaagctatgaagacacaaaggcataaaaatgacacagtggactctggggactcaagggaaaagagtgggaggggggtgagggatgaaagactacacatcgggtacagtgtacactacttgggtggtgtgtgcaccaaaatctcacaaatcaccactaaagaacttattcatgtaaccaaatactgcctgttccccaataacctatagaaataaaaaaaaaatttaaatcagctagagccaagcagaaataataaggaaagtgaattccaagaaaaagtatggaattctcttcaaagcataacagaaaatgttttgccatttctggttgttgtcatgaagcaaaaaaacccacttgcccacttggcatgtcttacctgacaaaaactacaaagaaaggcctgcccagggtttctgcaagtcctggatctgggaggctgtgtctcacagagagtgacagccaagactgaataactgtgagactgtgggcaagctggtgagttcttctgtgcctcaagttcctctatgtaaatggggacagtgatccttgctcttgggcttgttgggaggattccatggaatgatatgtgacacctggcacacagtgtacactcagttatcatcacatatgtcatcttcaatatgatttttgccaattagatgtggactttttgcgttcattaaaaatttaaacaaacaataataacaacaatcacagtgagtttgggtttataatactgtggatttcttccttggcatgattggagataaaagaaggaacattccatgtgatgctgtgaggtcccaggaaaggtgtgacagagaatcctgagtcatgcttacctgtcattactagtgggaatgagagccatctgggatgacctaagtgcatattgtttgcagacagtgataggtgctcagggagcaggaaagtggagcatgaactcacaatagaaggtaggagcagagacaatcaagtcctatcctaccagatcaactgagagatttctattccctaaagttccacagtctttgtacccctctcaccatgtcaactttgctctccttgaacgatcttatcccctctcttgaaccatactccctgtttttctcacatttacgtccccttcaggatatggcaaattgtcttatgctcaggaaacatttgctgaatgaatcctctggagatcttcagaaaatcagcatattccaaatgaagtgactgagacttaagcaagagacccagggtgggatggacagactcttgaatagcatcttgatctagaccagtataaactcgtgggacctaaacaaaagtggacctttgttcagtgaagaagattcccagggagcaggtagaagcagatggagctaactccagatacaggctgtgctctccgcagaccccagcgtcttcgtagataggaggtttagcagatggtgtttttgcattaagtttctaaattaccatctataagatcctctgttttctaaaaactagttgccttaaggctttaagattttaatgtaattttaatgtttgtgtgtgttgttagtgtacctgtttctcaggtttgctatcccagataggttatttgctaagatcagaagaaaatcaattggcaaaagaacatgctcacatgttacatgttattaccagttggaacaagagccatctgggatgtaagactatccaccaaacgggtgtgtggaactgtcccttggcattgcacaggaggaccacttttagtatgatttcctgtgctgtggctatgacatcagggaggctgaggcaggatcacttgaggccgggaggtcggggctgcataatgagttctgatcgtgccactgtactccaccctgggagacagagcaacacccgtcactaaaaaaaaaaaaaaaaaagaaagaaagaaagaaaagaaaaaagaaaaagaagaacaaattcagaagctacaataggaatagttcagaaaccatcctccagccttttaaaggcacagaagagctttgtttcacattcgtttcggcttccaaagcaactagtcaagtcagtttcacctgttttattcacaacagttatctctccaatccagattccttctttaaaaaaagggaagaaaaaacattctcatatttcttgttttgctagcaagaaatgagctgcagaacactttcagagatccactagctgttttccttaagctgaggctgagagcttcaggggcactccaaagaaagaaagaaaggaaagataaaacaaaggacgagaggctggggggaagaaagagaggaagggagggagaaactatagagaccactgtgtggacacccacaacttctggttctgaggctggtgggaaaggaatttgcaatagaagaggaggggaactgagaggagagcactgtattaagagcttataggaattctaaaaagaaaaaaaaaggaggcctttgatccattccaaagagggaggcagaaaacttcaaagcagaataacagtcccctgcactctgccctactctaagtacccggagcattcattatgaatcagcccacctcccctcggcccacgtggggctgtgcaagccagacacgcaattcagacccacagcttgttcagcctccccgagaacacagcgtgtgcaaggtttgggaatggaaatatagcagggtgcccactcctaagtggggttaattcacggatgtggaaggaatctctacctttcgcagagactgctagaaacaccagcttcccttctttctcttcaaaggaagatggtgtttttttctccttaatcctgagtcatttacagtaagatacacgtaaataatagtccaggaggtaaaatgtgatctacacagtctctacctcaaaaataagttttttgggggacttgtttaccattccgaatgtgacccggcagccctttacaaaaagtaacatttgcttttattagatacagcagatctatttctgtgagcaccgcagatgtaactgggattcatttttactggatgtctcagaagaccgggccgactgccagctctcctggacacaggaagttacagggtgcggtcacttctgctcacccatttctccttcaacagcgcagatcacatgcacagagttcttaggagacaggtcttccccaaggcaaaggcacacagaaatgctttccttcccagctgccccttgatgaaagaaactaaacacctcttcagcatggatatgacactagccctcggcttcttattttttgcaatgactactctgtgtcagagtcagtaaaaatcgcaatgcagagaagagagataaaaagaaacatcctggagaattctcctggttatttttaaaatattgtctctgttgacttgaagtggtgtagaaacagttccatatgctgtgtttcttttttcctgttgcatcttatagtttaaacatagatcttttatcggatacaacttctgttaacaatatggcctactgggttagcaaagaaaccgttcttttcttacagttctggatttggggaggttgctcacatttaactgtggaaagcattatgctcttatggtctttgccaattcttttctgtaacacaaacctaaattacataccaatttctcgaggttcttgcctagtttggaccaaattaggtcccacaaattcctgatcttagcaactgtgtctctcagttattttccgtgagacaatatgtttgtctgtacttcatattgctttgtggagacaattaccagtgctatatccctatttttctttttcttgaaaaaaaatttaatttttagaaattatttgtataggaaaaatgttaaaatagaaataagaatataacctctttgaccaccctgctccagtcctggtcccctccctggaggtagccgtattagcagacaggctcgtgttcttccagacatttttctgtatatttgcacacatctaaatacatagtcatatgtcttgtttttgttgttaccatcattatacaaatggaatcataccatagaacagatgcctcataatttatttacctattcctctattaatggatgctacggtctgaatgtatctcttcaaaattcatgttggaacttaagacccaatgtgacagtattaagaggagcctttggggaagtgattaagacatgggggctctaccctcatgaatggacttagtgcctatataaaagacactgaagcaagcactctggtcccttctcccttccaccatgtgaggacacagtgtttgtctctttcttcctgtgaggacacaacaagaagactccatgccagaagcagagggcaagccctcaccagaaacccaatccgctggcaccttgatcttggacttcccaggctccagaactatgactaataaacttcttttttaaattacccaggctaaggtattttattgtagaaacaggaatggactaagacaatgaatatataccttgcctgttaatttgctgagaaccaaggtttcattttcaacatttactagctaatctagcctagagaagtacaaagaacccaggacttggattttagtccaacaatactactaatgtccaggtaatcttcggcaaatgatcatcctctttgggccaacatatcctcagctgtcagaccagtgggcatgtacagtgaacaacttagtaccaggtactacaacaacttacacatgcctaggccccagggcaccatggtgattctgattcaaagctagggctaagattggctacccttagcaaagaagagttactgatgtgtaggtgagaaaaatgtctcacgatttagaacaggatgggacaaactacatcccatgaaccaaatcagacctgccacctattattataaataaagttttattggaacacagcaatgctcgtttgtttatatattgtctttggctgctttagtgctaaagtggcagagctgagtagtttcaacagagatctcatgactcacaaagcctaacatatttgtcactgggtaccttgcaaatgtttgcagacctctgctttggaaagatccctatggtcacacagagggtggggaaggaagacaatttagagtggtggtggtgatgggggtctgagtcagggcaagagaaaagaacaatgtgcgagacacaacacaggcagaagcacagaagttgtgactgactgaatggataaaagtatgagaaacagaagttaccagtttcatatttccaacttggaggcttgggtgattgtcattaaccaagatgagtgtcatgaaaggaaagaagatgtttatgggaaggtgagtaagattcgaattagggactttctgaattcaaagtgcagataaaggtgtccaggaagcagttggaaatatgagtctaatattcaggagagaggtggggctggaggtcaagcttgagcgccaccatcttggagatgagagcaggtttcaggtgagcagaccagaccaaagagggaaaaacatagaggcaagatatttgaggaagaaattctgagaaaccccaacagttaaaggactggcaaaggaataaacctgagaaggagcaatcagaagagtagaagaaaacaaacatgataatatttgtgaaagcagaagcaactgatgttggcttttataagaggtctttgttgggctcatgtcggggtaaagagtgctctgaggatttggtgcctcttgtcagtgtcctgtggtggcttccatagaaaacactccacacccattatctgcaaggagacagctgcagttttgcctcttcatgtggtttcctcaaacccaccccctgggaaatgcaatatgattctctcacagagcagatgggatgctaactggaatcacctctgccttgcagagttctccctcagttgctccaacagtgcctggtagtgtaaacaagactggcttaccagtgcagcattcaataccagtgcttacccagcagccattcaaccagtcctgctgatgccccaccatgtgccagccaccaaagcatctagtgccaagattacaactgtttccttctgctcctggttcttagagtttttttttaaaaaaaatatataaatgatctgcatttagtgatatatttatttttaatttttttatttccataggtttttgggggaacaagtggtattcggttacatgagcaagttcttcagtggtgatttgtgagattttggtgcacccaacacctgaacagtatacactgaacccaatttgagtcttttatccctcacccccaccaatgctttcccccgagtctccaaagtccattgtattattcttatgcctttgcatcctcatagcttagctcccacatatgactgagaacatacaatgtttggttttctattcctgagttacttcacttagaataatagtccccagttccatccaggttgctgtgaatgccattaatttgttcctttttatagccaagcagtattccattgtatacatataccacaatttctttatccacttgttgactgatgggcatttgggctgtccatatttttgcaattgtgaattgtgctgctatgaacatgtgtgtgcaagtaccttttttgtataatgacttcttttcctctgggtagatacccagcagtgggactgctggatcaaatggtagttccatttttagttctttaaggaatttccacactgttttccatagtggttatactagtttccattcccatcagcagtgtagaggtgttcccttttcacagcatccacgccaacatctattactttctgatttttttttatcatggccattcttgcaggagtaaggtagtatcatattgtggttttgatttgcatttccctgatcattagtgatatcgagcattttttcatatattttttgaccatttgtacattgtctgttgagaattgtctatttacatccttagcccactttttgatgggattgtttgtttttttcttgctaatttatttgagttccttatagattctggatgttcgtcttttgtcagatatatagattgtcaagattttctcacactctgtgggttgtctatttagtctgctgactgttccttttgctgtgtagaagctctttagtttaattaagtcccacctatttatctttgtttttgttgcatttgcttttgggttcttggtcataaagtctgcctaagccaatgtctagaagggttttttctgatattatcttccagaacttttattctttcaggtcgtagatttaagtccttgattcatgttctgttgatttttgtataaggtgagagatgaggatccagttttattctcctacgtgtgacttgccaattatcccagcaccatttgttgaataggatgtcttttccccatttctgtttttgtttgctttgttgaagatcaattgactgtaagtatttgggtttatttcttggttcactattctgttccattggtctatgtgcctatttttaaccatgctgttttggtgactatggccttatagtatagttcaaagtcaagtaatgtgatgcctccagatttgttctttttgcttagtcttgctttggctatgtgggctctttttggttccatatgaattttagaattgttttctctaattctgtgaagaatgatggtggtatttttatgggaattgcattgaatttgtagactgctttaggcagtatggtcattttcacaatattgattctactcaatatccctgaagaacacagatgcaaaatccttaagaaaatacttgctaactgaatccaacagcacatcaaaaagataatccaccatgatcaagtgggtttcataccagggatacagggatggtttcacatacacaagtcaataaatgtgatacaccacaaaaacagaattaaaaaaaaaatcacatgatcatctcaaaagatgcagacaaagcatttgacaaaatccagcattgctttatgattaaaaccctcagcaaaatcggcatataaggggcatacctcaatgtcataacagccatctatgacaaacccacagccaacataatactgcacagggaaaagttgaaagcattccctctgagaaacggaacaagacaaggatgccctctgtcaccacttctattcaacacagtactggaagtcctagccagagtaatcagacaagagagagaaataaagggcatccaaatcggtaaagaggaagtcaaactgtcgctgtttgctgatgatatgatcatatacctaggaaaccctaaagactcatccaaaaagcttcagaactgataagtgaattcaacaaagtttcaagatagaaattaacgtacacaaatcagtagctctgctatacactgacagcaacctagttgagaatcaaatcaagagctcaaccccttttacaattcctgcaaaaaataaaatacttcagaatatacctaaccaagaggtgaaagagtgtacaaggaaaactacaaaacactgctgaaagaactcttagactttctctatccctatatttggaaagaaggttggaggaggggtacagaaggacggagggaggtagagagagtgttaaagaagaaggaaaggggtaaaaaagaatgggaatagaggcatggactagaaactaattagatggtgaggcagagaccttgcattgcgtatcttacatgcactggcttggcagccttgagaactgatgtgtatattgaaagcaacagcacatgctaggtgtccagcataatacctgacatatattaagaactcaatacatgtctgttataataatatttttgagtatccagaggaactaggccagcctttgaattgataggccctttggtaattttcatacagccatgtagcaaaacttatattaaataaattgggggaatttcatattatactacattccttttgcattctcactggcaggagtatttagcctggatgaaacttgatacttcaaaaagaatcacttgctaaagggagaagtgagccccaccttctgttaggaagatgtggtgagtacatcaatattacaaagattcagtgtgttaaatcaatatgttcaaagtagtttaaatgtccaatactggtttccaacttctaacttttctctatcctctctctcggcctcttttcaaccattccttccttaatccttccacccatccctctcctaacccccaccattgtagactaatttcttttggttatctttctaagcctttgcacacttttccctattgacgagctttgctgttaggattctccagctacttctgcaaagaggttttcaaaggacttttgaaaatgcagcactgtgtatgttttggtaaaataaagcaaacattttgtgtggttgggtttgttgtttgaagtgttgcagtctccctctggggcctcctactgtcttctgactagcacctcaacagcatcccttcctgctgatttgcagagggtttgattctttttcaatagtgcataatgctgctgtcttattgcctgtttgctttagttcatatttcttctccagatggattttctatgaagatcatccctatttgtttgatctttaatttcagaccttgtcattttcttttcgagtatgcttttttatggatgtttcttttggcagaaccacttcctatgagcctcagtgtgtgttaatggcactttcatttattatcatagacaatttcaatttctagagggatagttgagttctgttgtggttcaaaggagaaataaatcctcttgcaactttggctattttatttcacttcacttttggcctcagaggacgagagagaagctgagaacattagccacatctgtccatgaagatttctccaatatcaatttgctcccacacctgatgtactgaatactcagaaaaatgctcaggctataaaaccatgtctaaggcacagacagtttaagatcaggctttgaatgaaggcctcagtttatcttacacattactgaagcccattctatagaagactaatagtttccacaggtgtcttgggtggagaagggaaaaaagtcaatggactgagatactattggtctcaggaatcatttgcccaatctaccctaggccaagctttgaaggacaggccatctgaattcactgagtgactgaatcccagcacaggaaatgttgatattcttattgattctttaatggccattttatatccaaccatccagccatccatctatgcatttatccatcatttatagtaatgtccctaaggctgctttcttgctaaaaataaggaatattgacagctgaaactcactttattattctgccacagttttaagcatccctgcaaacacgacttctttaacgatctccagtttaattccacagtatggttccctatctgcattattctctcctactctgatcatcttatttatttatttagacccagggtctcactctgacacccaggccggagtgcagtggtgcagtcttggctcactgcagccttggcctctggggctcaggtgattctcccacctcagcctcctgagtagctgggactacagttgcgcaccaccacgcccagctaatttttttgtagagatggggtttcaccatgttggatcaccctactttaaaattgtaatatagttcccttttccagcaacttccatttggtttaacctgttctttattttttctttgcacttttcacctcctagcctaatatatattgtacttatttactatgtttacagtttgtttattggctgcttcaagaacataagctcctctcaccatctactcactgtattctaagtgtgaggcatatggtgggtatttggtaagtatgtgtaaggcttcttggggaaatgacccttcagtgcctttattcaatactcaagagtgtttctcagcccctaacctggcattgtaggagacacaatgtgcgcgagtgcgcgcgagtctcatacacgggagtctcagcgtgtgtctcatacatgctgctggatgtgtggcatgcctggcccctgcccaccaattgccagtagtgaccttatcatcaatgtaacaattaaaaacaccccaggacatttccaaattcctcatatggctccagtaaggctttgcttgataattactgcaagtcttagaataaaaccatttttttacactgtgtttccacttggcaaataattagtccaccttatggcatcctaagggcactctcagagataatacactttcttttttatatgcctccctcaacagatttcaaaatcctctcacacaattaaagacagtgatatttaatggtaaaactcagctgtcaatgatgccttctatgtcagtcattaacaagccagtaaaccaatatttactaagagcttttgagcctgacttcatgccatgcagtgtccattttatagcacaaatggtaccccacccactaaggctgtgcctgtgttacctgcggtcagcatctcatctaatccttcctcacattttagcaaaaaccaggccctgcagtcaaagaacaagtttgactgatttcttttcactggactggtcagttattcaaccatgatggacaaactgctgagttaaattggaataacacaggccaagagaatcacatttaaagtcagagatggcaaaaataacagacatttctatgacagaacatcaacaaataattactgattgtctactggatacaaagtactgtggtatagggcaccagaaggtgtggttaacatgacatcaattgtcattctgctgggtgacaatgaaatatgtataggaatgtatactaatattcagataaatgcagatactgcgagcagctatgctaagtgctttacaggcacatatcacttaatcattaacatgaataccataggtatccctattttatagaagaggaagctgaagcacagggcagtaaagggacaaggtcactcagtcgggaattagtggggcaacagtttaaattcaggtttctctcatgccaaagggtcttaaccactgtgtgataaatcaaatagttttcagttgtctgaaattttcagttttcatttactttggttgtgtaggcacaaacacaagaagatctacagataatgtatattttttaacttcctttaaattaatgcatgttggattgctctctaccatttgccccatctaagtctttgtagttggaatccatcgttctctgcaaatttgacatttgatcataaattgctcatctcgagatgaattacaacacctcacattaaagaggcacttagggagacatttctattccatttcaagagacttatataagaaccctttttgatctttcctaaaattaaaatgaaaagccacattttggcaacattatggaataatacaaatgttcaattctgtggaaaaaggtagagacatgactgatcatttgatatttaaggcaaagaaatagtggttttatttgatttttcattttgaactctgtcagactgtgatccttttttctatcttcatagtttttaaaaaataatcatcagaaacaagaaacaaagagaaagcagtaaaacacattttctttgcctccaggattgaagacattttccccttggcatgtacctactaagtaggaaaacctagaatgaaagttactgtgttgcttcagtaacttctaagaaatcaatataattttggttttctgctataactctcaaagcatatttgatgtatctcttagtcattgacaactttctttatactctgaagcaaagttatcccagccaagtgtatgtggctgcggatgataaagtatggctatttgaagtttgcttcttcttaaagagaaatgcaaagttcccagaaagacgctagatacaacggttcacatacacttcacaaggcacttgcctaacttcttggaccaaattacattaaatctttgagccaagaaaattaactcaccactcattgaaaaacagtatttcagccatgtcatatctttggttaaggcagacttaacgggaaaatctctttccaatatgatatgtgattcctttacaagtacacagtttgttaagttttatacttttttaagaagtagaggttttttgtttttgtttttttaaccaatggtactctctctgtgtgtgtgtgtgtgtgtgtgtgtgtatcctaccaaattccttagttaataagcaagacaaatttattcacagaactcattttgtattatgtaaattttccaagaaaaaaaagaaaatcttaatttgtgtttcaaagcctctctagtttaagcacaatgactttgaagaaacaaccaaaaaaaagataaaatgtggatgcagaatgatgtttattttacatgtatatggtacacattgggtaccaaaagaaagtcatggttaattacaataatcactctagtttggccaaataacatggaactaacgacatgaatttcaactatggatagtaatattaagtgggttgaagtaatctctacacaattaattttttctagtgccttggcctctgaaaacttatctttggtctatatggatctatgtgcatctaattaaaggttcatatttgcaatgcagggttttagttaagggaggttaaacatgagatttccttagagcgcctcagtgttcatgggcctctatattctcatatctctgcaccagcagtaggaggatgtgagagcccagggagccctcgaacttcaaaattagatctgtgggagaaaacatgtaaatctcagccagaagaatctatgcctcctttttctcccatgctgccttactcatagcactgatagcatgcatgatctgttagccttcactatccttgcagaggaactggattcggtggtatggaaaagacatatactattccatgaatatccatgtgctctgctccatttcctgttcccttgcagataagtgagcatactctgaccagttctggccaagggactctgaatgaaaatgctaccttaaaggccaaagtatttaagagccagcacatgactctccagctctctcttattctgtctcagtgatacagaggctgcaggcccaggtgtcagaattatacaatacagaaaatagatctcttataagggagtttgtaagaaaattggccctagagagccaccagtcccttaaaagagtttatatgacagcctgggcaacatagggagaccccatatctacaaaaataaaaaaaaaattagctcgtgcctatagtcccagttacttgggaggctgaggttggagggtggcttgagctcaggaggttgaggctgtagtgagccatgatcacaccactgcactccagcctgggtgacagagaccctgtctcaaaaacaaagcaaaacaaaacaacccccccctcaaaagtttacattagtggcaaataaactttgttatgctgggaagatattaccaagaatagcttagtttactgtgacaatttaaatcaactgctaagataaccaaagtaatcagaagctataacaggacataaatgctgagtacaaatatttatttttgtacctcctctattggagaaaatctagaaaataaattcaatatatattccaaaggaaaaaggaggaaagtctaggaagtttttcatttgggataaaagccaggaataaatatatgactttcattggaacattttcaggcactcagagattcagagatatccttaatgctaagtagatgtataattagctccctgtttagggactccaaaatgtgccatgtcaaaactgtctcctgaaaatgttgctttgcgattccaaaagcaatcagaggttgttgaaaaatctttgggattttgcagtgtgcagttttccccaacaggcctaacattaatcattataggaaaaacattcaaactcccccattctttcatagtctagtctaaacattcaatgcaatatcataattctgcagacataaattccctcattatctgtgggccaggtcaaccacagcacagccagccacctagcagacccatgagcagggccttttgcaaaggtgtagcactggccctcaaaaagacttacagttaagcactccaggaggctgcaattgtgcacagcagccaacctgtctaattgggtcattttttcactgggtgatttatatagaatgtggactcaaggctgactgctcttcgaacagtatgactgcttttgtctgactgtaccaatgaagcaggatggggttgctggtatttaagaccaggcattctggtcccaaagaaacattgctttgggctgtagttctgtgttattgcaagaagcatagtatccgatgttaccagtgtgggctcagttacttcatctgtaaaatgggaggctataaccccacctacctcttagggttctcgtgaagatgtgcttgagaagagctgaaacagtgtgcctgacacagagaaagcattcaatgaatgtgaaccatttatgctatacagcattattactgatatgaagtattagtgatacattattgatataattatcatcaacattatctgtgatgctggtgatatgatgatgatgatgatgatgatgacagtaataatcattttctgagtgcttgccatgtgcttgccagtctactaagtgcctaatgtggattacttagtgaatcctcagggcaactattgagactattatctccttttgatgaatgaagacactgagtcttagaaaggttaagaagcttgatcaaagaagtaataaagctgaaatagaagccaagcagtttgacttccgagcctgtgcccttagttactaccctctaccccagcattgacacaaacacaaccacagcttttattagttgtccttataatgacttagcctcatgcgataagactgtctgtcccagatagagccacaagttacttaacatatctcagtgtcagcagccacaacctgctaggtaactacaactccaaagtgccctgcctcctgaatgagatggaaaatcagtggaatagggaatgggggttctgcttggaaataacctgtaaccagaccagttaaggtggaaaggggtggctgtgaaaaatgaaaacaataaaacaaaacaaaatgccaaaaagcagggtgatatagagagggtttaaagggtattgctcccctttcactcctagcctgggattcaatttgtggccaaaagctgatggtaagtgtgtgtgtattgcagccatagtcagcagagcaaatggggactctcaactactggtcctacttcccctaaggagctgggtagttaacatgttatccctgcacctgagtaaattaacccattactccttacccagtgatccacttgcccccccatgatgtgcactgtagggagttcatgctgtttagctcagaaattctaagttcacatggagtccagttttcctggattgtaccttaagtggttgattgttggagccacttcatatctatatttaagttagactattgagtactgtccctcagtttcaggagccatgggagcaaatcgaggggcaaaagttacttctggatcttcccaatcatttctcaaccattgagtcacagcctgtgacaccagacgtctttaacttaactccaacctcattgtgctaggttctgttttctcctcaattatttttttttcttgctctaagaaaaggataatacacccctaccttatctgtaacatccagccacattgtctggcttggttatgtgactttctttgcccaaaggactataagcagataagaaatatccatgtctacatagaatctttaaatgaggttgcaaggcttaactttctgcatttttgtcctctgcattgtgaatagcatggccccgatgagggcttctctgcttcagcctaggtcttggaataagagatgcacagaatagagccaagaagaagtgctgccaaccacagactcataaatgagaaataaatatttgtttatttgggggttgtttgttactgcagccgaggctaatacacaaatttttcaataagaactcagcctcagcttacatcatgtgcgcaagtgaatctggggatgctaggggctatcttccctatcattgagtgaaagactatttatgtattaagccaacaggcaaggacagaatcaagaaatgttgtaaaagtaagagctccgagtcctttgagcccctgaatccagctgtgcctgaagacttaatgctacatgttatgattatgtgagccaagacatttcttttactttagctagtttggattaggtttctaatctggtttaaatgaatactgacttatatcaggtctcctcactcttttgcaatgatatctgagcacaagcatatatgacatattaagtaatagtaatcacatgggggtaagttacactggggtataaatcattgtaattgaataagcctgtcatgggttgaactgggttccttctccacccccagcttcaaatggatatgttgaagtcctaatcactactacctcaatatgtgacattatttggaaatggcattgaggatgcaattagttcagatgaggccatactgaaatagggtgggctcctaaacttatataattgatgtgcttataagaagacagccacatgaagtttgagatacacataatgtcttgtgaccatgaagacagagattggagtgatgcagctacaagccaaggaacatcaaagatcgctggcaaactaccagaagctataaaccaaaggcaaggaaggattcctctacaggctacagagagagcatgaccctaccaacaccacaacttcagacttctagtctccagaactatgaaacaataaatttctaattttttaagacacctagtttgtaatattttgttatggtggccctaggaaactaatacaaagcccatcaggtgaatttttaccaacagatcccatggaaaacttctgatggaaatcactattatactcatgaaggtcattgacagggtttggctctgtgtccccacccaatctcatctcgaattgtaatctccacatgttgagggagagacctggtgggaggtgattggatcagggggacagtttcctccatgctgttcttgtgatagtgagttctcaagagatctgatggcttaagtgtatggcacttcccactttgtgctctctctcctgccaccttgtgaagaaggtgcctgcatctcctttgccttccaccatgactataagtttcctgaggcctccccagccatgaggaatggtgagtccactaaacctctttacttataaactattccagtctcacataattctttatagcagtgtgaaaatgaactaatacagctatattgccatatctatgtccacacaatatccagagacacagaaaggaaaaaggaggcagcacaatgcaatggtcatgcacattggctgaaagatcaggaagacctgaattcaagtcctagtttgttcatttactttaggtgatttctgactccagtgttctcctgtacatcacagaaaaatccattgtttcattcatgatgttttatgagagttaaacgaggtagtggatgggaggtgctttacactgtgcctggcagagtatatttgttaaacaatagatagatagattagctaaatagacagacagacagataggtaacttagacatatagatagatgatagagagagagagacagagagacagacagacactttgggcgactatcaaaatattataaactggttggcttataaaaaacaaacatttacttctcacacttctggaggctagaaatccaagatcagagtgctagtatggtcagttcctggtgagaaccctcttccaggttgtagattgtcaactttttactgtatcctcacgtggtggaaaaagaggaagttagctctctgacatcttcttataagggcactaatcccattcctgaggggccctatcctcatggcttaatcacttatcaaaggtcccaccttcaaacaccatcacaatggagattatatttcaacatatgaattttgaaggacacaaacattcagtctataacagatagacagatatacacacataaaaatatatcaatgcataagtctatagatatgaaggtctgtatctttcctgcctatataaaatttaatcaaatcattagcagttaaatagtgaattttcaacacattcccaaatagttttaacttacttaatatgttgtgttggtggtaattttcttgttgttgttttttaaactgaacttgattgacctgattttatgtagatatgcaaagataccacttactcatgcagaccttgttgtgtaaataacccaatcttctgtctttgcaaagacaatctttccctaagagttataatctcctctcaacacatcgattatatggatcaaaggccctctgacttatatcagcctgggccaaaatagtcattaccaaagattttccactttccctctttaatagactaagctttagaatttgggtaatggtttggatgtcaaacaaaacctgagaacttgtttaggttcagaagaaagtgagagtgataatattcctttcttcatcaatggagctttctaccctttcccgcctattatgtctaatgttattgtgcaccaaaaatgaagctctcctaatcttcatttaccttcataataaagagagtctttgtgcgaaccatttctactatactgcaaagacacaaagaagaaggcctttatgctgaagctacaatttgttgacatttttatggatatgaacctgaattgtcatgagtgagcttgttctaggagtagatgtgtccgagttttcacacatgaaagactgggtcctgacctaccaagaggcagtaaatggaatactctgaggattaaagacattactctcaatatgtcttccccataagcctaagattccaatttagtgctacgagaatcacccctctgtattacaatatgcattgagaagactctctttgaggtgtgttagaaagaaataccaacacacttgaagaccactagctcattaagttgattagttccttgccagcctataatgaaattctaagatctggagggaattgaatactggatgattaagttttggccaagcggtacattactaaagaaatagggaggagaaaagggggagccctagtcgcttaagagtaaatcaaggggacacaaataatctaggaggggatggttcccaaatggccccaggaagtcctgttgggatgggcacccagatttttaaccattttccctcactccccatagtaccttaaatcaagaatatccatgaatgttactaaatgcagcatgcccaagatggagtcctccccatgagtttacaaagaagactcaagtcaagaagacttgatggactaggaggtactacttaaatgggaaggaaaaagtttcttgctagatgctgcaggagactagaagatgagtagatattctgtgatcctctcaaaatttcacaggttgagctcctttgcacgattccatactgttaggctgggcattcttatcctttgtgactgctgcacaaggaagaaaatgagccacactatcccttcaaacgctgagagctggtttgacacatttgtgctggtttggataactaagtaggagacccaggacataagtggcagctggctggcaaggatgtcagatgcagaagtacccagaaaacctactcagggtgttttcttcctttcctggtcccctcctgttacaggaaggctgacctctgcacatgccatatgagcttggccctgcggtttgccttctgccaaagaagtccctgatataaaatggaacttcagaaccttgcctttttaggagtgtcattagaaatcaaatcagtatgggctgaacaggctcaaggactgctgctttagtgtggcagctgaagtccaaatttttgagagtaattgggcccaggctgttaacaggtgcagccacttcctactagggagaaagaatgcctgccatgtgtgttacacatggcctcagaaggaagccacctgtcaagagaaatgcagacactgggctggaggggcccgaacagtgatgcaagtctgagtgatgactaaatgaggcccctgcaaaggcagaatggcccaggattgtaattaagacactttcttaccttcgcatggtaagatttgacttgttatagtgctatttctagtcctaaactcactatacgtctatgctatcatttctaaattatattccattcaacactagtatttggagaaacacagttaattttctgtgagaaaaaaaagagttcagttttttggatttgcttaggagacacttctttgtacaggctccatctggcaattctcagaacacattattctattatctaaaaatggctgagtagtcctggagtatagaagcctgattaattttaagtcacctttccctgaaccaatacagtcatcccttggtatctatgggaaattggttccaggacctccctcagatgccaaaatgcacggatgttcaggtcgctgatataaaatgtcatagtatttgcatataacctatgcacatcttcacatatcgttcaaatcatttctagattatgtataatacctaatacaatataaatgctacgtaaatagttatactttattgtttagggaataatgacaaggaaagaaaagcctgcacttgttcagtacaaacacaattccccccaccccccaaatatttccaatcctccattgattgaacccatggatatggagggccaactgtaaacattttcattagatcttttataaaaatgtcccatggaatcctatttgagaaattcaggattacacaagtaaacaaaagttgagagaactggttttctctatcaaattgggcaaaggtcttctctgcccttgtcattatgtggatacgtttttctatgaggagcactatagcacagtggtgaagggaatgggtttggacttggactgcttgggttggaatactgcctccagcatccattacctataggactctgggcaagttacaaaacctctctgcactgttttctgcaatgtaaaatggtggtggtgtgggggggtggtgtgggaataatagtaatatctgccccagaaggttgtggacagatgaagtcagacagcctttgtaaagagcctagaacagtgcctagtaccctgtaagcctggggcaaatgttagctgcagtcattgccaccatcaccatcatcttgccatcatctcccatcctctctctcagaatcagattccagaagtcattttgtctccattttcctcactgctctccacagtcattcactctcgctgtcccactcctgcttttgaaaagcctccacccctctagccttcataactagcacaggccttcctcgctccaggctgaaatattacagctttcccctagctaggttccctgaccccagtcccactctctacccaaacaacctgccctcaatgcccagacaaacctgcctgaaaccctgctgtgttcttggccccattctgctacaatgtttctgccttcattgtctagatggcagagttcaaggttaccttgggttgcaaccctctcacaaactaattcaaacctgttttccaaaccacatttattccctcacccccagctactgttcctgctgttcttcccacttggaatgtcgttcctagcctctgcatagactcaaattccaagtagattccagaacccatctcagcttgtgtcttcttcccaaggccttcctgatccctccatctcttactctggcatgggacactagcatctgctctactgtggagtggcaggtttagagggcttaggtttagagacctgggctcatatgccagctccaaaatgagcaagcggtgagagttttgatccagttgtgtaacccctctgtgtctcaggttccttatctgagactggagattgataatgctctctctccaaagggatagcatgaaactcaagcaaaagtacttgtacacattcagatttttttccagtcttcctgtgtgttttttgaggagccctagatttggcaaaggtgcctttgaaggcggaagtaggaaactgaagcgggctaggttgtcagacctccagcccctgcctctacacttcaaccagagctgcgctaccttgatcaattatatttatatatttgggatctgggtgacctttacttaggaaaaaaaagagatctattccacaaaagaaagaataagaaaaccatctcatctcccagctgggcgcggtagctcatgtccccaatcccagcattttgggaggccgaggcaggtggatcacttgaggtcaggaatttgagaccagcctggccaacatggtgaaaccccatctctactaaaaatgcaaaaaaatagcagggcgtggtggtacatgcctgtaatcccacctactcaggaggctgagacaggaaaatcgcttgaacccgggatgcagaggttgcagtgagctgagatcatgccattgcactccaacatgggcaacagagcgagacttcattttcaaaaaaaaaaaaacaaaaagaaaagaaaaaagaaaaccacctcttatcattagtaccatacaggctttccataattatttcactatttcacaacagtacagctggtctccccagatacattgtaacctccttgggagaaaggactgagtcatctttaagtatgtattttccctagttaaatatgttgtacccggtaagtacttaaatacttgttgatgaagcagctctgccttactgcccaccggttcctccagagatcacacttttataaggttaagcccatcaagaagttccttttccacttccctgagcaggcagccatggcttctttatctcctttcactctcttctgggaagatctacttcaatcccagtgccattatctctctctaccaaacactgctcagagaatagcctctgagacctgtttccttaccaggattcagaggatcacagatactagagatgaaggagaaaaaaaataaatctatcagggcatcatgtcctctccttgtgcaaaacggttaagtcctgaacattttctaaatatttgtcaggcctggtattaaaggcttgaagtgacaaggtccctcaagggagaagttggcattaaacctcactcttaaagatgacttcttttactgacttttcagtttcatgtttcaccactgaatctcacttctcacttttagttaaatcccttctaagtagccaggctacagtgagtgggggctacagaaaagccacaggaggagtcagaagagggtagagctgtcactctgtgggctatgtttccctctgactacaggtaatcaaaaaggatgggcaaggtgaaatcttgacatctcacttgaacagaagtactcccccattcttgcagattccccatcattcccattcagagagccaaaatgcaactgtgtaattataagataatgtcttatttttgtggccccactgaggttaccaactcagacacctataggggccctttgataaggatggcaaacccacttccttcagcatattgccagctcacaggaaggtgcatcatgtcaccagattatccccctttaaaaaaaaaaaaaaaagaaagaaaccatctatcaaaatttcaatgaggaatctcttcatttttgaatgttggcaatgaattcaaattatctttaacccattgtaaaggcacagctgacaccagtcccttctgtaggagatttcttctccttctgaaatccatcgccaattcataagcaagcacgcaggaatggacaatgctgtatgtttattacatttataattttgtgtgtagaagccttgcctcaatcctcaaaatgcagacacctatgctgcagtcttttgcgtggttacatcactcaacgtccccagtacatatgttcagaaaaatggtcaggtcctcagggaatagttaaaactgtgcaggactagactacttaggtttatatccctgcctcagtgcttgacagctctgggaccttgggcacctcagttttctcatctatataatggtgatgataataacagccctgggctcatagggttgttgtgaggtttaaatgacatagcagggtgtacatcatttagcaaatacactaggagcttaataaatgtcatttggaagctgcttcacatttccacattctattaaaacacccaggaaccaatggtgccctcacttcatctctagattttgctaaagagttggtttaattttcgccatgtcttcgggtttcatttttacctctgaaggtcaagttggcttgctacattcttggcagagtccatagcccctttgatggtagaaaatgatataaatgaaaaggtcagatgatcttgcctgggttacctgtcattctggaagatcacagctgtatgctaaactagatctaggtatgtgtgtggggtggggctgaagtctacacccatattgtggtaggcacagatatgtaccacccaggttgcccttcaaggagggacttggcctcccaactgtaaggtggatagtgattagcaagcactgttcagccattagctacttgagaatgggcctcagctccagtgagctgcttccctaaagaccatacatttcttgggcagctttcatttcctacagagtgaggcaggtgtgacaagatgctgctgtttccattcatcacggaacaatccagataggcaataatgaacccagggctccccactggcttgggtgaagctttggagggcctacctcaaagtccagcttctaccttgcccactcctgtttctgccccttcctttcacaggtgttgatgcctaataaacatcttgtactccagagtccatctcagcactgcagcccaagaacccaacccatgacacacgggtgtactgatgcacacacacactcctgaaacccagacaatcctttaaaactatctttttaataaacagaaaccagccaagtttgattataaagaaaaccaatcgtgcattgagacctatgggattagcagggtcaggggtatctatagagttgggaaggattaccactgatattttcttccaatttcttttattgtggtagaatacacataatctaaaatttactatcttggctatttttaggtgtacagtccagtgacaataagtacatttacattgtgggctacaattgccaccaaccatgtgcagaactctttttcgtcttgtaaaactgaaattctatacccattaaataacaactccccattctccctccccccagcttctggcaactaccattctactttctgtccatgagggttgacaaatctagataactcatgtaagtggaatcatacagtatttgtcttttagtgactggcttattgcacttagcacaatgtcctccagattcatccatatcatagcacttatcaggatttcccctttttcaaggttgaataatattttattgcatgtatataacacatttgatttattcaatcatgtttcaatggatactgagttgcttctacttcttggctattatgaataatggtgctatgaatgtgggtgaacatgggcgtacaaacatctgttccagttcctgctttcaattatttcaggtgtatgcccagaagtgggattgctggatcatatggtaatcctgtttttaattttgtgagaaactgccacactgttttccacagcagctgtaccattttacactcccaccaacagtgcacatgagttccaatttctccatatctttgccaacacttcactcttttttgatagcagccaacttaatgggtatgcagtgatatctcattgtaatttcatttgcatttctctagtgattagtgatgctgagcatcttttcaactgtttattggacacttgtacatcttctctggagaagtgtctattctagtcctttgcgcatttttgaatcagtgatttttgttgttgttgctgagttttaggaattatctatatattatgaatattaatctattatcagatatatgatttgcaaatattttttctcactctgtgggttgcctttttactatactgatggtgtcttttgatgtacaaaaatgtttttcatttaagtccaattcatctatttttccttttgatgcccgtgtctctggtgtcatatccgataaataattgccaaataaaatatcatgaggcttttgctctaaattttattctaagagttttatagttttagttcttaaagttaggtcggagactcattttaaatttttatatggtgtaaggtaaggaatgtacctaacattaattgtattcttttgcacttggatacagagttttcctagcggcatttattggaaagactgtcttttcctccatttaatcatcttggcactcttgtcaaaaatcatttgaccacatatgtgaaggtttacttttggactcctctatcctctattctattccattgatgtataaatctatctttatgccaataccacattgctttgactcctacagtttacagtaagttttgtaatcataaagtatgagtcctccaggtttgttcttttccaggatttctttggccatctagggtcctttcaattacatatgaatttcaggatggctttttgtatgtcagcaaaaaaagcatcgttggaattgtcacagggattgtgttaagtctatagatcgctttgtatagtattgaaaacaatattaaatcttctaatccataaacataagatgtgttttcattgattgataccttctttcagaaatgttttacagttttcactgtacaagtttttcacttctttggttaagctaattcctaagtattttattctttttaattctcaattttcttttcagattgttgttagtggataaaaatgcaatgtatttttgtttgttgactttgtgtcttattgctttgttgaattcatttattactccttacagatttttttttttggtggaatctttagggttttctacatgtaagttcatatcatctgtaatacagtttgtatgttgtccccttcaaatctgatgttgaaatgcaatccccaatgttggagatgagtcctagtgggaggtgactgggtcatggaagcagaactctaatggcttggtgctgtcctcatgataatgagtgtgttctcatgagatctgtttgtttaaaagtgtgtggaacctcccacaccctccttctcttttgcttccgctctggccatgtgacatgcctgctcatgcttcactgtctgccatgagtaaaagctctctgacacctccccagaagccaaacagatattggcaccatgcttgtgtgactttcagaactgtgaaccaattaaacctcatttctttataaattactctgtctcaggtattcttttatagcaatggaagaatagcctaatacaatctgcaaacagatataatttaatttcttcattttcaatttggatgcctttatttttctggttgaatttttctggctaggactttaagtactatgttgaatacaagtggtgaaaatgggcatactttccttgttcttgatcatagaggcaaatctttcagtctttcgtcactgaacatgatgttcaatgtgggttttttatatgtggctcttatcatgttggggtagtttcttacttttcctagtttgttgagtgtgtgtgtctgtgtgtgtctgtgtgtgtgtgtttaaaccacaaagggcttgaaatgtggcagatgctctttctgcatcaactgagatgataatgtgtttcttcctcttcttgctctgctgtgatgtattgtattggttgatttttgtgtatagaaccatccatacactccaagaataaatctcgcttggtcatgatgtataattcttttaatataccggtgagtttggtttgctagtatttcgttgaagatttttgtagcaatgtttataagggatattggtctgtagtttttttgcaatgtctttgtatcaaggtaatgctggcttcatagaatgaggaagtgttcccttttatttaatttttttgaaaagtttgaaaaagatcggtttagttgtttaaatttttggtactattcaccagcaaagtcataaggtctggggcttccctttgctaggagattactgatcactgatttaatctccttactagttttaggtctattcagtgttcatgacttagtctcataggttttgtgtttctaggaatttgtccatttcacctgaactatccaatgtgctggcatgcaattgtttatattacttgcttataatccattttatttctgtagacttgatagcaatgtcctcactttcatttctgattttattaattttagacttctggttttttttcttagtctagctaaaattttgtcaattttgttgataatttcaaaaatcactttttcccctgattttctagtttttccttgatttctattatttttctgttctccatctcatttatctttgctctaatctttattctttccttctgttagctttggggttagtgcgttatttttctagtttctaagttgtaagcttagacatttgtcttatttttaaatataagtatttgtagctataaaatttccccttagtactgttttcattacttccatatgtttggatatgttgtgtttttgttttcatttgtcttttaagtattatctaattccccttgtgttttcttatttaatccagttgttgcttaagattgtgttattcaattttcacaaatttttgaatttttcagttttccttctgttactgatttctaatgccatcctattgtgatcagagaagacactctgtacaatgtctgtcttttaaaatttactgagacttcatttgtggccttgcatatggtctatcctggaaaatgtctcacgtgtacttgagaagaatgtgtatgctgttgttaggtagagtgtttggcatgtatctgttagatccagctggtttactgttttgttcaagtcctctgttttcttacttaacttctgtcttttgtctctttgctagcattttttatttaaagtctattttttctgatattagtatagccaactctgctctgttttggtttactatttacatggaatatccttttctgtccttttacttttaacctatttgcatcactggttctaaagtaagtctgtgaagacagtatatagttggattatgattttttaaaaccattttgtcaacctctgtctattgactaggctgtttaatccatttacatttaaagtaattactgttaaggagaggtttgattctgtcattttgtgacttgttttctatatgccttataggtttattttgtccctcatttcctgtattcctgtcttcttttgtgtttggttgatttcttgttttgataatgaaatgattaaattccttttcgattttttctgtatattctttagctgttgtctttgtggttaccatggaaattatatttaacatcctgaagttattacactgtaatttgaatttatgccagcttaacttctataacatataaaaactgtgctactttaacaacattataccctcccctttctgttgttgatgtcataaaattacatctatatatcttgacttcctcaaaacatcaactaataatttttatccattagtctcttaaattatatagaaaacaaaacatggagttataaaccaaagttataataatattgatttttagaccaatatattttaaaaatccgttattctcttaattcatatagaaacaaaaagtggaattacataccatgttaaaataacactagcttttctacttacaaatatatttaccaatacaaagacctttatttctttatatagcttcaagttactgtctagcatcacctcattttaaccttctggactccctttagcatttcttgaagggcagatctagttctaataaattttctcaggttttatctgggaatgccttaatttcttcttcactcctttacttcttttgcagtacagttttgttggatacgtgattattggctgacagttttttttcttttaccactttgaatatctgagccttctggcctgtaaagcttctaatgaaaaaatctgctgataatcttagtgaggatccctagtgcatgacaaatctcttctcttctgctgctttcaaaattctctctttgtctctgactttcaatagtagtatttataatgtgttttggtgtgagtctttcaggctcaccctatttgtattttggtgagctttttgatgttcatattcatgtcattcaacaaatttgggaagtttttattcattatttcttcaaataatctctctgcccctttctgtctccctcttttccttctggggctctcacaatgcatacgttggttcacttgatggtgtaccacaggtcccttaggctctgttcatctttcttcaactttttttttctctctgttcctcagacttaattttcattgacctatctttaaattcattaattctttcttctgcctgtcaaaatctgcctttgagttctagtgaatttctcatgtcagtcattatatttttcagctttacaatttatttttggtttctttgcatcactctctctttattgatgttgcccttttgatcagacattattttcttgactttccccaattattcctttagtttttttgatcatctctatgataggtagtttaagtatctggctaatggatccatcattaggtcttttcagctcagtgtccattggtttatttatttattttccctttaatgcttaatacgttcctgttgctctatatgccttgtaattttatttttgttgaaaactggacatatgaatcgaataatatgataattcttgaaatcagattctccccctttgctagggttgctggtatttgttttcatgtttttgattgttgtaggccaactctatagcaaggatcactctgaggtataaacttaaagtcttttctgagccagtgccttgcctggaacatgcacagtagctatctaaagtctcccacatatgtagttgcttttgaatgtcctagttttcaatatctgggtcccaaaaagggaaagaagaaaaattaagggaagcgaaaaaaggcatcagccctttaaattccctaggagtcacttcagctagagaggaaggtacaacaataatggctaccacctcttttttgtacctctgtgattgaaaacggcaatcagtaatcagaatacagatcccaatatttgcaggatagagtcctttttgcccaccgtggctcccacaagccatgtgcaaaccaggagtacatgcacagctgcctgccatggggctgaaagatggggaatgggtagttattactgtgctaagaactgaaattgattgaaattaatcacaatttgtgcccctttccctggaatattcaggccttcagtggactccagagttccaaaatagctacaacagacagattctgccaatgcaattgttatctatgtggaaatacagatttctcaagcttcatactctataatcttcccatcaattatattttaatatacctatgtttatagggaaagaatgccaaaaagatttaaaaaaatcacagacctttaatagctctttggggatttttgagcaatttcagtaatcttctaaaataatatttagaatatcttctaaaataatagagatcttagaaattataaagacaaaaaagattatttgtgttgacattcaatactttttcttctgaaattcccaaagtacttacatttaggatatattagataaattaggtaacgcaatgggaaggtaagctattctaagttttccagccttgttattatccagtaataatgccattcaacttgctggcacttagattgtctgaggaacctttccaaatatggtgtcatataaatgccattgtaaagctctaccagaatagcattatcagattcttccttcaatgcccagtaacaataaaacacttggggaaaaagatctcatttcagagtccctgtctctcatccttcactcttgagtattcagctgcatctgtcattctttgtttttatatttctgtttattcaaatatcacatgatcctaaaacagaataaatcctgtcatcatgcaaattccatttaggacagtactctcatatatgaggtcaggttcatatccctttataggcaatcaagctaatgtatatagttgtttgttaagaaataagattctcggccaggctcagtggctcatgcctgtaatctcagcactttgggaggccaaggcaggcagatcacttgaggccaggagtttgagaccagcctggccaacatggtgaaagcccatggctccattaaaaatacaaaaattagacaggtgttgtggtgcacgtctgtaatcccagctactcaggaggctgaggcatgagaatcacttgagcctggcaggtggaggttgcagtgagctgagatcatgctactgcgctccagcctgggtgacagaatgagactctgtcacagaaaaaaaaaagatgagattctcccattattaaatgcatatgaaaaagatcaaataatgcatgcgatatgagttgtgtccaaaccacaatctcatggaggcaaaattatcaagacttcaatccgattggtggcttgcaaactaccctaggcctccaacccacaaatatatacagcctccaacccacaaatataaacagacacagatgaaatctggatgctaggaattcgtttcctaaactttccaacagcacgtacctgagggactgtatggaagagatgaaacaagagacatgtttaggaggaaggagctagttgtttaccaattaatgacgaactatctaaaacttctttgctctctaaaagtaagacttgtaatgttttcagaaataaatatgggttattcttaatcaggtatattataagagtagcttatagaaggagatatgcattgtttctgcagtgaaggaaaaagcataatttaatttttgacaaaatcagaaatattataaggtatatgttcagctgcagaagctataatacctttgactttagttctttaaaataaattatagatacacaactatatgcactaacagcctaaaagtaagtcatgctgggtttttttccatacaattttaattaggtatattttttccaatgtgttttgaaatgatctgctaggaccaaatgctaacatgaaattccctgcatgctggtagttaatttaataaaaattagaaaggtgaagccctgttccctagagggagaaggtcttaacacaaaacattcattatttccacataaattgcaaaaagtaaagatgctggatttaaaatctaagcaggaagaaactgtcaactttcattatcagtggacaaatgttttaatttgcaatattccctagcaactttttgaacagacaactttacctctttaccaacatctactttaattcctaatttgcagctgcataagtactatgttgggcccaaagctttgggtatatctcttagaggtaatggaatccttgttgttttctggcactgcctcattaaaatgaaactcagactcagggtaaccctgaaaaacctaagccctccaataaaaaatgtggtatatccctgcacttaaattacgcaggagaagtgaaggctggtacatcacacacagaagagaagctaaaggtcaagctattagagttaatgagccgatacaagctcaggctctctaaccagagaggttagggacagaatacatggccaccccaaggaactttatttaagatatcaattaaaaatgagtcacctctcttctcagctcctgcactcaacactgacactgggaacaatgactgaaggactcacacatgtctgagaaaaggcaccttgtgggtgtgacttgccacaaaagcaagagtctttctgcatttgtaaatgtgttggtaaggcaacaaaaagaatactactgtgcaaggggaggtagaggtggtgatcctggcaacctaaaagcctgattgtatgttctaatccattctgatgtcaccaaagctccccttcgagggaataacctggattatggccaatactttctacttctaatagtcttccagtttcattgttcacaaggggttggtaaacaaaaatcaatgaaaagagcagggtcttctctattttggatttggacactgatgatgaagctgtgatattctgatccaggactcaatggctcctcctggatcttctaacaaggtcaatctggctgagttccagacagtcagctgatggtctcatatgaggaatctaaagttgatgaagatggtggtagtagagtggtgtaatcctcatagctcaaaaacgatcagagctcattaattattaactaactagaacttttatggctcattagctactggttaaatgtcaggtaaaatgtaatatttaatagaaaatgttaagattagaaatatgcagagcatttcttatgtgccagacctatgctaagtatttcatatccattattgtacttgatccttacaactcccatgcaagggacctatgtttatctcaatttaacagagaagaaggcaaagtgtgaaaaactaagtaacttgtcttaagttaaacagctaatggagtggtagacttgagcttcaaacccaggtttagccaactccaagcccattcaattatcacttgatacacacccaacctatgtaatacttagctttgttcttagtcattgttgcaaagctcatttcacccctcagtcaggcttattacattcattcgtgttctcaagagacaagagggtcttgcccaaaactacagaatatcactatcacaagttgccattcccactagaatttaccttgatccccagtgatgctacatgcattattatgttagtttcttcttggaggtgttatttttaaactgcaagattaaagctcctacaagcttctgacaacatgaaaatcagacacgactttgcagtctttttaaaacaaactagtaagaaggtcccaattaagagaaaaagagtagtcacacatacctgtagaactgattgtaatttaccctttcatcttgctctaaaacacattccttgagtctcagtttagtagagataagattcacccagtcgggggatattagttcttcctggatattttaattaaactgttacattgagtagttctgaaaatcacatataatcattcaaggtatggtggagttctgttctccagcatatggctctccacccagccacattccatctccttaggtaaactagctggaggccttcagtgtaagctctttaatttttaaactcttgggtggtgctttgttcttcgggtagagagtagagcaagagaacgaattaccaaacagtaatattacccccatcgacaagcgggtggtgtttatatcacacatactatataccaagaaatgcgccacaccttttacatgaatactcattttaaaacagtaaagactttatatttagagaagttttaggtttacagcaaaactgatagtaaggtacggagatagcccacatatcccctgccccacatatgttgcctcccatattaacttccccccaccagactggtacatttgttacaatttgtgaacctacaaggacatatcacccaaagtccatagtttacaagaggattcagtcttggtgttgtacattctatgggtttgggtaaatgtataatggcatgtatccaccattacagtatcatatagagtagtttcattgtcctaaaagatcctctgtgatccgcctattcatccctccctccctcctaatccttggcaaccactgatctttttattatctccataattttgccttttccagaattccatatagtcagaatcatggagcatgcagcctctttaggtaggcttctttcacttagtaatatacatttaagtttccgccatgtctcttcatggattgatagctaatttgtttttggcactgaatcagaaacccttgttgggatgtaccacagtgtatttatccattcacccactgaagaatttcttggtggcttccatgttttggcaattaaggataagactgctatgaacattcatgtgtagatttttgtgtggctatgttttcaactcctttgagtaaatatcaaggaatacaactgctggatcatgttgtaagagcatgtagttttgtaagaaatcgccaaactgtattccaaagaggctgtaatatgttgcattcccaacagaaatgaatgagagttcctgttgcttcacatcctctctagcatttggcattgtcagtgttctgatttgggctcttctaataagtgtgtggtggtatctcactgtttgaacactcatttttgaaatatccacataggctattatgatcttcattttacagttcaagaagctgaaactcaaagaatgtagatatttcaaactggccattgtaagctagagccaagattcaaactcaagtttggtgaatttcatagcctatactttctatcattgaggtacatcttgttttctcagttgtattatgtgatttgcaagtcctatgaataatatatttaaattataccaacatgaaaactaagtgtaatcttcagtcaataaaatatccactaaatacttcaaaatatgaaactggaagcttatctaaatgaactaattctttaatatcaccatgaaaggatgatgttttaaattaagaagtgaagaatttatagtttccagattgagaataatttccacaaatttttattttcatcatattctattgtgggtgtgcatgtgtgtgtgtgacagacacatatgcagacacagagatatggggacacacacatagacactttccatctcatgccatgttggaacttcccagagacagttaaaattagctagctaatttccataaactatcaaaataaaattatacttattgagagtctagagttcctgtcatgaagacttagcagttaaaaagcatggaagtcatggaatctcagtgctccttcgttgcaatccacactcctgctacaattagaatcccaccaatagataaagtcatcaggagctaattagtccacgtgtaaaaaataaaaataagacaaagaacagacttctaaaaaaaacaaaaacaaacaaaaaacaacaacaaatcatttgaaccattgggtacttcgagtacatgaaaattgtgaagtaaattaattagctttgcattgattggtatcaaaagtcgttagccctgcactgcaaggaaatccccagaagcctaaggtgcatgaaagaaaaaggctgggaaggaaatcaatctctgctcttcaacgctgatgctttaaagggtccctgctgtataactcgcccggaagcattccagggggaagaacccacagatttatatctgccacacgtgtcactgaacacaaatacgtctgataaataattgaagctcggtattgtgcttacgtcgcatgtgcaaaaaaacagggacaggaaggcaaagaggtcaagtttcccatctgactttccaatgagcatcccaatcatcacttaggtcattattctacctcgtgaagtgtcagaactcattgtcttagggaatccaggtgctggcatcacatatttagcaaatctcatttccctctctctcacaccgcagagcactctctagtccaagcacagtgcagggcagaatccagagcttattttatttaatcctcacaattttgtgatttttacagatgaaaaaactgaggtctggggaatagaattgtttttcacaggcacaaagctggtaattggtagatctgggatttgaaccgaggtccaggaaactctagagcccatattattgccatactaggctccctctctaaataactttctcattaagtgagcagagagagaggagccagactgccctgaggcctttggtattaataggaggctaagaagctcatgcagctaagtctctttatccaacggcacatccctggaaggagaaaatgggctctgttggaatccttccactgacaggaagctctctacctcacataactacagacctgattactaaaaagactttggtttgcctttccaaaactcatatccagtgatcacaattgtggcctctgaagcagtttgattcaatactaattgcactcagtacttggatctatcataactgtaacattaaacaatgttttcccctcgcagggttcttttgaggatacagtgagtattaaaatgggctggtacatagtaagaatttgcccaatgttaattataaaaattttcctgatattacttggtaagttattctgttaaatggaataaacacccatgaatgccacatataaaccaacagctttgaccctcataatgacccccatctatccatgttgtcctcccccatttatcttcttgtctccaaggtcattatgttcctgagtgccaggttcatctttcttcttacagggttttattgcatgtataattggtcctaacatgctttataatctaagctgttttaaattttataaaaaggattccatccttatttaatcttatgctatcctcacaaacttattttcccccacttgatattttactatgaagaaattaaaagttacctacaactgaataataatgaaatgctacatattaaaatctgtacttataatagaagatagcctcaatgttaataaggtgtcaatcttaagtatacaaaaactgaacaaaataagttcatatttagcaaaagaaaaaccacaataaatatgagcacaaattgatgaaatagaaaaatattttctagaaaagatcaaaaaagtcaaaagtagattctttgataaaataattaatagataaacctttttttgttttttttttttgagacggagtcttgccctgtcgctcagtctggagtgcagtggcactaacttggctcactgcaagctctgcctcccgggttcatgccattttcctgcctcagcctcccaagtagctgggactacaggcgcccgccaccacgcccggctaatttttttgtatttttagtagagacgtggtttcactgtgttagccaagatggtcttgatctcctgacttcgtgatccacccgcctcggcctcccaaagtgctgggattacaggtgtgagccaccacgcccagccaatagataaacctttgacaatatcgattaaaagaggaagatgttttgaatgaaaaagtgaatatttattacaactaaaataataaatggctattgtcaacaactatctgtcaaaatttttaaaaatttagatgaaatgtataaatgcctaaaaatttataactaaccataatggacccaagaaataacaaaaagtttatatagccctatggctattaaataaattaaggtaattgttaaaattttttttgcaaagaaaacatcacaccaggtgattttacacgcaaatttttcccaatgttcaaggaagacatcattccaattttatgcaaactcttccatatgatagaaaaaaagagattattccccatagattctgtaaatcagtataaccctgttactaggaccaggcataaaaatcacaagggaggaaaattacagccttctctcacaaaggaatatagatgcagaccattcttcttagtagtatactcaattgtaaggcataacaaattttatttccaatatacaagtagcagtgtaacattacagaaagatttcattagctttggaatgtaccatttttctagctgtataatgtagcaatgttatctaatttctctaagactcagtttccttctttgcaaaatggctttttataatatctatctaattctgtgggaattaaggaagtaaacaatataaagcccttagctcagagtctggaagtaacagtaagcaataataagttacagcttctatttatcaagtacttagctccccggctgagtattttttttttttttaactctcctttaatccccacaaccaccctgaatggtggagattatgctcaattagtgaataaagaaactgagtcaagtggaatttcaacaactcacccaaagtcacataagttgcaaaaagtcacgctaatgtaacaatcgcagtctctgaatactgatgcctggggtcctttcaaatgtggagctgatattaccagctgctatcggggacacagcacttcctctgaggggcactggagttccttccacaaggcatggaatgtgttcaccttttcaggggaagcagttttcaagttggggtttgatttgtgacatgtgagattaaattgcagcatttctaatggaaaggcttcagagggcaggaatgagcgatacactgtcatttctccatctctgcgtgaggaaccttaagcactaatgagatcagatatgtcaccgcaactctctccactctgccacagattccaggtcagaatatttttttttttaaacattctggccacttcactgcctacctgcaactctctaccacgttcctgacatataagatttatgataatttaccttaggcagggcttggagttttattccaccaggttatcaaaaatgttgccaataatctctttcatattttcataggacaagattatacaaataatattccaccctattctttccctagagaaacttacatatcgattagacagggaggcctaacaaagattcaagagtcagtttgtcctatgagcgtggaaaacaccactcctgttaaagattacagagtgacgtcacttatgactatgctgtgcaaagtgctgggtttttttttttttttttgtatcctaaggggctttatgcttgtctttgtactattggtgccttgggaaggaaaacaagaatgcatttctcaacatttatgtctgcagcgatactgggaactgtgaatgctaacatatttttaaagagctctgatagagagaaaccaggtggtgaaagaaggtagtgaacaagcctggatacagaaaggtttagagtagaacttacgggcgccacctgctggtcccctgacaccactgcccagagcttccagttcccctaattggagtctcagctttatggccagttggctcagctgaatattattaaatgatttctgtcttcaactatgcttagacacagccttggagacaagtaagtaatgcagagagagtaaaagggagtgagtagatgtcaaagaatggtttgcccattcaacatatgtgtgactgctgtgaaaggtgtatgggagtttcccacatcatctatcagcaaaaagacataaatggtgatcttccttccttttcccaccttctttttttttttttttttttttttttgagatggagtgctggagtgcagtggagcgatctcggctcactccaacctccacctcctgggttccagtgattctcttgcctcagcctcccaagtagctgggattacaggcgcccgccactacgcctggctaattttttgtatttttagtatagacggggtttcaccatgttggccacgatggtctcaaactcctgaccttgtgattcacctgcctcggcctcccaaagtgctgggattacaggtgtgagccatcgtgcccagccttttccctttctttcttggagagaaatgatagcatctgaggaggcaggagcgaggggtgtcttgtggaggtgggtagtgatggcagcctgctctgtaactgaacatgcagggcaacgtggggagaggggtgctgcatggatgggggcagtggtgtttctagtgtgtgaggaagcagagcagaggatgagatgtacgcaggtggtgggcagtgaaggctaatattgaacaaatgagtatatatattaaggataatgggaaccaagtttctgtcagagaaggtatttataaatgtggaagggggaaaagacttagatttgaattgaagatactgatatgaattcatgtggcttatgtgtaaacatatacacatacccagatatggaaataataataagtgtgtgtttgtgtggacttatatgtacatatttcctagctctgtgttgactgggtctcaaagcattgacatcacaggaacaataagcatgctaagcacccagatcttgatttctaaaatcattctacacggacaggaaccagagctgcttggagaagtggctgattccaaggctggacagggacagtataagatgatcctggagcatcttttttgtaccagaatataaagaaatgctcaaagaatgatggggagatctggcaagtaccaactggaccaggtgatcaagtggggatacggtcagtgtggttgccttctgatgtgatatgctgagaagagctcagcagcgtttttgtggaattcctgccaagatggcatggaagaatacatgacttgagtctaataatgaagaaacagtggaagctccagagaaagagtcatcctacaggaaaaaaagacctatactctttaaggcaggaaaacacgagacagggaaagaataaaaatccattccaggctgggtgctgtggctcacgcctgtaatcccagcactttgggaggctgaggcgggtggatcacctgaggttaggagttcaagcccagcctggccaacatggtgaaactccgtctctactaaaaatacaaaaaattagccaggcatggaggtgtgtgcctgtaatcccagctactccagaggctgaggcaggagaattgcttagaagctgggaggcggaggttgcagtgagctgaagatcgcgtcactgcactccagcctgggcgacagagggagactctgactctcaacaaacaaacaaacaaacaaaaccattccagattggaggaaactgatgaaaaataataattaaatgcagtgtatgtttctgtatagcatcctggaccaaaaaagaaaatgtcatcactgagacagttggcaaaatgtgaatggggcctgtggactgaatggtagtgctgtatcagtgttgattcctgattggaagtgtttttataatagtaatgagaagagtgctcttgttttgggaaggtaatcaaacacctgaagagtgatggagcatcatatctgaaagggaatatctatatattgatctctctgaatgaaagagaattaaaatgttgcaaggtggataatcagggtgaaaggataccgcagttcttgctacccttctgtcggtttgaaacagcttcagaattaaaaaaaatactaaaagtgctgagctctgagaagaagaaaatagcataagtttaatgggaaaattatgttatacatgattagaatccttctttgttttctgagaagaccctttgttgggaagaattgatgatcaggaatgcaaatgagaatggccaaaggacagctagctgacttacaaaaagaaaaagaagattcggtataaagaaggagagaagggtgaccaggtatgcaaggagaaaaactgattgctagatattgagagagagtacttgcaaacaagcaaacagttgccatagggaatggaacttgtagggaaaagaaggatgttggagaaaagttgaataaattttgaagtgttaggtgtaatataattcttctgttattccaaatcaccacccataacatccacacccttcatcaacacccttaagacacaggtatttatttgtttaccttgtttgtttgatttaatgaaaagtatgagactgactggagaacaggtgcttggtgagcacagggcagtcagtgtgtatcagtatgtttgtgtttattatgaaaagtgagataaaacatctacataaatagttctaatacagggtagaacagaataaaaaggagccaccagagagtgtcagataaggtgtgaggaaacttcagaaaatagaaggaaaaagaatatttacattccccaagctccttctctgaaccagaaggtgggaattatacattgaaatagcacggtatgaaaatccagtaatgatccatgatcccccagctagtaaatggcagagcccaggtccatagaacccgaaagatctctttttttcctactatagtgggctgccttgtgcctgggtctgaagagaagaggaagaaagaggggagtctgatggacaaagctctgtggaggacgtggcactgagcagaaacttgaaacagagcttgactggctggcaggatgagaagaatggactcttggctgaaggggaagcaagcacaagcacatagagatgaggaagcatgggtggtggtatatagggtaagtgcaatctatttcaaagacagctaaaacacaagatgacccattccatggcaaacatggacaccaacaccatgtacaaagatgatgagggtgaggaagattgagacgtcagttatactgattgggaggctgtggaataggcagcactggcaatacttctgtgccctaatgtcattctctgaagctcaaggccaaacccactggggccaaactcacacagaaacatttattttcagacatcatttaaggaaggcaacacctgaaagatggaagggctcagtgcaaacttccagggtgctatttttgaaaatgcagaaactcccagtttggaaatattttcttaaaaatttccccatcattattagcacttctgccaaataatcactaactaaaaatattccctccttgataatgcacagataaggtctctgcactgaggaggaacaataaaggaaggtgatgaattgcaaatcaatcataatttatgcagatactctactgaaaatcacattcatcaccttttccaaatagcgccacatgaatttcctgaagtacaagaagtctattttcataaattagaccttaatttctttctctcatcaatatatttttatgccaaaaagttaaatagtaaacaatacagctgaggaagaaattatgaactagaagaacatgaaacatggtattcagaaggaaaaaaaaatagtcaaatatattttctatggcctttgctttgtgttaaagtgtgtgttttttccccaaaggattatgtgatgtaattggtactagttggatgatgaatataaacaaaaaatgccaaattatcacaagatgcctttgggaaaaaaaaaaacctgtaactgatgctacagtgtaccctgccagtatttttgaaagcaaaactgtactagttcatttttacactgctatgaagaaatacccatagctgggtaatttataaagaaaaagaggtttaatggactcacagccccacatggtgggggagacctcacaatcatggtgaaaggcaaaggagaagcaaaggcacatcttacatggtggcaggcaagaggccatgcgcaggggagctgccctttataaaaccatcagatcttgtgagacttactcactatcacaagaacagcacgggaaaaacccgctcccatgattcccaccaggtccctcccacgacacatggggattatgggagctacaatttgagatgagatttgggtgggaacacagccaaaccatatcaacaatcataacagcaatcagccagctaagaccaatgaccatccagcaagactcacttgctatttctctgtgttatctatgtcaaatggcaccttttttcttagcatcccgtttgtagaagagcagacacagagaatgtttcacaggtccccattctggggattattggctgggtatttaaatatacttttcttaggctgggttcctctaaagcaaaccctgaagacaagactttgaaggcaagtagttgatttagaaggtaattgcagaaatcaccactagtggagtgaggaagtaagatcgggagggaagaaaatgtgtgttattaaacatgtgattgctgtgggcaagagggactccgtttcactgggaaacactatagatacgtttcccagttattcctccacaagagcaaaggagcctgggtacttactcaccaacttccatgagtcattctgataactgctaccaaggggtgacggggtaggatgtgggctgggagattaaattcctagcactttcaggctagtttgcactgcacaaacacgaagtagacaccagtgactagaaaaagacaacagccagaatgtaatagtatttaaagatggaagccaggggacaatgtgtagaggaatagtcctatccgaggaatagtcctatccaaggaatacgggcagtacactgcaacagggcccttttaaggtgagatatttagaaacctgggtcaatgcttgtctccatgccaatgcagttacccactccctctcagccccagccactctacgataaagtcttaatgaacatcagagggacgtttcagggcctgctttgtgacgcacatcaccccttagactactccagtgctcactgatgtcccaaataacaagtcctctaaattattggtggtttggtctaattatctgctgaaagcattcaaaaccattgggtatccctgaaggagaaagtcacaatgctgcataagaagaaacaacgcctgcaacggataacttatttgctgtcatatgatcctatagcatcctacagatctccttccattagcatccatcacatctgtaattatttccttttcattatctgtcttccctgagtgaccataaacccaatgaagccagagaccatgcatgattattcattcacagctctactccctgtgtctagctcatagtagggagtcactcaatacttctgaatatgaaaacaagtgaatgaattaagattattaccgtcatccagcaggcaaaatggattacatagctaagggtctgttcttctgaagtaccttcttataaaggataaaaaaaggtgctccttcttccaggcagatgaagctctgagccagagctcattgcttaaccaaagcattgcagctcaaattcagctcctgctcacccattggcaaggtgcctgcggtagttttaagagccatcaacaaatatttctagcttgtcttcttcctgctgaatgaaaagtttgcccttccctgctcccttgaaattagatgtggccatgtggcttgccatggccaatgaaggaaaacagatatgatcccattctaggtggaagcctttatgagttcgtgcacaatttaccatatttgtttctttctgccatgacaaccagcaagatcgcagatggcagacagtgatcggcctatattcttaaaaggaagagacatatacacagtacctagctaacccacaaaaggcatatgatatgttttggctgtgtccccacccaaatctcaacttgaattgtatctaccagaattcccacatgctgtgggagagacccagtgggaggtaattgaatcatgggggctggtctggcccacgctattctttcgatagtgaagaagtctcacaaaatctcatgggtttatcaggggcttctgcttttggttcttcctgattttctcttgctgccaccatgtaagaagtgccttttgccttccaccatgattctgaggactccccagccatgtggaactgtaagtccaattaaacctctttttcttcccagtcttgggtatgtttttatcagcagcatgaaaacagattaatatagcatgttagaaatatacttgtattgtttaaatattggcgctcttcattcctgcagcatatctagcccactctggctgatctagtatacaacccgcagccctatatcctgtggccctgggcaggttaacacgacttgcagtttctttgttctcatgaactggtgttcatgtcataccctcatgcatgcattaccctctctctgcacacaacgtgggcctctaagaagcaatgcttttctgtggaagaaggaagagggggcattcagacttaaccctttctgcctaaaaggcccttctgaaattatatgaaagagagagagaaaaaaaaaaaaacattttgcatgctgttcatttagaagggaggcctaattctttcaccttcctataatctccagagcagttcctataccatcaaggctgcctctcctgagggggccagagcttcaggctcataattagttgtattactactactgtcactgctaattaatgatccacattcagcctaaattgaaactgcccatttctgactcctccactctaggtcaaatagatggttccttattttcaaattatgtacttcatcttaattgtataatttcaatttcatttaaaaaaagaaaaaaattaaaccaaggaagaaatgacattttctaaactggtgagttgggttatcaaacttaaaagcataaaaaattaatactgtgggattagcattattatagaaatacattaaatcttatatttaaataccagtcttttaaaccatggctgtcacagtgaaaatgttaatagtatttaaacataaatccttctccccatgaagaatcattcatcgtgcaagcacgttagctattctattcactttagagatgctgcctagcagagcattttaacgtaagccttgtcagtgttaatcctaatgtctgatgctgagatgtgtgttatattactttatgtagctgaaaaatgggaagcctttatgtcagattacaggctgaaataacgacctccccttggagccagggcctgggatataacgaggtgccaaatgggattctaggtcagagcctctgcaggacataaaagggaacagatcttttgttaagacccattcactcactaacagaatgcttttaccctttgcaatctactttatggctcctctgcaaagaagagtaaccaagagagaaagtcttgattcacagtggggcttaccagccaagctttggattcaggcaggcgatggtggaaatgtacccagccactccttcacctccacaaccaacagtctagggctacggtgttcaaattgcattcatcaaattcagagtggggagtgagagcctgaggttcggcagaggcaggaacggggagagagagcatcaaagtggatccagtgccttctccatcctcactgcatccagagcagttccctctacatctgttttatataccacagttttatgaaagatggcacatgaaatatggttctcctgttaaagtaactcattaattcaacaaatatttaccagccacagacaataaacccctgaataaatgagcacatttcagagagtgatagacgatacagagaccagcaagcatgatgatgagatagagagtacctggagtaagggccacttgcagagaggacagggaaagcctggctggggtttggtggggaatctgagctgagtcatgaataagcagaaacagcaagccatgtgagatccaggaagaaccattccacgcagaggaagtggccagtacagacagcctaaggcagaaacaagcttaacgtgtccaagaatagaaaaagggcaatgtaactgctattgggtgaataaagagaggcatggaaaagatgaggaaggcagatcattcggggcattccagactcaaacaaggagtttgggtgtcattgtgtagtggttggaagccaatggaaggttgacaacgggggcatgacaaaatctgttttgcggagttcttccacacagagagtagattccaggcacaagaacataggctggaggatcaacaagaagactgttaccttccaggacctggaagagagttgcagtgaagatggtgcaaattatctggatctgggatatgtctaaaagtaaatctgatgggactaaaggattacttgaaatcactaaccagaatttgagaaggggagggtggaacacgtggtatgtggggagggaggagatagtgcttagaaagaatagaataattgccacttctgtagatagcttctggccaactgacttagcaaagagcagcacaatatccttgggctgagaccagcgggtttgccactgtctctcaccggcaatcgcattcttgcttccaaatccggctgataatttaggaaggttttatgtcaccgctgctcggcttctttttgtgctttgattacctattctcatacaacacttaaaggtggtcacagaataatctctaatgttttgctttctatgataaataaggggttcgtgaagttcattaacagggattgcatcaccctccaccctcttttacaaccacaccataaaagtagcctctaattagttaaaagactacaaattataccatcaacgtgaggtatggcaaaatctgatggctctaattatcttaataatcagcagaaccactctcaacctaataagagaatgagtcattagtggtagtttatgaagatcaccgacattctctttgttatggagtttgtccttcctgtgttaaaatttggacacactttctacttgaatctaaaaaggatgatttctaagaagttactgaagcaatgcaagatcaaaacataataaccacattcattcttaatcagcattacagtgaaagtaatttaccaaagaacacataattaagtcataaatgaaatctcaagacagaaattgctccccttttaagatttctcattgtccatacactcagaaatgagaagagggattttctcattctgatcctaaatctatcactgaaatgatgacttcacttgcatttatgcattttgctttattttgtgattactttatctcactatcctcccctttttctgcttgtgtgattgccttaatccttttatctagaaccagggggagttccattagcttcagctttttggtatgccttagccacagaaaactattttgtgattcaaaactgctctaaaattcaggaccaaatatcacatattatgtactccctagacttttgagagtttcactctagattatagaggacaaaatcatctccccacctccaccttagggtatgtactccccatctcaagtcataagataaacctattgtggtcagaaggcagagtactctaataaccttgttatagttgaagagactgagtccatgaaaaagttacggaccaaggttatacacagagctggtgacagtcttgaggctaaaacccaacgttttactcttagctaatgttcttttgggcttaatgaatgaactactgctgtggaaatgtttttttttttttaaaaaaaaaaaaaaaaaaacctttcattgtgttttgccagaataaagactgaacatggccctagcggaagagctaaattcattatctttaaaaaatgaaattttctcaaatcataaatgcagtcaccaagtgtaccttctttctctgcattgcagtacaccaaaatgccagtcctctctacaaacacattttatggatcccaaagcagagagattgacgttgttccatttcctgttcacagtataatcaggacaaaggaataagattagtattgtgccatttccacgcggaaaaaaaaaattgttttctccatgtgactgtcagtgtatgtcaaaatgataatggggaatgtgtaatacaagatattgctacttatcaatggactctgaaaagaaaattagctcaagcatcccttgatataaaaagcaaatatgaggtcttgaatcacaccatcctgctatcaacatgttttgttacaagtcagtttatgttccttgagtaccacgtggtttacagtgcatttctctgacagcaatacagaacctcaaacaaatattacccttgcctccaataccaaccaacattaaatacaagttctattcctgaactcagtggcattcagaaattcaaaatgcttagatgccctctccatcgatttgcttctctgggtattgggctgacttcctgttcatcagggggtggtggtggtggctggaggaggaagtagatggttttaaccatttgtaggtctaattactcaagctcagtgagcccacattgaagaaggagaaggagaagaagaaaaattctctttcctattgttcatatataaaatcccagggaaagattctaatcaactctgtttggatcacatgcttactccttgggccaatcgctgtggccaagggacagtgtagcttaattaggcaagcctggttacattcccatcctgttggcttggaaagggggatactatgaccagtaaaccaccccaaatcatatgaaatgtaggagaacggttatttagtgaaaatgaagcactattatcagaaagagttggaagttatactagcagacagaaacaacaacactccactgcctttcaaataagtttattatgaaatgaaactacggctcctcttttctaacagaccgattttgtgattagaagtaataggtttttctcaaccaacaagctcaactagtttagctctttctaccagatgagccaagaataaaggacacataagggtctcaaagattatgctttctatcctgcccaaattctgtaaccattaccttttcagtaggtgatacatttcccaatttagacttcacattatagaaaaaaaccatccttcactgagttgtatttgataccgaatgcctgcattttcatgtactagtcattattccatctttccttaaagaacatccttttttttttttttttagacagagtctcgctctgtcgcccaggctggagtgcagtggagcgatctcggcatactgtaagctctgcctcccgggttcacgccattctcctgcctcagcctccctagtagctgggactacaggtgcccgccaccacgcccagctaattttttttttttttgtatttttagtagagacagggtttcatcatgttagccaggatgggctcctcctgacctcatgatctgcccacctcggcctcccaaagtgctgggattacaggtgtgagccaccacaaccggcgaaggatacccatttttaaaataccatttaatttaaagttaccagatgaaagctgcccactgtaattccagggaaattttactcttagttttcttctttatggtcacccaaatctagattatttgaattcttcttctgcagtaaaattaattataatcatagcttccaatttttagctgctacttattgagtgctgactattcttggcatcagctatattatcattaatcctcataccagcaattattatcatctccattgtatagctggggaaactgagatagagttcaaagaatttactcaaggtcatacagctgagaagtgacacatcttggaatcaaacccacctctatttcactaccaaatgccttctcctaactatatactctacccctgcatcgcgagcatcaggcaccgagtctctccaaggctctgtgataaatactactcttgtgtgacctcatgtcaccctcacttttcactcggaatataaggattcccattcccatgtcacaggtgaggaaactgaagcttaaagaaattcatcaacagacctagtttgccctgtatatagaaaagctcaggtagtctcatattttaatctctttttagcctccttttgttttgtttcactcagttcagtcttaacgagtcttaatagtcaagaaaataaaatcatagtaaagaaaacaacaaaggtatctcataaggacaagaactaatccatcccactcctactgggctggctccttttggcagtggtgattgctttctcagatgtcttaatagaagagagaatttgtgaaagcagagagccccattaataaggaaggaagaacctgcaaggtgcaaataactaatctcttgttgctttcctgttaaggtaccatgcatgtgtcaaaaatcaaaaccagggagcccagcctctaatatgagaagattccagatttcaaaagcactaggtactatttgataaaccaaacattttccctgttattgctagaagcagacacacataggcacatttgcatcctctatattgatacttctcaaatcatccatagtaaagggcgtgtgtgtgtgtgtgtgcgtgtgtgtgtgtgtgtgtatttaacctctatttacggcagtctgattcatgaccctactgtaaatgactactacatagttcataccacatgtgacttgccacacaagtctgatcacattggaactggtcttctccttgttcaataggataaggccaccaattatatacttggatgtcatggtgacttcaaattgctataaagtttcttatccaagactgacaacttgcatttcttcaggactggcactgatcctccagcgacattttgaatggcctactccataattttttgatacagggtagcaaatactatgcctatagtggcaaggaagtgtgtactctgctgaggaagtcacctctgcagccaccagaatgacatttctgaagccagtgagagcaatatcagagagcatcaatattgtaaatacgttttgatcttatagataacctgaattttgctgtgtgcgctattaataactaatatttgtaagaatctcaacaattttcaaaatgctctcttatatgttaacaaatgtagccctactacaatcctgtaacatagtatccttacccacccccccacacacgcacacatacaaagaccaccacctccaccccatttttcagatgaggataatggggcttagagtatttgggtgacaaggctaagctcacataataagttttacaggctagcaggaataacaccaaagtttcattttatttgcccactccaaagaactgataatgacagccagccaggaagctacttggaggctgtgtctgggttcagtgggtaaagagtctttgagagattagcaatgtctgccgggtaagaccagatacactggatacccttggatagattccaatccaggtagcctaatttccttttccacatcctttagcactccacatagagttgtttctcacaagtatccacatttaaaagaggtaacctcccagaacagaaactagctgacattttggaggcaaagtctgtttctcttgcgcactgaagacaagaagagtcaatttgtgatacgtgttacagagataatacacatctaaacagcggtgataaatgcatgggaattacaggcaaaaccaaggtgatacaaagtttccaaagattagatgtatctcagattaaactctccagattatactaatcaattacagaaatggggctgagtgggagtagtcactgaagccaccgttgatgtactttccctaaccattttatgcaggcattccttcatgggggtctcctcaagtcactggagtcctcagcaggggaaaggaaaacagcaatagagaaggaggttaggatcttgggcttcattttgggagtcacagtactaaaacatcacctcatgattagcagataaaaggtgctgccctgggctcaggcaattacaggaagaaacaaccctaaagcagaattcacaacatactgagttcatgaggagggcgatgaggctgatgtggggactggcttttcttcttggtgactcaaagacaaagccagcagtacttatttaaaacatgccacgtgctcatgtttatgtgaggagtagaagacaacggctttggtaaaggagaaaattcactgcataattgaatctttgaaattccagagggaatggccttttctgagaacaatgtctgttattaacagaagaatttcgaggccaaatgcagagttttccaccaggttgcatagtgagagtcatattttgaatggatatatagttttttaaaaaaagaactctgaagagttatggatgtttctcaatatctttctcaagaaggcaacagattttggactcagcagataaccctttatcctatagctgtagtgatgatgacatgataagctgtgtagcctgagcttagatgcagaagtgaattctgggcaagggtcccactaacctgtcttccctgggctccagacccacatccctagctccttgttgggggctccaacttgtacagccagcacatcaggctcagtaggtacaaagttgacatatcaattttcccatgaaaagagatcttgttttgacaacactagtctttcagttacctagactcaaaatctagaagcagccctgctcaccttcatctccttcacagcctgaactgagtcaagggtcaaatcacatagctgggttagagatatttttgacacaattccttccttcctttccacccactttgagttggcacttgcttaaacactccctgttttacctctggatagttacagtgcccctcacttgtttcctcatctccagtaattatccattccaacccatcctttaaacccatgccaaaatcactttcataaagcttacctccacattcaaatctcagtactctaccaggcacatggtggctattcaggtaatattttctggatggatggatgggtagatggacaatgtatttactcatcatttactatatgcctgacattgtgctgggtattaaagacagcaggaaacaaaccaacttctaacaaaacacttccctgctcatgagccttgaatggccaattaacataaatggttcattccagcattcaagcccttctgcagcacagccccattctaattgtttcactggtcacctactctcccatctgtcctctagccaagggtttctgaccttagcactattgacattttgagccagacaattctttattgcagctgctgtcttctgtattacagcatgttgagcagcatccctggcctctacctacttgatgctagtggcacacagccccactcaagttgggacaagcacacatgcctccagacaatgccaaatgtgccccgggggagaagagtcgaaaagaacccaactgagaaccactggtctagggtggcgcccaatttacacccactgtcctagggaaattattaatagtactcccctttcactttcacatgtgttccagtttagaagacaaactagattggttccctgcttaaatctcccgagacagcaaccttgctctgttctcatgcagattgaagaggaaagcaacaaattagtatgaagccttcagcttccaagcaacacttttttttttctggtgaaccggtctcctctttaaagattcaacttctctcttcttctttcagcacatgcagtactgggaagtaaaactggcccaaatgctctgcagggaaatgtgaggatcataagctatcctcgcctctcaaaaaagaatcacaaaaatatttacagcttttctcaaaaagtttcatgttccaaagatccccttctacgtcattctaaccccaaatgcctcaaaaagaagttcaaagctctcaagtccatcgatccaacttcttctctggccaaaaaacaatttcgtgccatgtgttaatgcaaagggctcatgctgtattcacgaaatgccaagacacctggttaaaaagttcaaaaaagttaaaaattgatccataatttcgactagcatggtagttctcaagctttactgtttcagaattccctggagtgcttgctgaattggaggttactgagccccagtcagcagagttgcagatttagtaggtctagggtgaggcacaataatttgcatttccaagttcccaggtgatgctgatgctgctggtccagggatctagaagatgcccgctgctccctgcttattccctcacagactgaaacgtacgatattacggggttaggacagtgggcttgggaaagaagggagggaggtcaggagacttcatccggctgcttgcttaggttttgtgtttttcattttttttttttgccagttagtcagaagaaaacgattttaccctggcctgtgctgggcaccatgctaggcactagggatgcagcaagaaccagacagaccttgcctcctgctgttttcccctttagagccacaagctcttctatgggctccaattccattccttctagcactccctttcagttcatcagctgctaatcagcaccttcaatcactctccaaatccccacaagacagcttccatttttcaaaagcaaagccaaagggaaaatcaagagtttttagaagcatctcctatttcggcaagtgcttccctttttgactctgatccatttcatcaaaaacccttattagagtggtccttcccaggtgtatctttttagttacctctggagataggaggtgcatccagtttattctttctgctttgtttcctgtccagaggagaagagtgctttgatccaacactgacaaccacgtctgcaggggcctcagacttgcttccagggaacaatcactcagcctatgattttgaatgcttcttttgtcactgtcaccaaagcctgagggaaagcaatctacacgctggttgacctctgaggcgactgccagaggtgccagctgtttcccctaaactactactcactgttgaatgtctaggtttccatctcccagggaagacattgccccagcttacctcttcatcatcatttgggaaggccagagaagtgtgggcgaagccatcctgcctggcgtcctcaagactcttgtctgataccagggctctctctgggtctataatctttgttcagggaatagggaaaatgtcctgtgatttgttaatccctcctgtgcagtgagggggaagttttagagtaactatttatatttttgtgatatcaggagcatctagatatctttgcttacaagtttttttttataattttagcaaaggaaaattttatagtttttagcaaaggaaattttacctttcatcataataaaaaatgtattctagaggccattattcatgggttaatattatcagggagctaacgatggcttaacaagagatgggaagccattttggaagtgttctattatggaaagagggagggcctgtgacatggattcatatatcatattcatatggattcatatgccagccatgcgtcagccatgagtaacatcatttcttaagatgtcagagtttttcccaagcacatatgccctcaggatgagaaacaactcgtctgtttgataaaaaaagaaaaaaaaaagaaaaaaaaaagattttagttcaagaattttatagattacaaatttcagagattctttattccagtatagagacacagaaatcaaaaagaatcatcactcaaatatacataggtctattaggtggggacacctggtagatgtaattatagtttcatatgcctgtatttaatgccactgaactgtactcttgaaaatggttaaaatagtaaattttatgttatgtgtatcttaccacaaatatatatatgtatatatgcagaaaaaacatatataaatatatattcattaattaggtatctgaatagggagctatgatcttaaaaaagattattttttcctaaatggcaatgtgaatttcatgtggcttaaaatcttctagtatggatttttggtgtttgataagctacattatttaaactagaataatctggaattatagagaagtatttggcttctggggccactgggacaggggcagggagggagtgtgggagcagcacccctccccagcccctgctgctgtgggagttgggatggggatggcacttccctcaaaggagaccaatgttccattgtcagtcaacttagggcacaaaacagtcttcaagagagaagaggtggaggggactcatacctttggtgggagataagcccctgctacagggtaacacaggtgaaggtcaaaatgactagtagagaacacctcctgccactaaggggtaagagtagtaacatgtaaaatccagctttaagctttactttcctgtgttagtatcagacactgctggttgtctacctactttctgttcccccttcttacctcactaacgtaactccaattttgagaggaagctaccctttttcatttgttcaacttcttcttgggaagctaatcttacccttgacccaactggcctaagccactgataggaataggaagatgatacaattccggtcattcacatgctcagctagctgaggagacatctgtgaaacagttccttgtccatcaaaagagacacataagaagaaatgagaatcattcttttccaactgttaatgggtctagataggatggctatactactgtagttattgtgtgaccatgaagtgtgctaaccttgagccagaagccaatgcagggaaattgaagagtagaaagaagggaagatgttatattcttgagtatgacatttatgcaactgatgtaaccattcattatctcaaaggtggaactatcctacccttaaactccttactattggaactttttgaatcatgatttctataatgtgctgccaaaatcattctacttaactggttcagaattgtaattctttcaggtttttcctaaagccattgaaaaatggtttgtcataaatgactgtgtagagttgacagggcctttggaaaactgagtgggtgctgatgaccatacagggataaagtggtcatggaacaacctctgcgacatgaagatatggctgcaagcagcaagagataacaagcaggaaggcccagagcagtgatccatagcataaagtgacaagtgacaggagggacaggcttgtgggacatgtaaacaagccctatggttcttcagaaatacgagtggagaggaggtcatttaagacattgaccatgttcagacatgcagagtagaggcttgggctatgatcatcagataccaaaagaaaaagtaaaaagatgaagattttagagggattcagataatactggctataaggaatatcacaggatctcctgccaagaaaatgagattcctatatgatttcttatatctctccatatgtttcctataagaatactagccatcaaaatgacaaattcaaattggtatattcagacaaatagaaagaaagtatttccctatccctcaaatgagttggataaccatgaatggtgagtcagatgagaaagaaaatgcaacagctctcactcagacctggacaaaatgttaaaagatttagtaggatggtcaaaaacatagttttcaccttaactgcttactttcaactcttcattggaataaatgcatataggccaaattaataaggaataagtagttatattttaggttaatagttgtaccattattagaaaaaatctgcctcatataaatgcagccatgagcacttcctcccctttaaaaactagtataataaaaggaatgactgattgtacttggcatatttcccctctctgtggttgcatttcactgcagttatgaaaacataatataatttttcccaaggccatggttacctgacagaagcatttaaaaaccaactacactttggacttccaggcacgtgtgtgtgtgagtcataagacagttcagaagagaaattcatatttgacatccagagctccatcttcccgcctcaagtgtctgtgtggatgtacttactccagtcttacctgagtttcaataatatgggtttgtcacaggttgttatgggctctaactaacagctgtccactgcactgagaactattattttcagaggcaggtcagaagcccatttctgactctcacgcattgtaaagaaatgctgaccccaaagtgggattctttctcaaatacactcaccctgtaagcaccaggtagagccaggagctttcaaaagtgctctgagtttaaacatttcacagcatgaggaacacagccgaagagaaagtgcaagaaaaacaatataaagacattattaactgtgtgatcacacaagagtgaggcctccagatgggccacctcatagttattgacgagcgtttagagaagaacattcattactcgatattgacgctaacgagaaagggtttgagagcaagtttaaaatgtagaaggaggaaacacccaaaccccatccccatggcagctaattcactgttcccaacaattctgcatgctattttttttactccccttgttcatatcttatactgtgattaaacccaagcattctgactgtaaaccctttttttctgtctatttcgcataggcttggtgtgttaatcaaactgtcagcaaaggaaaaaaaaaagaagaagaagaaagggcacattctatccaaatgaagaaaaatctgagctttctacaacaaacacattttccagtggatgagcttctcacacagtaattatttcacttctcccagagattactgattacatcacacagaaaaactaaatgagggctgttttatctttctcatctctctgtggttcttgtgcaaacttatacttgttatcatgaaaaatgacaaatttgccatctgatcaaaatgttaacaaggtaactgtcagtgagatggatctctgactgtcactgcaagccagaacatgaggatacattgatatttctcaatacagcccctgcttccccaacgttcactaactacatttccacagtaaggtaataaatcactcagaaataacgagctatataggatctctggggtatgatagatgtgtcctaacagcactatctgcaagatagaaaacaattgataatgatctaaagaaaaccctaatcaactgccattttccataatggggtagatgaagcaaagatatgaaatcttaactatgtgatgcatgttatgacaaaaccggactgctccaaaaaaaacccacacagccccaaacaaaacacaaatgacctaacattacgtagggtcgaataaatgaaaaataaagttaataacacagtctggatacaaacattatattggacactggcaatgatgggataatcacagcaattgctgggtccacaaacagctaaatagtggagggttcctcatataacatgaatgaagactctggctcagttattggtttaatgaactctcctccaatacttttatgttctttaagactctttgggccacattatttctgagcctttaattcaatggtttaaccaatcatttcccccacccccccccccccgccccttagcaacgtggccaagtgccacatccaaaggaaccaagagagaagaggagaagtccatatggaaataggaggtaatcaaagacagaacacaagatagaaaacttctgcaagaagatcatggcttcagatcacagggacaaagaagcatggcatcaaactgccaagaagctgcctcataacgacatccctttaggttttaaggttaagaagtctcacatagccacagttggtctcctgcctgtcccctctgctcgtttgtctttggccattcctgcttctgctgtttgtagaatactccaagcgccttccctccccaagaccttgtgcctgctcttctctctctctcagggatctctctcctccctggctccttcccttcatccagcttaaatcttccccaaggaacctgccttgcccttcggtttcaaagtagcctctactaccacccctttggtctctatcagcttcatcgatagcagaaagaaccatgtctgtctggaccactgtaatttccaggcttctagcactttctcttctctagtagggattaagcacagtcccaatcctgggctctgggatacaggactgactagccttgaatctagtgccacaactaagtacctgtgtcccactgtgcaagcactcaatttctatgtgcctcaggtccctcatttgtaaaacagagagaatagcaatgcctataaatgacagcgttttgaagactaaatcactttatcaatgtaaagagcctgagatagtatcaggcatacaggaatccatcaatcagctgctgtttttataagagcaagaacagaggtaattcagacataaagtgaattaattcatgattatagacgttagatcaatgagtcaccttcatcattccaggtttttattttaccattagccaaaacagtattgtgctccttctaattccatattctcagactacatggaatgaatgggtattggtctttaagcctctttgagcaatgccaataaatacagtcacttccaatttgagggcacttggaatagcagtgctattgttcctttgacatctcaacagcacttgaaagtgaaagaaaaaaaaatagattaatggatgtattccctaaagcaacaaacatgtttgatgtataaacatatgttatgggcaatgacgctgtacctttggtgccacgtctcaacaattctcttttcatctatcccctaatcatgcaactgaatgcttccagtaggccacacagtagggacaaaatgatagtaagaccacctggctatagatacctgcttctagagaggccaggttccaacccattacaagctgataaccatatgtatgatttttgctacactggccaagtatttggatcttttttaaacatatttgattatttaccctttgattagaatttgtgaataaaaatgtcttttaagagacacaaaggaagggggtacgggcaatagctcattactaaaaatcattttagtgtggaaagtgggcttcactattcctataaggcagtcattttcaaacttcagagcatcacaagccccctgttagattctaatagaaccctgaggaaaatgcacatacacataaatgttcacatataatttctacaggttgaaggacctcccaaaacaaaacaaatctatcaaccacaaactccagtgtaaaaaactggctctatgaagacttcaaatcaccctcacttcctttgcatataaccatttttttcttcagacaaataaaaaatacaattaagtttaatacaagaagaggctaaaaacattaggatagaatattagagtttaaagatctttgcctggttatggtctaaagatatttgctttgattaatatatggtgtaactcattaattaaatgcaaattgaaataagataaacctgtccccatatcatttctggtagacaataatgtgccagttttctctccaataaattagatgaggcaagctttctgttactaaataatagcaatatgggacaggagaaaaaaatttaccatgaggtgctttggaattattcacatgaagaactttttatttcttactttctttttcactaaaatagtactttttctcattttcaaccaatttttaaatatgaggtgtttacattgcttactgttcaaattagcattgcatactttcaggcacagacatgctcaaaataggagtcttttgaaatgcctgcattcagtataaaacacactgctggtaggaaatgcaaaatgtaaaagtcttaaaatacatttagatatggaaaacaaaacatttaaaacatattcacactttaacatgtttggaagtataaagttaatatcgtttatgaaacaaatttcaggaatcatactattgaaacaccctcacatcttcaattagctggattaaggaaaaaaaatattaacaatatttaaatgcagaaaacagattatcaggaagagagatcgttatagcaccttgttttcactaacaagcagagcagactgtaattgagttttagaaatccctgaggtggtaactcggtagagaaatccagacttggcaaggaaatcaagtttccctttaattacattatctcaatcaaagagataactttcacatccctacaaagcaaatgttttaaggagaagtctggcaaggaaagtaggtggaggtacagaggggttaagagtttcaaataacttcatattggtaggaggaacatgtagaaaactgaagtacactgtgaggaagaagacagatgccctggcaaatggtgctgctcccaaaaacatatgacacctaacaccttggtccattggtcctgctttcctatatcagccttggttttgcctttgtcactgaagaaacatggcatgttccttagtgttgaacacataagcctaaagctgatctacagtttcttaagctgataaaaggcaaagctaaaatgactttggccatgactatgctgttcggaggaggaaaatgagaatgttcagtggaaattattttcttggcagtgtccttactaggtcagcaaacctccattctttccaaattttccgggtctcctgcttatttcaggacccatataaggaggatataagcagtgatgtgtgagagctggtttgtaccagatcacaagagctgtttgtataattttcagaaattttgtaagctggtagcttaaaaagccattaaaaattaaattgtgtaatttgaaagtaataaatattaaaaacaaagggaagaaaatattaaaaactctgtaattcctcataatgtcactacattttactattgtctatgctcttaggttatatacatctgtattagtctgttttcatgctgctgataaagacacacctgagactgggtactttaaaaagaaaaagagatttaatggacttacagttccatgtggctgtggaggcctcacaatcatggtagaaggtgaaaggcatgttttatgtggtggcaggcaagagagaatgagaacgaagtgcaagggttttccccttataaaaccatcagatttcaggagacttattcactacgacgagaatggtatgggggaaactgcccccatgattcaattatctcttacagggtccgtctcacaacacatgagaatcatgggagctactattcaacatgagatttgggtggggacacagccaaaccatatcaacgtctattgtatcttgtggtggaaatactctcagtagtgtgctaccgcacgtctctttccaagtctgtgcagtgacatcaggtttgtagcttcaattcagccatatgaactggaaactggaaacactacagattaactgttttcttggctatctagatttaagaaagtgatgggggaaaataatgattatggagacaaagcttaaaagcatattgtgtcaatagctgttacatggtgaatagtacaaaaaattaagaaaataccctttagtgttctatatctattatctgatttggcaaaaatgtcactcatatgattgacaaatgagtaaagttttgacatatattcttaggcttcacttttgtcttgtttatgtaaacaaaaatgtcaaccaatattcatgtctgaagcacacctgttttgtcagtgacatgagcaactttgcttaattgggtagtaaccaagcatttattccttatctgaattttcaaatcatggctgaatcacaatcataagttgactgtgattacaggaattcaacaaacattaacaaaagcattctgtgagaatcaaattggctatatagaatctatgataaagattggtgtatattttatgattactcacaaattgtgtggtgcacattttatatcagtaaaatttataataagcagtcagatgtatgagggtatgtggatatatgtttttatatatacacacatacatacacacacatgcatacacaaaaaccagttgttaatatttaccagcacaccactggatatcaacacaataaagatatactttattgtgtatctcagcaaaaactgaccactcaacttttctagggacaactttattatggttggaaactagaggctaagacatttattgtgtcattgttgaagttccgtaaaaccatttcctatctctaaagttatttatttggctataatgccaagctacaccagctacttccccaaaagcaaggctaccagatggtgacagatttgaaagctctttctcatattttgagggtaggtaggggagtcacgctatgggacagtaggaaaatccacttttagcaggcaggatagaatgggagaagtcaacaccttgtcagttgccaatgagctgctgagaagtagttacagggtatatagcaggatagtattaaactgaaaggtcattaatgtgagatccttgggacaatatgcactctgtatgtctcaataatgttaaaagattctgtacaatatttgattgtatccaaatagtttataactgtaacatttaatttcaaggacaaaaatgaacttaagtcaactattcctgtggttttacatttcagagagcagtaagaaaaattcaccaaaacaaaataaagcaaaacaaaaatggagtgccaaaacagatttgctaatttttaaaaatgtgttcaaataaagatattttcaaatccttccttttattatcacccttatggcgcaaaagaaagctcatcagtttgctattaggatcatttggtagcacacaaagtccattttctatatatgttcagaagaggaaacaggatgagcattgggctcagccactggagatcacagcttcatcatggttcaacctcatcttcagacactgaaaatattgctgaagaaacaggaagcagcattgagcacggggggctgccatgtgtcctctccactgaagatagtctgaaggatacagtgaccgcaggaacaaaaatgccctcagaaacagccctaaagggcttctagaaagtacatgctacctgatgctttttttttttttttttaacgattgatgtctctgatttgatttggtccaagctattctgagaattcatgatggaatgagaacatcagcaactgcagcctattggatttcggtttagtagagtacagtgctctgtttgatcatccacttttcaagagccagcttcacatcctaactgcatcatccttgcaaagctctgctactttgaatgctgctttttttcagtccctgaaatacatgtgcctggggtgtcaccaacaggtgggttttttcctctgacttctttccatgtaagcctcaaggcatgtataaaggacatgagcgctgctttcattttccaaaagaaatcagctttatactgggaattgcaagcacgtgccaggtttcccatagtgacttatatgaactcgcacatactcagggtgagtaaaactagcaggcaggcaggcctcaaccaagagcacatttgctagtttttcttgaaatgttcagaactctggccctaagagaagctaatgccaggcaatcccttgcaaggataggagggttatgggatcaaggcaaaagacacatttggggaacaccattccattgggcaagctctgatatgcagaatctaaggcagctttctggacctctgaatatcatagcatcgcagtggcttcctgtggctctgtggttacagaacaatttctaccaaatgaagagaatgacagaagcaaggacctccacattcctatcatatgtgacagtctggaaaaaggcagtgttcattcttacctctcctaacttcactcgctcattcccaggtgagcctgaggccacatttcacctgagcatcccagctcctacagtcagaggaaagaacaaacttcactcccactgaattaggaccaactatttactagacactgtgcaggtattatgttactgtctcagtctgtttagttgtcaccataaagaaatacctgaggctgggtaattcaagaagagaagaaggtttatctggcttatagttctgcaggctgtacgagaagcctggtattggccttggcttctggtgagggcctctggctgcttccactcatggcaagggtgaaggggggctgtgtgtgcagagatcacatggggagcgaggaagcaagagagaagggaagaggcaccacactctttttaacaaccagctttcatgggaactaacagagtagggagtaactcaccaacagagaggtcattaatctattcatgatggatctaccctcatcacccaaacacttcccatgaggccccacttccaatattggggatgaaatttcaacatgaggttaggagggcacaaacatccaaaccacagcaattactagtcaattatttccgcagtccagtgagacagttttctgatacttgtttacaggacaagaaattaagtcttttttgtctattagacattcatttattgagaaccaactatttgtcagaaatggtgctgcagggctaccagagaaccagacaaatgtggcccctgacctcatggaatttgcattcctgtggcactcaaagaagtgagtacctaagcagtcagtaaataactttggctggctggttggctaagtgtgtatggagcagggaggcttggaagggggaaagtaacaacatggaaagaaaagcaattgtgcagggattcctagataataagccaaagacccagaatttgaacttcagcctaattcacttttgactttatcaagtgacatagcctcgcagatcccccatctcttcctatctcatattaaaaacgaaccagagcaagaacagtagcagtggaatctttcccatggcccatctctgttcgctggagtctgagcaccatctttgggccaaaagcctggggaagaacaggatctaaattccacatttgtggtgaggactagaaagtttcagaacattgcccttttaaactcatctttattaatattctttaagcgcacaggtaatgagaaagtgcaaatacagccccctctggctgcagcagtcagagagccaagaaaaaactgcatgtcatgccatcctattataataacagattaaaagggcacaaacagggtactaattagcagtcataaaaacttgaagctccagattgctcatcttcatatctgggcagtaaaagtaccacgtgtgcagataacatagaagtaaaataccagggtgcaattgcccagagctcagccagcatcagctgagagaagcagttgcatccagcagcacatcctacactttctcaagaatccaaaggcattcaggtgactgcccaagaattaaaaatcagccagcccagagagaggcaagtgcctcctaactcagcaagggacagcgggagaccttgccaacttctgattgatcgtcttcaattccctttctccaagatgtattcctgtccatggtctctccctggattttatgcagaaagctacttctgagaaatgagagggttttattagcatgcaggggccaaagtttagcctgaaggagagataccttcatcaataaaatcttttttgattaaattcagtcttttttcttgggtctgctcagagcttggaaaataagacgggtgtactttctaacttttatccccaatttgttccctgaggatttcaaggattctgttgccatcggggcactctgaaagaagaaaggaaggagtatgctttctttaacaagttgtctcttaacaaattcatacccaataattcaggcttggacattcactgtactcacctagcttggccaagtggctctgtattctatgttaactgtgatctataattttaaaagtagtcatgcatagcttatatagagaaccatcttttaaaaaatactctaaattttgttctaataaggagaaaagtgtatctacattgcatgtgatactgaaactagacaaattccttgtagccttttatctgacaacagctaaaaggcccaaattgaaggcaaagcaatgatgcaagtgaactatacaataagcacaattgtattcattttatttccaacattataataaggaccatatattattcactggtatatattctcttcactgtacagtgaaatatatgggaaaaaatcaagacccttctcttttaaacattagctctatatcagaaaggaaatggtctatatttattgattttctttgagggatctaggtaaatatcacagggctatgactgggtcctagtctccataccaccagtgatatggcttgtccaacatgacctttagaaagactcagagtttggctttgtgtttctcatctgtcttagtctgcttttgctgctttaacagaatacctgagactggaagatttataataaacagaaatttatttggctcatggttctggaggctgggaagtcccagatcaaggggcaagctgcatccagtgagggccttcttgctatgtcataacatggtgaaaggcatcacatagccagaagagagggtgagaagggctgagctagtgtttacaagaaacctactcccatgataacaacatcaattcattcatgacagcagggccctcataacctaatcacctcttcaagttcccatctgtcaatactgttgttctggggattacgtttctaacacataaactttggaaacacattcaaaccagagcaccatcctattctcagtaataccctttgtcttaatttttccctactaacctgggatgatattcaaagatattcaacaatgcttgggcactgaccaataaaaatgggactagacaccaggcatcaagaggcagtccagcctttctaattcatactgtctgacatccatccagtcccaattgtttcaaaggttctggtgataataggggccacctctcccaaatttgccttcttaactggattcctaaaaggacaagtcatgaatctctaatcataattctagcacacgtaccacaggccattaggaaaactatcctcagataaatgaagcctccccataccctcaaattacatcatgaaggtgagacccttagcatggtctctgactcactaggcaaccatggccaagtgatttgcattcttgagaaaaacttaccctccttataacagagaggaggatccctcaaagagatcctgaaagctcaagtaggagaagacactacaacgtggttggaatgcttcaaaagataatactttctaatcctaagacataattgctaataaatggtttcttttttacgtaaggtcaaagaatttttaataaatacagtctttggtgctcattaagaagacactaattcttcatgggttcataagcacacacataagaaaaatctgcagcaacagtacagtaataaatgtaaaatcctaatgagagaacatacattggctggaaaagggtattgttcttttcttccttcttttcttttgcgaatgatattgtaatgaattttcttcagaggacttattagtgtctgtttaatattatctctctctttcatgtgaaaactttccttagaatcttaggcaaagctttaggccttcaatgaagacgtcattaaaaaataatatctaagcagtgctcaaaatatcacattacaacaagttaacagcactgtcataggatatagagatgggatgatattaactatcagagattccagcctgatctatcagtaatttcattatttccaagtacgaaattaacttctttgagaggataaagcctgcagggctctggaggcctcttttgatctaagcagattattgccctgtggggactccatggtgggaattagatctgcgttcttggtggtgtccatagctggttctccattttctacattcctcatgttagaatggccataaatacggactgagcatcaatctgggactctttttcagattgcctagagggccaaacactggaaaagaaaagggctgcccgtgaaacttctggttcctgccttactgagggcttcaaggaaaggctgggtttagggttcctgaacactctgtgctgcctcggttcatttcctgttggggaagttctgaagttcatctgttacattcccaatgcttatgttaattcatatgcaaaatgggaacccgcttaactattgccttttattactctgaaatcagccaaaccagcttatgcatcttagcagtcttaaatcagcgtttcccaagtatgatctttgaaacactattaccaaaaagctgctcaaaagagagagagaaattataataaaaatatcatagttcaaagtactttggaaatgctgcttattatctctcttccgttagtttcacgtacaatgctaaggtcaaagaagttcttcaataaagaacagtatttaattttgcttagctgagcatttttcaatgttacttgccatagaatttccttcatttctcccccccaacactggctctcataatctgttatcattctgaagaacaaagagcacacactttgagaagagatggccctaagttaatcagcacactgcattaggtggctgctatcaattttgatttaattacacaagcatgcactcagcatttatgcaacgtaaggtcagaataagggttatgtactcctcaagggtaggttcccaaattggtgggatatgttccagcccctccaaggacttacacactttcctaagacctgaaaagctatggtttaaaaatagttgatcaatccttccagttgtccagctggggtcagttgccaactctggcgggcaaaatatcaggaaccaaggacacaaaatatgaggaaggcgtggcctcttccctcaaggaggctaccatggacaactaaccacaaaccaggaaaagcatgatatggaaaagggagtggtttattctgcatgaagggaaaaggaagattggtaaagacacaggctgctaagcggggctccagtgagaagaattcccattgctgggtagaagaggacagatgggtaagcaacctgagaaggactgaggctgcaaatgtgcagggcatggccgttctaagccagtcatccccccgacatcacagatgaaccaacaggacaaaaatttaagagttccatgatagaggaggcaaaccttagccaatttcttcacaccaggaagccactgtgcctatattctgaaccttgctgacggtaggtctggagtgggcctttgtgtctcccagcagcaggcatacataggagtcatctcttcgatgggcattcacatagggctaggtgtgcccttgctttataaaacatatgggttcttaaaaattggatattcctggatgtcttgtaagtaaaatcattttacatgaccatgaggagtgatccatttaaaggatccttgcagggaagactctggggaacaaggaatccacatgcactctgagatttctgtttagatttttcctgaagagctgcctcttaggggacttctgaatttaaagagacgttagaaagcagacatgatgaaactgcgttgtctccaaactaaaaacaaaaagatgaaagtaaacttaaaagctacagatgccattcgacaatgatttgatgtaaaataatagtccatctataactcaatttagccaagtccataccttctgagatccttgacttacctaaaggctctgtctaaatagtgaccctatatcatacaagttgaacaacaacaaaaggagaaactagcagatttttacatcatcgggagggacatagctggtcaaacaggcagtaaagtttgagcacaacaaagcgagctttgaacctcctaagcaaactgacaaattgcgctcaggagtccagttcccagcatcagcaccactttgccacaatggcttgtctcctatctctcctgcctaatggctttccatgccaaggagggcagtcagtgtgatgaaaataaccatcaacaaagcatttggtgattagtcgtctgcttttttaaatataatgcctgccagccaagattgataaattattttggtcattaacaatctatttaacaactgtaaatttaaagtgatcactttcctgaggcttagtgttatagaggttagggggtagaatctatttagccagagttaagagctggaaaattaagccagaacacgagaaacaagattacaaagtagtattcctcagtgagtgctgtgaagctatatggaatcaggctattaccaatggtgggggatatgtttaatcacctcttaaaggaaaaacaatcttaattaatgttgtatgtcataaaaatataatttagatggggatgggaaattgctaaagacgaaacccagagcaaagtgaagacttggttcaaaatgaaccacccacccatcaattataaaaatattgcccaacagcaaatcaaagaacatgctctttggtcatatttgggcagcctgaaaacactgatccttgaaaagcgttttcatactttatacaaaaaagataggaaatatttaaacttactttaaattagaattttaagtgccatatttaaaaagctgaattactcatagacacagtcaaagttaacacactatattttaaaactatatctaaaaaactcataaatatgtagtcagttgtgttggtcagtgaacaatattattatctttatgctgcaacatttggaccgaacatttcacctgactaaagtttggcattggtccacttgttttatttgatgcttataggacatccaaagggaaacatagcaaattgtttctgtagcctattcattagtagcacagagaaccaatcccagcttcaaggtgtcaactggtgttgcatcccaggccccatctaccagtagttcaataaggagcaagatggcaggaataagagggaaatgcatctcccttcagctttcaggttttagactactgtacatggctctttccaaacaagaagaaaagaatataacatgaactgattggtgcagtaaactaaactggatttatatgctctaatatggaaaaaagatccctagaactgatcctcaaaagcatctcccattaatggagaaataggagaatgtccccaagggtgaaagtctgggaccagcaatatggcaacattataagtgcgctgaacagcatttttgtaggaagtgtgttctaactgcctttgtaaaaggaaaaaggaaaataaaacaaagcagctggacaataccatttccactgattaaagttcaggggagcctgaaaagttacttatgagatatagttcaaccattttcccccttgctttcagatttacgtgatattaactcctatgcgtccacagcagccccatgatccgcctcagaggaattcagtgcctaatacttgactaggaagaaacattaggtattgatgggcaaagagttttcatctcaaatgcctctctgatcaactagcagtagctcttgttgaggagtccgaggccatatttaaactcagtggaaaacagcagcatgggaaattagcagtttggcatagagattaagaacatggattccagcagggagcagtggctcatgcctgtaaaataccagcactttgggcggccaaggcaggcagatcactttagaccagcctgggcaacatggcgaaaccctgcctctacaaaaaatagcctggtgtggtggtgcacgcctgtagtcctaattatttgggaggctgtggtaagaggatcacctcagcccagtaacgtcaaggctgcagtgagccatgatcataccactgtactccagcctgggcaacaaagtgagaccctttctcaaaaaacaaacaaacaaaatgatcatagattctaaatacatatggatgtttgaatcctggccctattccttaccagcataacaacataaccttatgaggttattatgaacattaaataaattaaggcaactttcacaatgtctagcacataatttacacttcataaacattagcatcataaccaggaggactaattgccattgttgctaattggcattgcagagtagagttgtggcttgtcttttgcccatcaggctatctgtgtttcagaatctgctcctcaactcaagtgtaaaacttacaagcagtggtggagtgggacaagtcaaatctacacagttctttatatgattgaatcagtgaactggatagactctaccaccaagatgtgatgtgttgcgatggtggttctgtagtatgtttggaccgtgaaagatcaaaaagtctttcaatgattcatattttcagggcattgcaaagtgatcaatttggtacattcttgacttaaaacaatcacttggacttctccaaacttcccagactgctaataacatgcaatcctacttctaaccaaagtgaataaagcatcaaaaggaaaccttggtttcatcccaagtgctaccagctgctttcacatattgaaagtttggctctaccactaacaggaaaggaaacactttcaaacctggcaggtgatgagaacagacttcagaacttggctacactgtcatcagacatcaggggctggaattagggcaggggttctcaactggtgacaattttgtcccacaggggacatttgacaatgtctggagacatttttggttgtcacaactgggtgggaggtgtttctggcatctagtgggtagaagcctgaatgctacaaaacatctcactatgcatactctcactccccaaactctgaatcttcgggtacaaaatgtcagtagtgccaagactgagaaatcctggattagcacggaacacagagcagtgtggactcattgctaaatgttttcctcactatactggaggctccaggtaagtaggaatcattgtatcttcagtgcctagcacagttcccagtacttagcaggggctatattaatttttgtggagtgaatgcactataatagcagatattaatgcaggtcagctaccatttttcttcacagcagagcaaatatttcttcaatattaaagtcagaaagcaaggtgaacagagaagacatatcagaacatgactttgcttatttgggcatctagcacatcagacacttccaataaatctgtcccacttccttcattccctatcttccctagagaagtaactgatgccacatccagaacctaacaataagttacgtcaacttgaccagcaccaacatatttctagaatccacttgcttctctccttccatgaagcctaagccaccatcatcaacatctctaatgagtcactttgcttttgctcttgacctctaacttccattctccacagagcaataaccatatgtcctgttaaaggcgttaatcagattacatccctcttgtgtttaaaacttgctaacatcctcacgggggcttaaaacatcttacaaagtctggcacctgctcaactctgcactacaatcatagcggtcatcttcctatttaaccaaattgtccaattcctttgcttctcagagcctctgcactggcctgggaatgctcttcatctagatccttacatggctggcactttcacataattcaggaagtggtttaaagtcaactcgtcagagaaattttttgactgcacagaatcttcacctgtgtagtcagacaagttttcttgtctttagattatgaggcacaatctgagagctttatttgctcatttacgcttgtacactggcatccctcccagactggagtgtcagcttcatgaaaacagagaacctgactgttttgttctctgctgtgtcccaagcaagcacagtgcctggcacaatgtaagaagtcaatacacatctgttgaatgaatagataactgaggaataaatcgatgaaataaacagttcatatacatgaactagtcagagaaaaaagaactcatctaaaagaaaatatgtgttaactgtcacttacaaaagagttgcctagaattttcaaattaaactccaaatagcatcctttatttaactgcgatcaattcaacataagactgaaaatcagaataatagagggtagttagtgttcatctagcaccaagagtaactcagaaattaaattaacagtttgttagtataaatctccctcgttctctttatgagtactaaattaaagttcatcctatatttttaaatctgttacaagcaaagagacaatgaaataatgaaagtataatgaaataattttactaattcttaatacataaccatagcaatgattttgtaagtttccaaatatggttcagcagtgtggaccagcatggcatgaaaataaatttaagtgtgttttccttttataatttttattactgtgaaagaaaataattaaggtatttaatattcacaagcagtatcagaggcaagaatacgagtatgacattactgacgaaatctggaacataacgcaagtgtaatgttgctttttttggaccacgtgatatatctgaatgcaacaaggaaagaagccagaaacatgttagcaacgattgggagggtgagttgatggtagcatgtagagtcaagcaaagtcagaggctgtgacaaaccatgctgaattagcacatgcagttcctcttggtctgcctcccacccacctttccaactgcagttcttatcactccaacaacatccccaaaacttgcagggttctaaagtttatatagtcttggggtatctgtgtccttatttacaccacagctgagtctaaaagaactttctgcaatgatggaaatgatctaattctgcactgtctattgcttctgtatcgagaaactgaattttgcaaagcatttaatgttaattaacttaaatttagccacaggctgccaaattgcacagcacagctctagacaccctccctatagtctgcaaactcctgctcgtccttcaagacccaattcaaatgtctcttcctccagaatccccttcctcttcctgttccctaaatagcaggtttcatggctttaatgataaccatttatcacattctattacaatcattttatggtatgttggtccttccaactacatcaagaatctctcaaggggacagactctgcctgactcatctctaaatactcagttccgtgcttggcacatgagaattatttgataaatacttgttggatgctcaagtgaaataatgaagccatctttagacatgaacaaatataagcacagcttaccagaaaagttcttcccaggggaaggtttactccatttatataagaagctgcaaaccagatatagcttgagcatccctaatctgaaaatctgaaatgctccaaatgctccaaaatctgaaactttttttttcttttttttttttgagagggaatctcaccctgttgcccaggctggagtgcagtggcgcgatctcggctcactgcaagctccgcctcccgggttcacgccattctcctgcctcagcctcccgagtagctgggactacaggcacccgccaccacgcctggctaattttttgtattttttagtagagacggggtttcgccgtgttagccaggatggtctcgatctcctgaacttgtgatctgcccgccttggcctcccaaagtgctgggattacaggcatcagccacggtgcccagcccaaaatctgaaactttttgagcaccgacatgatgccacaactggaaaattccacatgtagtgttatgatgggtcacagtaaaaatgcagttaaaactctgtttcatggacaaagttatttaaaatattacatacaattatcttcaggctatttgtacgaggtccatataagacataaacaaattttgtgtttagacttgggtcccattcccaagatatctcactatgtatacgcaaatatttcccaatccaaaaaaaatctgacaactgaaccacttctaggcccaagcatttcagataaggggcagtcaatatgtatgaccttcagatttgatagtatttcaccatatttgtatatatgtgtgcgtgtgtatgtttgtgtgtgtgtgtgtgtgtgtgtgtgtgtgtgtatttggtagacactgcttaccaatgttaaaaacagatttccaacatttcttgaaacaaatattagatctggcaattttagtcccatatttgggcttggcaacaatgaactagaatgtaacaagcagctgcatcatttagataataaatatcctctacagaatctttttttttcttctttttttggtacttttagtccactgttgtcatttatggtctctgtctttctcctgcagccatgtgaccttacaacaccagacaatgaatgaagagacagaaatttcaagttcagacattgatttctcaccgacattagtaaaataacaacagtgacaataatagctgcaaaaacaacaataataatggctggtagtatttattgaacatgacatgccaggtattatactaggcaattaatagacattgtcagatagaatcctcctccatgacctagaaaacagccttagcttcattttatcaatgaggatagtgagatgctaaggggcaagctgaaaacaaacagaaaggtcttcccctagtctgcccaccatcagagtcctcactgccatctcttcattacaaggcgacatccctcttcactcctccatgttcctcccagcctggatttagacccagagcacaagacaaagtgggaccttgggcaactgacataacctttctgcattttgctcctccactcacaatggacttcagaaataagagctgacattacctccagggtcacatgcgggcacatgagatgatgtaggtcaaacactgaacttctcagacacttttcacaaatggaaaatgatctcatctgagcaggcagagaatggctggacaaaggctgacacatctggagtagggaggcatggaaaggactgaactctcttaaggtaaataatggccttgtggcttttgctagcacccaccctcaaggagccctcatctagggagagcatgtctttgtggaactaatacaaatttggctccatgaggcttgcctagcttcgtgccagttaggtgatattgaaaggatgcaagtcaatggaaggtttaagaatcagctattgtaggccaggcgcagtggctcacacctataatcctagcagtttgggaggccgaggcggacggattgcctgagctcaggagttcgagaccagcctgggcaatatggcgaaaccccgtctgtactaaaatacaaaaaaacaaaaaaaaaattagctgggtatggcagcatacgcctgtagtcccagctactcaggaggctgaggcaggagaactgcttgaacccgggaggcggaggttgcagtgagccatgatggtgccactgcactccagcctgggtgagaaagcaagtctccttctcaaaaaacaaaaacaaaaaaaagaatcagctattgcaggcctagcactctgccaggccaggagttggcaaacgttttctataaaggtccagatactaaatattttaggctttgccggccataggtaaacaaatgagtatggccatgttccagtaaaactttacttacaaaactaggccagggcccacaggtatcgtttgcccacaacccctgtgctaggcaccatggaggcagagcagaggctcttcacagtcatccggcacaatcaccaggggcaaagcatgaagcagcctgttggattccccactctggtagccacagtcctctgaggtaaaggcctggacagcaagaatgacttaagcaacagactttcttggtggctccagccccagactcaccccacagggcatgaggagagtgagcctctctttcccatgaatggttcctcccagcagttgtgcaggcctgtccgcagaacaggtgaggctacatggccttcaaccacgtgatgtattggctcctctgactaaatcaaagtccacagatgataggcctacaatatccaagaagttgccaaacaaagatgcttaaattgatacagacaaaactaaatacctctccttcccttgtgcctgctttgactcccctagatgccatccctggtgccacttcacactgagctatctccttgcacttgaatcccccatgtctcattaccatgtgtatatcccaagacggggtggctcctgttgtaggccacatatgtttggttgttgtttgttttttttgagatggagtttcactctgttgcccaggctggagtgcagtggtgcgatctcagctcactgcaagctccgcctcccaggttgaagcaattctcctacgtcagcctcctgagtaactgtgattacaggcacccaccaccatgcttggctactttttgtatttttggtatagacggggtttcaccatgttggccaagctggtctcgaactcctgacctcaaaggacccacctgcctcagcctcccaaagttctgggattacagacgtgagccactgcgcccggccaggccacactgtttaaaatctatgcagtccttctttgatatgataaccttggggttgtttatatttcttccaagtgtatgaccaacaggatgcagagaagcaaaagttttcttactgttttgtctgttaacgtaacctcccattgtctttatgcttttgtttctgttctcatttaatcctgttttccttcacaggattaagtctgctcatttctaaactattgtctgaactttaatattctaacatgtcttagtgtcatgtttactcttcactgtttgactttctgagtgaaatagtgaagaatatgagagtggaaaaggtatttggaaagattctaggttttaaaatttcagctttagttgatccttcctacctgtgggaccttgggtaaatgagtgaataatctgaacttgaattgcttcacctgcaagacaaaggtaagtatgccaatctcgggagaggtatcatgaggattacgagttaaacatggaaaattcctcttccaactcaataataaaaacacaaaaaatccaacttatatgggcacagaatctgaatagacattcctccaaagaagctatacaaatgaccaaggggcatgtgggaagatgctcaatattagctatcagggatgcctcacccaaacaaaaggacaatgagataccacttcatgcttattgcttattcggatgactataataaaaagttacaaaataacaagtactagtgaaggtatgaagaaactagaatcttcttacactattggtaagaatgtaaaatggcaacgctgctttgaaaatggtctggaagtaccttcaaaaattaaacatagggttaccttatgacccagaaattctattcctagttatataccctagagaaatgaaaacatatatccacacaaacacttgtaatattaacagcagcattcacagaacgattattcataagaagcaaaaagtagaaacaactcaactgtctatcaaatgatgaacagataagtaaaatatggcctagccatacaatggaatattatttagcaataaaaagaagtttgtgaagagcaaagaaaacaagcaacatagtgaagagacaatttacaaaatgggagagcatatttggaaaccatatatcagacaggggattaaattccaaaatacataagaaacccattcaactcaatagtaccctcccctgtaaaataacccaattaaaaaatgagcaacggacccgcatggatatttttccgaaggggacatacaaatagccaacaggtttataaaaaatgtgaaatatcactaatcttcagggaaatggaaataaaaaccacagtgaggtatcatctcacacgtgttaggatggccattatcaaaaagtcaaaagataacaagtattgctgagggtgtgtagaaaagggaacccttcttggtagaaatgtaaacttgtacagccattatggaaaagagtacagagtttcctcaaaaattaaaaatagaataccatatgatctagtaatcccactcctggatatagaaccaaaggaactgaaatcccccatccaaaagagatatctccactcacatgttcatcgtagcattattcaaaaccaccaagacatggcatcaacctaagtatccactgacagataaatacagacatgcgatgtatatatcaataatggaatacgatttactctttaaaaagaaggaaagaaaatcctgccattcgcaaaaacatgataaaactagaagacattatgccaagtggaataagccagacacagaaagaaaactactgcatgatcttacttagatgtgtaacctaaaatattcaaactgttagaaacagagcatggaatagtagttaccaagggccaggcatgggggaaatgggaataatctggtcaagggtacaaactttcagttataagataagtaagtgctggcactctaatgtctggcatggtgactaaggctaatgataatatattgtatacttgaaatttgctgagagagtagatctttactgctctcaccatgcacacacacaaaaggtaactacgtgaggtaaaggatatgttaattagcttggttgtggtaaccatatcacaatgtatacgtatgttaaatcatcacacagtatatcttaaatatatataatttttgtgaatcataccttaatcaagctgtaaaaaaagaaatgaagtgcggatacatgccaaaagatgggtgacccttgaaaactttatggtaaatggaaaagacagtggcacacaccaccacataatgtatgatgccatttatatgaaatgtccataacaggcaaatagagacagaaagtagattagtagtttccagggttatggaaggggaggaatggggagtgacagctaataggcacagggtttcttttgggggtgatgaaattattctggaattagattgtagtgacagttacacaactctgaatatacctgaaatcactgaattgtacattttaaatgggtgaactgtatggtattttaattgtatctaaataaagctgttactatatggaaagttcttagcttcatgtctgagacaaaggaagaaataaaaatggtcactacggttatcattcattcacctgcattttaaaaatgcagtcggtttttctagagacttttcacccctgttattctgagaattaaaatactcaaacatatgtgtggtgaggtctagaagaggaggattattgtagcctggagtagttagaaaagccctcgagaagtttaaacagaataaaggaggaggcaaaggagaaatcaccaaaggcagcaatctgaaagtgaaaaggtgggaataatttggttccctgtgagagccataaggaggcaattcgattaagcaaatggctcatgaatgcaagggataagttgaagagaaggcaaagttagatttccaagggtcttggaagcataggccaagatgtttgggcttcctccagctttggaatgtcaggaactgaatttaaggaaagccatcctgccagtttatgtggtacaaaagggactggctgaaatcagaacccaggaagtatgagttagttagggcctgaagaaagataataagaatggaaataggaaagaaatagcacaaaatagtggctacttctttttttttctcccccacacccccccgcccccggacagccagttgttctaaaggggctatttctttatgataaaggtgacagaatacagaagaaaaaaaatctcccttcctccttcatcaacacctaacaaaaggaacaataataaccataaaatcatggttaaaaaaaaaaaagggaaatttaccagtaagctctaaataaggaattaagcacaaacttgtgccataaaattcaaaagaggaaactaattaaaaaaaaaaaaaggaaggcaggaaggagcgagggaaggtgaaaaagcaaataggagatgattttcatgcaatttgaagttgcatcaaaatcttccacctcaactgtcagaaacagattggagaaagtatttgagttgacaaaattatgggatttcccttcaatattccccacaatcaggagacaagtagactgaagtcatgattttgatgtaggatttttcttctcagtcactttgcaagctgggaacccctggccagtgatgcccgtaccaggccttgcttggccatgctggtgtgctccagcttcttgtgttatagcttgtacccgtgtttggtggttccctgagctcttgtaccatgcccaagaagaatgaggatacactggacattgaagggtgaggagggcagggaagaattttactgagtgacgaaaacagtttttagcgaagaggggatatggatttggtctccctacctgaaggtgagaaagttcccctgtgtggctgggcctggggccttttccagacttagaatgggaagtgcctgctgatttgtttgtgagtctgcaaataagtctaaagcaaagacaccactcaaaggtgggcacaacagtgtagaaaaccaattaggaaagcgcaggtatatgtaaaacaggtgaagggtggggaccaatcagaggagagcttaccaaacagaaagggaaattctcaatccagtctgaggatttaacttgtagcttggctttcaggctttaaactctcttccacttgaggtggggtttcactggggacccacccctatctgcctaggcatttgcctgcctcctgttgctatcaatttggaaaccttggtgaagccccagaaaaccctggggagtacaatcccagaacttcagcccagccaagaatagcaataattatgacaggggcttggcaggaaaaaagaattgatagaactagagaatgacagcatacagaggacgaacttcaagaataaactggagatgacccaaagtttctagcctggatttttcagaatgggggtgataccagtaagaccaggggtcagaataggggaacattttatggtagaagggcatgcactctgttatcagataaattaagtttgagcaactcatcccttgaattcgtatgtctgtataaacctaacctagtgcctctcacgtagtaagccttttataggtgtgtgcaggagggatgaggcatataaaatttaattaaatatgaacaaatgatggtaacaataaactcagattttaaaaaatggttttgtttcaaccactgtggagtcaatagactctatgagacttaaaaattttttaattttaagctgtctcttagatattataaagccacagtgagtcatcttgcacttaaaatccagaaaagcctataaaagaatagaaaacccgaatacgtaacttcctcctgtgacagaagaacaaaaacgtcaacgttcacagcttaaagacatttagcacctcaaaaagatgtatcataggtaagtttctatacttgaatgatattatataatcataatgcattggaaattaagtcaatttacaaaaaaaacccctcagaaatgcaaataacagtgctttgtaaaactgtatggcctgttttctggaaggtactgtgtgattctgggactggacttttcattaaaaagataagagattcaggcatcagacatgttcaattattggctccctaatgaagttcactatcctgtctaatggatctttccttttcaaaagaccccttcctccttgtgtattctggcattgcgtgtctctggcatttgctctatgagaataactggacagtacaatgctcttgaatacagagagctggagcttgaatggacaccatagccccaaggacatgaaaactattttttgattgtgtgtgtgtttataaaacttcttgcataaaatcagtctttgtaatttcctagacttcaagggcattcttttcaagttggggcttcttaatgtggcccttaaaaatcctaaaattaaatgcatttttaagctatctgtgtaaatatattaaaaatttccctcattaggaagttgccagtttatggcaaagctttcagaggagtctgtaacacaaagtggatccagaaccacagcatgtagacccctaaaaattaaaaacattgaaacctatttagcaaatctgcatgaaatgagccaaattcatactgcttctgtggagttggttcctggaaatctaggcatttagtggtggagttacagatggatctcaatggcctgcgtgattttcccagcctattgttttcgtatctgattaattattctcttaaaatttccatccataaaaaatttccaaagatattaggatctctcttcacatagtctttccttcttttgaatgatgctattgttgtcactttgaaaactgtaaatagcattcaagatgatatttaagtttgtgccaacatttagtggaaatgtctaagttttgaaatagtagggagctcacattccatctggtgtgttttcattttatctcctattctcagtgaattttaaaagtcagctgcagtgtcaataccctttctgctatgctaatgtgacctccacgtggaaatcaaaggaaaggagttctcagggcaagtgattctttctcaattgaactatttagtgtcatagaatcacaaagtatcagagctgaaagcaggcttacaggtgaccatgatgaatacctctcagtttgaagggaaactgagcctcaggcagagggaactgcccatagtctcattagccacagggacaggagttgaacctcgataggaagcctttctgatggccccatatcaggtggtcacttccttccccacacttccatggccctttatcagagaccaccatcccatgttacttagcggtttcaactttgtagcacagttactgtcactaatttcttacccatgtgtagcaggctaatatttcaaagtaatcactggtgtgccatttccttcctgaccatctcttggctaaagggaagtgcatctattgcttagcagtagtctccttcactcaccagcttagcctttaattcaaaaggcgctgccccagtgtgagagagaaatgattcatgcagggataaggacacagaagagttctaactgcccacccccagagtttaaaatagagtttcaagctggataatggacagagtcaagagagataaagcaagaaagagtgcatgtgtacatgagtgggcacgtgcatgcatgtgtgtgcatgtgtgcactggggcagggtgtgctctacccttgccttttccccaacccccaggctgaatcctgaggttgggtaatatatgagttttctatttgctactataacaaatttccacaaactcagtggcttaaaacaacacaaatgtattatcttacagcactggaggtcagatgtccaaaatgggtgtaatgggttaaaattcaggtgttggccagtctgcattcctttttggaggctctttgccttttccagcttctagaggctgcctgaattccctggcttatggctcaattccatctttaaggccattgatggccagttgaatctttctcatattgcatcactctgacactacttattttgcctctctcttccacctctgtgattatattgagtccacttggataatccaaggtcatctccttatcttaaagttggctgactagcctctaattgaatcttctactttaattctcttttaccatctaacatatttacaggttctgaaagattggtacataggcaccatttgggaggctattatttggtcttccacagctgactcactgcaagccatccctttgaatttgagactctaagagtagattgaatgtgcattcagctttttccatccagaattctggtagtacacagctttgcaaagagaataatgaaggactatagcagcaacatgaatgtctgctggaggcacctaatttcctgcaggtcttagcaaagtatgtaagaacagacaagttttttttgagcccatgagaagaactctgacaagctggcaaaggccaaagagtaagtgtccttcatgtgcttgtgacaagagactatgtcaggaccatggacacctctaggaatgtaggaggccaaaggtcaccatcctgcaaagaatgatggcattccttacgggtatcagaatggaccaaagatgcacacaaggaccaggcaaagtggattacttggacaccagaggccaaggaaacaacagccaaggacaacagaatccctgcctaccccacacgacatgttgctcattaaggccccagaatacagaatctgaattgagagattataagccagaatatgactgaatgaattacaggcctgaactgacagaaacggcactgaacttgctgagcaaaacctggcccagggctgatgagatggtttgctttcacagccagaaattcaactgaactttgggagtcaagaacatttcattttttaatagtccaactggtgactgtgaaagtaatcattgttatacttggcactcaaatgaacctcagacacagcaagagttgacttggtgattgagaagaaactggagacaagacaaaacaaatgggaatataaaactgtagactatcacatcagcacaactggctagtttatttttatttatttatattcctttttatttttttgagacagagtctcgctctgtcacccaggatggaatgcagtggcacagtctcggctcagtgcaaactccacctgccgtgttcaaacaattctcctgcctcagcctcctgagtagctggcactataggcacgcaccatcgacccagctaattttttgtatttttagtagagatgaggcttcaccatgctggccaggctgatctggaactcctgatctcatgatccgcctgccttggcctcccaaagggctgggattactcgcatgagccactgcgcccggccctactttttatttttttaggtggagtctggctctgtcacccaggctagaatgcagtggcatgatctcagctcactgcaacctcctcctctggggttcaagtgattctcctgcctcagcctcctgtgtacatgcgattatgggcacgcaccaccacacctggctaatttttgtatttttagtagagacggggtttcaccacgttggccaggctggtctcaaactcctgacctcaagtgatccgtccgcctctatcccagggagtatctttatttttttttctaacaagtcaaagagtagaaataccaaaaaagtcacctctttgggtgtttcagctacttagctagctcacacacacatgtatttcccatgaggttttgatcaaaactaaagtcaatttttttcactaggttcaccaaacaactgccagtaaatattggcttctgccaatgaatgaaaaagaacacaggatgtctgctcttaaaaagtgacccctgatgtttccttcacattatcaaattattgcatactcattatattatgtttgggaaatgcaagagaatatgaagaaaggaacaggagtgtaacattctatttgaagctacaatctctcttaatttcaaggtacatgtgcttccattccattctccatttatatgccactctttccattcaatattatatcccaatgtattttttcccagtgaatttagaaagcttattttgccaaggctgaggaggtgcacctgtgacacagcctcaggaggttctgaggacatgtgcccaaggtgatcagagcacagtttggttttatacattttagggagacatgaggcatcaatcaacatacataagatgagcaatggttcattctggaaagatgggacaacttgaagcaaaggcaagaagactctaagtggggagggagcttccagggcataggtagataggagacacatggttgcattcttctgagtttctgactagcctctccaaaggaggcaatcagatatgcatttatctcagtgagcagaggggtgacttttaatagaatgggaggcaggttgcccctaagcagctcccagcttgacttttccctgtagcttagtgatttgggggccccaagatttcctttcacatttcccccccttctctttgaaaaaatcttttggaggaagcattttagaagaaaatgagtctctggtctcaggttttgtctcatctctcatggctaggatggcttattcctagatgggtaggtcttgagttattaggtatgttcatttttagcaggttgtaagtctcatgttctataaagaaaaaatagggggaggaaggaaaaaacaacaacaacaaacaaaagaacaagcctgtaaaatccatataggccatattactctgaagtccatacatcagtaggcaggtatgaaagtggcttatgtatgtaaataggttgctgttatctttttctgaagtttccgttgtctagcttcagttcacttggctttacgaaagcacagcttagtttttggtgactccaaattaggaaagatgggaaaaaaaagaaggaaaaaaaattgaaaacattgttttgcagacttgtagcccagaaaaattagaattcattccaaaccacagaaaataataaaaacaggcaagactagaatctaacaacaggtatactacagtttttgaaatataacttttctctctccagtttcccatttttactaatgataaatcatggtaggactaatttgctttattattcttggtctgattatttgtgtacagtgttatatcattaatattattcataaaaactcatttgatggctacatagatgaatatatagtattaaatatattcctctattatttggcatttaaattgtttcccaggtttagatttttcaaattaattagatcagttgtccaagttttatagacacacactcacacacactctgatgtaaactggaaccataatgcaggtaagagcattttgaacgtagaggggatgacacagaaatgcctggtattctctgggttgggtgtagacacagttccatacatgaaggtgtgtgttgaccagcctattttggattgtctatcttggagagtactggtgggccttttaggggagcaatttatcaagctaattttcagggagattccagaaacgggtacaggggacagagctggccttggtgatttgattctggagttacccacaaagttccactgtgcctctagactaagcctcatattccagctttaaaatcccattcttttctcagcaggctttgttggtttgaaaaaataccttggcatctcaggaaggacaacaatttgaactactattgtaataactgaggtaaaagttctttctcagggggaggttttgacaggaggcaggcagtgcccaagaagtggggagacttgcagctgataaaggaaagccacggacctgaggattcggagaaccaggctttgaatgcagggggctggggaagtgccaggttcagctcaacagtcatttcttgacaacctactctattatgaagtggtattttttgggtgccgggaggcagagacgatgaagatgagtaagatgcctctggtagttcataaaggcagcagagagaaaagaacccagactctggagccagacagcctaagtatgaatctcaggtctgtttcttactctctctgtgtcctcagaaaagttttcaagtctgcctatgcctccgtttctacacatgatggagataaatgtaccttaatgcccaaatgagcacttcattgtatctactaactcatcagtatgctaatgtcattatcatatcacagtctccctccacatttgaggtatctccaactaatgaaaattttgtttccagcctctttcaaggagtccaattcagccttatcccagatcaccaatagatgaaactagcccaatgccccagggaaagaaggtaaatggtagacaccgcatgtggatggaaaataatttaggaaaacaagtgcagttgtttattccaggtcacgaaaaggaaattcagcctcagtcttcaatatcaactgatagggtcaagattaccagagaagccagctgaaatttcatatatagatttgacctaaatgtgcaatgtcctttcaataactctgaagagcttactaagagaaacaattttttagagtcgctaaaaggaaattcagcctcagtcttcatatcaactgatagggccaagattaacagagaagccagtgaaatttcatatatagatttgacctaactgtgcaatgttctttcaataactctgaagagcttactagaagaaacaattttttagagggaaaatatatgttggagcaaggttacatttccgtgcaaagggaatattctatgagttccttagttaccactaatgtaagaaggatttccagcaggtactggtgcaactggcctacaagatatttatggtccattaagagttgtaagcaagactgtttctttttcagaaaaaaagcaattttctcttaaatattttagtgtgttatgacatgaatacactatagggcaagcaaaagtatttaagtggttcagcacacaaaaccagctccaaaaggatgaccttgggaattttagaagcttggctagagcatgttgatgacttccttgtgtttaacaaaaactataaaaaggagttataataaagtacctagatggggactactgggccatatcctaaaagcagagaaaattcctgactttgtaaaatgtcatttctttcactgtaagtctaaattactggtagtgtgtctaggacttataaatttattggaaatccagtgtgtgtgttgtgtgtcgtgtgtgggtgtgtgtgtaaatgtctctaaggttgaacagggatatgaaaaccatttgggatttagtactggaagtcccagtgtctaagaaaatcgcttttctccctatacatgggttttccataaaattgaaggataatattttccttaggctaaagcaaagggtgatagaaacagggacggctttgtagtcaaacagactttgatataaacaagctttgccatgagctggttatgaggttttgacatagatatttactctctgcaaatttagtttcaattcaatggtatgaatgatatgcttggcacctagcagacagtccagcccaatgtgtattctcattgacagtaataatttgattattattctcaaatattacatttatttaaaatagatgtattactagtctcagtgtattctcaatgacaataataattgtattatattattatttttcattagtgctctccctaggagcaaagactgcgaactatagttgtttatgaccactaaccttacactagaagcccagtatgattgggtatttttcccccattttaaatatgggaaacataagatactgagatttaaatagcaagttaaacattaaacagtttgcaataaaccactatgttgactcaaggtggagagaatttagagctacacaggtataccagctatttcttgatttccttgattagaaagaaaatctggcatcattcaaattcctattctaaatctggggaaggtcataacagtctccacaaacagctgcttgccagtaagctgaagcagtttgaaagcattctagagcaaaaccatccagaagaaatctaatgcatgatacatatgttattaaaagtgtttggtagcaacaccaaaacaagtacaaagaaacaggtgaaattaattttagtgatataatttttaactcaacattaccaaaatattatttcaacatgtaactattataaaacattattaatgagatatttactttttttttggtagaaggctttgaaatccaaactggattttacatttacaacgcatctcaattcagactggtcacaggtggctagctgctaccaaattgaacattaatggtagacgtcaccccgcagtgacaaaaatataaccacatttgaacactcaagccgggattctaaacatcaggctatgtttccaggactctatgtctccaaaagcaggcaacttggaggccttaggattccttcctgctggcatgtggcacatgaatgaaccttgctccaagctaagaggttacgggatttatttatacaggttgtttgaattacgtgtatcattcttttgtctaaagaatgacaggtgataatttaaaaataaaaacatttacaaatgctttgggactttaaaattgtattaatttttatcttctgtttccccctaattcttgcttattttgattttcttcattaaaagagagataaagttaaatgtttgggggcttttcactttggggccattataatttatattgagggaatcgtgtcaatgcttaattcatatctgttttatctttacctagtttatccatttctgatcataatttatttttccaatagtctttttttttttctatccttaatccctatactctcatttctctaagtaaaatagatttggaaaaactactgaggtcttggtagtttgctttagcaggttaactccaaacttatcaaaactttttggacaattttaagtgactgtttattaatagctatgtcaagaaccttgaatgtaaacctaagatttttttaaacactgaaacagcccattattcaagcactgtagttaaacttaggtttcattgcagcagccactgtgagactgagagcagaactgtgagaagcaggtaggaagacagatggactccagcaacaaggacacctcggaggaggcattttcctccttcaccggcaagcaccttagagctttctgatggaatgtatctggttggagcgagaattcactgtggagggcagataggactctgcacaagaaagcctgattcgtgaaataatgagagaggaccacatggagtggtttgatagagtggatttactatggatgctatggatagagtgacacgtgattaaatttttcttatttctcactaacatgcgattgaacgtattcaaacaacataggagagcaattttgggaaactaatctagggtggcttacctcaaagcaaactctaggaaaaagccatggcatcctttgccttgaagctcaacctgtagatacctgcatcctcctcatcaagcactcttcagccttctttcattacttttcctctttagtgtccaatgacttcatgatcttccttggaggctccagctcaccatcactaccattatagccctccatgcttctcaacattcctcatttgctcagctctagcctgggctgggcacagtggctcatgcctataatcccagtactttgggaggccaagccaggaggattgcttgaggctaggagtttgagaccagcctggacaacattgcgagacctgtctctacaaaagcattagccaggtgtggtggtatgtgcctgtagtcctagccactcaggaggctgaggcaggaggatcacttgagacccggggtttgaggctgtagtgagctatgattgggccactgctggccagcctgggcaacaaagtgagaccctgtctcttagggaaaaaaaaaaaaaagagttaataaaatgactaacctgaatcatatattgtgacagttaatattgagtgtcaacttgattggactgaaggatgcaaagtattgttactgggtgtgtctatgaggatattgccaaaggagattaacatttgagtcagtggactgggagaggcagacccaccctcaatcttggtgggcaccatctaatcagccgtcagcatggctagaataaagcaggcagaaagtggaaagagctgacttgctgagttttccggccttcatctttcccctgtgctggattcttcctgccctcgaacatcggactccaagtttttcagcttatggtctcttggacttataccagtggtttgccaggggctctcgggccttcagcaacagactgaaggctgcaccgtcagcttccctacttttgagattttgggactcggactggcttccttgctcctccgcttgcagatggcctattgtggggcttcaccttgtgatcatgtaagtcaatactccttaataaactctccttcatatatacatctatcctactagttctgtcctgctagagaacactaatacatatattatctgaatatttgtttctgtgagaaaaatgggcacaaataacttttaaccagataaatgcttttctgctaattttgtgtctctcttttgaggaacatagagatttagctcagtaataatctgacataggatagggtaaaccagatgcttacccagctttctcattactaaaataggtagtcaaagagcattcatagatacagagggagcatttgaggtcataggtcattaaattagcattactatatgcttatttgttagttttatcacatctggttctttgaataaaaagtctccattaatttagaagaacatatcaagttgttatcttattctgagtgagagacaccaaagttttcattccaaaattctgaaatacccagaaacttaccactcagtgggaggacatcagtaaacccagaagacaaaaagctaattaactgtctcactgaaacattccttcctttttgaaaagtcaactagggacccatggactctgagcccattgtcaaatgccgtgtgaaagagatccaagttcaacaacaaatatcatcagcaatataatggttctctccagccctcagggccaaatggcctgcattttagcaagttgattttgctcatgaattgtgttaagccaagcaattgtttcccatgacatgcttgaacccacagttgctttgtctatgaaattcatggttgaatttgtccaattgctgattgctattcccacttgctttagtaatagtcacttccttcatcagtaatgggttttatatacagtgcacagtcacaaccattcaatgtcacccataagcatttgatgaattgtccaatacagttatgagagttggttatttgggatacagctagggtaagtcttactgagttaatgaaatgatatgacattaggccatgggtgtttcctcccccacattggctatacacactcttttatctaaggacgcatttgggtcattaccataatcttcatcaacttgtcaagataatgaagggcccattgagttcagggaaggcttggcataattcatgaaaatttaaagaacatagatgtagaaagagtttgggagctacagataaataagatctgcatagacaaccacaaaggaagagcttcagcagacaatctgctttggaagggggagagtttgagctcagttttgagacagaagagaggctcatactctgaaatgtctaagacatactgctggaggaacagaaggtgaaaacaaacttagagatgataatcaagattggaaagaaaggaagagtagctctcgagcctgctttcagcaaatcctacatctgtatttgttatagccaccacacaaatctaggtttggtgggagggggcaagttagttatcaacttcgacatgtgcctatcagacttgcttagcaatcagacaaggtttataattgcttccgctaacctttccagagtaccacaatttgtagccttctgcacactgatttctgaccaaaggattctgttccatcaatgccccattaaattcacctcagatggctgatggcaccatgtcgaagtctcacccagtgtggctatgagttagtgaattgaccgtctgaagagcaatatatagtctccttttaaattatgttagaactagcagagaatttcaggttcttctagttcaacaccttgtttttttttaaatgtgttcattcattttcaaatattcactgaaggtccaccctaggccagattagatccctgccctaaagactgtaacacataattgggggatgcaggtattgaataataaagtaataaattatgtcaagtgtgggaggtgttaagaaggaaataggtatggcgatatagtagagttactctagaggggacagaggattaactattacagatgaaatcagagaacagtgaaaaggaccctttgaggaggttctgcacatgtatcccagaacttgaagttaaaaaacaaaaaaaactcacctggggccagagcactgtaaatgaataggcagggagattaaacagatgtttcagttaaacagcatgcccagtataccagacagaagatcctggggaatagtaatctttgagtagcagagagaagaggagcagcccatgaaataggcaaggatcttaaactccaatgccttcaggagctatgcatgcaccattagccagtgaagcaagcctaggtagaaggcagtcgtggcaactgtataggcctagagaatgagcaatatgcctaacagcattcaaactcattaaaaaatactttacagtcacaataaagcaaatcaccaaaaatactttgcaggcaaaaataaaacacatgtgaagaggcaagcaaagcccaaggaccatcaatatgcaatgctgagctgcaggaaaagcaggaagtaggctgggaatgagaaaaaaataaatacagtgtggtttcctctaagttaaaaagaaaaggttttaccttttatttccatgaacttaacaatgaaaacaatatgtttcactaggcagtcacccaaacattgcaatactgatcacaaaaaaccccccactatttgttacagaacttgtaaaacctgaaaatggcggtaatgatcaaatgggtcaaatgtgtaaagagaggcaccacaaatccaagtggcccatgcactgaccaaatgtagatatcctcttgaagaattgtggccatgtgctctgtgcttgagtgaatccagggatgggaagctcacccccttggaaggcactctttaagtgttcattttttttcactttgacccgttattatggagagctaatgatatctgccactttgtagtccgatactcacagatctgccctctggagccacatagaatgtatttaatatctttccacctgccagcccttcagatatttggaaacagtgactctgttactatcttccctctacaagtcttcctttttccaggcaaaacattcccaccatcaattagtctccaaatctgttttcagacccaaccacctttcttatgaaccttcttatttgtcactaaccatcttaaaacagtgcctagaaagaacacaatgttcctagccaatttatactctggggcttctttaggcataattttctatgtctgcagcagtagaaatacaattacattttatggagctcagtctcctgctgttcctgtttcctacctcccaccctccaaggcagtctgtttgttgaatgtcctgaacagatgcataatctagagcaagtgctcccatcaatataaagaatgccatccctcatcactccatcgcttctgattaagatcatttggtctaatgtacattaagttctattccaataatgcctgtgcggtactgcatgcttttcatgcctctttctggacactgtgttattagatactcagcctggagaaacatttccatacaaagaggaagataaaactgagaatgaatggttaaaggcaaagagaaaattgggaatctcacccttggaaagaatggtagatgggaacatccaatgacctggctttgaatctggttctctatttactaaccattgctacttaaagaaaaatagtaataataacagtaagaacagaaactactatctattaacaaattcttggtaagtaccaagccctgaaataagcctttcaggctacaatatcatatggttagtagatgccactgggatttgaacttacttctgcctgtttctagacttcaatctctacatagtcttgtaccacaatttcccttagtggatactgtctatactacatatgacttataccactgatttttaaaaaaagaaaaactctcacagtaattacttctcctgagatgatcctccaaaatgtgggaagtagaaacatgtgttttcttttctgtggggccatcagagcatgcagacaagggcaaaggaataagacaggagagagaggccatacaccaaccacagcactgtacattgtgtcttgaactgggctgaaaagtaaccatgcagcttcattttaagcacagttggaacatcgacaagatttcaaggtgactgttcagcctaaggaaacagtgttttcaagcacttttatgctactttagcagtatttactagtatataattcacgtgctaatttattcattaaaacagtcgtatttggcaacattaaccttagtttacattagtgagattggtatttgtattttaattacatctctttataattactctataattctgattttcttccaatgtgaactaagcccttatcaatccccaaactgcattccacatccaacgaaaatgagttcaaattatagttttacagaaaatggctttgtaaaacccagagagcctattcccaaaggtagtcatgcatcagagtctcctggggatttccttatacaatgactgattcctgagtgctgtgcaatctacttgatcagaatctccagcgacgggacctcctgggaattgagacctgcagcaactggtccacaaatcagcacttagggactggtgactagactatttccactctacacacatccagtacagctcttggaaaacatacaaagcaaaagatagtaagggttatcctaaaggcagaataaccagccacctcacggaatccaatgtgttccagaaacattaattatacgtttcattattaactgctgacctattgttctttattttcagggtttgagttgctgttttaatttcatcactgcaaagaagccctatagacacacacacacaaaaagatgcatagattttaactggtccctggaaacaaggtagagataatcatgtggtttatttgatagagccacatgataaacaatcgagataaacaatgtgttttaaaaagcattctcaaagagttagaacaggaatgtcaaaaagacggcaaatatgatacctacctcctatccaatgcccttggcaggcgttgctaatcaatcacagcatttttccttgcatccacaaacagcctcaaagtccatttaaccaatcactccagggcactagtgctatctaatctgctctaccgtgtgggggacatactttctcctctttggctacaataaacaggtaaattgaaatcaccttataacagcctgatccatgacaggctgtatgctccacaaggtggaaatgggcatctgaaagttctcatgtagacagggctttaggcgcagatcacctggctcttgctggttcatgtttgtagtggtttcacacttgtatctttgaatgggagtacttagaaataaattaactgctttaatatttatgatatgtgagttacacttactcaaaccaacctagtttttgctcatgataatttacagtttcactttgaataaatgctgttgggaaagacaagctgagttccaaagtgttttaaaaattaagtgtagcatttgactaaaagaatcatatatcaatctgcttgatttccagtggtagcactgtaggttttcttctatggagattctgggccatatctccatgcaaatatttactgtcctggtaaatgacaggatagaaatcacaaggacacttggtttctgctggttttcatttgaaaaagaaaatcattataattaattagtcatgggttcccacgatggccattcttgactccttggcctctattgccactttccaagtctggctaaatagaattccatttcagaccatatctagggtaatacttgattcattaggttgatgtcatcccaccgacagtccccgtgatcaaacaataagatcagagagaacagacccacctcctcatagatgctgtcattcctgtgaaagtctccagccttcctgggaagaacatggacgtgaacgtgctgaaaatgtacaagaaagaaaaaaaatgtgattatctccccatgtatttttagacttgacagtgatgctctcatgaagcccaattactccacgatggttcctgctgggttatttttcagaggaagttgatatccaccttcggtaactatacctgaaatctgccgagaagagagtgcactaagcaagagagaacaacttggggtatatatgagagttggtgcgaaatgctagagtgtttcagagtctctgtggaattattcatggttgtcagtcttggttgtagttagccagtgctttgaaatgacagtgcatcttcaaaggtgaccatcatgactctgaaactgacaagaaataagaattggctaacagagaactgcataagtaaagagcgagtgaatgaggtagcaagtagtatgggcagaattacagacttggggcttcgaaaaataatcatataatagtaatacaaacagttctcatttagtaagcatttatttcctatgataaggaaagctctgtgtttggcattcttcatttagtactcttaaaaatcctatgaggtggccgggcacggtggctcatgcctgtaatcccagcactttgggaggccgaggtgggcggatcacgaggtcaggagatcgagatcatcctggccaacacggtgaaactccgtctctactaaaactacaaaaacaaaaacttaggaggctgaggtgggagaatggcctgaaaccaggaggcggagcttgcagtgagctgagatcgcgccactgcactccagcctgggcgacagagcgagactcctcaaaaaaaaaaaaaaaaaaaaaaaaaaaaaaatcccgtgaggcaaggtctactatgatctccactttacagaagaagatatcaatgttcggtgaggacagggcgccacaggaagtaaaagtcagcaccggaaatgaggttgcctggctttggctcctgtgtttcattagcacatgcactgattctgcgaacttaatcttttaaatagcccatttctctagtctactaaagcacccaggtaatatacatagcaatgctattatgcaatgatggtgaatcagggctcagagcatatctaattcaatatattcttcaaagctaaactgctatttgaaagttttactttccaaatagcctctattgtacctcggctgaagttaaacctcatttctgcccttgagctatgttccacttttattacaaaccgtggggaggaatgcgaaaatgaagagcttaaatagagagaggcagacagagggtcaaacctcatccctgatcacccaccccttcctgattactgcgatcgggttccgaggctccaaaaggcctcaagagaacgtaagatttaagtgtccctgtggcttcgctgtacaaggagggggaaagtgacacgctattaaagccgaggcagggtgcaacgtggtccaaggtgaatgaagcagagaggagcttcaaagcagcccctgagcacagttcccaaagagtgacacgcttttgccagaatattcgccagtcaatgataaagccagtcacggatctctcagcaattgggccaagtgtgcacttcagtcacaaagattacgtgagcatggagagagaaagtgaaagaacaaacaaggaaaaaataaatcacaaactacccatgaaaccaaattcttaggagaaagccaggcaggtgggcctgggctgaaatctactgaaatctccagatgggctgacttaaaagcaaaaccaggaaaataacgtagaacaaggatacagacaacccttagaaggagccttcactcactctttaattccagaatctcctgccatcctttcttcttctcctctttttgtcctttcttctttctgtccccctcctcctttcttcccctcttcctccctcccatccatccatctttcatcatctcccttatacattctaggaagttccagaccagtgtcttccagtcaaacttcctaacacaaatcctggacctaccacaaactaactgtgtgaccttgtctcacaaagtctatgtgtcagtatcttatctatatggggattataatggttgctacctcacagggttgttaagaggattaagtctgctaaccatgtgctgagcattcagctttgcatgtagttagtactcattacctagaactgtacaagaattagttttattatttaaaaaaacaaatttaaacctgaagatcaagtagacatcacattcagggattgatttctgcaccagcaaaaaaataaaataaagatattaagaagctccttgaatgagggcattgttcaagcatctcttttgtgaaagctgatttctgttgctttgactagccattctcaatcttccacctgtacttggggcttattaaaatgcagactgcagggccctaaaagtctgcatttctaacaagctcccagctgatgctggtctaatgccacactttgagaaccactggcttacaatatccacctggtttcttaccttgcttctgccagtgtgggcacggaggtcacttgctgttttgcctgccctactgcattatgtgtagactctttgtctcttttcttgttttttcctcttttttttccttctttccttctatcttttctcttttttcttttccttcttctttccctccttcctatttttttcccttcctttccttcttttctctctccccacagaatctcactctgtcacccaggttggagtacagtgatacaatcatagctcactgcagccttcaactcccaggctcaagagatcctcctgcctcagcctcccaaatggctgggactacaggtgcatgctaccacatcaagctaactttttttcatatttttagcaatggagttctcactatgttgcccagtctggtctcaaactcctggcctcaagcaatcccctctcctcagcctcccaagtagctgagattataggtgtgagctactatgtccagtatgtggagacatctttctgaatgcttctctggctttctgcactctgaccactctccttgcgtggtcctcaggaatatgcctgttagtatccactactaacatatggggggttgcgaacctgcacttgggaacctccagggtccaggtctatcccctgcctactattctttaccctcgtcttctcgatttagttcagggctatctctataggctgtgttaccactaagttctagaaaagccactcttgatcactggtaaccacttgaaattcgccgtgacacactgaaaccgtaaatagctcactgtacaggtggttttttcccgagggcatagatctcaacccaccctgatatcgtgacataaattcttaagtgacaggctgatcacacgatgctgacaacccactcagcttctcagaacagggaaatcacgatagagccagctcaaagcctcattgctgtgaaaaaataccatcactatggacttctaatagaatgacattctgataaaaacgctatgaatagcagagatgaggataatttgatataatctgttcttactgctttcatattaagctgtggtgatcacaacttacttttctaagtgccaacaaaacatctatttaataaaagccttccacaaatttgctaggggttgcagttgagctgcttgagctagaagagtatctttttaaagtcccatgacacattccacaccaaaaatgttttcatggtcaaataacatttcacaatgctcattagcacattaaagtatgagaatttccacacaaaagatgcttgtttaacttcatctaatccagcattccagaaacttatttgattgtggagtcctgattttcctgtttcattcatgtaacacttctgtacacttttctaaagtatacattgattcactcaaaaatatctatttctaggtgctattctaggagccagggatacggtaatggacaagacaaagcctctgtccccatagagcttatattccaatgggtgatgcagaagataagtaaggaaatgactatacattctaattttggatagaaataagtgtcctgaagaaaaacataacggtataaggtaaatactgagcactgggccactctaacgtttgaagtttgggaagagaagcaggactcaatttaaggctgtagtaaggaaaggggcaaaatcaagagagggtaagttccaacagcccagagaacaaatttcaaagagtgtatcactaacggtgtgaaatgtttttgaaagcttgaattgtttcagtaaggctaggagaacaaaatttaaaaccccatgaaaagatgctccacattattagtcattagggaaatgcaaatcaaaaccacactgagctactacttcatacccactagaaaggcaataatcaaaagacacacaataacaagcgttggccagagtgtggagagctggaaccctcctacactactggggatgtaaaatcacacagttactttggaaaacagtttggcagttcctcaaaaagttgaacatggagttaccttgtgactcagaattctgatcctaatacatacccaagacaactgaagacatatgtccacacaaaaacttgtacgcaaatgtttacagcaacattattcacaatcaccaaaaagtataaaaaactcaaatgactatcaactgatcaatggtaaacaaagtgcagtatatgaagacaataggatatgatttggccataaaaaggagtgatgtgcgctgagtgaaagcatcatgctcagggaaataagccagacaaaaacggccacatattgtaccatgccatttacatgaaaaagccaaatgaggctgattcatagagaaagaaagatttgcggttgtgaagagggatgcagggtaactgctaatgggcacagggtttcttttgggttaatggatatgttctggaattatatagcagtgatggttgcacaactttgtgacaatactaaaagaatgaactgtatattttaatagggtttcttttatattatgtgaattatatctcaataaagctattacttaaaaaaaaaaaaaaaaactgaaggccgggtgctgtggttcacgcctgtaatcccagcactttgggaggccgaggcgggcggatcacgaggtcaggagttcgagaccagtctgaccaacattgtgaaaccccgtctctactaaaaatacacaaaaagttagccaggcgtggtggcacatgcctgtaatcccaggtactcgggaggctgatgtaggagaatcgcttgaacccgggaggcggaggttgccgtgagccgagatcgtgccactgcactccagcctgggtgacagagcaagactctgtctcaaaacaacaacaacaacaacaaaaacccaaaacttaactgcagtgggtttcagagcaagcaggaggtgaaatagagacagcatgcaatgccatcatttttagaggctctgcctcttctgcgctgtctctgctccttccaccatctctttgaacacatctcttctgcccatactcacctgaggattgccagtgtggttgtatcgatatcctttttccttgtcagaatatattgtaattcaattctaagggatagaaacatggctcatggcgggggaaagagcaaggaaggctgaagagctaccctgctccacagctggtgtcctgcaacctccaccagttggccctgtgtgaatccttctccctcacatgtgccaatgagcaactgcagaaggcaggtctgattctaaagaacaacagacgatactgtggtaaaacgataatggccaccttcaaagttatccatgacctaatccctgacctgtgattatgttaagttacaaaagataaattatggctgcaaatgaattaaggttattaagcagctgaccttaagattggcagaggtatcatagattttccaggttgccccaatgtcatcaggagtccttaaaactggaagagggtgaacatcatcaaaattgtaaactttctacttcaaaggccacaagcaagaatgtgaaaagccaagccagagactggcagaaaggatttgcaaatcacctatctgataagggaagtatatctaaaatacataaagaactacttacaactaagtaataaaaagacaaaaatcctaagtaaaatgggcaaaggatatgaatagacatttctccaaagaggatggataaatgaatacatgaaaagatgctcaacatccttagcccaaaaccacaaagacaataccacttaacacatactagggcaactgtaataaaaaggacagataggccgggtgcggcggctcacgcctgtaatcccagcactttgggaggccaaggcgggtggatcacaaggtcaggagttcgagaccagcctggccaatatagtgaaaccccgtctctactaaaaatacaaaaattagccaggcatggtggcacacacctgtaatcccagctactcaggaggctgaggtaggagaatctcttaaacctgggaggtggaagttgcagtgagccgagattgcaccactgcactccagcctgggcgacagagtgagacttcatctcaaaaaaaaaaaaaaaaaaaaaaaaaaggacagataataacaaatgctggcaaggaagtggagaaattggaacccttgtacaagctggtgcagatgtaaaatggtacggctgctttagaaaagtttctgcagttccccaaaaggttaacaataatgttaccatatgacccatgcactgtttccagcaatttgttatagcaacaagtagagaatgaatacagatgccttgatatttttaatgcatagtttacacatttttcttatctctacaacacctgtatgaagtattattctaccaattttataggtaaggaagagacaaaattttccctcagcaagactcagaaatcttcacgtattgtttttttggtttttttttttttttttttttttttgagacagggtctcactctgtcacccaggctggagtgcagtggcacgatctcggctcactgcaacctctgcctcccaagttcaagcgattctcctgactcagcctcctgagtagctgggactacaggagcacgccactatgcccggctaatttttttttgcatttttagtacagacggggttccaccatgttggccaggctggtctcaaactcccaacctcaggtgatcatgcccagcatctattgttctatgtttgtataatcaccaacagctctcaacttggaataaccaaatgtaatgtaacaataagattgtttccatttgctgaatatcaacatcaaaaacttacagcatagaaaatctggaagagacagaaaaacacataggagaaaatttagatcaccagttaatctcactaccaagcaataacaatccttttcttcatgtagagtgatacaaatatgatacacgctttttttttttttttagtctcaattgccccagacaaaaaccctgaagcaaggatgagagtgcaagtagtttatttggtggatgatccctggaaacacgagtaagggaaggaaacaagaaaggaaaggaggccaatataggatgtgtgatcaagtgagttattatttcatgtgactggagcttataaaacctgctagagaactctgagaaccagtgaagaatatgcatcccagagttatcccagccaaggtgtgagggaactagcgtattcatacaccaacttttgtcctcactggttgagaactgctcctggggagacatcaatactccagcacttctgccttctcccacctggagagtgagaaaagccaggtttccagggccagtcagatgcaagtcaggctaggtaggatgcattgcagccatggtgggtgggggtaacacaatgtgggcagagcacagaccccacttgtagcaatgctttgcacagtgctgtctcatttctgacacctggagtctcataatttgctgctgaaccgaaagttcaagtatttagtctccttttcatgggtgagataccagacagataaagatctggttagaggttcttaaactgcaaatcccaaagccctagagcttccagaacaagcctggtatggccaaggagcagctcatgatggaagtaagaatggggcaccagaaagggcggcaggcttcagttccccctccgtgattcaaacagagcagctctgttttatctgtttctatgttgggatcccatgcacgatttcatttgcaaaaagaatttattactaaaacaaacaaacagaaaatctttgaaaactactaggattagaattaggaaacgttggggggtggtaagagtgattaatttcttcatttcacagaagaggagagtggcttttagaagaccaataacaaagcaatggcagggctgggactggaaccttgagaaccccgaaaccctgacttgtgttccagtgctttctacctcatcttgcccaacctacctttcccagatctcagaaaggtagaagcccctacaattaagcagtttggtgttcagtcactggagatgggtggccaaggttcagatcctacctattcttttgactgagtcaattccttaacttctttcatattccctcatttatcaagtgggcataaaaccagtatcccaacgcataagacttttataccgattatgtgaaatacataggtaaagtgcttaagctaatgctgcacattctgaatattcagtcaattccagcagtgactatattacaggacattagttttaaaaataattttgacaacctgcttctgttctaaaccagaaggcttaattctacggtgagccttgctgaatgtattctacttcatccagaccatcaccaaccccaaagctgtgtgttctacatggctggatttcgcctttcttgatttggggaggcctcatcttctgcaactaagtcgagtcaagggtcagcatgaaattactgacagccacttagttctaaaataaatgtcactggaagtaatgccacttacaggactttgaggatacctcagcatgatcaactcaagaatcaaattagtggcctgtcaaaatgcacaggcacactgatggtttctgatgctactgtcaatgagctccttcacttagaatattagcaatgctcaggcagttggtatgcctttcaggaaacagaggaaacatagtgcttttcatgtgttcaaagtgtcccaatcaagttgggaaacttcgaggaaaaaaataaaataaaaaaaaattcagtttaaacaaaaaaaataaacagaaaacacctcctagaatttgtggagactctgttgagtttcgtggcttaacaattgtgtttttaagccatacatcactggtggtgctccaattgtgagttataataatatatcataagagggatggtgatctcctgatatatgggtgccatacatcatctaagcaccatggctttgatgatgtattgctccaagccacaatgagagtttaaaggagcttttagcagccagacagctttaaatttcaaattttcaaaaattaagatcttttcaagtaaaaaaaaagcaagataatggaatgtgatgctatataaagtgtcactgaactctgagagcctgggtatatgccttttccttttggctttgagctcacaaggtggaaatcattggcaagttcttcttcaattcctcctccatgagcacagaggtgagcaagtgtcaatgcatccattttgccaatcaatttcccccatcttccacactgcaagcctgagtagctcatcatcatcccaaagactggatcacataaaatgctgtgataggcactggataaacccaggagaagttattttttattttttattttttggtttgttttaaagagctcttccactgagattcagaacaaaaagaacagataaaaagtagatagacttccttcctcattgctctcaaactcaaaacagggcatgtaggaagaaaacatgccttgtctagcatttgtctttgtaaagcaaaggaagcattgattgcagatgaggagaaagaggggaatggcatatgggcttctcatccagactaggaaagggagctgttgtcatagttctgtcacctttcctattttaacgatgggtttataagacggtaatgtggcttaagagaatgtacccacttcgtttaaaagccactcacttttgggggcaaagtaatcacaatcaattaagaaaacaggtgttgagagaactcctccctttttttttaaatcctactgcaataaacagaacaaaatgagaaatcttcctactgtttctgtaatagacctaaacaggaacagtgagagacgattacacttcaagtggcttcttccattttcctttactaagtgaattaaaggaaagaataagagtagttactgccatgtggagggaaacatctgggcataaggaattaacagtcttccctcccattctcctatctctaattttttgctccttgggcttcctccagtagattctaagtcccaaattactgtagatattttgcacccggctccctccttgaccacttccaaagggcaaaaacatcttatttccaccaaagaaaaccaatggctgtctcaaaaagaagtcccaggcttcttttctcctgtagtagtaagttaactatataatctgggtaacaaagacatggaaataaatgcatcacccactattctgaggctgtcagttgaaagatgtgaatgaggcaggctttgcatctagagaaatgtgggttctttcacgggctggtaaataaatcccccaaattcagtcctcttcttctctataaagagaatactgacacaacacttaattatttctttcacataagccaaaaagctttacttacgtatttatagtaatagcacaccattcatccacccaccatttttaagtcattatcagttataaaacttgctgccatttacataagaatattatatgttggaatggtacttagtactgtatattatcacatcctcaccaaaacactaaaaaatagaaactgttgtctccttttttttcagtaagcacactgatgcttactggaattaaataaattgtgcaagctcaccaagctggcaaaagtggccgagttaagattctaagtcaggttgataggatgtcaagcgtaatctgtattttgctatgctccttcctgagtaaataactaatgtctgggtgaccatatgccccagtctgtttggaaccatccagctttaggcctgcaggtatgaacaggccagtgtaataacaaacagcatcttctttcactctcctaagttctgctgtggacaataaattatatggtctccctaactagtagtatagttcatgccaggaaattttatttctgctcattctaactattctcatctgcagatagcaggggaaaaacaaagaagaaaggaaagaaagaaggctctgtgaaagtttttaaagaatgggctactaactcttatctatcaatacctttcatgaaacctccaacatgttcagagtagagctctgggagggaaaagaaatactttagactaaaacagggcccctcaagctctaaagaaaaaacctcaagcatgctagaaacctctccagttgagcattctttacttattatcatcacaagaggcaacggtaatagctgttgctatttattaagctcttactatatgccaggcaccatatgccaggaactgagctaagcactttctttgtaagatctcaattatttatcataaaactgcatgatagatataatccaaattattatcatcattaatttatagatgaagaaactaaggccgaggaacgtggaatgaggaggtctgcccgattccaacatccaagtgtgatactactatcaacactctggtacagttgaacacagcctagtaaaagttctaagcccactgcccctgcaccccctgctattcaaccttatgacagtaagctcttctgcaagaggggcccattagagagaatggacttctaacaaattgagatcaatcttgtacaaatattctgtattatcttttggcttctgattggttttcagtgacataacagctttaaattcttaaagctatttaatgagaagagagtagatgtattagtctgttctcacactgctaataaagacatacctgagactgggtgatttataaaggaaagaggtttaattgactcacagttccacctggctagggaggcctcaggaaacttacaatcatggcagaaggggaagcaaacatatccttcttcacatgggggcagcaaggagaagaatgagtgcccagtgaaggggaatccccttataaaactatcagatctcatgagaactaactcagtatcatgagaacacgatgggggaaactgcccccatgattcaattttctccacctggtcccacccatgacacatggggattatgggaactacaattcaagatgagatttgggtgcggatgcagccaaaccatgtcagtagaatttataatcactgcctctagagaagttgacaaacctaaccaacagctataaaaccaggataactccagatgtagggctctcagatgaggtcatctctactgccttgggttatggacaggtagaaccctgggaagaccattccaagatagagtcttcctgttcagttagacatgcaggagctcagaggttcttgtaaaattggttctgcttgctgctgggtgggaagggacagtgccttagtaatgtctccatctgaaaacgtatgaaagtttcaaaatgacttttaggagatacagaggatgtttcaagatttgtcacccttgtgcttctcagctgttgttgtagtcatggagtttatagtacatgtgcttggtagaaaaaattataagtgttcttccttccatgtggagttcctttctctttccttttcttcctctgagttttaaagagcatgctcaaatgccacctcctttgtgtactcttcagactctttcaggcttttctgattcattatacatatgtccatgacagctttttaccacaaagtataagtaattacaggttttctcttccactagtctggaactctgggctatttattacttatttttcccctgattatttcttttccctaaccctaggttcctaggttagaagacatattttctaaatgttgaatggatggatgaatggatggatgggtggggtggatgggtgatggatgggtgaatggatgggtggatggatgaatagatggatgagtgggtgggtggatgggtgggtagctaggtacatgagtgggaatgtggacagataggtgcatggatggatgaatggatggttaaaaaatagacaactacactgctcttaatttcttagcttgcttaaaagaagaaatatatgcactgattttcttcgccattcttgtcattttcttttgcttgaaagttcttgtgcatacaaagatatggtctatgaagagccattatgatcacattgtacacacctttcttccccactgaaaagtatctttttaccaaaatgtaagtttgaagttcttgtgtttctagcctcacataaatcccttttaaaaaactcctcagatatgctcaagtgtctggagaaatagcttatcctaaaaacagtcagcattgcaagggttgccaaggggatatatttgttcttcagtattaacttcattaagagctactgtggttctctctcaggagagaagaagaaacctaacctttctttggatatcttctgatctttacaaattatttccagggtgctgtctttgttagacaaaatatgaagaatatctatttttttatttatacatcatatcagaacattaatttgtagagtgattccctctgggtgcctttctgttgggtacacaaaaaaggatttggatgcaaatgaaacaatgatagcatttttccttgtcttactcattttgtgacaaatgcacattgctttactgtttgctatacacataattacagttctttaatttatgtttcaataaaatgtataataataaacatttactgctccatgaataaacattcgagtgaagcctctaatggaggttacatgtttcgaggcagctctgtggctttttcagaaatctgccttctacttaatgagcatcatttccataatctgtgcattattgcttaagcctccctttaaaacatttcaaaatgcaaaaatttgtgaaatatgatcagtccaaaggggaaaaaatgttaagggaattagcaacttgtcctgttaaagggacaggacaagctttcatgtccctccagagacagtaacatagtaattatggagacagcacttcctaattatctcactagctgagcgcaatactactgtggtttttgcctctaagatctggtttaaataaaagtgataagaaacctggagaggtcagccatgaaggacaagcttgtgctaattctctttccagtgctaacaaagaaaccagaaagtagaaccagaaatttggggaaggtcaagatacctgtggtatggacattcctggatgtagagacagacaaatggtttgattaaaacggtcaccccaaagtaactgaattcagacaaaagcctatgctgagctttatgtcgatggtgtcacacattattttcagtgtgttatttcttaggaaaattacttacataattttatgtcattatcactttaaaaggttaatctatttcagataatctttgcaaattgtgttctaaaaagcaggtgcttttaaaaataactaaaacatgatgacatatttcttttttctttgtccaacagccatggctgggttgtttaactagagagaaaaaaagatgccaggagaaatgaaggaacaaaggacccttcacagtgtgataagatacagatagtcagcctctgcagagcggtgatgaaatgtgttaaaagtgatggctgtcacttcatgacatgtcagcgtgctttattggtgggttggcacaatttatttaaacatcgtcaggagggactcattttggtgtagttagaagttgtgtttctttagtgtgaataaatatctctgggcccacgtgcaacattttaaaactgtgctgttgtttactgtgggaattggagcaaggagctaagagttccaaagtgaagctctccttctcccaccattttatgatttgctataagtaatttgctccttgctttgaccgttactacaaaatctttcaaaggaacattattctccttaacaggggctaaatttaagatttttcatcattcaatattgctattttcacatgtgacttcaacaaaataaaacattcggcataaatagaatttagtgtaatccaaatcctgcttttctcttggtacatatgctttgttgcttcttgacattcctgaattacaaagtattaagcagaatcatctttttaagggttacattttccttctaactcaagtgagcaggtatttacgtcaaagtcacacatttaaaaatgacatcctcttccagcatggggcaaatctcaacctacagggctgccaagtggagctgcaactttttgcaagggttctacccagatgtgctacaagtccatattacctttgaaatcaccatcttgtaaagatatctgcaccctcatgtccactgcagcattatctatagtagtgaagatatacaaacaatgtaaatgtccatcaaaggacaaacagattaaaaaatggtatataataaatacaatgaatattattcggccttaaaaattaagagattctgtcatttgcaccaacaaggatgaacctggaagacatacactaagtgaaataaaccagacacagaaagaaaaatatcacatgatcttacttaaatgtggaatcttaaagtaaaatatatagagatagagaataaaacagtggttatcagactgcggtggaggttgggagggcagaatggggagatacaggtcagagaatagtaagcagcagatttgtaggaagaaccagtctagagatctaacatacaacatgaagactgcaggtaaaactgtactgtatttgggattcctgccaaatgagtatactttagttgcccttgtcacaaaaacaaacacccaaaaaagtgagtaactatgtgagatgatgaatatgtgaatttgcttcattatagtaactattttactattttgtatatatgtcttaacaccatgttgtatacctcaaatacacacaataaaatttatttaaaaaccaacgaaaaagcacattcccttcataaatgagattcttttcaaaataagtttgaaaatatacattgtaaaatatactagaaaaaccaccccctaactaactccccacaacccaggagctctgatttgatagcttaagacaggataaatgactccgattaggacaatgagccccagttttatggggacctcctaaatcatatctcggtttgggtctagaatgatggtgctgggagcacccagagagctgcatatcatctcagcctggcttccacacagggagccagagagatttatggggccctgtctggtggctttgaggcacaaacgatgaatactgctaaagcaataacaataaaagaggcaacagacagtgggggaagccccagcaccaaccctcatttttctcataatatactctgttgtacaatgagacagagtgattccataggtaccagccagaaattacatgaaaaattgatcatgtttctttttctgggtgatatcagtgattgaggcccttgatttatgctggccaaactttttcagtgcagaatggaacccttcctaacttcagtctccgtggctcacacagactggccattaacagaagacacactgcatcataccatttagtcaggaccctacactaacagagggaactgcagcagagtcttaatagcaactccaatttgccaggaatctcaccacagatcagaaatttacagtggcggagaccttttaggaactttcagcatggatgctccctcaaggtgtgggtcagaatttgcggcgcaggaggtgaggtgaggtgaatagtttataatgatttttctatgccttttaacctttggaattaacatttggtcaagaaagccaattgaaggctaagtgtgtacttgacatgtgaaaaaatgaatgtgtcttctaggcgttggcttaggacactgctgagccctggctacagccaactcaggcttaactcattaaggtgattagccaacaatcaattctttaaaattagtaacataaaacaggccataccaggctcatggatataaaatttgggtatcaagttttgctccagagaaatgtcacaccctcaccggcaaaaagtctatagaggtagggagtgtcacaggtaaggttgagttaatgagacatcctctagctggcatgaatgtgtaaagtgcgctccatggtcatacatccagcaagtcaggatttcacagcaagcatagctttcactttaagctaagtgacatggaaggttcaggtccttaaccttaggtcacgggatgacaatatacagaatctgcagcttgacagcctgggcttaattcctagtcctgccactttccagctgtgggacctgagatagtcaacacctcagagcttcagatttcttgtttgtaaaatgaacccatctcagagggttgctgtgaggatcaaattggttagtactgcaaaatacccagactagtacttggaacttagtaagcatagatgtaaggtgtttgcagctatcattgctgctgccgctgccacgattattagtactacaactacttaaccacaaaatctgtgctacttgaccacaacatctttcagttaaaaaaaattcacaatttatttttttaatttaactttctcttaaggactttaccattgttttaaaaattactctactgaagtctaatttactaaatgggaacaggtagaagaaccattctcctaaaaactaatgtggagtcaatatacttatcctgggcatgaagaaaccctggagcttccaaagaacacagtgtgaaaaactttgcttggggagggagatggaaggcagagaacgagggtttctcccactggggtacaaatccttaggaagtggagcttggtgattaagagcatcgagctctaaagtcagatgagctgggatgaaatccccaccccaactttcatttcctgtgtgacctgtgaaggcagtcgaatatcttaattctttgggttctatatttataaaatgcagataataaagtctattcttcaaagggcttctgagaggattaaatgaaataatacatgaaaacctcttagcaccgcccctggcaccattagaaaatgccttataaatgtaagctgctcttctagttacttttacccagatctctgctcaagtgttacttccatagagaggacttccccaatttctatattacatataaacagttccggtcctatctcaaattaaaatctgcatttattcactttttcattttttgttcccatactcacggccatgatcccagcatctgtgactatgactagcacttagtaggcacccaataggtatgtgttaaatgaatgagttaaaaaggagagacaggaagtatctctaactcaatgttaagagactgcaaaaactctattaggctgaaaactaggaagtataattcttcaaagtaataacagaaataaaacttgaagacatgttcttttgtgtatgcaatagtgtatgctgattgttctcaagctgccaactacccttaacagtgctctgctgtgaagacacaaaaggggcaggagggtggatcagacagacttcatatgagccacaatgcaggtccagccaaagtagcaaggatacagttggaatataaatgcctttacccacctctcactgttttcttctcctgaaaattgctctacattatgatctctctctctttctctatctcttgtctcatacttggctttcctctgtccatgcaaagggcctccttgtgatatcccacattctcttttatcctgacacattgcatagactcctgttgtgggtactgtgtagttatataaccagagttgggatgttttactgccttgatgcttgcgttgtgggtctgtgtaatctttgcattcaaagtgtgataacagacactggacatagcgcataacactcagagctgcactccaggtactaagatgtcatgaggcccacgagagagatgcacatttctgcaagggcgtcaagggacccaggagaggaaggtaaaagccactacgaggtcctctgagggcaaacgctccctgctctctcctgacaatgatccccaatgcatgaagtaggatatagtgtgttaaggtgataagggctgaggatgaagtgggttggctcaactggcaaagcactgtgaactggaaatgtgttagtgtgtggaaaagcaatgttaccttggatgagagctcactcctctcgtgaactagacttttccctcaagtgccttcccccataatacagtcagtaaaatcttctaaagccctgagaactggaatcatctcacgatctatagtaacccaaagtggcctagcaactaggggtggaccctgttaactattcacatcgccaccctgacaaaagtcttcctgctcccatttcaaggctctctccacacttggtttctctgacctttctgaacctttcaccgtatcttgctctctggactgcagcccctggctgtgaatacatatttagtctctcagcctgcccttcctatagacatattatttgatgcttatgcaaagatcacccttagccttcatctttccatgcctttgccatacactaccttcctcctccccacactcctgtagtcagatgtgatgcttcaaactcagcttgagcgcaggtctcattttcaccctcctcatacgcctgtggacaagtttgtcagaccattggttaaatattcgaccaagagtgaggttggtaaaaggaaggcatatttacgagacagaacaaaggctttgcattaaacaaaacaaaatggcagttttccttcttgctgaaaccctcacttggatattcctccagaatcagagctttccaagactccacatgattcatcccctctcccatacttagctgtctggattacagcccttagttctttttttattttttagagacacggtcttgctctgttgcccaggctggagtgcagtggtgcaatcatagctctctgcagcctctacctcccaggctcaagtgatcctcccacctcaggctcccaaaaagcttggactacaggcatgcaccacattggctaatatttttttaaattatttgtacagacagagtctcactatgttgtccaggctgctctcaaactcctgggctcaagcaatcctcccacctcggcctcccaaagtgctgggattacaagcatgacccactgtgcctggcttcctagttctctataggagtctctaggttgttctgcctgagagattctgatagttcagctagtttcaaccagaatgctgaacccattattttgagcatgaatctgctctcctgttatattactaagaagaaaaacaaggtattccattaaatctgtgggcacatcctcaaaagcacatagttttgccgagatcttacacctgacaatggaagtgcttgcacgatgcaggtagtaaaacggaaaataggaatcaggaagctgatcaggaaccagctcagggctttgaaaaggagaaggccagtgagcgcccaccatttgcaggttgacagagtcaattttttttttaaacctgggctcaaagagagattaggcagctggatggggagcagactaaaaaatatgttcacctttaaataaatcagcaacgaaattggaggaggattatacctcagggacaaaagaggaagaagaacatgaatacctgctttacttgaaatgcctcccttctcccagcctttcctgcatggagtatgacaagagaggcccttggtaaccttcactttaattagaatcattaactgcaaatggaagtaagaacaactcaactctccttgtctaattacaggggctaccttactcctgtctgtaaaaggcaccaatattgtcctatgaggccctggcatgaagactttgctactctctcaagtaccaagaacagccttggagtggaagaaagaacatatttgactctaccatggaaattcttctatacctcaacatcattccttcatcatactcacatcctggcttgacagaacttatgtatccctgaaagccaaaggcagcttaagggacaggatagtggagaaaaatgcagccctggaactagactccttgtgcatgcatcctcatcacaccactgactgctacctggagcaaattacttcatatctccagattccagtttcctcatccgtaagaaaggcacaacaccactgtctacatctcatcatagtttttccctgacaattaataatacattacataaaataaatctttaataaagtcctaggactcagtactaggtactgtctaaatactagctatgatttaacatttttattggtaaagttttagaaacacttgctttgagattatggattcaaaggaaggtacaaaatagtacagagagatccctggtagtgtactcttcatctagtttctcaaagtactatgctgacatagtttataaaatataacatacctatagtacaatatcaaacccaggacactgacattggtacaatgcgtgtgtatagttagttcaatgccattttatctcatgtggagattggtataactaccattgcgctcaagatacagaatgaatccattaccacccaaatcaccattgtaatcctttggggaggcactcctgttccttctcctccatccattacaagactggcaaccccacaaccactaatctgttctccacctccacactttcgtttatttttcttgaatggtgcaataatatgctgccctttattaaacatttttttcttttttttttatttaaacttttattttaggttcaagagtttaagcgcaagtttgttatatagggaaattgtaagtcacaggggtttcgtataaatattttttcatcacccaggtaacaggcatagtacccaatgggtaattctttgatccgctcccttcacccaccttctacactcaaatatgtcctggtgtctattgtttctttctctgtatccaagtgtactaaatgattagctcccacttataagtgggaatatgcagtatttggttttctgttcctatgttaatttgcttaggatactagccttcagctccataaatgttgctgcagaggacatgatctcattcttttttgtggctgcatagtactccatggtgcatatttagtacattttctttgtccagtctaccttggatgggcttttaggttgattatatgcctttgctattatgaaaactactgcaatgaatatgtctatgtatgtgtctttatggtaggatgatttattttcctttgtgtatatactcagcactgggattgctgggctgaatagtagttctgtattaagttgagaaattgccaaacaaccttccacaatggctgagctagtttacattcccacaagcagtgtataagcagtccccttcctccacaacctcaccactacctgctattttttgacttgttagtaatagccattctgaatggtatgagatggtatcttattgtgtttttgatttgcatttctctaatgattagtgatgttgagcattttttcatctgcttgttggcctcatgtatgtcttcttttgagaagtatctgttcatgtcctttgccaacttttaaatagggttgtttttgcttgttaatttatttaaattccttatagagtctgaatcttatacttttgtcagatgcatagtttgcaaatattttctcccattctctaggttgtctgtttactctgttgatagtttcttttgctatgcataagctctttagcttaattaggttccatttgtctttttttttttttggtcacaattgcttttggcatctttgtcatgaaatattttccagagaccgtgtacagaatggtatttcctaagttatcttccagagtttttacatttaagtcttcagtagttttaggttttacatttaagtctttaatccatcttgagtttatttttgcatacattaaaaggaaggggtccagtttcagtcttctgcatatggctagtcagttattcaagcaccatttattgaaaaaggagtcctttccccttttggtcagctttgttgaagatcagatggttgtaggtttgcagctttatttctgggctctctattctgttccattggtctgtgagtctggttttgtaccagtaccatgctgttttggctactgtagccttgtagtacagtttgaagtcagataatgtgatgcctccagcttcactttttgcttaggactgctttggctattctggctctttttagattccatatgaattttagaataaatttttctaattctgtgagaagtcacgttggtagtttgataggaacaggacagaatctataaattgctttgggcagtgtggccattttaacagtattgattcttcctatccacgagcatggaatgtttctccatttgtgttgtctctgatttctttcaggagtgttttataattctcaatgtaaagatctttcacctccatggttagatgtattaggtatttttttgtgtgtgtttgactattgtgaatgggactgcattcttgatttggctctcaccttgaatactgttggtgtatagaaaaagctactaattttttacattgattttgtatgctgaaaccttgctgaagttgtttatcaaattaaagagcttttggacagagactacagggtttcccaggcataaaatcatatcatttccaacagatggtttaacttcccgtcttgctatttatatgccttttatttctttctcttgactgattgctctggctaggacttccagtactatgttgaaaaggagtggtgagagtgggcatccttgttttattacagttctcaaggggaatgcttccagcttttgttcatttggtatgatgttggctatggatttgtcattattattttgaggtaagttcattcttccaatgcctagtttgttgaggatttttaacaagaaggatgtctaattttatcaaaaggcttttctacatctattgagataatcatgtggtttttgtttttagttctgtttttgtgatgaatcacatttattgatttgtatatattgagtcaaccttgcatgccagggataaagcctacttgatcatagtggattagctttttgatgcgctgctggattcagtttgctagtatttggttgcggatttttatatctatgttcatcaaagatactggcctgaacttttctatttttattgtgtctctgccagattttggtatcagaaaaatgctggcctcacagaaggagttagggagaaggtcctcctcctacatttttcagaatagtttcagtgggaatagtaccagctcctctttatatgtctagtagaatttggctgtgaatctgtctggtccgtggctttttctagttgttgggcaatttattactgattcaattttggaaatgttattggtctgtccagggtttccgtttcttcccggttcaatcttaacaggttgcatatttccagaaatttatccacttcttgtacgttttctaatttgtgtgcatagaagtagtagtaatagtctctggggagttttttggtatttctggggggttggtggtaatgtcccctttgtcatttctaactttgtttatttgaatcttcttttttccttattagtctagctagtggtctatcaatctgattaattttttcaaagacccaatttatggttttgttgatcttttgtatggttttccatgtcttaatttcattcagtttagctccgattttatttgatgctctgagggtttgattatggtataagaggttcagttgatgagcttcatttctggaagatttcagggggccacggcttagctcagcactcctgggggagtatgctgcaaccctgggggggctggtaccagtcccccagctttgttctctgcccctcaaggttaagaacctgctgtgctggaggggcataggtgttccccatcttctggaaacaacactctgacagaggatgctggccaaagcacttcactggggcagtggcagcaggatccatgcttactagcatgtgctggcaacagtggcagaatggtgggtgtatgccaattttgtttttttgaaaatctatataaaagactcctatattatctgaccttttaaagtgggcttttgtcatttaacattaatgcccttgagatccatacaagctgttttgtgtattaatagtttgttcctttttattgctgggtaatattctatggtatagatgtaccactgtttgtttaaccattcacctgctgaagaaccttttgactgtgtccagttttcagctactataaactacctgtgaacattcattcatgtacagatttttgtgtacacataggtttccctttctctgggataaatgcccttgggtgcaattgttgggtcctatgataagtatacgtttggtttttaagaaatcactcggccaggcgcagtagatcacacatgtaatcccagcactttgggaggccaacgtgggtagatcataaggtcaggacatcgagaccatcctggccaacatagtgaaaccccgtctccactaaaaatacaaaaaaaaaaaaaaaaaaattagccgggcatagtggcatgtgcctatagtcccagctacttgggaggctgagtcaggagaattgcttgaatttgggaggtggaggttgcagtgagctgagatcatgccactgcactccagcctgggcaacagagcgagattctgtctaaaaaaaataaaaataaaaaaaaataaataaataaaaaataaataaatcactattttccagagtagtagttgtcttctatatttccatcagagagatttggtttctgttaccctcaccagcatctggtgctgtcattttaaaaattgtcctaatgtatgcagtgataactcatcatggccttaatttgcatttccctatgggctggtgacgttgagtatcttttcatgtgctacgtgccaccctttattatcttcaatgaaatgtctatttatgtcttttgtccactctacttgtattgttcattttttctatcataaagttttttttttccccacagttccatgaatactatagactttttttcctttttcaacttttattttagacttgggggaacatgtgcaggtttgttacctgagtaaaggtaactactgtgtgaagctgaggtttgggggatgaatgatcctgttacccaggcagtgagcataggacccaatagttggtttttcaacccttacctcctcttcctctccctctactcaagtaatccatagtctatattgttaccatctttatgtccatgagtacctgatgtttagctcccttttgtgagaacacacatataccagagttttgagaattcattatatcttctagatatgagtccttcatcagtaactttttaagtttcagagatcctctctcattcccttcaactacgagtgatctcttctttccctaacttctttacaaattttcacataggaccttttatcctgtctatcttgagtctgccatagatggccctccctaactgcctcactcatctatgaacaggctctatttctgatttgtcatcactcagtgtcttgctaacatttgggcacctatctggcattccactaatgtccaccaagtgactgaatcaactatacctggattttcattcagttactataagacttcagcctaaagcaaaagccacggttaccatggatacgcaggcttgggatagatatgtatcctaagcatttaatactttggaaaggataactaattacaaaaagaaatacacacactcagatgtgttagtgattaatttcttctcagctaccacacttctagctaacgctgtgacacactaacgtttattgaggagtttctatttacgccaacctggggctcacatttggctaattaagaacacatacatttcagaacttgtgatctgtgggctgtgtttacatatgaacatcatattcaatacacaggcaattgtttagcacctctaacctatttctagccttatatttaattagtgagaattgctgatggggaacgcagggtatgactttgcattaaacaaacagctatcctccttacaaatcacaacaacaatgcataattaaacaatgagctacctgagctttattcagtctttcttccaaaggaattaaatctctaatgaggaccaggcctcaggaggaactgcagaaggaatagaggtaaggagacataggggtcaattctagccctgcttcctggcctttctgggtcttaatgtccttattgtgagatgaggaaatgaatactcctccctggctccccatccttctcttcttctctctggtatgcatgttctaaagatcacatgcaataacagaggcaaatctctttgctaaagtaaagcataatataaaatataagaattgtcactgctgtgagttaagaggatttcattatttttacactggagaagaaaaacaattgccattaaacaggttctccatgacctgtccccatctcttccctgccctcatcacctgtccttcctctccctgttcacatgtaccagccacctgaccttgctttgctccttcccatcatatcaggcacatgccagccttgggcaaatccccctcctcatcaaagcctttccatgaccgatcctccaattgaaactatcactcactcccctcttatatcacttcttttaatacagtcagagtacttgccactgtctaaaaaaactgtttgtttacttgttttcttttcttttcttttctgcttttcctactattctctcctgcttttcctactactctccaccagaatcaggagcagtaaactcaatggctctgtcttacttccatgctacaaactcaggtgagttcactgtagcctccaggagggaaatgtacattatgttctctgggacaaagctcccaggcaacaggcaaaaatgttccttttattctacacaactttggaaaacacctctgaatccaacgttgagagccatcatccttatgctgagtactcaagagctcccaggattctacagcccataaatgagacaatttgacaagagtcactagtggtgaccacagtaatagtattaggatgaaccacatgaaatcactgagattcactgttttggccctaaccactttcatatggtttggcatagtaacaacaatggcagcaggagcccttgctacatgccaggctttgtattaaggctttaatagatactagttcattcacttcccaccacaatcttataacctaagtattaattacctatgtgttatgcatggaaacagcaaggcttaggaaggttaagggatttttccagaggagaggtggtagcatcaggtcacaaacttaaccccgtattatcctggaagagctaatgtgtgttcccttcctagggaccaccatgaacccacctgggttctgtgcatggaaataacacagaaatggaagttgctgttttttgctttattgcctccacgactttgtagccattgctgttgactgggaatctctaaattacaccaacactcagggtcatctgagttgacaactttcatggccacggccactacgcccaagaaaaaaataagttggaggtaaaatggggtataaaactatcttctagcactttctgctaattgtcttttacccagacaaggaactctgaaggactctgacatcagtttgcgatgcctcagctacctctgtcctttggccatctctgacccttcagccaacttgggaccctcagtcctggtaagagatcatcaggccttgtgccccccaccccaccatcttggtgagctgactctttcttgctcacaccatacctaagttccaaatagaactttagggcatctgagatcccacacaggcctccccactgctgggatcaatgataaccatctcatggaaagcctcttcattgagatgtccccagttacatcaccccaccagcccagcattctcctggctcacctctctccagccacagaatttgcatctcacagctgagaaatgggattggtcttctcctctctccatgtctctgaaaacatcactcaaccaccttggctcaatagtctcctgcttcaaccagtgccactgagcatgccaatctctttttgtcatgttgacatcatgtgtggccttgatttgcctcccccaaattcctcctaggatggcccttctcacagccttgatctcatcctgggcacctaaaggggtactgagaatggtccctcccacagctttgactgaaagttcttggattccttctatatccagtcaatttcactaccttctactttagctacttagtcttgcggatgtttgaattttttggacactggatttttttcatcgtataaatgatttcacatcccaaatctgacattatgtaacacctctttcctgaacaacctgccgagtttgtctataagaccacccacactgtgcattaagttcaccaggtataaaacataggtggccattgcaccaccaaagccagtatcccagacacagtgggttggagaccctcgggacatgcagacatctccccactcccagtcagccatctgactctgtggagtctcctccctctcttgttaccattcctcagttgtgccaatgtgacacgccacttccagactctcacctcccctgaccaaagctagaggcatggcctttcaatgatctcggcttgtggtctcaccatagagtctatatgccacattcctgctcaacatctagaggtgtcacttcaagctaccctcccattatagggtattaagctctgaagttagccagtaagggggaaaacatggttaaaccactctggaaagatcccttaaactgaccaaccttcaacaaatctgaaaagtctaatttctttttcttggaaccaagcgctggttctgcatttgaacacaagttggagtcctggttaggatttggagggctagagggtgcaaaaacgtccttatccattagggtcacactcatcacagcaagatgctccccttgtggacagctgtgtgggacggcagccagtgaagaggagactagccactctgaagcctacgttccttgagtagaatggtccacaatctaaatctaggggttcactccttctctccctctgcatttgtctctctttccatgtctgcttgtgtctgtctctccaccccccgaagtgtgtgtctgggtgtttctctctgaatctcggtcccctagcgtatgttgtgtctgtctttatgtacgtatctgtgtgtacctggctctgtgtctctctcagcatgttactgtgtttccatgtgtgtaagggtaaatctcccctgtctctatctcttcttgtctttctctgcatctgtccctgtctctacgtgtgtacctctttcttggtttctctgtggctgtctctctgtttctctctcggtcttgatgtctctctgtgtgagtgtctctctctccttatgactgtcttcatgcgtgcattgggtccttgtgtgcatgtcctcctcctccagtgagtgtctccctatgcacacatttcttgaggtgtagggctctgcaaaacacttagagttgacccatttcaaatatgttagccgcacatgattcccggccaggtatgccagcgctgccctcttctgcattgccacgcagacgcctaccttggtcgaaacacttgcagacatatctttagcaaggtatctttcctcgtttttccccaacaaaactcatgctgtaggaatctccaacatatacaatgaaagagtattgagctgccatagataaattaagtactgtgctcggcctcccactcagcaccaagaggccaaacagaatctaaaaccactgctgacacctagcacaccaaacctttccagcctctgcaactggcattctctgcatgtcaaaaacctctgaatcattctgggtcaagcacacatgcctcctttcacaaaggttctgcaaacaggtagcatcctgtaccccgagtgtgtgcctggtacctactggtgtacccccttctcattgagaggtcctgatgcctgtggtgtgagtcagtttgagtgtgttaatggagtgttctgctttcaaggccaaactgcataagcagagcccatccttttcccttcttttgtgcccagatgggaggaatttgtgaaacttgtattccagtgttaatgctgaagttgggaaatggctcaatcaagcaatggcagtttaacttgaagagtgcaaaggagaagagcagggagaaaaccaacactggaagcaaatcagaaggccagaaaccttcatgggcacttgcactattgtttacagccacaataatcatgtaagggaacccagcatttttcagaagttattttgttctgtttttttttcttttttttccaaatgtgtgtttgtattgctttgtttaaatataggcctgattcattcaggcttgggtctgaagatcccaggctttcagaactcaacaaagctttcatcatttgcaaataattcaactcaacaaatatcatttgagaaaagctctgtgctagtgcttcttgtagagacacaatgaagaaaaaatcacggtccctgctctttggagacaaataacttaggggaaaacacacacacctctcaactctcacctaaggagtgctgtgcaaagtgctgaaggagatggagactcctctcctgggaaaatctgcaattcgaaactcaaaagaagatgaggctaagggccctccaggtggaggaacagcctgagtaaatgcctagaaaggaatggcacatagtaggcacttgcaatcaaagctttgctaaatgaatgcatgttgaacatgttccagaaaactcaagaccagagtagcactgagaagtagaggtgtttcagggcttccttttagaaatttcttatactgaaggtttcagaatgctaggagggaccagggagatggtttattccaactggtttcttttgaaaacgaagaaaccaaaaacccaagcttacatgctagggccagaaatgagatgagaactcagaactgttccagaaggtaatcactttgaatttaaatgcctactcttctgatctcaatttaaggaactaaaacaaaatcagcagtactgtttgctagttttctgtgaatcattcagaccctggagaagccagcttcacttttgaaagctgagctgatccacttacaactgtgtggctaggttcccattactgagtctcagtcttcacaactgtaatataggaaaaacaacagtagctatcgtacagcgtagttgtaaagattcagtgagatcatgtacaaaaacagctcttaacaaggtcatcagtgaccttcactttgccaaactcaatggacattttttgtccccatctcactagacctctgggcagtggcatctggcacaaaggggctgctccttccccaaaacaccccggcaccggctcctgggatagccttctttcctgctattctttctttctggatgttcctcggtctccattgccaagtcctcttctatccaatttctaaatgttggcaaactgcaagagctcaattctatatcctcttatcttccccagcgacacacttttctcattgaacccattcagcccctccgctttacacaccatccaaatgttgctggcacacacttttatatccctagctcccacttctccgctggttgtcagactcaaatatcaaactacctgcttgagatctccatgtggaagtcatagaagagtctcaacccaatatgtcaaaaactgaactctccattgccccattcccaaacttagtttttcctcacctgcttaaatggtattgatactcaaccatgacttaagccagaaatctaagagtcattcacagcacctcctctccccctctcccaacatctgccatcaggtcctaaatttcatttgtgatatatatgttaaccgtatacgtttttctttatttctaccaccagcactgtctctcatctgaatgacggcaatcacctcctaactccactcctgtatctccacagtcagttctctgcccagcaaccgccatggtgtgtaacaaatgaaactgatcccagtactctgtgttccatccatcagtggcttcctcttgttcatagaataaaggatgaaacctgaaatacttcttcaaacttctccaggatctactcacaaaaatcctctggcacagctctcttcttctatcatttggctgcatttctacttgcctatttttcatactcggaacaatcatgctttttgtagagccagggccctcacatgtgttgctcaggtctttagtcagcaaactcttcttccttaatctagtggttaaaagccccagctctggagtcaaactgacaggggctgggtgactaaagacagtcttctggccaggcatggtggctcacatctgtaatcccagcacacagcctcccaggaggatcacctgagcccaggagtttgagaccagtctgggcaacgaagcaagacctatttgccaaaaaagaaaaagaaaaaaggccgggcatggtggctcacgcctataatctcagcactttgggaggccgaggcgggcagatcttgaggtcaagagatcgagaccatcctggccaacatggtgaaacctcatctctactaaaaatacaaacattagctgggcttggtggtgtgcatctatagtcccagctacttgggaggctgaaccaggagaattgcttgaacccgggagggagaggttaccgtgagccaagatcgcgccactgcactccagcctggtgacagaacaagactgtctccaaaaataaaaaaaagacaatctccttagtaaaactatgtaccttactttaatcatctgtaaaatggggataagaacagtagccacctcacatagtggtgaatattcaataaaacaaaatgtgtgaagcactgaaactactacctggcagaagaaaaacactcagtaaacattattgtcaaaaatccctatcatcctttagttctcatcttaaatgtttctgcttaaagcactctccattactctaaccctcagttttaatccattttatttcctagtactaatctaaattggtcatcaaatattgattttgagacttattgtccatttctgcctctcaaattacactctacagaacagggactttgtctgtgtttccttcagtcctggaaacctggcagaggagctgaggaactgagctttacaggctgagttctgtgaccctgtgattattatgttgaagccctcatccccagtacctctcaatgtgactttaattggaggcaggggctttaaagaggaaagtaagttaaagtgagaccatcaagttaaaattatgccctaattcagtctgtctggtgtatgtataagaagagagggaatttggatacacaaagagaaaccaggggtgtgcattcgagagaaaagattgtgtgaagatagagcaagaaggtggctagctggatgctcacaagaggggcctcaggggaaatcaactctgctgacaccttggtctttggcttccagcctccagaacggtgagaaaataaatgtcttttgtttacaccacctaatctgtagcatttttgttatatctaccataaaaactaatgcagtcagtaaagactgatgagtgaatggatgaatgtgtcaacccagtgctcagcacaaggtaagtatgcacaaaggttgactcctattcctgaaataatgatgatgaatgtaataacatctcaggagcaaatctaaccaatgcacattgaccaagtcactgagaaaaatatgtctcagtggcacttacagtgcttttcacctgtaatactgaagtgaaatgtgattagctatgaagatctgagaccttcctttaggagccagcacatactactctatgacttctgtttacttaatttgtacatgttggaacttgactgttttatggtagactcttggctatacaacatggaacactagacatttccatactcagtaaacaaatatttctcagacatgacagcaaaactagaaatgagaatattagattaatacttccaaaataacagcctcatcgttttaatcaacatgtccttgaacacgtttgaatgtgtgtgtaactgtgtgggaatgtgagctacatgtgtatttttccactgaaggtgaccataccatatgcaagagcaggatctcaaattagatattcagcataggtagccatattatccacatctaccaactgtcttcaaattaaagcccttctctagctggaacatgtatctgtcactggaaagtaggcagtgttgaaaatcatgacaaaattggcacatatcttgatagttgcatcatcttttctgtggcagtccccagtaatagagcttcatctaattcagcaaactattagctcataataagaaacagcatgtgtattgattcttttaatagatcttggaattaatacacatgattcctataaaaggactgtataaaaaaaatcaccaagttgattattgcacaatgaggtctcactcaaatggcataggctacggcagaaaggtaggcaattcctcttttgaaaaaaactctccatcttacagactgattctctcctgaggaagaaaaaatataatgaagtgctataattaggtatctcacatgtaagggaagataacaaaatcaggaacagcaaataggtttttactgagtgtcaactccattcaattagctgcagctacctagagggttgtattaagaagcccaaggtcgacagtaaacaatgccttggtgaaataatgatgttggctagggttgcaaaatgatgagtagatggccgctatgtaatttctactctgaaacagatgtcactaaagtctcttccggggccaaccttctatgactctctccttttttctcctcttccctcactcttgctcttggagttgggatgaataagttagcatctcctgagaatcccaactttctcctcttatataaagtggtcaggctcagttttcagtatcaggattcaaagcagcaacctctgtcattacaatcatgtgtcgctttggtataggcattgaaaagctgtaccagggtgctgactgtcacttaagtaattagactaaactataataaacaagaagagatcactgctggagacccacatttgttaatgacctccagggtcctctcccctggcaagagatagacagatgaggtaccaggagtgcaggcctccttgcacgtataatgacaacagccagacaacaatgcaacaaaaatggtcccatgtcctgttctgtgtgtatagggagagtgatgacaatcatcattaccaccagaactaccaaatttcctctccagttctttgatgcttctcaatcattgtcggagctaccctttaaagatgtctcaccatgaacagttactatgacaagatactaagaagagagtgtttcatttaaccccttccatcactacccctatgagacatgattgcctttacttgacaggaaaatgaggttcagggaggttaaatgtatgtagaagattttagcaagaatattctgacttgaaatctatgttcttaatgatttaggataccagctcacaactcaaagcatgaagcatgtggcaatactataggaggtaagagatctcatgacaggaaactcgggttattcattcattcatccatctagtcattcatccatgcatatatccatctctccactcagtcactgtgtcaacagatatttaccatgtaactatctctgtacttggtactggggcagaggtgagcaaaacagataaagcccctggcctcacagtgttcacagtctaatgaaagcacaaacatcaatcagtgacattactgtgcaatcacaaattgagataatacttgaaaggaaagtaatgggagcctatgacaaagatctggatttggggtagggtcagatttaagaaaatgagacctgagagctgaactgataggcaagttgacattaattaggtggaaggcaggtgaaagaatggggctagagaactaataaggagataataacatatgtagaggttcatggaggaagggaatataaagtattcaaggagctatgagccagagcacatcgagcaggtcaatgagggaaagagtggtatgagaaaaacctggaaaggcagagaggaggtggaccatattaaggtgcatagggtggcagtggaaaccactgaaaaatttgagagagaggaagacagtgggtggaagaaaggggacaactgtgattgttcagacttcagtgaccacaaacaatacagggagcatggtgagatcagaatggagatgcagcaacctgtaacaggtcacttagttcagatcagagacacttggtagctttgattaggtgatggtggtagagatgagcagaaatggatggatttaagaaatattgtggggtaaaatctaaagcacttactgataaattggatttgggaagatgaggaagcaggaggcaaggataatccctagatttctgacctgaccagatagatgttgctactcactggctggcaacttcacaaggtggccttgttgactttggaataccttttgggcatcctagtggagtggcctaaaagggagttaggttttacatgttaggagttcagaaaagaggtctggggtggagacattatcttgacagtcagttttatagctagaaatggttgaggctttgggatagatagagaaggggtactttggaaaacaatgttcatggaaagcaataaacattctcgtcaatcactatattcttctaatacacttcttccttttgttatgagcatctgcatctttcttcctcttgcgtttcaataaaagcttctatttttaattacacttcccttggttctaatttttaaaagtattttgcatatctgttttatactatgtatccctataaccactccaacttttgtagaatgaggagagaggaccaattactagttttcagaagatccacatgagactccaaatggtcaaattatcctgacagcgaacccagcaaggaatagattaaatttgaatagtgcactcaaaaggactatctttgagactctaagacgattcttgattcattcatttcgtgaaagccaaaatgtccgaaagtggtttgcggatgaggggactgaatcgtgaatttgaggcctaaagaatttcccaatgttcagccttatggtggattaaatttaccatgactaattggaggattcaaagctgttaggaacactagctattagggccatttttctcatcttcgatcttactgcttgactgattcatagctggaactgctaggccgttatggaaatggaaatgcagagatgaagcagttcccaatgtcaaaaacttccagggacatgtaaatacaatacacgtaccaagtaatgagtttaattacttaattattagatactgagcactaaaatttaactaacacctggttccataaggaaaaaaatacttcatttcgctgtacttatagctctttattatgccttttgaattatctgaaatccactgatgtacgggtaaaaaactcctgcagctagctcagtgtctgtccaaatggccacccagttttgtgcttgaaatccaggaccccactggtgtaggcatctgtggggaatctcctggtctgtgggttgtgaagaccatgggaaaagcgtggtatctgggctggagcgcaccattcctcaaggcacggtcccacatggcttcccttggctaggggagggagttccctgaccccttgtgcttcccaagtgaggcgacaccccaccctgcttcccctcgccccctgtgggctgcacccactgtctaaccagtcccagtgagatgagccaggtacctcagttggaaatgcagaaagcacctgccttctgcattgatctcgctggaagctgtagcccagagctgttcctattcggccatcttgacagccaccaccccatttttcaattttttttatgacaggctaactgtgggctttcctaagagacatgagagtagtatccttcccctacaatcctcaggcctagcatggtgtctggcatataacaaataaatcaatgcagcctctcaaggaatcctcaaaatacagcagaatcattctagaaaacaattcatttcgattaaagaaatgaacaccatagagatgttccattggaagacttttgaaccaaaacatttaattcgccagtcctgaccatatctataacaaaaggaactatgtctttaacgtatttttcttgaaagccagttcatatggttgagagagcttataaggaatactaaaatagggaatataatcagccttctgtttttgagcaaaagtgctgtcaactagagatggggctcttggaaaatactttatactgcctgttctcagtttttttcttcttaagagctacttcatttcattgttcaaagtttagtgagagccaaaagaaaatacaatctatttacaataaacctatactttccagaatcaccttaaattatttctgctaactctaagcataaatcaaaagttctgaaaagcagaatggcctaaagaggaaatatgtcatttgtgtagttttgggaggggagggagtctgttaggaaagataaattattattgtcctaagcaaaaggacagctaatgaattcctaaatgacagggtttaatcctcaggcttgttgactacaaggttatagagctttcttcctttccattgttaaggagatatttaaatgtaaacatcttttctaaccttggaaggaaactgatggaaaacagtgagtattttcttggtgcaatttaaatattaaattcaaacttaaagcaattgttcacacatgcatttgctagctcaagaacacaaacataatctgtgggaataagaatcacaataaatgaaataataatagaacaactgaatccatcaatttttctagcatatatacactaagcaaatagtttgcactttgcataggattcagcattgccaatattttatttctaataagccaggtataataagaaaagcaaaatgtattggccaggtgcagtggcccatgcctgtaatcccagcactttgggaggccaaagcgggcagatcacgaggtcaggagatacagaccatcctggctaacacggtgaaaccccatctctaccaaaaatacacacacataaaaaaaaatttgctgggcatggtggcaggcacctgtagtccccagctacttgggaggctgaggcagcagaatggcgtgaacccaggaggtggagttcgcaatgagccgagatcacaccactgcactccagcctgggtgacagagcgagactccatctcaaaaaataataataataataataataaaagaaaagaaaaatgtattgttagtcttaaatattttctggttttaaattgagtcgaaaactcatggctcaagttcatttaaagtccaagtctgaattctaaaggttaaatgctagtaccgttagttcctcaaattattcacttgttttttatttttgttacatgagagagagaaggaggaggagagagagagagagacagaaagagatatcacagaattagaacttgaatctcattcagtggatagggatgagaagaaaaatgaacattcacagagcgcctaacatgtttcacgtatccaagtatcacatcaggaactttcatacttatgatttcatttattcctaaaaattaagtaactaagtttcagaaaaatagagtgacttgctaaagataattcagtgactgagtggtggaatcccagttttgaagatagagctctttgactccaagaagaattctcaatccataaagctttactacaaattagggaaaatggcttatctttaaaatagcgtgtgaataaataaatgagtaaagtttccatggggacataggcagcaaattaacagaacacaatttaaaatgttggatgtaaactaataaacagatgcatgtcactaaaacgtcacatttttcatcgtaacagtgtattatctgttggcaaagacctcagtaaagctgtttttatacaacagaagcacagctggctaaaaacagaacaaatgtggtcaaccaactaaaattttcaattcgttcaatgccaagaatctgcatggaatgacgttttaaataaaacaacctgaaagtaagctgacccataacaatttggtttttatctttaataactttaaatttttggttaatgtctctataaacagcctacatattattcagggtaaaggctcaaatatattatactaaaattgcttttagacccagaaaattcctttgcatggaggtatgaaaaaggaacatttgaaattagcttgaaatttgggtgtatttcagatatgacatgccattcacattcatgtgtttccattccccatgaacaatgggctgcgtgggccagtatcaatcatctattaatccagaactttccatactacctattagttaataaagtacattgacatccattaccccatgtgatgggatatttaacacacttccagaacatagaataaaaataaaggggtttatactttacctagaaggctagtgacttaagaattttggtgggaagtttcatccactagaggaaaagtcttatgattatgtggaaattatttatcacatgcccccaacaaaccccacaacatcacaatagacaaatagtggtgctcaaatagtgaacattatggaaataagggagaacatacatctctacccattcccaatagttttgaacttaggtatttataaaattaatttcatgatgctgcacataaatcttaattctaatgtgcataaacagaaaaaagcaagttgtataattattctgtgttattatttttaaaagccctatatatcaaaccaaaacaaatcaatataatgccaccaatgtgaatatcattaggctcagcatcttaaactcagcatgatatccatcgggccataaatttgaaggaaaatattcaataccagtttcataaatcatattaacattaggagaaaatctattatagcacaaagtcttattcaagggaaaatcatgttcataggaattaaacaaacaaaaaaacacttgtggccctctgctctattatccttaaattttaggaaataactaattataggagagttttcagtcatgtaaatcagagagttagcaaaacaatggttatattatgacagcaatcaataatagcatgcatttttattaaaacattactttctaaatttgtagggctttaaattgtctagcagaacacagcttgaagtatgatatatggatggaggttcatagaaaatatagtgtatgggaaatacagactccactcaggagatatatctgatttaaacacatgcatatatatgtgacaatatatatctaattatatactaaatctcacagaactacataaatatcttcttgcttgctttctacagtttctttaagaaaatattatttaagaggtgacaagtttcttgttgttgttgagcaacttgaattacttagtttcttgcagaactgtgtcttcttccagctagagtgtaaaatcacttggaatcataacatattcaaagagttttgtcttaacaaatccatgagtgatcaacttccttccatcctcaacaaagctgagaggtagaccttgccagttctaacctagcactggagtttaggtttattagatttagccagaaccttcaagtgattcttgaaatgaactttttaaagagaattaattaagcccaatttctagcctacatgattcccatgactatacatttatattagaattgatattcaaaactaactataaatatttaaaatccttttatcaacaaatgaaactagatcagcacagagaaagttgaactcaacttctaatttcctcctcttggctctatcaaacaagagcaaatcaaactggctgctaagagaactgatgaccaagacagactgggaaatgagacttctagggagtatgtcaccgtcttaaaggcctttctagactggatgaatagaaataactggcagataaaactgataaactgatttgaaaacatctaagtaaacatggccacatgcaaaggtatccagagaaagataattctagaatttgcagataaaactgctgaattgctttttggagcctgtgaagaattacagcagaggtattctaacaaagcagaggtattcaaacaaataagactcttagtattcaacctcccattgggcaaaaactagaagctggcacccaagagagaaagcacctctttcttgtcccccaagcatgtggcttggactggattttaccccaagtcccactgtagccagaaactttcatgtagggcataacctgtgcaactcacatatggttgtcctggatctaaatactgtataagaataaatatctctttatcaaaagaactaactacagctagccatgtgttacttaacaatggggatacatgctgagaagtatactagtatatttcacccttgtgcaaacatcatagagtgtactcatacaaacctagatggtacagctctctgcacagctaggctatatgctatacccttcagctcctaggttacaaaggtatagagcatgttactcacttaatactgtagttaatggtaacataatgataagtattcatgtatctaaataaatatagaaaagatacagtaaaactatggtataaaagataagaaatatggtattcctatatagggcacttaccatgaatggagcttgttggattggaagttgctttgggtgagtcagtgagtaaggggtgactgaatttgaaggcctggggcattactgtacatttctatagactttctgtacactgtatacttaggctatactaaatgaatcttctaaatttatgtaataaattaatcagcttactggaactttttaactttatcaactttaattttcttaactttttgacttttgtaataacatgtagcttaaaacacaaatacactgtacaggtatacaaaaatattttctttctttattctatttttaaaaccttttattttttactttttacacttttgtgttaaaaaccaacacacacacacacattagtctaggtctacacaaggtcaggatcatcagtatcactctcttctatgtccacatcttgtcccactgaaaggccttcaggggcactcaccatggagccgtcttctcctatgataacaatgcattcttctgcaatagtccctgaaggacctgcttgaagcggttttaaagttatctttttaaaaaaataataaatacactctaaaataacaataaaaaagtatagtatagtaagggtacaaactagtaacatagtcgtttattatcaagtattatgtactgaacataactgtacgtgtgatacttttatacgactggcagcatagctttgtttacaccagcactgctatgaacaagggaataatgcaatggactacaacgtaaagacagctacgacattgcaaggcagtaggaaattttcagctccattataatcttatagggccaccttcatacatgcggtctgtggttgactgaaattttatgcagtgcatgactactataaccttacaagcttgataaaaggcaggtaaaattctaaaatgcactgtttcagaagggttggtggaagcttggcaaaggtgttcacgaagagccagcatggctcccaaaggcacctcagtttctatgtttgttggataagcccagtagatccaaagaatgctacaaaatacaacatatagtatataaagctaccataattctgctttaggggaggatggagaagaaaagattagatgaacaaaggaagaaaagagtgaagaaaatgaagaaaaggagaaggaagaagaaagtctaagaaacataaaagaaaaaagaatggagaaaagatatcttagaaaatggaaaatgaaggaattaagaagaatcaggatatctgcaagttatatgacatactctctcacaatacctttgcgaagcatgtcattttcatctaacacagcagggctcaagcaagagtaatatagtaatattcaaaaagaccaggggtaggtagtcagttttccacctttaccaatatggaggaacactgatgtaaagaaaactatcacctatctttttagggaggcatttttagtgtataatcaggactttagaaggcaaactttctttaggctgtacccaccattgaccttaactgagaacacctctaccaaggtcagggggccaagactctccactccaggtgatgaaatcatacagtttcgatatgatttcacaatatgaactgtagatttttgataaagtaaaggcctggccagaaaaagggcagaaacctatatgaactttaaggtggtcagaaagctcagctctacttaagaaacacttttagactcactttagtaggctatcaaaacaaaaacaaaaacaaaaacaaaaaaagacacaaaaaggaaaaaaaaaatagttgtaccttcaagatatctcttgcaggaagcctagtccatcaagaaataaaccttcatctcccgattccaaaaatcagataccagcagttctcacaatgcctctagtggtaattctgtggttttatatcaagttctctatcctccccagagactcacagaaatggcatctcagcacttttaatccattactccccattaagtccattagttacataagcctagaagataccagtataggtcagcatgtgccaaagtgtgtttccacaagcactcaacgctgctagatgctaaaacacgctctgtgaacaaaagcgcttgctgtcaaatgcttttgagagatgctagagttaaacaaagctaaagttgtttatttgctgccagatttctgggagcctttcagatgccaatgcagcctgtggcagtgcaggaaagagaccaagaatgcaacatttcccacacattcttcactagggtctcttcatcttcgaattttgctgagcatcatcacagtcaactgctctaatgaacatattttgggaaatatacaaagaagaggtcagctaggtcatgtgagaaatccatgtttcgttcattgctcacacattaaattttctgcacaaacacattattctctgtgaaattatccttcactcgtagggaaaacaacaatagaagtcctctgcatctaaatccaaagggatctgagctgttctacgcatatttactgtgttgcttaagaatgtctcatggttctttcctatggcaatctccattccattattcaaaaatacaaattaatcacattctaagcaattgttcagtttccttcatttgtatgtggttgcagtctgtaagtgaaattccttaatttcttttctcaaagaaagcttctatccatacaaaacagtccccaaacccccaaattttgggctctaatatgagttaagtagaaaggtaaatgctaatgtttcattaatcctaacgcttgaatttcaccccaacctctgcagtgttctgctctctctgaagtgcttgtttgcttttcagttccccaaatttggctctggtaaaaacaaaacaaaacaaacaaacaaacactaatgggaacagtaactgtgttttgtataatttggggccattaccagctactttatgcttcatttgcgtacttgcgtgtattagatacattttgttaagttcacctaaggatatttccctcaatgggcacaaattcatggtgcctataaggtgactttagtacagcttcatcatctacactaatatttccagcagcccctcaaaagcgagatattttcttgaaagtaaaataacaaaacttactgtatgtctgatactgcagaggccacttaaattgtctataataagtccaaggaaaggatcgttgaagttaactggccttgggaatttcaagtacacctccctttgaaataaaaccatttccaaagaacgtcatgtcaaatgcacatctccctccagaaaattgtgttttcttttcaccccacccagaacataactgaatatcattttgctgggtagggaacctccctaacctgccttaagtctcatctatttccatttaaccatagttcccagctaacactacctctttcccaagtttacctctggcaagacaaaaaggatggtctttatgaacagatggtcttttcaaggtaaagtagttacatttaaatacagataaatgtactgtaaaaaacggctttaaaagaatttaggtctttaagggggaaaatatgagagcacaagacactattctttaattacatgagatttcttttttcttcccttgaagacaaaaccaattcctaatgaagcataatgaatcgtaaagaggcaccaatgctcatcccaacagatgtttattgattggtgttgactgaacacaaacacaagggtgttgcttactattgtcagtaagtggtgggaagcagcaccagttccccctggttattttacctttcaaagacaagctgacaaatttattttgtcacgagcagctgtgttcttatttttataagggttggcttacaactaagaaagcaagcggagggaacagccttttggtgtccaatgtgttatctggcaaggacagattgttttagggtgcaatggaaaagatttttaatgaaactacatttcaaacgagcagcatatgcttgattttcccttctgctactcatcctgccatttgttaatttttgttattgttgttctccgggactcctaaattttcatacaagctgtctcgtccggcactaacacagcttggggcgaattaatgcttgggatgcaaaaacctgcacgtcccactccagccatttttttttttttcatttctaaaatttctacattcaatcagggtttaaccggtgaactagttgacggaacaagcagggattaaaaaaaaaaaattcctcctctttgtgagtccttggagccccagagccagaaaatgtgacttcagaatatgtgtggacttgtcagcagctcagctgcacacaattatggggtcagagcccagattggaggtctggagaaactctgaaattgggaattaggacaaaatttttttctttttaacaccgtaatgccacatattaatttaaatgattctctcagaatgattctgtggcccagttaaatgaagttcaaggaaatgaatttcagcctttgacactctgagtcctatttgaaagtagtcggctttacaagattaaaaacaaattacagggaatacgaaatctttgattagcaggtgctttgatagctgcaagaatattttttctcaaaaatgtgaacacacatgggagaggcaccactattattatctttgtgtggaaggccttataatgaggattccattgtgtccagagactgaggacatgaattgctatgtctgaagggtcctggttcaagaggtgatttcagtaagacacagctgatagatagaacctaaggtttcatgggttcataaactctctttttttgctaacctcccataatcaattgaagaatttaagggactcacccctttctgtaggattcccttcataactaatgggaggcagaacttttcaacagagaaagagaatgctcgacatttttcaataccatgtgcatcaaccaatgggagaaaagggtcttggaagtttagacagagtctttggtcagctctgagctcaggaagactgaagtccatgtccaggttgccccattcactcattgtatgaccttgggcaagatacgtcaattctaaggagttcagttttctcgtctatactgtgggcatttcaagggtcactgtgcagatgaaacgagttaccacagggtgtggcatacagtaaaaacaagttaaatggcaacaaaatataatcagaaattgcaccaacgtcagtgccttattccatctcatttctcccattcagttagtttccaagttataagggttcaaccccttcatgctaggccctgtgcagacatgccttgctccatcacatgttcagccttgaatggataggaatgtccactgcttggtcactgttacagaactacacatatgagatgctccatcattatgtaactcatggaccagctagcaagatggcactagtgtcctagtgaggatgggtactcagaaccaagatattagagacagaatgtgccctgttaagttcagaacatataaagtaaatactctagagtttcagactaacttgatggaatattcaagaggcttgataagccctgaatggggccttgtgagacatagggccacttaaccttggacagtaagaatattattgccagcaactcaagtgtgtctctcatgaagaactggggctacctgtgaagcttggttcactagccatccccagactattccttggcatgtttggctgggaaggtatccttggcgctcactgtagtatcatacatttcagtagctctatgggtcagggttgatattctcaccaagcctccagcctaaacctctgagggtgcctattcttcattcctccagtgtcacctgtctcacacggggccagtcagctttttcctgcaggttccatcctgccccagattctgaaccaatcaaactccctgacaagtggaatccaagtcctatgagttcacagcttaaagtcttcacagcaagtcagaccaatgcctgaccctgctctgctcctgcaagtggcttataccctagtttagctcactgagtttctcttgtcttattcagtacaggtctcagtagtactcctgttcatttgggattggttttctaccttgtctcctcgaggttctctggaaaacagaagcaaaccagtatttgctggcccctacctagtgctttcatcaaattgatctacatgttgctcttcagtcacaggctccctcacttccgtatttttgctcctgacttatctcttcctcaaccccattctcaatctcagctcctctactgataaaatccctcccagttgaataccaactcttccatgaacctcagctagacagggtgtgtctccctcctctaactcttaaagtacttggtttctcaattctggtgcttctcactgcttcccatgatggcaattactgacatgtcttctctttctggttaaactcttgactgtcttccaaatgcatcttgccttatccactcgcatttcctctaatctgtcttccatcctaaccgtatagtgacgctcttgaaacacaattctgattccctctgtttctggccttcagtcatttcctaccatattaaaaatagagacttggatcccaaacgaagcctagaaggctttagttggccccattatctttactgccttatcttgcatttttggtcttctcttgccttgtgctcccaccacaccaacctctctcttctgccacaggccctctgcacatgctgtatccctccccaacctctgtctctgccttcactgacacctattcatcccttacaacccaattcaatcatgttttaaagaagatctcttgtggtctttccaactaggccagttttccctaagatatcctaccacaaacatgtcttctttatagcataaagatgtaattttaagttttttattaatttcctgctatcccactagattgtaacctccctgatggcaagaaccatgttagattttgttcaacatttcatccccataagttctgagaatatttatataatagttgctcaattaaatatttgctgattgaagttattttgggccaaagaccaggtttcatttttcttctcagcccactgatttctggcacaaaggagaggttccataactaactgttcaccaccaatgaaaatacaggtataatgtttaaaagcttcctatttcttcttgtggtactattaagtaggaccagagcagcagtacttcacaggggtagtgtggcatcttcaagtacaatgatttgtaggggataaagaaaagaaaaaaaaaacccacaaaactagtttgtgccacatataaggaagaatatggttctcttgggcaaaaatggcattgttttcaacaactgatatggactgcctcataattgctatagccttagcaatctatactggccataaaggcaagccaaagggaactgttatgactccagagagttaccattgcctgtctattaggccaagttgtaccccaaccccaaaatgacagatgatttgctacacagtgcccaagagaaggaagaataataaaagaaaagccgtgttctcattctgtgcatagttttgcctcacttcgtacagtaagtccaggagtcttattttccaaagtaaaaatggtgaaatttgtctttaaacactgcttctaaatgtgttggttagatgcttcatttctacaattaaacacctacctactggcttcagcaccaggtatttaggccatcctggcctagttccactgactattccagtgtctataaaacaccttcaccaagcatgagaaacaaacacagactttattttctacctcatctgtcttgcatttccttgtgcttaatactgtgacatttaagtggcagtgacacaatcagcaaacctagtgaaggatgagtctatgtaaaggcaaccatgtttgcgggcagagaatatcaactttatacgtacctaaatgactgctgtgtgcacagcagccaagcccaataaatgttaaatcacaaaactcacactataagctgaaagtgcctttaggtgtgtgaattccagtttcatgttgcaaagctacctaatattctaaggttgtcgggggagatatggaaattgagtctatagtagagagaaaagttctacaccaactccagaccttatcagtggtcaatataccaacccaacaaaagcaggttgcattctaccacggctattcattacaaataattttacttatattcagtgccaatgcccagccttctctagtccctgttctagctttacttttcttcattgcactaatcgccacttaacatgtgcatattttacttatttttttgtgggccctcattcccctcaaccaaaatgcaaactaagaagacagagatttttatcagttttattcattactgtatcccaagaagctaggatacaggggattctctctgagattatttgctggcaaatgaatgagattcttggcatttgctaggcactgttcctttcgctttccatgaattagaagaaggcaacataaatgaatagccaaaagcttgggcctcagagtgagataacctaagtcccaaaccttatgaagtgtttatcttgggcaagtctcttaaactctctgtgtcccaagtggctacctctaaaagggagatgataaaaaggacactacataaaagggctactatgaaatgtaatgagattataaatatactgtaagatgctttgcatagttcctggccacacagtaactaaacaacaaatgttagccattatttttattttctttctattatttttataattattaactattaaaataaaggtaggaactattatcattctctttctacaattgacggtacaaagaatgcttctgcttgaagttgcaaaatgttacaaatggttaaaaaaacattagagaaagagagcaggagagaaggaagagtaagaagcgttacaggaagaatcaagagatactagcctagaaataaaaagactcatcctggagaacttggttaaggtgggttctgtgagcatgtgggagcctggtaggtccagaatagacacttcttatagcagatctagaactggcaacgaactgtagtaagccaaagagtgaggtaggacctaacagattggactaggaatccaacctacatgacctagatttctgattatctggctccacttcctttaccgtcacagagagtaaggtctccagttcctcccctgtactagaatgctcccagacaacctaggtgattagtgagagtttaagttctctactctgaaggacttgggttcagacacaactcaatcacttataagcttagtgaccttggactgacccttaatttcttcatttgcaaaatgaggaaactaactgcatcttatcccatagggttgccatgaagataaaatgagatggctcccaacaagtactggatgctgtctggggggtaaaggaagctttcaataatcacataaacagaagtagcattcaacctggctgagcaaatgctttagataaaatcgaagttctttctcttccctgccctgactccccagaagagaataatatatggtataagcaaatccaaaaatacccgctaaaggaagttaacaatcagcaactatcattcttaatgtcttgggcaaatcagcatacttttcaaatacaaaaaacacaaacaaacaaacaaacaaataacacctcaaataattaagtactttatgaaaataagtcaaagtttctttagaaactttgtcttaagaatcagacaaaggccagcccaccacctatgtcatggaggggtcataaggaaagagaatgaagaaagagaaaaagaaaaaggggtgaaattctaatatttaacatctccaggcacacgccccagcctctcacgcagccctacctaccacaaccaaccaccacatttgatgcttgaaatctacctaaatcaaatcgatatttgccttagcactttccaaatatctaggcttcccctagaaatacttacaagggagatgatattcagtttagactcaaaggccagttgtttcaaatgtcaagtgaaataatatctcctcctccttcatcgtgctcataaacttatacaacaaagacatcctgaccctcagaggtcagagaactcaagcaagagaacgagaatgcaagatatctccaaggttattttggaactaggcatggcttgaagacacatctaatggtgaagggcttttaattgagatgctgcacaccacctggttggggttggggtctctgggtgggtggatcaggcagtgggggacagtgaaaactggtgaaattatcttggaatgtgcttttatccatagagcttggatatacccttccttagctgatcagagagggcccgggaaccaaaagacattaagatcttagaatgcattttctactctctcattttatagatagcacaactgagtcccagataaaataaaagtgtttttcccaatatcatacatctgctgatggtcctgacttagccactaggcaagtcccccagactccagcctgcggttgcttccatctatcaaggcctcttttcaagctacttggaaggctctcctagcaaagatgactacaatttatgctcccttcacaacattttgattgatttttggtggaaaagtaggcatccctgaagcatttctttaaaataaatccagcctgccaaaccagcactgatgtacaaccctagtagaagaatccaccattggccacaataatagcaaaaagggtaatgagaaataaacgtatttaagtttacaagcctcgaagaggttatcacacacaatgacaggaatctttgtgtcaggactgaacaagtaaccctgatttaactttacattttgatagagtcagccgcgttgcagtcattgtttcgtctaacaattaaaagcggaatttgaaactattcctgtccatagttccccttaaaaaatctaaagcaaagagattctctcatgccaggattgaatgaatttataattatctatctgtagctccaggacaaaagacttaaacacaaaaaagccaaataaaccaaggacaaatttctgatagttctagttaccctgcctattaaatgatagacacattaaaagaaagagagtgatatttggaatattcagaagttggtggtccatttctcatgctttgttttagtatcactctttcttagacgaaagacagtcatgaagttgtttgtgaagactctcatcagacaagagtacagtgttaataaatgcatttagcaagcatttactatgtgccaaacactatgctatgtatgggctgtcatgtacaatctcagttcatcctcataataaacctgtgggtaagtattattgctaatttcagtttaaagaaattagcaataatacttgaggaaactgaggcctaaaacaggcaaagtaacttactccagttgcatggctaataacttgcaatttggactcaaattccaaagcctgtatgtttttactcgctaaagtttgtggtcttggccagcaaatttcaagaaggcctgtcataaagccgtgctgagagggccaccttacatgccaattacaaccttatttaaaatttaaagtacgttatttcttcctgaaatggaaaataaaccattagatatctacaatattactatgctttagagtcccaaaatcactcatgtataattagttatacccatgatgtaaatattttaaatattattaaatgccttactataaatattagaggctggaatagttaaacagccaattaactagctagtggccatctctttacctctcagcatttctactctgttatctgaaacaacccatacaagtatctaagtagaagtttagaaacaacggggctttggggagctgctgaggagggacactttgcaacctccaaaattactgcaaaactatgtgcatatgcctatccaatagtttttcagtaattttggaggtttcaaagtgtccctcctgcccagctccccaaagcccatacagaaacctatttgagaagctttcgatctaagaaatgggatctgggaccttaaaaaaaggctaaaactcaatggtctggatatttgtgagactatattccaaccagtacaccaggttactgcttcccagactctgttcttcaaaagacaatgtgtcaagtttccaaattatggggggcaagggtagtgaaaagtgagtgtgaacctaacagacaactaactgaatacttccctctgcatctggaggcttaggaattcagcagacagacataagcaaaccattctgtgaaattgttagggtgctattctttctgacattgtgttggtttcctattgaacatctgaagactgttttaacatgtgtgcctaaaaatgtcacactgaggctgagagagcacagagccaggggccacccagactttcaaatcagctctcagaagcagccagggaaattccaaccttggtcttgtggtcctcaagaactacagaagcatggcagaattttagattcacaggttgtttgtacagttagtgcatttatacctaactcctcaaagccagagatattttttataactcagcattgccctcattgctttcttatcacatattttgcatgtgtttccatctccaagattcagggaaaacaagatacttagttgggaatgtctagagtggagaccttataaaaattacttgacagacttgggagaggaaagcattttgcaaaacaccagctatgagaataaacaattttagagaatcccttggggacattttttttcctatggatcccaaaatcttttttaaatagaaacatctcaggcaggggtaagaaattattggttaagcccatttagaacgtgtacgctgtcatggaacattcctatcaatggggcacattgaaactctacactaagatatggtggggctgtggtgctttactggataaataagaaggggtttggtcgctatactcccaccctgcccataaatgagtaagcccgtgtgacaagagtacatgttttcgaaaagaaagaaactgtgaaactgagcgtcaccatcctgccacataaaaagcaacagaaatgagaattaaattcagcactttcttaatgggagactgaggaaatctgggagatgaaacagtagctcttctccagtccttcccagcataataaggtcagctgacaacactgttcgacagagaagacttaatgtgtctgacagatggcaaatacaccatattgacttttcttcctaatttaacaaatttgaatcttttgtcaattttctttccccagtgaaaagatattctaaaacaccacttaagcttacattgctcttttccccctctccctcttacacattaagtttgacactatctaaagaaactgaagctaactcactaaattaactcacctttccagctcttcatgatcatcacaaatttgggcattggcatgaatgttaattcctcatctctgccaactgtaaggcagatactcacttcaggccagaggaaggtggctgaatggacaacaaggattccttgaactcttaaaaataacacacaaaagtgtgcatctatattcttcatacttcaaaactatgtatctatgttcttcaagagtccccagttttgcccagttcctgaaggtataatgcctctggctttagctataggttgttataattagccctcattctacagtttctaaccggactttggaattttatggggtttgtctatataagatggatgggatgatagcagagaagagcttcaaactagtggagctcctggatcacaaagctgtgtaagtcatcccaagtgtgactcaagttcagcctggagaagccatggccaggccaaggatagcttgtcccacaaggaggcaaggggccgtttcccaccactgcctcatcccttccaccatgtgaggacacagggagaagatagcatctatgaaccagaaagtgggcattcaccagacaacaaagctgccagtgtcttgatcttgaacttcccagcctcaagaatgtgagaaaaaaatgttggtcgtttataagccacccagtttgtggtattaccttagagcatcccaaatgaactaaactactgttttcataatttacaatgtgtcctaaaattaattataatcctaactatgaacatgaaattctgccaatgtgaaaataacattagtttctcttgacaacctttgtagttatgttacccaaaagtatctatagacaaagcatctgaagattttagtggttattcactattataaacaacaaccacaaaaaacccaccaccaacaaaaaaaacactgggtccatggagaaataagtttgaaaaatatttcattatgcaaagtaaaatggatttattacaaaaaccttcttagagcatctcatggaaatggagtttagaagaatactatgctttagattattcctgaatccagacacattttttttaaattttaactcaaaggattaaaatttccacacttggaatgcccctgtatgaggaagaactgaacgctgtcctgtcttgtctaagtttcagagtaatccctatgtttctagctgattagctggtttcataaggcaaagggccttctgaaaatgggccattgcttctgtgacaaattcaatatccaaattctattgctgcccttgaactgtgctctctgatttcctgctgcaaaaatgtaggccatcagtggggacgtgaaaaatttgttcattacacacagattcccacagtggcagtgcctggccacattaccgaacctatagataacatcacagcacctgacatccagcccacatttcctcagcctcagagtaaagaacataccacggtgcccgcacattaacgcagagagatgcccttgataattaacagttcttatggagtctctcgaatgctaaatggtcaaatagagaagttaaacacacataaaacatttaatgtgaaatgaggcaaatatgccaaattaacctgaaatgcacacaaaagcctttcagctctggaatcgatattaatcattttctggaattcaagaaaaagtctgatgtggttaatttaaaattgtattttatgatagagaacaaaaatatcccacaggattcaaggtatcagtttacactactgccactcctttttgctgccagggtcagcaaaaagaaaaaaaaaattattgatctggtattaaaaatcagttgacttcacttctttctgaacaggtattctttgaccactaagcactggctagtcttacctctctctagtgacaacatgaagagataaatagactattcaaacagagctcttcgcgttacattagctgaataaatagtgatgtatggtctcttttctcaagcactgccttagcttgtgaagatgagagtgaggaagatggggcttatgaatcctatttgaatatttaaataaacacaaaataacatccctgaagatggttgtttaagtggaaaaagaaggtatgaaaatctgtcttttaattgtagcttttggggcaacaaaaaatcccccaagaaacttttgagattccagtgtcaagtgaaatcacagaagaaaaaaaaaattaatttgtggttttataagcagtatccagaggaaatgggatgccagtcccacagggttttcaaaggctgcaaagctagcacaaaccaattcacctaaagtgaagtatattatcaataactaactgtgatcactttttggccttccagctaagatcaagtgtaataactaactttactttgggaatatttcacaatgaatttttgccctctttaatctgctttaagatttctgtgctcaatttccggtatatgccgtacttgcagaaagggatgaagttctgagctaggttaagtgcttgtggctaactacaaatgtgttaacacaatgtaattaggtcatcaaacagcatcatgtttattaggtaccaatagataaaaaaagggagcaggcctagaccagcacatcagccccagtccctactgtcttggaactgggattctgagacatctccgtggcttctacacattactggcataattactaaatccaaagttttctatttgtaaattagagattctagcaaggaaaagatgaagtcctatgcatcgtgcattagccaggattctttttttgattttttttttcattctgttgcccaggctggagcacaatgccactatctcagctcactgcaacccccacctccctggctcaagcgatcctcccacctcagtcttccaagtagctgggactagaggcatgtgccaccatgcccagctaatatttgtattttttgtagacatggggtttggctacgttgcccaggctggcctcaaactcctgagctcaagcagtcggcccacctcagtctcccaaagtgctaggattagaggtatgtgccaccactcccagcaggtcaggactcttttggaacaaaaagaaggggtatatttattggttcacataaacacatcctcaggaatgttaaggcagaaccagtacagtcctaccttcctattggcagttttactttctatggtttcaagttgcctacaatcaactatggcctgaaaataagtgactagagtacaatattctgagagcaagaaaaagaccacaattattaactttgtactacaatatattggtatagttgtactattttattagtagtaattgatctcttactgtgtctaatttataaattaaacttcatcgtaactatgtacatataggaaaaaacagtacaaacagaatttggtaccatctgcagttttaggcatccgctggggtcttagaatgtattccctttagataaggcggactaatgtatagtcctttccctctccagtgttggcttcattctctcagaataaagatgacaacctggctgtggaaggtggcctcaggaagctcccaacctagtaatcagagaagaatgagaggattgccccattagtaccagaaaatccctatattagcaaagacagggacctgatttggtcaagtctccattcctgtattacccctgtggccaaaggggattgagtaactataattaatccagtcatgagggaggaagagttgctgcatagaccaaaaacaagagcctctacgtactgaagtgatagggcaaagaacatatatttacgaattataaccaagtctaaattgtattcgaattcctagaagatcaatgttacttaactttcctgtgaataatactcttgcctcttactaagtagcacactatccctaatattccaaggtgaaactcagtcactgagaattgggcatgctgcaccagactgttttcccagtagtagcaggagatatgctgaacctcatattctttctctttactgctttattatcattaatgccttagactgaatttctccagaactgatcatgagacaggaatctgagtacaaatggattatttgagagatgggcccaggaagcaccattaggggagaagtggaagtaagacaggggaaaaaagaaatctactacaagaaacatttataagaatattagtgcttcaagcaattggggctcaaatccactggggggggctctggaagacagcgtggaacatgctaccctctgagttttcgcacttacgacataggaagctggggaatttatcctcaaattcccactggtattggctaaacattgttcctaaagtcaataattcctgacactttaggcctacactctacaccagcaagagaaagccccagagtgcagagtaaaaggcatgtgaaatagaataaccttagcacatatgagaagggtgagtcccagagaatggaaccaaggcacacagccttggctaataccagtaacacacacttatgaaaatgtgccttcatttattcaaatacttaccaagctcctattaagtttgagttttcttctagatgatgggcatacactgagggacaaaacaaagattattgtcttatttaatacccagcacaactgggcggggcaggggcagattccaggggctacatgtcataatcctcttcacaacagcaacttcaaatgtggtccctaatcttaagagtagcagcagggtcagcagtattgggcttcaccattactaagccaggtgtgttgaggtctatgatccagtaatgaacctgaatcagaaatggaatctcagataggtattggaaaagtgggagagttcccatcgtaggacagtgagttacattttgtttaggaaactcttcagggacatcttctctgtggtggcttgtgtccagaggcactgcagagttgcctgctctaactcttgacagttgagtggggcatgcagcttctggacatggaaaggactaaagttaatttgcccatctggggattgaactggcatcagtgacttcaaatgtgccctgcagagcccaaatgatctccattacaaacacagaatgctccgccttccaaatgccacagaattccattttatctgcactggcagggtaaggcagagtatttgccaaaactccagacatagggggttatttgtaaaaccttagagtattatcaggtgttgctttcaataaaccattacacttgtatagaaagtaacaaactacgtggtctaaggaccagttatccctattccaaaaaataaagtgtaagtaagtaaagcaattttacattgaatcttgaacatctatgtacataatttagaatttgctaaaaggtaattttatctgtgctgattatctttaccatttggcatttcccatctcagggcaatgagtacaacttcacaagtccagctccgcttagctgtgagtactcaatttcactaaagacttaaacagaaaattaaaaatctgtgagaattgggatgagtcctgtctgtcttaaagcagggtgagcaaatatatgtggcacatgcccttaagagacattattaattgatcacctctcactttcacactgagcctaggctgaaccttagaatccgtcacagcgcaggtgtccactcagtcatgactggccttccagaactgggtactggaaatgaaacctacttgacacttaggatacatttatagagcctggtcccctcagtactatactcccctctcacaaacagagagagagaaaaaaaagaggaagaggagagcagagaaaggatgggggaaggaatgagaggaagaaaaaaaactctgaaccaagtatcacttcctttgcggtctgcacatgtcaaggaatactccattttaagcatattataacggcaaaaagaaaaaagcactatcaatagcggttcacactttatggctgctcaccctgaaactgtagcagctaactttcttgggaaaactcagacagactcattctttccaaaaacaaggaaagaagaaaaagaatttcccacatccttaagataactgagaagctctcagtaggagtaaactgtccaaataaaattcaacggcaccccctttggaaggatagttaagaaacaccacatgtacaaagaaggattaagattccaaatactgtcttttctccaactcgatttttccttcttgtgcccttacttctcaaacagttattccctttgctatatcacccagaagtctgtgattggatctcccttggactccaaagggctctgggtatgagaaagtagtccaaaatatatatatatatatatatatatatatatatatatatatatacacacacacacacacacacacacacacatatatacacacacacacacacacacacatatatatgtgtacatatatgtctaggatttactatagaaaatttttaaaatatttttatgtatttatatttataatatatttacatatttagttttatatatatttatataaatatatacatatatttatataaatatatacatatatttatatatatataaatatatttatataaatatataaatatatatatataaatatattttgtattatatattaaaatatatacgtatatatgtgtatatatgtataggatttactatagaaaaatatttcatatttttatatattcatatattttatattatatattaaaaatatatgtacgtatgtataggatttatatacatatatgtatatatgtataggatttactatagaaaaatattttatattttatatatattaaaaaataaaaaaataaaaatataaaatatataaaatatataaaaatataaaatatatctatatatatctatattatatatagatatgaagatataaaaaatctatatattttatatagatataaaatatataattatataaataatatagacataaaaatatatatttatatattttttctataggaaatcctatatatatttatttatttatttaggactgcttttcctgaaactctgtaaaagttttcatcatactagctatttcttgtgatgagccagatcatcattcacctggtataaatgagcttggctgtgaacacggttagaaattagagccaaggatgatctattagttcatcgtgtgtgtctcatgggacaaaagcaaatgtgtttctctaaagagttttcttgaatggtttcccaagtccaacttgaaatcacattcacaatcttgtcattttcctctttcttgcagcacaccagtaattagatgttttaacacgtcatggcaatgatatctaacatgaaggcaaactgtattaagacacagcatcacccagttttatactgtaagctcatttccaaacattatttgtttttataaatttgagcgaggctgactctttcctctctgcctttaattaataaggaaagcttaatatgcacttttttttcatcaatctggcactaaaaatcctgaattccttttgtagtaatttgaaagaagagtttggggctattaggagaaattcacattaggcatttccctacatggcctacttatgtttttcaaagtgaagggatatttcaaggaaagaaagacttggggtactagagatgtctgccccatctaaagtcttatttttctatttcctatatcaagaagccttaggtacattttagtaacatagcttgaaatatattttgaaaaggggaacaagacgtaacctgacccactacagaaaaatgcctcatgtagatccttgaatgaatttatgactgtaaaagtccctctcttttgtttcctgggtaattatttcacacatttgggaggtttatagggaatgcgtatcagcttttcaagtaaaaagtgtgagtctctgactcttcctggaaatctggaagcaacagagaatgagaaattctcaggcagcctccaaaattgagcaagagatactgcaggtcaccttcagtgctgaatattccaaagttaacttcgttaaaaatgcacaaacaacctgataaaatatctgattttaccttttaaaagtaggattaaaaatttaggaagcttcgtgacttactctcgcatctctctttgatatttctttgtttggtatttctctcacctcttatgccctggtggagtctattgttggtttatgtgtaacatgatcgaataaagcaaaattgtaaacattttctttttaaataaatagacttttacctgaacattataatcacagtatctcattcatccattcactcattcattcatccatctattcattcattcacccattcatttattcactcaggtattttctgagttctttctgtgtatctggcgctcctctaagcagtggggatacacatgtcccctgttctcatgagcttacagtctcctggtgaaggattttaatcaaatcatcacacttgtgcctaagggtttcaaactgagataaggatctcaaaataaaggagcaaacacccgaaggatcaaggacgacttccctgtgggggtggtccctgagccaagggcttcagcagaagcagaggttaagtaagtaggaagtaggacaagccctccaagataggggaatgcagttagggcctcgagcaggaggaaacaggggcaaagctctgaaagtaaaggacaggtagtatttgctgagctactctaagacagattctcccacctatgctgacagcatgcacaatttcagctcaatgaatacaaatgaatgctctaagtattttttagattctctagattatgcacattgaggagcagtttggggtagggatgatggaggtctggccattagactcaggctttaaagaggttctgggaaggggagccaatctgaagtacctggaaattggaaaaaatagatgaacagtgattttatctggcttccaatggcagataaatttcctttcgggaaaggcagatattctcatttcaagccaggctcctctgccctcactttagcatatgaggaaactgagctcttgagttcctggaaacctttgagaatatggagacagccttttcactaggtcagtttagcttcagagggaatgagatggctgacttcccccacacattaggactttcattccaaccctcggccagcacctagggaacaaagcaaggccccagctttagttctacttaaagtgagacactgcttgctctttcacactcaggttaacattcactccaacaatgagttcagaagtgaccatgggaagacaagaggctttccaaataactacctcaccatggcacagggtctctgagggctgggcatgttagagtctgagatataaaacacagtataaagaacgttctattttgcaaaacaatcacattctacaatctatacctaagtaacaggaagagagcagatctcattatgtcccttctacaagaagaacatctgcattgagttgggtgtcttcatagggagtcattctcagggaacgtgaagcttcctccccatcaccctgacctcccttcccctgtaaatttccacattgattgattgtaaacaaattgtgttcatctgcccagattccattatatcaaaaagacatactcctctccacaaatatcggagatagacagacagataaagaggattactttccagtagcaggggttcctccccactcttcctccacagagaactttatttctagtacatagtagaagaaagagtcaagagacggatgagaagacaaactcagcaaagccttatttttatgctgctgttgtttttaacctttagtgggaagtaataggagacctcatactttatgaagcctttttgtatctggtggtagtttttaaaaagaccatcagctaaaatataaatataaatttaaccatggatgattgtaatttcctgcattatatttttatgtattttcgaaaagtatctgtaatgagcgagtatcatctctgtaatcagaaaagaaactatgaaaatatccccagtgagatctgtgtttgctcacagggcactatttggcatgatgagagtgaggggaatgatctgaatgttttcagtgccaagcaccatgttggcctcaatcggtagcaattctaattctttttcctgtggatttgtatcagttgctggttcatttaaatcagctattaaaggaataaacatgaatcttaaaaatacatttagagaaagtatattgttctaaattaagcaagcagttggcatttcaaatcatatggaagcagatgaggggaacccgctctcaccagatctcaatccactttgcaaactgcttactccttaacttggctccctaattagggcattttatctttgtgagcatttaccattactgcatcatgataactcttggctagtattctgtgaagaaataattaataataatccacaccagccaaaagtagatagagcaacatgagcaaagaactaggttggtgtgatgtggctcaataaccacttggggaaaaacaatgagagggtttttattgaccaaagtggtttaacaaatgacacttaagtgatctactggcattttagaacagaggcaagactgctcactcattaagtcattttaaaaatagtcattatagagcttttgccataaatcaagaacaaaagattccaggaaataattttttataattcataaacacatagtaatgtggaaagaaggactctatagagttgaacagggttatcaattacattttccagttgtctatcctagagacaacattccttccgtgagttcaaaccttaaacatccagatgaggtattgtgggtaaacttgaggattgacacacttcagcagactaccagctccatgagatcaagggccacatctgttttatttagcgagaagcagaattaggccatgtgtgacagtgggtgttactcagcaggtgctcagtgaataatgaatggattaatgacattgtatagtagtgtctgactttgcaaacagaaaatcacagcctttgtgaatgtaaatttacacagtaaacccaataccatatagacttttagtgatattttggtatttagaaaaaagactaagatcttctccaggtagaaaggtattttgtcaagtatttgctgtgtgtgtttgacttgttttggcctgcaatgtaaatgatcctgatagacatctagttctactgggttccacagcacttctttagccagtggggtcttgtattcaacttgtatttatcacgtccttctaatttcacttgtctcaccctggctgttattataatcccaaacagacagatacattagtaccccaggcttaagtctcatcctattcattgctatcgggttattctctaggaagcatctttcttttcatcttagtcccttcttccttccttccatcagtcctgaatgctttctgagtcaaattccgagagcagaccctggctcctgaatctttttatgctcagaccctgcaactgctcaacagtcgttgtctccctgatcctcttcacacagccatatgtcggccaagatgctcaactcactactgccacctttatacctaggctcatgccagtccctttgcagagaaagagaaacacagagggagagagaaacacagagtcttgagtccctggatcaagccatacctgaagtcagaaacttcccttgaactctttaattatgtgacccaataaatcatccatttactgtagccagtttgggttttctgacacttgcaactgaaagagtctttaacgtatgcagggaagaggagatgaggaagagaggaacataaaaatgaagtaaaacgaaacagaggaagaaaacaatgaaagatttgtccaaggctgtagaactaaacagtattggataagaatatagaacatgaagcccagagcccaagactctttcccctactacttcccttcagaaattagtactattactcattgccacacattgttactttaaacctaaccaaatgagaagtgacctgccatcaagctcccgcaggtttaagacatatatttgtcctgagtaacttatattgttttcctggcgtagtacatttaagaattacttttacaattaagctgcccaaggggtctatagatgcccgttttaatttaaataaatactaatgctaaaatcaatttgtaggatatttcaattggaccgataagtacagtcttcactaaatccaaagtatttccctattagcgcatctttagaagcgtataccaacaacacatcaggattttcagaaacctgctacaaatacattactcccagagactggatcaaacagctgatgatcaaaacataaggcaaaaactagtatttcatctttgaattcggagtacctgatttctactaaatattgattagagtttttcccataagagatcctgctttgtgcctccttaattttcttggtttcaatagtgctttgtgcagagaacagcagaagtaaggcagaggatacagctgtcatctgtgccacagacattgacatgcagcttagtcacagaacagagagaacacgtgaaagtcaccatcacaccctcgcaacagtgtcagtgtaaagactcaggttccagatatgaagacaggactgaaaatgcttctggctacaatgaaatgaatctaccacacacttgccaactttattcaaactgatgatatttttctttaaacaatggatttagttattctacccgtaagaagtccaggtcgttaatgaaatgataattttctacaaactaaaaacaaacatatctcatcctactaatggttcctgcctctccaatatttcacttaggccatctcccttttctcttctggtagaacaacttcaataggtaagaaagttttcttacatccgggaaatttctttaaccaccaaaatccatggtgtttgcttttcatcttcaactcactccttggtcgttacgacatgttgcctcctatttctggttatctatgttagtttcctgctcttcctacagaattgcaaccccggaaagagaggtactgagtctcacacaccttcttcacctggagcttgtaacaacatcctacaaagcaagtaatcaacatgtgttttacagagaaaactggttatccctggactgtattaaaacagtggtatgggtactctaaaataacaccaatgtgagtgtagaatgcatttctcatttaagagaggtgttcattcagcctgaggatgggagaatttacgaaacctcaaaccccaattggcaaacagcctctctaccttcccagtttacaaaaccctacctgagagaaggtgtcttctctcaaatgaagacttccagatcctgttctccacagacaattaaatgtggtttaaaagttgctgctgggagctgaggttattacccactttctgatgaggccggcgccaccaaaaccagcctgtgggagctgatttcactaggactcccccaacattttcttgatgttggaggtgtaacggggtctcagttcctgttcaactctgcctctgactggattctaggtcttgagcaagtcactgcttccctctgaacctcagttaacctcatctttaacatggggataaaattcctggcaccatagctacctcactcaatgctggggaaaattaataatattgatagtgttaataattaaataatagctaacatgcactgagttataccatattctaggcactgtgataagtcccatacctcccttaactcttactattctcataactactctatgacaccaagcaccatcattatgtctcttttacagatgaggaaagtgaagctcagagatgttaaataacttgtccaggatcacagagctaggaagaagcagagcaatatttgaacactggcattgtgggttacaaagcattactcccagaatactgccttacaaaaataagataagccatgtgacacaaaaatcttcacaaactgcaaaatattaagccactgtaaagtactgttaccatcaatgcaaatagatgctcattacatttattgtaaaaagcaggtaaccaccaacccgtttagggaaggtgcataaacctctgtcagcaatactcaatccatctgcagagaaacaattagaactgcattagcacataatcacagaagaagttctcttgacaccatttctgccaaagaactcattcttccctggaatttgaaaaggcaaaaagaaaaaaatcccatgccgcatctgacaataggaacaaactcttcttgcagctctggtaatgcaacacttctgaaagaacaagttaaggaacgtacttccactgccctcattagctgacaacctctgtggggactgcaaaccagccacacattcaaaacaaatcccagggaagaaatcacaccacaaagcctgtttctatttgcaagtaaaatgacggccccaagtgtctttccataaagctgtgtggtaccaaatccaaagcccaaactggttacaaagggtcgccattgataagacatggcatttcaggtccacccaccatgggccaaggaggtataaagctcagaacgtgacatgcaatttttaagccctcctttcaccttgtctatgcactaagttactttgacgccacacctgtttctattctgcctggaagccctgtctgcacaacagatggcagagtgtttgcctaacaaatgttcttgtgggtcagtataagaaggtggtggtggggattgttgtgggtacgaaaggagagaggctctgctagagcagcaaagaaccatcgatctccaacttagctagggaaacttcccacccaatgagggtctgggtatgtctgagctctgaatgttctcacctctgttcatcccttctgacaatcttgtccaggatagtacaaatctgctgctgcaaccggaaattacaaagaaaatctgatgtaggcatttagaaaaaaaaaacaacagaacaaaaccttatcaaatttaaaagttaacttcaaattcaattctaactctatctccaacttagctctcttgaatctaactgaagattcaactttcttaactctaaacttaacccttgaatcccaactcctagctttcacctctcaagtgtcttaactctaacttaaagtcaaacttagtctcttgaggaggtaattaaacttcaacaactaattggaatgagttcttgtgaactgagagcttggcttatcaacacatctggtcttcagaggttaagaaaaaactcactttctgttattgtaaacttaacaccagagtaatgttttatttcagctatgatggtaatattttttaaattatgctattatccacttaaaaaatccatgatgtaaggtataaagtaacataatgctccttgatggtgaaagcacatcttaggcaccatgctttggagaaaaactgtggatctggagggaatctcctcctcccaccctaaaccacacatacctaaaccacacacagcaccgggtatacctcagtcttcaacataaagaaccaactcggcacgttccatttcatttgactcacttgcttagatagcttaggaaaccaatctgctcaacattagtaagtctgggcccattaaaaggggactgacactaaactgaaatccatttcatctcttctccagggttttcctcggactctctgatcagcctttccttcacacaggggtgaggccaaaactactatagatgaagaagaagagagtgagatgatgttctttttgagggccaggatgacactggctttgtccagtgttttcatcacagaaattgaagtgggcatgtagtaggttctcaaaaaaacaaaacaaaactggtgaataaagacgatgtgtgctaagcactaagcagagacctccccattcgtgctcttatttaatactcacaaaatcctaacagcagggggtattattattccaattttgcaaccaaggaaacacatgcaaatagctaacagtggacagcatcagatttaaatacttaaagcatgcatttcccatgagtgagagagacattttgcaaacatgggtagaatgtggctttgtgacttgcctcaagattcaccccatcaatttaggcaaaaaatacaatcttccctgactatttagttggaagataacaagtcagggaaattcagtctagcagtccatgggtaagcctcaggggaataggaggcccctgaaattaaatgcgacattttgtgtgtatgtgaatttttccatggaaaaagtctgcagctttcgaatacttgaaagattctatggtcctcccagcccacaaaatttaatgacttagctgcttttaattaaagttatgcttctaattctcatccccaaagagtccaaagggctccagacaccctttgtatgcctactgaaagaaaaatgattagcatgaaagcctggtgggtattagacatgagaatagtcaaacaccttaggtatggaaagcacccacatagatcattacttaacgaagaaaagtaattgagaatgtattccattgctagcatttgtccacaatgagattgagaagccattctattgctgaccagatggtcctgaggatagtgaaatgacagaacccctgtatcactcatcagattcactgctcttcaaaatatgaaaaagaaccaacaaaatcctcattatgacagtgcctacaaacaagatccttctgaccatttcacattctgcaaacttcatctgcaataagaatgtccagacctgaggctctatacttggtgaaaccatgctcatgttcaaaaagcatttattgagagcctactatattctaagtaccgcaataaatacttgttcctataccatctggatgccctcatgtgattctaggcaacacgtttaaaagagaacagtcaccaaatagagaaccctgagatgggaggaaccagtttgggaaagggataaaaatcatgccatgtacacagccaaaggcattgatgattctttaaagggaaagtaatacattttctttcaacttctacaaagtttctaggtagaagaagaaatagagaatcaatccaaattgccagagaagtctgaaagaggaccacaaggtaaatatttcagagaagcaaagtgttggttcacaataataaaaagaaagaaaggaaatgaaaaagcaaactattatagctggggttattcaacaatggaataagacagctggtaaaatgttagtcgttgctggaggaatttgaaatgcatttatatgttaaaagcactaaagctaaaactataaaaccaaaagatgggttagtacaagatgattgtcctaaaatacaaagaaacacacattgtcagtatgtgaaccttaaaaactaatgttggttattctgtttaaagagaagaatgtgatgttcacaaatcaacttatcacaaattacatgcttactctagtaatgtaatgaccttgggagctgactcatagtcttccttgacctaatgagcatgctgagtataatcaattaggtttgcaattaaaattgcaatttatctaacacccccctctacccccacctttttataaggctcaggagacagtggggtgataaatataagcccttctgctgtggctatcttttattttttaagcatttctattacgtataatttattaaaccttaaatttcttccctatttgtaagtttcagcaaaatttagtcaggtttcaacacagggtatcaagggataattaggacagttagcagtaatttatcatttctcagctgggttttcatgctttcgctgactgcccgtagaaatctgttagccacttctacacagatcactatgaaatctgctttatctttgtgcaaattgcttttctattttcctaaagtgagctgaaagatgagccaatcgactcctgaaaatctagccaccggtgtgcttgtcatcagagtgcagctgaggccagggccgcagatgaagggctacagtggctaatggatgatgcaatgccatgagaggcttttttccagcctgctgcgggttagaaatttaaaccaggcagcccgacttcaggttagatcttcacaaaatatgcccaggaatctatgaacatgccaatacacattttatggagcaaatattgcctagtaagccaccagagaggaaaagcctagaaaaggcagagacactagtactataccacttccactgaaaagagggattttatgaagcctgaaccaaaaagggaggacctcgtgttctttagagagattcatttactagatggtgaaaaatgaatgcttcgggtaatttcattttgaattgatttatttctaaatggggggaaactgacacttggtgaagaaagtaacaagtggttctctggaaagagccagccagtctcaggtataatccaattattccaacacaggaaataaggacacagagggaagggtggaaggtcacctgagaaagtcattccttgcaatgaataccttcctgtccccttccctacagactctcagagaagtataaactgacccatatttccagtttatttctgacacctaaacctaatcaaagtccactatttagaaatccaatagttattcgcaattagactgcacggcaaattaaatcataaatttctctatctcagccctggttgtcacattcctaaaacacaacttgcctccctccggcactttatttaaatctctgaggccgggctccaaagcaagttatggatttgataatttgctaatgtggccacagtaattgttttgagccatatttatgattttattggatcttacaacaatcaataataatccattgatgtccctgactcgggttttctcgcagtcgacaaatggggcagcagattcatttttaatgtactcacttagcactccctccctgggagagagagccctgcatattttaaaaaagggcaagaaatgaatggcactggtacacatactttactgtgaaaaactagctgcaggataagatttaatgctaaaaagaaaggagagaatagactaacagggcccattttgtgcagcaccaccatcgttaaagttaatggaattaccgtgtggtcacgcactagagggaacctattggaagttaagctcttctagggccattgattcacagactttcattcaaagattcccactagcatgtgatgagtattgcagatatgcagaggcactttagaaactgtttactcaaactgccagttaagcatattaagaaacaacaataactgaatattttagagtggatgatctagtggaacgtgtcttctgttagacatagtaaaaacttcaactccgactggcttaaacaatagaggactttattggtcacctaatttttttcaggctggagtgcagtggtgcaatttcagctcgctgcaccctctgccgcctcccaggttcaagtgattcttgtgcctcagcctcccaagtagctgggattacaggggtgtgccaccacacctggctaatttttgtagttttagtagagacagggtttcaccatgttggacaggctggtcttcaactcctgacctcaggtaatccgcccacctcagcttcccaaagtgctgggattacaggtgtgagccactgttcctggccagatcacctaatttaaatgtctggaagtaatgcaggcttcaagtctggttaattcaacaatccaataatgtcacctagtgtccagcttctttctgtctctgccatgtcagcctcagcatctgttttgctctgaggcatgttgccctagaaaatataagatggctgctagaagctgtcagttacctgctttcttgttcataagcagtagtggagaaaacagcccatccacaactaatgcatctaagtcctccatgatgatgggactccgatcctttagagtgtaggattcctaaagtcaagggaatcctacactctaaatagcttaggaaaggattaatgaaagtcattactgtggcagagacaactgacttagactgggatgggcaaattatggccctcaggccaaatttggcccaccatctgcttttacaaataaagttttattggaatacggccatgcttatttgtgacaattcattttcatatattctatggcttcttttgtgctgtaaagtcagatacataattatgacaaagaccatctggccctcacagcctaaaatgtttactatctggccttttacaaaagaagtctgccaacccctggtgtgtaccaaacaaggtctgcacctggagctaaagatgagttcaaacccatcctaattttgtggctactaaatcaagagggagggtaggaagaatgctagagggacaaccacagtgcctaagatagacatgagagaaaatccttcaagtctagaaaaatgggcttagaaactaaaaaaaaaaacaatttaggaaacctatcataagcacatgtgaaataccctctgccctgaaatacactctgagtatcatcaaaacatcaaatatatttaaaattgaattacaattccttaccacagcataagtcccagtgtaacggctccccgcccactcttcccacttctctcctgctgccactctccctacactaaatttctgccacctggtcttcaattatttcctagaatgtgccaagctcattcccactgccatttcctcttcccagaatggtctttcttctccagctcttcgctggctaggcgcctgtcgttccctgttctgggtttatgggttatctcttcagtgaccaccccatctaaagtagccataccaccccattccccttccaccatgtcattccatttcataacaccttgttttagtctttctagtattaacccaaatctgcaatattttatttgttccctttcacataaggggaagaagacaatacactgagagtttttcctaggctgtcttgccttccactttaacccagtgcctgggagcacatggcacatagtaggcactcaataaacacttattggagtaatatgttaatattaactatagaatttctacaactttttcagccttcctgcattatggtgttcatttcaaagtctgtacttgaaaacaaggactacgtctcattcttcttaggttctcagagcctgtgacgatatctggcacatagtaggtgatagaagaataaattaatgaatgaatgccagatagaaaaacatgagtaggcaggatactcatttcctggaagggaggaacagactactttggtagtgaggaaatcgagatcagagcgattcagaactggaagcagctacctcacagtgctttgagtttccaggtatagaggaagatgaaagacagacttaaatgctacaggggtgattaactgtcaagtagtggatgatgctaatgacttttaaggtcacttgctcctctgggattttcttgaattatcccgtgctctgagtttcttccttaaagagtgagattcatcgatggtcatctgatagtggagcagagcttggagtcacatttattccttccttggccaaacagtttcatcaaaattatactgctagaacctgattacgtctgggaatttataccatttacaaccaacagacgaatttaaacgcaaataaaagcccctggtgagctgtttgtcagggcaccaggatggaaagcatgataagaaaatattttgtgggggaacacgaactgatatatggaccccagagtgggagacttgaatgtgaacgttaggataaatgaattccaccacaaagtaaaagaatatttggtgtgttcactttgttaactcaatgttgtttattcttctcaaccaccctaggcagggtcaacatcttaaagaattccatcttcatttttcatgtaacgtcaggaaccaggaagacttgtttaaaagaataaactaccagggaaagaaatggaagttttcattactggaatccaataatattatctttatgttgaataagcctagaatttcaaaccactgtttgtgtgtgtttttttgtttgttgttgtttgtttgtttgtttgttgcccttccctcctgaggttttggattaatctgatggagaaggcttccgaagatatatgtctcaacttccctgattttggtgaacaagaggcttctttggagaacggatctattagacaataaggtaggatggatgcctcatgacatgggaagttaaaatttcaaaatgaccctttcccagcactaacataattgacttagaaggagggaaaggattcctcaccatgtttggcctgagggccattatagagtctcaccatcccaacatttttcactcaaatgtcctcaggaaggtcattattctaattcttccacatctgtggctctgcaggttgccttgtctattattcattaagctggtttccatctgaccctggctcagccatgaaatctttaccttttccagctgctttttgtgtcttgagacttactttattaatgactttggcataaagggtaaagagaagcgcctgaggggactgaataatttgagatgagtatcaagaaagaatcaagtccaggtcatctagaccaagaatcaaaatatatttataaaaataaacaaatgaaattgcagttgatattctgggtaaccatcagaatcaactgtggacctttcaagaagctacttcatgggccccaccctcagagattggaaaataggaggcatgagaactagctatatgctaaagataataaagcaaagagaatgaattataatagtcatttcttaatggaaagtgcttcaaatggggcccttggtttttcttttaaaatgcactttaaataatagaatcaacaaccatgtacacattacccaatttaaaaataaaacactgtaaagccgaaaccctcaggtacaattcacatcccacattgcactgcttcccctcactatctccacccagaggcagtaagaatgttatctgtgtccttccttctaagccatatatagatctacatgtttataaattatatggcagcctataagcaacctgttcttttattttattatttcctgctgttaataactactagtcaaaagtttgtagcatttggatctgtttcagctaaaaggcccaatttcaatcaaggcacacattattgtatggtctttcattccccattctgtatttaaggatgtggtgtagtctaaaacaaatggttccagagcactttaagaggccaaggcaggaggatcacttgatgtcaggagtttgagaccagcctggccaacatgatgaaacctcatctctattaaaaatacaaataatagctaggcatggtggctcgggcctgtagtcctagttactcaggagggtgaggtgggaggattatttgaacccgggaggcagaggttttaataagccgagatcacaccactgcacttcagcctgggcaacaaagcgagactctgtctcaaaaaaataaaaataaaacaaatggctcatctactgaggttgaattggccactaatatttaatcaaaagtactgaatctttctcacatgattaattgggctgcatttattttacttttttttttttttttaacagaattgacagtttggccagccaagtatttggatatcacaggtttaaaattttgaaattagaatgagctgattacatggagttagagatttttatatttgatttcctaggcttgaaacacccatagcaaaatggtgaggcagagtagtgctccttcaatgattagttattgagcactagtatcctatagcaaaatgacaacagtgagtaaccggccttactacatcaacaaaggtaagactctgactgaataataacgccttacatttaggtggtattttagggtctacaaaacacttgcctttcacaggaggtttgacttcacagtgattaagtagaaattacaggctctgagcctcaggtgtaaaagacagtttactgaatcctataaaacactgaatgtccctactatatgtgccacgtgtcggcattacaaatagcaaaataaattaaacagccaaatatccactttgctatatgtcagggcctctaattactgaggggatttgtttggtagtactaatgaaaaattaaacactaaaagcatataattctgccataaattgacatacagcaataaagcagcatttaggttaagcttcacctgtgtaataaacagggattgtcctctggatatttttagatggaaaccaacattattccaagcagagcaaaataatacagattaatatgtggtaagggtgacaaaatatttacaaaacctgtgcttgagtttcttctactgtgattacaggatacaacatatttctttaggaacagcctggtcatatgatataatgaagagttgaaattttggataggcttgggtttgaatcccaattccactatctgtcaactgtgcttttccagtatgtgattttttttctttaaacctcagtttccctaagtgtaaaatattaatgcctacttttgcaggttgttgtgaggactgaagtaagaattataaaactaatggtgaacatgtattgagactttactatgtgccaggcactattttacagggatttacatgcattaatccatttggtcctcacaacactcccaagagacaggatactcttaagacctccattttctaagtttatgaatgaatgtgggggagctcagaaaggttaactcgcccagggttcatgcacctggtaggcgacagctctgggtttgaaaccaagtagtctggccccagagtcctccctcttcatcagtatgctttaacttccctgcattttcttctcaccctcatccctgcttcaggatctctctcatctctttcaccttagctgcctttgagtttgaatgaacagggaaaaagtaaataagaacgtgaaaatactagggagcttggttaatttttctttcagtgctttgatccaaatggtatcatgcaaatcaaagttaacaaactagaaacggaaaaactcaatgatttgtatctacttaggaaagggcctgagggtttagtaggagagaggaagtttcccaaaggagacaggcaggcccccagccccttctgcctggagagctggggactgggggttttgcctcaaatcaccaggagcgggagagggaggggaagtcagagatatttacatgccagaggaaaagggcttggaacctcaacacttctctaaggcgtccactcccacatgtacacccaaacccatccccctgagcactgcagttgtctttggtttaccaacccagtcaaactggattcattctgagggcagagatgcaaattttaaggcaattatacaagataaaagctacagcatcctgaagataccaattcttcatgcaggaaatacatgcattaggtattaacatagtcagggcactgttcaccatggctgtaatgaaaggataaaagtcctatggcaaatcacatctctcttggagtgtctttccaaatgaaaataataagtaacggtaaaagaaaatcattttcatcctcaagataaggctttctctctttctgtacacatcaaatctttcctagaaattggtttgggttgagagcagcagccccctacaagtgcttcttatcactcctttaggaaagcagcttcagaaaagtgaagtgtgcatcagaatcacttgtggtgtctgttaggacagagtcctaggccccacatcagaactaccgagtcagcaaagcatggggcaggcaggcttctgtcctatggctaccttcttcaggtaactgtgaagtactctatcgatttgtaaccgcgacttactcgtgatcatctgtgcatacaccagaggctaaaaatgttcggacagagagggccagtattattttccccaattaagaaggcagatttctgaattttcaaagtgtcatttttataagttcagataagatatttaaatagcacaagtcatataatcagagtaaagttttctcaagaatttaaccaaaaggcagtcattcgtagcgagagaattcagtgtataataattaagggaatttggcagcaccacaaaccatctcaatgctagttacaaccccttaaagcctagccacaatctattttatagatgagaaactgagattgagattaacgttaagaaacatgtacgaggtccaagggccatgatgtggcagggccgggatttgaactggggtggactggtcagattctatatccatgtccaaatcctagccaatctctgctacatataccatgtactgaacatcaatacgtcagtttttctccactatcattcaatataatagatagggtttccgcattcaaaaaaaaaaaacaaggaaattgatgttcagagaggctaaaaggctgatccaaaggtgcacagttaggaagttaatatggctaatattcctaacggaacctctgatgccaaagtatgttaactactagacttaattaagagataaaatgtcctcattttcatgaatctgaaagattaccaaattttcaggtggaaaatttgttctagaaccacagaaacttctcagtgaacagaagagcttcctttttatctcatttaatttttgaattatacttctacaaataattatcttcttcttctagagcaatctaaaaagtaatttctaatatcttaaaagttattaacagctacttcccactgcgttaatactataaaattaaatttctaagtagaagattcaagtaccataaacatagaagagtgtaagcaagcataatctataaacagttcttacaagattccagattacctgcctggaataaatctgtccttaatatacctaaaaccgcctcccacccaaagatgaacataccaattgttctaaaagatagctcacatttaacttattaagcagcatcgcttctaaagaaatgaatattgccttaatggttagattagatggaattacattttggaacatgatttgagaacttgattcgtggaaattttagtcttcgttagtaacacctggaatatagaagacttttgatagagattccaggaatattgctgactgcatgctggaatacacatacatatcgtcttctacttcatgttaactaaagttagaaacttatgagattcgttccaacaagcaacaagcaaagttccattatcatcatcattctcttccccacacaaaagaggcatagaaaataaaccggagaaaaagctgtgtcatttccttacccattgcccggttcatggctcagacccctgtaacacaatacagattaacgagaggaaagcctaacgaatatatttaatataaattttatgtgccatgggagcctttagaaataaagacctaaagacaactgtgtatttttacggacagtcatgcagaagtatgattggatgataaaagagtatgacttgatggtaataaattggggaaaacttagcaaggcctgtgtgttcagattcttcttggcatgtgagtagagggcagaactcctctggaatgaaggtcttatgacctacttgcatgggtgttaggtcagagaattcttttatggcacacttgagggtagacaaatggaaaaaggtcagagagtgatgttcctgcttctgtagttttctcagtttccttcaccttaaaatactcagtatgcagagctagcatattttgggggtagcgtgtcctgagacctatcataaacaatgacaaaatccaggtcctcacaaagcttaccttctcaaagaactagagaaaagacagaggtacaggtgcatagccaaacaaacaaaagacaatgaagaatgcctcgagagaaatcaaatcatgcaccaggacagagagtaggggctttaggagagctacttcagatgaagggtcagggaggctgtttggatctgtatggttgaagatgaaagaaaaagattatttctcaagcctgcaggacatcaaactgctgcaataatcaccttgtggatggcagggttctactccttttaaacccaaaaaggagagttaataatcaattgtgaaataagaggtcacttttttactttgatatttccctttcctgactacaagtgccttactgagtaagcaaggccacgcttgttctttgcaaagcagaatttaaagcccctgaaacaaaaaaaccctacagtggtatcatgttcaagaggctaactcagtggtgcaccttcattaacgataacaacaggtgctccaggggaaaagaccattactgggcttattgctattaccactcagcatgagacaaaaatggtttagaacccagggatcaggcagaatctcaagaatgagacacagaggcaaagatgaagagaacagtcactgtgctttccatggcaggttgtcaaatgctgccttaaaatgtgcaactgtgtgaattccaaaatatgaaatgctcagaggcttgaattgtagtattcacaactggacagctgaatattaaagatgctgctttgtcccctagaggggctggctactgcaagactggcttccaggggtcataattatgtggccattgccactcaatattttatcatcatacaatactgaggctggcaaatatctatcacgggatgtgcttgttaataatgaagattcccaagccccagtcacagtattctaaataagtagatttggaataagaactgagaatcaactttttgttgttgttaactgataccaaagttaattttcatgcaggtgatacaaagatcgcattttgaaaagcagattcaacaactttagatatggatactttgtctaaaaggacagctttggaaccttcattgttctctgggattttatgtgtgtgtgtgtgtgtgtgtgtgtgtgtgtgtgtgtgtgtgtgtgtgtgtgtgtgtgtgtgtgtatggtggttttcttataaccaccatattctacaaacgagtcaagatatccccattatttcatatcaggaaacttctgtgatcaggttggaaacaactgaaagatgtgcaaaacagcataacctgctgatttaaaaaacagaatcgttttaaaaagttcaacttaagctaaataatcagggtgatgataacaataaccacattcaacaattcatatataagtactatatgttaagaattagtccatcatcatcaccatcaaaggtaacaaaaacattacacattttggccagataattgggacatcaaaaagtaattactattggagttacacaatctgtagccatagttatcagcccagctaggctcactgcttatttgttttgtgtgtgtgtgtttattatttttagtcaagagataattcaaatatgataaaattcaccattttaaaacgtacaattcagtggctttattatattcacaatgttgcacaaccatcaccactaagtccacaacgttttcattaccctaaaagaacctgtatccattaggaatcattccccattccttccttgtcccagtccctggcaaccactaatctactttctatctctattcagagcctgttgcatagcaaatattttctatcccgctttagaatggctaaatgaaattttgagatcatataacctatctattcatataagttttagctatgcttactatgcacctattatcattctgtgcatcccacttaatacagtttgtgcattcccccatgtcactagctatgcctctacagtatcgctttcaatggctgaaggaattccatcaaatagatattgcatagtgcatctaactaatccggtatagttggaatttacatttgaatactgagttttaaaaaatcttggaaccaagtttaaacatttgtgttttgcatttcaagaagtgatttcaaaaagaagccacaggtattaaatcctttctttgcatccgtatatttagagcctcacatggaggtgagacagtgggacagaggaaagctgaaagcctctgtgtctatcaccataccctgtgtgtagagcaattaggaggctagcccttttttatgataaggaatttggtagcccatatggtggcagtccctacataaactttcactgcttagaagtatttcccagagattgtattttaaaagtcccagaatagctgtgttaaagacaaaagtaaagtaagatcaaaagggaacttacgtttatttggcattgtttgtgtgggcagcaccttatccactcacagctagtcttcgaagcattaaactttatttcaacaaagtgtaacattaacatcccagcctgacttgcttctgacttctagcaccaaaaatagagccttttctatgacttaggtgcagaatctacccgtataggaattagcatttgtatgaaaagagctgaaacccagcttctgaatcagccaggattttattattttatttttactacagaagcagagactatcctaataaatcctcctttcttctcctagcacacttaaaaacccatctttgagctccactgactccattaggtttgaactttggtattaagtacacagggaggaaaagagtaggtgtgggggtgacgagaaggagaacagagagaagcacaggagaacagaaaggaagggaggcagcttgatgctactgctgcggttattgcttcactcaaaaacaatgaagcaaaagcagactatgtcaagaagcaaaggtgtgtcaaagacaccccaggcttaacatggggctgcacaaacccacaggaagctcacatgctatttcctagacactctctcacatgaaccactttgacttatgtttccggactccttgatttagtttctgttttagcgtttgcacaataataattttactactaaaagtaaatgtcttgtaaaccaatgggaaacatattgtttggcagagtttataatgtcaggatttacggctctaacactgagggtctctctgacctcgaagataacataatgaaacagcaatgtgctgcatatgactcgttgtgattttttattagttctcataatcgcctcttattaatttgtatgcacataataagcactcaccttcacagtctgtccggcttcggggccatcctagaagtaggaaaaaaccaacagaggtgagaatagatagatggtatctcctgcttattcagaaatatcacccattaataatttagatgcaatttcattgtgtgttaatttatagtattctcatggggaccattggcttcaaatgtgcgggattagacagttctccatttccgcctgagagtaagtgcgaagttatgtataaaaatgatataaattatccagcaagccaactccttgctacttttcatgctctttgctctaggctatggttttaattgcattaaaggaaggctgaaaatgtttggggaggtgaagtatcacaccttctggttatgtttagaggtggtttaattaatgtctgattactttaagcttctactcaggaaatctgctataaacataagccattaaggaagaatatggggtatttcatatgggaagagtcctctggctattctgaccttgtgggagacaaatggtagtgttcattgtagctggacccttttcccaaactggttccctttctctgtttctgaagcttagttggaaatgggcaaactcaccaagtcaccagccataatataaagcaaaagcagatactcagctggttgagatggccaaacaaagcaatggctccacaatcagaaattccaaaatagaatttcacctctgcaactttagccaggtttgtctacctctatgagcctgactaacggggtgagaactcccgccgtaaggattaagcataactgtgtatatcagggattttcaaacttagagtcacaatccattagtgggtcatgaagtcaacttaatgggttgcaatcagcattacaaacaatgtaaatcaggtgttttttttgttgttttttttttttttttttttgagaaagggtcttactcagttgtccaggccagagtatggtggcatgatggcggctcactgcacccttgacctcctggactcaagtgattctcctgcctcagcctcctgagtaactgggactacaggcatgcaccatcatgcctggctaatttttgtatttttcttagggacagggttttgccatgttgcccaagctgatctcaaactcctgagctcaagagagctgccggtcttagcctcccaaagtgctgggattacaggtgtgagccaccacacccagccagaaatcagatcttaatagaataaaaactattagactgcacagaatgagtaaacattgttttgtgaaactctggtttcctttatcaatataggcatatgcatatatttcatatatgtgtgtcaggggagacaggcatgattttgaaataaatatgtatcttactgtaggttacagtaaaaaatagtttgaccacattgcatatacgaaagtactctaggtgctaacacaagtcagctcttacatttatggaattaactttctagtgaaaaatgttccataaccagcaatggccatttcctataaatgtgatttttattcttgtatctcactaaacattaacagaggttttcattcactgccttcatttagtctctccagaaacacggtttgcaacataagcttgataaacccactctgaactgaactacctgcctgaaggggactcaaatggtttgacatacaacacatacacacaaagcatttgggggaagtttagctactcttaacacagacatggcagcaaaaaaagaaagaaaaaaatctgtttgagaagaagatgagcacttttagtcagagccttcataacctgaaaacactggctttctttatctggtctctttgaagctctatggtaaagagctaaggaggggaggaagaatggcaaacattcagtttaactaacaggctgagtacagagtcctcacattttgaaagtgtgtccttctaaagggcaattacagagtcatccaatttcagagccatgaaggactttatacattgataccccagccctttccatagagggcctgaaggagctcatggtatgttactacggatttactcaattccctactgatgactcaccatggacatccttctcccaacctgacaactgttggctcaacctctgcctaaaaatcttcagtgactggggatctgatttcttcactggtcagtgggccacacccaaccagtgaatctagcttctaactaatctgtgatcaatctctgcatcttgaattaaagacagacaaaaggtaaggcccaacctaagctgcatatcactgccaccctggaattagagcagggcttagtctatgcagtgctcaaaaattagttaccatggaatgaaaatgatttttccagtcccagttccagtaagcaatttggaatgtctgaatgtccattaaatcacttatccattactcccacctgcttggtaaacaagcctcagacatcaccttagacactatcccacggtccatcttggggccaatggacagtagggttgccctgcattagaaatctctttttttggctgctacctaaaatacaaacaatcacatctgccctcctggtaagatatcaggaggagcaagcccaatgccgggatatgaaagggaagaaaaatcatttctgagaaatctgtacactcacctgcatggaaaaggtgagagaggtcccatggaaatgtttttccaccactgtcccgactctctgggtcgtctgaaacaaatcggccacttcatcaggacgcaggtcatggaagcgctccactggccgcagcgggcacacaaggacatctgtagcaaggtctgttaaggcccatgctgctggctttgggtagtgttcttaccaagcagttcatacccacaggattgaatcctctcggaccagggcctgaactctcaaagactaaggaatgaagaaacagatatttaccatccactgaactccagagagttgaaagagagctcccatacatggataattacactttgaaggagaagctgtggtatgcagaagaatttcttgcaaaagaaagggacattcgtgtacagacagactcaagtgtatggtgagataattatgcgaggaggcaagatctattctagatcattctctcttgacccctattctaaagctgtgtccgcttcagcagccaaaggcactaggttgaaaaagcaactggaatatctacttggtttctctaggtagaacatggggataaatttttaatttaaattatctctttagagaaataagaaaattatgcaatgaacatacaaaagtagatgtttattttatttttaaaagagtatagacattctgaaaatgtacagtgaactttatccataactaagagaggtgccatgtggttaagcaatttatgacaagagttcctcagactaattttttttttagaatccaaaagaagacatttgaaggtaaatcatgaacgaaaggttgtctgtttattcaaataaagcattcttaatgcattctacaagttagacaaggcaacgtatttacactattggtctcagcaacatataagatctgagaaaaaaggatagaaatttgattacttcttgataggaaattaatattcactgttacaccatcaataacatttcagtcactatacacacatgtatgcacacatgtgtatatacacacactatatatataaatatttgtttagtttttagatactaacaagagaaacaaactcttgtacgtttttctgtttcttttttcttgttgttttaagacagcatgctcctgcctggagctaagcagctgaggggcataataaaaccataattctgcaattgctagtctcactagaatatcaaccccattccgctattggtagaactcagagcccaaggggaaacacaactgagctcagctggtcaggcctgatttccataagagagaggggaagagaaagaagaaactgattaattttgctcataatcaggaaattcatgtcaatggtaaactaggaaaagaagcatttttaaaatcagagttcatttttcaagagaggagaagggaggcgttcacccacagggcatctgatacttaaaaagataattatccatctttggcaggcccgctttattatcatgggtcaatgaaccatttagaaatgaagaatttcctttcatttcctttgagcagattgccagcctccactcccacgaagctgctttttctgtgttaaaagggacccttccccatattcctcctccctgatttgaattacaccctcacttaggcctgacttcaccaaaccacagcaagggtgacaaccatgcaagcttccaacgaagtccataagtgctatgttaggctatgttcacacacagcaactcggtgggggaggaagacatttcacttcaacaatggcttactgtgaaaactggtggaataaatcagacaacctatgtatctaatgtaaatttagtaatatcaatgacatccaaaaatgttttttttcaacaccataaaaaaacttattgtttgtcaattttgcttgtttgcatgttgctcctagaaaaacaactcagggaaagcaaattaattagaagaacagcagatagcttttgtaattctaatgccactttttatatgccaattgttttaaaataatatcacagatgcaatataatttaatttggagcctcttaggccttgttaatgggtaaattccatattatacataggctatgaagacacatttacttctggatcctgtttgcttgggattatctcctctgtcaagatttcttagccaacatgtaggataacctttaaagaattaaagttactatattgaattgaataaatgttttatccagtacatatcatgtgtgaaaacttgtggaactggttaccacttctccctataatctagagtatagagtttttttagcaataatattttttaaaggaagcgaaggtcaatagttataatttaggttgtatagctgacaaggagatttctcacagtagatgaaaaccaaaggcgacttcttagagcagatgagatttaaactggactttaaaaattggggagtgatttaaccagtggattgggctggcaacctactcactcatccatcccaacactgcagtctcctctcagtccagggtctatgctggaacttaggatgctaagatgaccaggacagagtagctgaccttgaagagttcacattctaatgtccgcaactgtcatgcagtgtaaacagatcattacaacacagagagatgaatgctattggtagaaatcagtatagaaagctgtgggagcacaggggaggtcagatctaattctgcctcagggtgttagataaacttttccatctcattttacatttcaccttttaaagtagaacaatttctccacacctagaccaaaatctgtccttaaaaatggtccagaaacttaaggttagcttcaaagaaagttgttaagcgttcctcctttggcccaaatcaccatttcacttttgtacgtactcttacttactcaatctttccaacaaacccataaactattaatactattataattcccatgttgaagatgaattataagcaataatttcttatagaaaattagaaacttgccacaccagcacactcaaaatgagattaaaactagaattcaacccgtctgtccgattctaaagttcatgttattaatgacagtgctgtgatgtcatgcttgttagagctttcatgactccatttttgcctagcctcttattaaaactgtgccctgcattccctagtcactctgttcatagaagggaaccactgttttcattaaatagaaggctatgatgcaaacatgctgaacgcttaagaaacacctaaccttggaaaaagaaagcagacgagacctacaatcccacaatgaaaggaggcctcagcactgggcagtgagtatgccttcatcctaacagagaatcgtaagatcaaaaaggggggagagtaccagcttgcctgaactggaggaagtaaagagggatacaaagctggcattttgccccttctcatcctgactttgggttgcttcaaggtgacttgggctccatcatgggccagactcctgagaaagtttagatactgcagcctctatcactgggtcaggttgtcagacacactgaatccattgcttgttggacagtctaattactgagaattatggaccttctcacaacacatgattcatatcacaagagactaccagaaacttggcaatcctttctttttgttttcccttttcgtctcctcctcttcatgctcaccaccagcccagaactgactatctctctttttgaacatgaacactttaggtgtttttgctgcattaaagtggtgtgaccacatgccaagccctatgctgaactcttgctgacacactgccaactcagaatacacacaatgaaagaaagacatattcgcattagtcaggtgcctagagctggtgtggtttgctatttgcaaatgtgaccacaagaatccctcccatcctacacatgctgttttgctctctggctttcccccactttccatcaagagttgcagtctatttcccctccccttgagtgtctatcttactttgtgtttgtgttgttataaaagaacacctgaagctgggtcgtttacaaagaaaagaggtttatctggctcacagttctgaaggctgtccaagaagcacgatgctggcttctgaatttggtggaggcctcaagatgcttccattcatggcagaagtggaagggaaaacagtttgcagagatcatatggtgagaaaggaggcaagagagacaggagggaggtgccagacccttttcaacaaccagctcttctgggaactaatagagcagtagagagctcactggttaccacaaagatgacatcaagtgattcatgaaggatctgcccccaaacacttcccattagaccctaccgccaacatcagggatcaaatttcaacatgaggtttggagggtcaaatatccaatctatagcagtgttgctgtgtgactttccaaggttaggccttaagtgaccttgaaacctctgattattgctctcttggaagcctgagaccaacatgctataaaaaatcccagctagcctgttaagtggcaacatgaagaaagaactaaggcacctcagctgatagtcagcaataactgtcagagatcatctcagaccttctagagtcaggagagccactgacttccagtttctatatcacttatctactgctgcataataaactaccccaaatcatagagccttaaaacaacattgatcggccgggcgcagtggctcacgcctgtaatcccagcactttgggaggccaaagcgcgcgaatcacctgaggtcagcagttcaagaccagcctggccaacgtggtgaaaccccatctctactaaaaatacaaaaaaaacagctgggcatggtggcgggcatctgtaatcccagctactcaggaggcagagacagaagaatcccttgaatccgggaggtggaggttgcagtgagccaaggtcacgccattgcactccagcctgggctacaagagcaaaactctgtctcaaaacaacaacaacaacaacaaaccaacattgataggttttactaccataagtctgtggatggtttttgctgagggtctcacctggactcactcatgcaactgctttcagatggaaggtaggctggagtctgggctcagctgcatccactaggcccttcactctacatgctcttccatcccaatagatgcagaatctctgaatttgcttaaggcttacattgtcccacattctatcggtcaaagaaaatcacaagccaacccagattcaaggtagagatattctgtcttctaaaaggaggagtggaaagatgacagtcaaaagggatatggacactaggaagttccagggatgtttaaaaattaacaggggcccaaggtatcttggctgtcctagtgagtaaatacaggatggcattttagagttgagatgctcctttttttttttttttttcctgagatggagtttcgctctcgttgcccaggctggagagcaatggcacaatctcagctcagtgcaacctctgcttcctgggttcaagtgattctcctgcctcagcctcccaagtagctgggaatacaggcatgcaccaccatgcccagctaattttgtatttttagtagagatggggtttctccacgttggtcaggctggtcgtaaactcccgaccttaggtgatccacctgccttcacctcccaaagtgctggggttacaggcatgagccgccgtgcccagccgagatggatcttaaacatcaactactccaataccttcactgtcagattttaaaaatagggagagaaaggttacttaacttgttcaaagtcacacagttaggagcacagttgggattggagctcaactggtgagcttccccaaccaaagctctttctgttacactgagatggcaaaacattgcacatctgccactattttccaatggtaaacttatggcagaataatcgaccacagaattctctcctttaaccaaagtgtccccaaatacttgccaatataacctctgagcagtcaacaccagtgagaatgggcacgcgacatgagatgcatgtgccatttctgtggcctcccacactgcctcatgaaacacagaaccaactgcaaaggactggtggagtcagaacaaagggggatgctgcaaaagggagaatcttcccaactacataaaatttccattatgttgccacatttttattcaaaataaatttgataagttcaaaatttgctcatcaaggataataattgattaaaaatatttttaggaggatttccatgacaaatacgaaatatttaaacatggagcactgacagataaatggaaatgtactgattcagatgattaattaaagatgacagcagaatattatgatcggagttgctcagactcgcccccatttagttttctatatctgatctattctagggattcagaatatagaagtcaccaaaataaagcaaatcatcaaaatatcactgattttgattaggctgattagcctgtgtatatattaatatgaagtaaggcagtatcagataatacaacacagaattaatcattcttctgaactaataaaaaagagtctgtattcatctcgactgcagatctgtgtgtagtttagtgataagcaaggaacattccagcttgcaatgcagacctcagcagaccctgtataattcattatttgctctaacaaacactcctaggccttgtaaatgtttaaaataattcttaatgtcacttcacaaaacaatagcaggatggactgtcagctacttttcaagaaaatattcaatttatttgatttaaatagcacaattacagagctttgagtcaaagtaggcggcatctcaaaaagtaatctattcacaacgtaagcactttgatggattttcatatcagaaaggcagaaatatcacccttaaatattaataaatacaattctgaagaagcatcttgctttgtttgggccacaccttttttcagtggggattaacatactcatttcagtaactcaataaagggttcatgggatattcatcaaccataaccataaatgacacagatgtaattttaagcaaatgtgatttccagaatatgataaattccagagcagtgtgattaagataatgataacactctgctcagagctggttctcaaggcaagcatctcacaaatatccactatctcatgttttgccctgggatatgctttgggtcagagatatgatgagaccttgttcatctggaggaagagaacccaggtatccttgtctaggcaacatgccctgagctgccctcaaaactccggtaccgatctggatgctcaaaagtaagaatcactttcatcgagagaagcaaacagttgcctttcaaagaaagtaaattgacaggggagtccgcagcccgatagcattctggtacagattctttggttgaatttcacatatttttctgtgaacttttcaatgcaaagtaatcttatactgattgagggaagagcatcatatctggaaaaaaatatgctcatataaactaagtatgtgggaaagaagtaaatgatatcattaaaggaaagaaacaatatataacatttgtttgctgcctagtatggtctagtgataatcaataaccctttgagttaggataatatcacctcccaatgtccagattcagaagttgaggccaaaaaagtttaactgcataaccaaggtcacgtagctattaagtgaaaatcccagccaggggcatgtgctacaacactgttacaatgtccatgctgtttcaatgcctctcaaggttataaaaacctccatgtataatacctactgcagtgtttactagagtgggatagcagagccctgcttccacgggatgctgttatacattatacagaaaaaaaactgtgcggtcaaagaagattgagaaacactgcatgaaatgaagtaaaatagctctctttaccgcagtattcatcagcatatttactgtactactatgcattctggcttctcaaaaataagaaatagtatgcagcactgctcaaatttgcttatctacaaaataataatgattattaattattagtaatattgtagaacactacacaggacacatgtttcagaggatgttctttggaaaccttgagcatcatttcccaaaacacagagaggcctgagtaatttttctgttttttcaaacaaaaagttgagtacatgtcctattaatcacatgggcaaagaaagagagcattctgtgaaatgaaatatgctgagaagttgagcattaaaatacatcaaatgggatatggcagtcattagtgctgtttgccaaacagttcaggttactgccatgtctgggcatatggtaggccttctggacccttgcagttgggtgaagctcaaggaatacaggtcaaagagttgtgagcgaaaatgatatacgtcacttctgggctaaagcccttaacttctagtatgtgaccgacagctttatttccttcaccaagacaggcagcaatgctttgcaatggtagctgctctggcagtgagaccccgaattataggtcagcaggggcctctgagcatcgtggtcacagtgactagggcaagtttgttcttaaataggttttacctcttttgctaaccccaaccaacttgtagtagctatttacagcagcatgttgaagaggattctgaagctctgataaggagcaggaggaaagaactgaggaatttattagttttggctgccaccagggaggaaaaaaatattagcgtgtataccaagtacctgccattcttcaattagacggcaataaaaatgttttttcaagaattctctctcccccattcttaatgatatagaagtcatttctgggacttgcaatgtctctcagtaaccgttatgaaaatctattattattgttattgtcctagagatatacagaagtgtctagaatttagataattctggttaggagagtactgaaaaggaaaattaactgtcactcgaaagagtctgtccacaatgtgtaaacatgagaatgggaacacaccaatatgaaaatgagcatgttgtaaaaatgctcttaggagttaagacttgaaggagtatggcaatagaagaaataaattgcactcagcagctgaagaaatatttaaagataactccaatgagagattattttaaacttcagatacactttgctatgagaatcatttcaaaaactctgtaaaaagctttttagtgaagtagagatgagaaagtaatactaaaaatctgcaattcattgcagatctagaaaaccacatgcaacataaataatttaatagcaccctcaccatatacacagtttcatttcaccagtatgtgaatgaggggagtgccctgagcacatacctccatagggtggctagagtgaaacctggggcccaaactcccacatagacaggattcttccagtgcaagctctatcaggttttgaaattatggattccaaatttaggtttgcttatgtcatttaagagactaaaaattccagtttccctcagatcttccatatagctggccaagccaatggagcaaccagacaacacagttcagatgccatctgaaggcaaaaagtagccaaactataaatatgaaaggaaagaaataggaaatgagagaaagggagagaggagattaaaggtaggggtggtatttagcagatgaagcctccttagaagagaggaaatactcctttatagataggctcaactaggattcctggtgctacacacagagcttaacatagcattggcctttaataaatacttggtgaaaaaataaatgtcatgtaggcttattcattgtttaatctgggaaacaattctttctaatgaataatttcttcaaaatgctccccaaactgtgggttcttaaaagaccagtgaaccagtccagactcaacttacttaaatgtaaaccattaagaaaaatatacttcatggtaaaaaaaaaaagaattatgaattcctaatacaaatgtaacatacccagctaaagggatagaaaaataaatacaaactggtctttccttcacacatcaaaagtagtgcatgtgttttaaatggaaaacttcagaactattaactcagtgaagcttggaaaagttcaaagataacagtgttctatgctttttaataacaatgaggaaccctcttctatgacagatactaatgttaatagaaacatcctttatttcaaataaatgaaagagagtcacacttaacactaatttggcattctcacagaatatgaatcaacgtctttctctcttaaaatcagtcctccatgagctagcaacctaaaataaatgtgaagatttcgtagtgagaggtattcatcatgtgttcagtgaatgaacttctgaatgaattagtgaaagatcacaaagttgaatattagagaaaaggataaagccaaaagactttcaagaactctgtatttttttgtatattcattcagtaaatatttgtgaattaagagccgactacctggcaagtactatataagacactgaggatacagcacaaccaggtacagtcatcctctcccttccaaagatgtgaaatctagagggtgagcagacaaaggcaactgacatagtaactactgtgaaaatataaggggtgagatgagaaagaaaaggtgcaagaatgcaagggcaagaccgtaacaagccaaaccagctaaggtggctgtgaactaggcccagttcacttggtctaactggatcttcaggaaagagtgcaggcccttgatagccttggtcagcagtctgtatttattcgccatgcatggagaagccactgaagcatttcggagagtggagatgtatgacagattctgggttctctttgcaaagctgaaggccactgggaatatctttattgcagactaggtaaaagattcaaagcaggcctggcctgtggtggtggcagtagagatgcagagaatttgagatgtatgtttgaggtaggagcaacaagacttaactaatgggggcaaaaaggaagagaaggatcaaagaggattccaaggttctggcttgggtagtaggtgaagagtgatgtaattttgagatacggtgggtgggacagtgtcatgtagctcaccatttggagacttttctttcttgaatttatagaattctccagaaataactagagcagagtttcctaacctgggtctacagataggctccagggcttctatgaatctcctgaaattgtttgcaaaatggtgcatatgtgcacgcacacacattgttttcctctggtataaaattcttaaatagtctcctgaccccaactaagataagaaatctagatttaaatcagaagaattctttgaagattagtccccaagagaatgattagaaacaggctcagacttttgctcactttggcttagaatctaatatacccagtactaaagagtaagaaaagaagttcactctgtctgagcaatgtgccataattcacaagcatgaagcctccataaaagacaaacaaaagattttttaatgccataacaccgaagtcattttaatctgattcagcagtgaacaatttaagacatgtctcctccaacaaaggcagctggacacataaagatgattgtgtgatccattcaaaattaaagaataagctaaatcatttacaacaataaaaatgcagaaaattctaccagaaaaaaaaaaaaaaagagagagtgaaaactttcagcagcaagtgatttccaaatgtttccaaaacaggaagcaaaagacattttaatgtcactgtggcagcttccagaatagagtaagttaatcaggcagcctctaaaaacaaagcagcaattcattaaaaacaacaactgctactcagcaatgaactgtactgccagagtgtcaagaaagcaaactttttcaagatagtgatttgtatgcaaatatagctcagcatttatcactaaacctccaaggcctgtaaagggggggaaagaaaagttctttccatctgcttacacctgtctcctaataaaatcaactgccaatcacaggggaggctggggcattttaaaaacagtcaaagaaatacattcacaaatccagggtttcaaacaaaaaactcctgtctactctttcttcttcaaatctcctagcctactgtcctcttcctaaattggagttaatatctgtacctacttcattgggatgttaaaagtgttttttcaaaataatagcatatttcacaccaacaaataaaagctgaacgaatggttggtttagaaaaaaaaaaaatagtcaatggaaatgaaatccttcaaagcttccctcaatccagcaatggtaatgcggttatgtgattgaaacagtgtctcactagcaccagtgttatcgtttggaacccagatcttcattcatctcatgtttaaaatgtctgtacttttctacattccactcacccacccatctccattttctcatttgatctctgttttttatttccccctcataatgtaagcatcactggtagcagagtctaggaattaatcatcttataatcatttagtcttcctctccagttctaacttacgactttttcaaaatatggttgctaacaataaaaaaaatctcaaaatgtgaaaacaaacaatggaaaaatattgtaaatatttaaacgcatttagaatttgcaagtttttttcactctaatgtcatttttcaagctatgtttagacagcacagaacactatatggtttacctaatgtttaaattagtagatctggccaggtgtggtggctcacgcctgtaatcccagcactttgggaggccaaggtgggtgggtcacttgagatcaggagtttgagagcagtctagccaacatggtgcaatcctgtctctactaaaaatacaaaaatcagctaggcatggtggcacacacctgtaatcccagctactcggaaagctgaggcaggagaatttcttgaacccaggaagcagagcttgcagtgagccaagataacgccactgcactctagcctgggtgacagagtgagtaagactgtttcacacacagacacacacacacacacacacacacacacacacacacacacaaaattagtaaacccaataatccacaaagatctataaaaatatgaacttacaagatttctatatatttgaatttcattttgtatataactgaaaaaaaatatttaagcatgcctaaggaaaaagaaaactgtggaaacaaaacaaatgttctggcaattctgcaacagtttcacatttgtatattgttattcctcctgaagaatcctaaaattcactctcattttctttatatgcttagatattaaaaacatgtctttgacaaccaacagtcttctgtcatggggaatcagacatcggccccataatctctcattaccaacatcaccattgtcactgtctttaccatcatcacttaaaagaaaatagaaactgcttaaataaccacagctaaaataagtgtcacaagtttcttactgattaaatgctcctccgcgagactgcaacctcgaatactacgccatagagttcagattccaacacctttaatgtttctataaggaaaaaaaaccacaagcgttctccctgaaaacgtactcttaactcagaatctcttctggttccatttagtttataaaaaaaaaaaaaagaataattcagattgaaggatagtattttggattttcagtgttattgatattcctcgatccatcataatttagctaacatagatcactgcctatagagcagtgctgtctagtggaactttctatatcctatactgttcaatatagtagccactagccatatgtggctactgagcacttgaaatatggctgatgtaatcaaccatatttaattgcattttgttttaattttaattttacatttaaaaattaaatttaaactttacattttaaataccaccctgtagctagtaatcacttgtagctagtagctattacattgtacagttcatcaggagaggccacaaatttatggtaacaaggagtggtggaactggcacaactggaaaacacatgccccaaggtgggtggccaccacctagagatttttttgttcctgaagaaactagaaatttgaattgctatgtgtaattctcttctatttaacttttggcaactataggcagtccttctcatggttccaatatgcacatatttcagttactccagtttaaacaacaccaattccccaacaacacggtttaaatttcagttaccatgtcacattaactctgggtcattgggtaaagtacaagctccactactagctcttcaattcacaaattaccatgtagatcatagatgtgcatgatgatcagagaccagtcacatcacttcttccaaagtctgtcagtgactgatcactgcacatctggtattcagtcagaggcagccagcaaagtatgtagttttgtatcccactgatcttccagtgatgaacccacatatttcaccaaaatggataatcgaaagagggaactggccaagaaatatgaaacacaagtgaccaaaaacaaaaacaaaaaaccaaatgtgacaaccccagaagtgcactttgaatcaaatgtaaataaaattatagaacaaataactgactttgggaatgccaattgcgctgatgttcaggagattctagatatgtaacccaaggaatttagtaaagacaaacttattaacataaattaccaaagaatttatgatgcagaagaaaaagatgtaccagaggaagtgacatcaaaaaagtcacattttaaaaaacgtcctatttcatgacattgaaaacacaaaggatgaaatattggaaggagatccacactttaggagggattatgacaatcagccaaagcacagaaaagatgccccatctgtactgttagttgcaggataagaaaaacaaggcaagaattgttcaagagactctcaataagtgattttcaaagaaataaagcacttcaattcttagtgtttctaatgttttaaattacagtgtactaaattagtattagttcgttttttacttctttcattatatttttctatttctttatactctgataacttatagagggtttttaatgattagagaaaaacgttaaaggtcatagaacagtcatacgttttcccattgattactaagtggacattgcatggtttccgcttgcgtggtcatttttatagtcccacactgctgtataagatgaggggtacttgtacttccaatgtgttaaaaaatattgggtggggcaaataaaacatataggtaacaggccacaaatttaaaacctgtgccaagaactagtgtcatatgtgatgtgcatcttaatattaggagagagcagatgaaggaaaatcaaggactgtgactttaaaaagacatatatatgcagtctctctccagaaagagcagacccgtcgtcatatgctcctgaattctcccaccacactgcctggcaaaattaaagtcaaagttctcttttgtttcccaagtagcctgagaactgcatgttactgtctacctaaataacagaggctctctaaaagaaaatgatatttattgagaaatgggccttgtcttgggaatacatgtgccacagtaaattatgagtattcagccaggtgaaggaagacaaaggtttttaaagggcaagtgaggagaattacctaattgttttgaggtaattatccttggttactaggatcaataacattgtagcaccagaaagaggttggacaggcagttgttgggcagatgtcctcatagaagcattgtgtgtgtgtgtgtgtctgtgtgtgtgtgtgtgtgtgtgtgtgtgtgtacaaatgtgatggccttggtgcagcgtggctttttgcagagtcttttatgatagtttttgttatcaggcatttgtacatgagaacgctcccgtcatggcctttcctagctctatttgtcagggttttgtttgtgactccatttgattctgacaacttttatattatcaaacctcctgaactctgaatgcatcattaaacctggctgttagcattaaggtttccccaccaaatgttctcttgtacatcacaatatgactgaagggagattacataatgagtaacatcaataccatgcatgttctatattccatatggataatgcgcaacaagcaaaattcctgccaaaatccttattttgacacaaaaaacagaatgcagctatagctgtatgttttccttcacaatgttccactataggccctttctgtagtgcattatctgccgctggtccagaagctctttaaaaacagaggccacttatttttcatccttggatccaaagaccagcatatggagcccaggttaggacagatgtcacctcttagtagacttatcaatcccatcccatgaaggtatccctccttccttttcttcccatttgtttgtatccctcatagcttatatcaatcttgaaattttagtactcatttatgattacttgttttctattgagaatgcaaactgaaatgagggcagaaatcaggaatgtctgcttctcagctgtattctacctggatacagtatactgcccatagagcacttgctaaacactgaattggtgggtcaatggatggatggatggctgggatgcatggacggatggtagatgactgggtgggtggtttgaaaaaatgtctaagggaatgactattagaacgaatgactgttgaatgaattactgtttcattaataaataaaaataaataaataaaagctaaaactattattttagtaagtagagagtagaaaaaataactgttattttcttaatgttttataaccataaacataacattctctgggttgtcttccttttcccaagttatgtcctcagataaatctaaaaatgagaattcttccaatgggtgatctcccctggtccagtccactatttgctgaactacaagatggagaagtttcactttgcagcagcatgtgtgaaaacagcttggaaatttttgtagagaataagctcaagaagagtcaacagagaaatgttgtttctacaaaacacgttttatctcagattgtgaatgcaagtctggtgttgagttgagggaggtgatttctcactctgatcttattgacagggatagtcatggagttttctgtcaacctgggagccaccaggaacagcctatagcacattcacaaaagagatcagtatggctgaagaaaatcaaagaaaagagaaatgaggaaacaagggtcaacctttgactatagcattgcaaaggcagtcattctaggaaggaggaaagatgcaggtgaaccaactagtaaatggtagaacagaatctgaatccagcatatgacctgtggagtgactcagatctggattccaattccatttttgccactttttagccatttgactctgggcaaataaactcttatcagtaacctcacctgcaaaatggggcttatttattctcatggaactgcatttcagagtaaccaaacagcaccaatgatggacaattcttcaaagaattctagcattaaaagcaaaaggacccccaccattttaaatccctaaaaatataactgactcatgcaaaattatcaacaggtaatttggggcttaggtcaggagttcttaacctgggggtcccacagaggcttagcagagggtgcatggataaaaggaaggaaacacatgaacatgaatgaaaaaaatgacacacagttatttttactaatttttaactaaaattttgtatcttattaaatcacagatgtaggcaatgaaccactgtagtaacagcagtacctatgagttgtgtcacagtataaatcacaggtatttaaaaaatatgtaaagtaataacttgatagttattgcagttaccttgaaatatcatttattctagaagtacttatcattacaattactatcacacaattatgatggtcattatagctgctaccacttctcattatttaatatgtaataaagaaatgcataattcactgtatcacaaatttgctgttaatactgtgttaactggtattaaataacatgaatttccttggtacttctctatacttaactgtccttaattaaaatcattattgggtgggagggttgctcgaggctaggagtttcaatccagcctgggcaaagtagtgagaccccatatctaaaaaaaattagctgggcatagtggcgtgcacgtgtggtctcagctactcaggagactgagatgggaggactgcttgagcctaggagttcaaagttgcagtaagctatgatcatactactgcactccagcctaggtgaaggagcaagaccgtaccttgaaaaaaataataaaaataaaaaataaaaacattattgggggaaaaggtatacaagcgtcaccaacagccaaaaaggtgactgaaccaaaaaggttaagaactcctgctttggatgaaagtgtgacgggaaactttataatggagaaccaggctgtcactacctaaatctgctgatcaatttcaggattctaagagcaggacatccagacattatgcctccctatacactgtgatttgaagcacataatactactactacaaatgcttatatctgaaaataatccatagacccgcagctgtctaatagaactttttgcgattgtttacactatgcaacacagcagacactagctgcatttgaaatgtggctagagcaaagaagcaacctgaatttctaattttacttaagtgtataatcagccacctatagctagcatctaccctggagcccaccttagagctaacttactttacaccaaacacaagatagagaaacaagttaagtaacactaaagggaagcaaacagacaaatccgtactatagaacagtctacaggacaactgactcagttaaaaaaaaattcaatggcataacaatattggattaaaacagcactaaaacaaataataacctaatataaggtgtggatcttttttggatcctgatccaaccaagcaatgataaaaagacattttaaaacagtcaaagaacttgactactgcattaagaaattcctattaattttgtgaaatatgataatggggccaggtgcagtggctcatgcctgtaatgagcactttgagaggctgaggcggggggatcacctgaggccaggagttcaagacaagcctgaccaacatggagaaaccccgtctctactaaaaatacaaatcagccgggcgtggtggcgcatgcctgtaatctcagctactcaggaggttgaggcaggagaatcgcttgaacctgggaggcagaggctgcggtgagccaagatcgcgccattgcactccagcctaggcaacaagaacgaaactccatcccaaaaaaaaaagagagaaagaaagaaaagaaagaaagaaaaagaaatatgataataatattgccaattagggaattttcgtagtctttaaagatacatgctgatgtgtgtagagctaagaaaatacttctagcaattgccttaaaatatttcagcaaaaactcaagtggataaatgaagcaagtgtggcaaaatccgaatgacatttgaatctggttgaaggtaaacaggccatcctttgtattgtttttggtgctttttctgagtatgtctgaaacatttcaaaattaattttaaatgggataatgcattgggtacagtgaccaacacatagtaaacattcagtaaatgttaattagcaagtattagcatcatcaacattatcatttatgttctcaaaagtcaaaactaagatcaatcagtaaaaaatacaaagaggtagctttcagcttcatctaagaacaggctctgggaagatgaaaatacaccgtctcgtgagggagtagccaacagcatattcaagataacaataacagcagtgacttacatgattgagtacttataatggggcagatgtggttctaagcactttccatataacccctcactcaatcttcacaacaatttcataaggtaggtactctaactgtccctgctggagcagagattgatcacttggtgaggatgctgcagaagagggtcaaggtgaatggctttgctagttgccctttaacatccctgataaccctgaactcctctgattcaatgaacatgtcattcagatgaattgtgcaggttggccagctggctggctcacacacacatacagggcaattcttgcttttacttactgaaaggtctttaaacaccacctttccctttcaagtaggagactaaaacgtcacaggaatttaattatctgtaggcaagaagatgatatgatcaagaaaatgctacatttaaactactccatttacccactttcaaatttcccatcaattagaggggaacatcttccctaggcagccatttgaccaagaaatgtccgtggtatatcttcgtcaacatgtttcagaatataaatccagattacacaaactaaagttggtataaaggctgtcatcatatattatatcatttggaaagaaatattggtgaccttatccagtatgactgttataatggtaataaaattgaatctttgaagattacacttctggtcaaagtagtaaaatgtgaccttattctattcaacattgacatttattatattaatttacatgtaaaaaactgcattagaatgatattaaagccctggttagaaatgttagaaatgggaatgttcaagaacttcagaaataagatttcactttaccagccattcacagcattgagtttgtttgatgcaaattaaactaaatttccttcaccaatctctgattcggttctaattttattattatcactatctcattcatacaggagatatttttcccaatgcctctttaaacattttataaaccttaactcattttcatcatgctctggataaaaagataacacagagcactgaatatataaacctgagtcagaggatcaagccatctgcttatgacggggagagtctcctcagcccagtaaaaatgagcttagcgatgagtatacatcagatagtgcactaggtcctagaaggataccaaggtccagaggtgagaaaagagagtcagaccgccacgtgggtttcacagaatggccaccatgcagcaaaaagatcgctcttgttgcccaggctggagtgcaatggcacagtctctgctcactgcaacccctgcctcctgggttcaagcaattttcctgcctcagcctcccgagtagctgggattacaggtgcctgccaccatgcccagctaattttttgtatttttagtagagaagaggtttcaccttgttggccaggctagtctcgaactccttgccttggcctcccaaagtgttgggattacaggcgtgagccaccacacccagccaaaaacatttttttatactggtcaaaattttatagggaggtccctcccttaaatataagttttgcaaactttcagtttgggggtagaacatggaatcatgcaatgaattaaggacaagattcagccacacctcaacagattattctattttcaccattagcccaaagtccaggcttgctaggatgggtcccaactgtccttccaattttgtttctcactattctcgccagcacttcaaggttccaaccaaaattaactttttgctatgtatttcctcatatgccttagttaatattgtcttctactctgaatatcttttgactttctatcaataggttaagctaggtgttgctatgataacaagcagtcccagcatttcagaagcttgtaacaaaaaaggtttacttcttgcctgctatttgtccatggtgggccagcagatcagctctgcccatctctggcactctgatatccaggctaagagagcaaaaaccagctcaaatactgttaggaaccatcccaaggggaagagaaaactgcagggtcttacaccagaagttaggtgcttagtccaaagtgacacaattcactgccataactagtcatgtggttccaccaaaccacaagaagcataatgctaccatacacctggaagaaagaagaactaaaaatatttggtcaataccatcaatgactccctatctccatgtgtcccaaatctgataatttttccagatctaagttagattccacctcctcctaaaagaaaaccacagtccttcctgctaaaaggaaaccgttcatatggttaatatacagagcatgttattttacctcataagactctcatgactctctgagaaccgtgtctctattggaattccgtgtttcccataatgccttgctagataaatactgcttgaatgattgaacaaggctgtctgtataatgagagtttcatctccaaagacttcgaataccctggaggctagtaatacgtggtaagcaataaaactttattttttcttatttatatcataaagatacttaaaacaatattaaaatgatcataaagatgaaataaaaatgagcccatagtcccgccaccctaaaccaacaaatgttttcatttcttttcctcctggtcctattcaaagggcatccatttcctttacatagctgtattcagggtgcatacaaagagagaattctaaatagaacagaagtaactgcccagtcaacaggttttgtttgtttgtttgtttgtttttgctcttccccaagatagagacacattgggccatatcctaatactgagacttattttctgcaataaaatttccgttaatttaaagcttctaagctgtttaatacagtcaccatcattaggaaatatcagtgtagtcttcaccactacttcctctccttggctcaacactggaagaaattgcctctagtgaaaggagattgacttccaacatgagaagaaggaagaaaaggagaagtgtgtgctaaatcttggacagttctggggaacatcgtagaccaacgtcaccttgtcacggtccgacgttaagacatcattaacaagagctaacaaccaacattgaagttttaacctcattcgtgaatttatctgattattattttgctccatttagctcatccaattcttttcattttatcatgcactctttttatttgtgtagtctgagttgaaccttttctaaaacaaggtagaaaatacatacataatgcttcaaaaaaatgttttccatactgccaaataggcactaggaagtctcaccagagttgataaacaatctagatggccatttaacccactcagcttacttaaaaccaagtctttcttttttttttttttttgagacggagtcttgctctgtcgcccgagtgcagtggcgaaatcttggctcactgcaacctccgcctcccaggttcaagcaattctcatgcttcagcctcctgagtagctgggactacaggcacgcaccaccgcactggctaatttttgtatttttagtagagacagggtttcaccatgatggccagcctggtctcgaactcctaacctcaggtgatccgcccgacttggcctctcaaagtgctgggattacaggcatgagccactgcacccggcctaaaaccaagtaagtcttaaaatttgtactcagaactactttttttttttgagatggagtcttgctctgtcacccaggctggagtgcagtgacatgatctcggctcactgcaacctctgcctcccgggttcaagcaattctcccgcctcagcctcccaagtagctgggactacaggtgcatactgccatgcccggctaattttttgtattttagtagagacagggtttcattgtattgcccaggctggtcttgaactcctgagctcaggcaatctgcccgcctcggcctcccaaagtgttgggattacaggtgtgaggcactgtaccttgcctcagagctacttctatactgagaataaataaacacccaaacacctttcaatgttattaaatttcagagtaatgactttttgtctattttctattttaatagctgatagattagtaggttttcaagctatattttaaaattttatgttcagtttcctaaccactgccacatgtacacataatttatactcttacatttttgaaagggtttattattttatgtgctatagttattgatctgaatcaaatctttcttacttgattcaacagactatagtgggaataaaatgtgactatttacgaatgttaaccactgctgtaattcatatgaaatctgccaagcctattatattaggaataatgttatatattttatctaagagtctgataacacctacctcaagtctaaatattctctgaaaaatttgtcagaataaaacaagtgcccttaaataatattttcaggtataactgcagacagttgcttgtacgtttgtctttaactttaatactgtctcaatatgcatgaaacgcttgatagttcaatagttgttttcatgagttgtgccttcattaaggtacaaaacattaaacacctggaatgctgctcgaactattcctaagggagaaattttggtgacaaatgaaagggatacatttttaagctgaaaaagttgctcgctactgataaaagaatttatatcagaatattccaatagagcagaagaaagcaacatgaaaagaaaattaacattcattaagaaacagctaccatggtgcgaaacaaagatcacaaagccaaaactgaacaacaatcaaatttctacacaaaaaataagacacatacaatgcctacagttccgattgtctaatgctgtgtaacaaactaccctaaaactaagtgacttaaataacggtcattatgtactgcctcttatggtttctggagggggtggtcaggaattttggatcatctcagtcagaaggtctggctctgaactttcatgacactccagtcataccgtggctgagactagggccatctcagtggcttctatatgtatgcctgaaacctaagctaggatttgaatagttaggggcatccctctctggctccttaaggtgtttccatgtgctctctcccatacggtggcttcaaggtagccagacttatcatatattgccttgaggttcccaagacatatatctcaagctagaaagaaaaccaagaaaagccaaagttcctttaaggacctagtcttaaaactcatttggccttacttctcccatcatctgagcagctccacttttatctgtttcatacatggggctttggcataagagcatgttgaccaaaggctgtcaaagtaaccaaacataaaaagtttaaaagctagtggctgggatgaagtctaatgccccaaacttcaacaaagctaggtgatggaaaaatactgctgaggggaaggctgcttaggtgatgggcaagagagtccttggagaatgcagataatcaaaacagcacctaattaaggtacagataattgagagctggattatcactaagattgtatgtataaagatgcactaaatatcttattttcaatttctcttatttttctatactgttataatagaaataatgtaataacagcaaaagcaaaaaatagtcctataaagtgttcacatggtgaattcaatactttcacactgggaagatgatggtggaagatagtatctcaggcagtgcagtccaatggaagatcttagaaccaaatgtattgagttgaaaacattaatgctgtcatttctgagccatcttaactttggcaaagtaattaacctgtcagagtctaaatgtcctcatctgtgaaatggaagaaattatgagttcacaaatttacactgaagagtcactgatccaccattctttaattcagtcataaaatatttatggagagccaaatatatgccaggtatgatatggtatggaaatacaataatgagccaaatgcctacaataatcaatcaccaaacaaatgtttatcttaagatgacacccataaacatgtccaacaaagatagtgtcaaaaaattgatgtcacctaatgaataatttccttctttctttttatttatttatttatttttttgagacagagtcttgctctgtctccaggctggagtacaatgatgtgatctcggctcactgcaacctccgcctcccaggctcaagcaattctcctgcttcagcctcccgagtagctgggattacaggcatgtaccaccatgcccagctaatttttctatttttagtagagacggggtttcaccatgttggtcaggatggtctcgatctcttgacctggtgatccacccacctcggcctcccaaagtgctgggattacaggcatgagccaccgcgcctggcctttccttctttcttgaccttcctttcttcataccataactcagtgataattagtagggggtgaaacagagccataatacattcatttgtgaatctcccctgtcctcctcacacttaccttttctctattcccttctcccaagcctggttctggctctctcatgcttcagaatctgtgaaattggttcggagggcttcaagagaactgcggaggctaagcctgtatcataaagatttaggactaggggagaggaagcgaacacaaagaaaagttggaccatgtaagaactagaaggagagactggggagctggtcctggagtgactccagggcaccaacatgtaggggagaaatactgctgaggggaatgacatgatttctgtttctttgagagattcaagactggatttccttttaattaacatggggtggctgatctatacttcttgaaggcaactctaggtgggggtaaaccacctggggcctcaagatttattaggacctcacaatagcaaacctgttgctcccctaaaagctagaaaggggggtttacaaaggagataaaccacaggtgtcagatatgtatccaaaacatctctctgaaggacttttctcaataaaaaaaagctactgatgcatttaaaattaagtaataaaacaagaagtacctgtgcatgaaatatttttacatctcccacctccaaccctgaagccatcctattagcaacctaccctatgatcctgacatgacccgacagaaggagacttgcagatccaactgctcctcagactctcacttgcacagggggcattttcaacatgtccagggagcatttgctgccttgataatgacctttgaggagaggaaaccaactcagaagtaccttcatcctccttttagtttgtcttttatgtttttttcttgagccaatgacttctttcagacagcaataatttacacttcaggaaaatgtcaaagtatagcaatgccctgaataataattaccgccaaggttggaatgaagcctttcgaagaaatgctaagttaattagccacacacttgtttaccattaggccagtggagaaaacaaggagcacaggatcagaacatgcctgcaacatatggtctttattaatggcggcatctcaattagtctatgggaccccacttctgtcaacccagagatgatctgaataaagaaggagaagaaatgttcacaaagctgtcatggggagaagatgctacctgagaccactcaggacacccacaaaagaaacttggatttctgttgttttctgtcataccttcatacatgaaattgcctcttttaatctttccacaatgcatttgttttgggacaaaggtcaagagaagggcagattaggaaataaggaggtttacccattattaccaaaaatctatttaaaaaatcatgtttccatgaatatctcaatttatcccttctaattcttattctcatttctgaaatatatactttgtttagctttttggaaaaatccacattttaaagaagtatacaataaaaaaataatactccttatttacatgcttctgcaatcatggccgcctttccacagaacactctcagacgaaggcccttttgtgccggcctacttagatgttaccaaaggtgtacaaaaacgcatctcttgcagatggctggaagatagctctgagctctttgtgttcaatcaatcccccaggaaaaggcattagaaatttattagaagcagctccctgttctcctcagtttctgagcttggaaaaagcacactacactgaaaaagcattttgaatggaaaatgtaacctgaagtatcttacttttttctttcctccatagtcctaccatcgatatatcctttgtaggactctattagtttgctaggacgagcataacaaaataccaagtaccacaaactggctggcttagaaaagagacatgtacgatcccacagttctgaggacaggggcctaaaccaatgggtcaccagggttggttccttctgaggactgtgaaggaggatgtgttccaggactctctccttggcttgtggatggctgtcttcttgatggatttcctcacactgtcttccctctttgcttgtctgttgctatgtctaaatttccctttctttaagaatacaagtcatattgcactagggcccaccccagtgacctcatcttaacctgattacctctgtaaaggccgtctccagatacactcacattcagaggcactagggattaggacttcaacttatctttctttgcaagggatacaattcaacccataacagagatgagtaaaaaaaaaagatattaatgttcaaaaaattaagtaaccaaacataaaaactttaaaagctagtggctgggataatgtctaatgccccaaagtggaaaggtaccattgtcacatatttcaaagaggaaaggtaccattgccacctatttccctggctgtttgttaccttgatgaagtgtctactgtggcaaggcattatgcatggcactgggcaacagagggaaaaaaacatggagcctctatgctcatgaatttaccctctccttttatgccagccttttcaacctgggggaaagtggactggctagagtactaatcaagctgtgaaggactttgggcttctacttcattctcccttgcattgacagctggacagttaaaagcagcaacaccaacagctgcacagcacccaactcatcaacccacaacaacggtgacatcacctaagttagcatggaagtggccagtctgcttttgccaattctttgggacattaaacccatgataatacttttaatataattctgtgtgaaccaataatgatgacaaactattcttcttgcctggttggagataataagtaacaatacctcctattttctacgaactgtactttttttctagcaccgtgccaggcacttaccatgataattttatgccattttcacaaggtgagactgatattactagctccattttacagatggagagattacatgtcttgctaaagctaccagctaatacagagtaaaggttaaatctgaaatcaaggtgtctagaaaatcaaccccatgctcttgagccttacacaatagtgtctctttcaaccttttgaacctgagcacttatgacaactgcccagtatatgtgtacacatattctgtgcatgttatagatagacagatagatagatagataaaatatctattttctccccccaaaatctatgactaatgcaataaacctcccactgattagacagttatggctttttctcacatctccatcagtgacataacatattaagcaaaaaagtccgacccagctgattagtatttgatgtgctgaagagcctaatgtttctttatatgaaacatcagacagtggcagcctacttaattactaggttgactttatgtcttcaaaataataaaacagaataatccaaacgacaggccaacgtggtgagtgatatttgaacatctactcgaccctaaaactgttaaagcaaaagtacttatccaaaatccaatactttccatttttcttttaaatgttgtaagtcaaaaccagctaaattgattttttgcctttgacttctgctgaaaagttcattcctaagcagattacatgtgtggctttgcagctcagaggaaattttacagccaagtaaaaccctaaaatcaggaaaacatgggtttgctgaatacagtagaaagacgtgacagatcttaattataaaagaacaaatatatcttgatagatgaactgtcttttgtgaattaagactcaaaagttttaactccttgattaaccgttacccattagtaatatagaaagttgtgaggcaacgtcttcaaacttctaagtagaacagagcactcccaaagcatgcagaaccccctgtaacatcactcaacgcattttcagcatgagtgcccagggtaagccttcctcacaatgttgcaaagcaaatcgtgtccctcattcccttttctactcccagcactccttggttaagtgttttaacagggtaagtgatgacggtacaggaagagaagaaggaagaggaggagaaagaacaacaatgatatcatggtaaaggcctgtagaaattgatctaccagacaaaactcaagagctcatatgatacaggattttgcttgcacatggtcacaattaaataaatgatgaaaatgagactcaaatatagattgtatacctcattccactgttacaagctttcttctaaatgaggaatcatcaaaaccaaacagaagtgtctatcttaggtcaccttaccctcttttctgattgttgaaattaaggcagtgcaagaaacctggggagacactggaaagtgtccccatgccaagccctgtgagcacaatgagctcatgaaagaaaagcccagagccaacaactaataatcgtgcttaaaactcatcatttaagaatttcaaaataaacactgatcaattgaagttattttgacccaaagtcttacgtaccttcttttgcttgtccatattggccatcataaaaaacagcaaaaaaaagaaagaaagaaacaaagatggggagttgttgcttaatgggtatacagtttcagtttcgtaagatgagtgagttctgaagatctgttgcacagtaatgtgagtatgtttaacactacagaactgtacacttaaaatggttaaaatgatgtattattccattaacttaaaatggttaaaatgatgtattattctcaggtatgataaagacatacctgagactgggcaatttacaaaagaaagaggtttaatggacttacagttccacatggctggggaggcctcacaatcatggcagaagacaaggaggagcaagtcacttcttacatggatggcagcaggcaaagagagagtttgtgcagggaaactcccccttacaaaaccatcagatcttatgagactcacccaccatcatgagaacagcttgggaaagacctgcccccatgattcaattacctcccactgtatccctcccacaacacgtgagatttgggtggggacacagccaaacaatatcaaatgataaattttatgtttttttaatggaaaataaaatttaaaagaaggaaaaagaattctctccccttccctctctccctacctccctaccttgctttctcccctccagggaagacatgtgcctccaggatggaaacaaatggattgatctggaaaatacttaggaggcagaactgaaaaaatttgaatgtgaggatgagaaacagggagatcatgggtgatttccaagtctctggatcaactgaaatggagaatggataaggaggaacacctggaggagagcacgcttggaaaggcatggtgagtttcatctaactagagatcaccagcaggagtctgccctgtccatctggagcccaggaaggagggttagggtggagattctgtacatttctacagccaactctaatttttggttacaatcaaagcctatgcccttctaaaacctttttcttccatcactaatgatcagctgtgtttccagaagtatgaatggatttatcctatatttctgcctaatatttcatatatgaatacttctaggcaggcattgggtcatatgtgtaaaacgaaagcaagtacttaacacaatagaccattcaataaagctgcttttcacatgcttcatttactactttccattgcctttttcgcaagcaattaccatctcacacatgcccagtttcaccattctgcagaaccaaatgttgaatttaggcaaacatagggtgttcaataaacaggtggattttgaacagaacaccaatgaattcaggaagcacggtcaaccagctgcgtctgtcaatggaataatcagtagctggctgcatctgtgctggctgggctgccatcggtgtttacaagctggaattgaagagggctcggccagctgacagcagaagtttgcgcagcacctgtctaaagtatatatgactgcctccaggcaatcccattagttctccactttcatggacactaggacttgttcacaaatttagggggaaaaataaaaaagacaaacagagctagcctctgactgagaaaggacacctgaaagagaaacaatcccatatggagaaacagaacaagggggtgagaatgagaaagacaagaaatcactcaagaaagccagtaatgtttacagatagtagaaaaattttgtctgtaaacagtgggcttggtagcatttttttaaatcagagatgttctggagaaatatgtaaagaactcagcccaagctttctgatgccaggcagggcataagtagtttacatggaaccttctgacttgtttatctgacatagtaaacagctttctctgatcccactgtcccttttacgcattacaagataacaaaaagttatgcgattttaggaaatcaagtatataaacagggctattctcagcacatccactgaatattaagtgcccacttttatctgctagaacttgatgtgtgaaggtaaccaacttaaatgcactgaagagattgcattcacacagtgaatagtgacattttgctaggaatttgttaaattttataatgcaagcatactgccgtaatgttccacaaaacgtaacagtcggtgcacagcaatactgccctctggtttgtgagggctatttccatcctcaattcattctagcaggaaaaagaaattaaagatatgatagaatgctatccacattgttataatgctggttctttctgaggttagtggtcacacacagtgctatagaggcggttgttctttcttgtgcctgtaactgctgaggttaatctctcagtgcttccaaatgcatatggacatttacacatatggacactgaccaatcctaaaagaaaactcaggataaatcatgttcaacttcaaaagtccagcagctaattcaaagccatgctcttgtagaaggagccattgaaaacaacagagaaaccagacaacagtctttaacgtcttatctttgtttatgattcttaagaccacacctggcgtgaaccgatatgctaggtcaccctggttcctcaggtgcattaggcatatgtgagcagtgaaactatgacaaccagaatgcaacatccaattataatgattagaataacaacaaacacttaggcaataattatttccattcattcacttcatctccccaataactctacgaggtaagtacaattattattccccacttcatggaccactcagtgccatactaagagtcccagagccagtaacgagcagactagatttaagatcaaccccatctgacttaggggttctgctcttactgttgttctgtacctaaagctatctgatgtattttaaaatgtaggtgtatcagtttggtggggttgccataaccgtgagttgggtggcttaaacagcagaaatttttcttacagttctagaaactgaaagtccaagatcaaggcatgggcaggtttggtttctcctgaggcctctctctccccttggcttgcagatggtcttcaccgtgtgtgcaccttcctggtatgcctttgtgtgtcctaatctcctccacgtataagaacatcagccagaccagattgggacccaccgtaatggtttcattttaagttctctctttctttgttttcttcttttgagacagagtctcactctgctgtccaggctggagtgcagtggcgtgatctcagatcactgcaccttctgcctcctgggttcaagctattctcctgcctcagcctcccgagtagctgggactacggacatgtgccaccacgcttccctaattttttgtatttttagtagagatggggtttcactatgttagccaggatgggctcgatctcctgacctcgtgatccacctgcctcggcctcccagagtgctgggattacaggcgtgagtctctacgaccggccttaagttctcttttcaaaggccttagctacaaatgcggtcacattctgaggtactgtgggttagggcttcggtgtgaatttttggggaaaccacaacgcaccccataacagcaggtgtgttaacgttctacaaaacgcaacggtgggtgaattgtaggacttccctctgctttatgagggcttaattgtatagggccttattttggatctttccacattcaacaagttctgagaatgtgatacttggaaaccatgttcatcagaagagtgaaaggctttcaggtaaacgtcctttgatctttttcaccgtgatgccctccgatgacattaactgtggtagtaaccagcatcattcagttgctgttttagaaggaacttaaaaatggaagatttgaaaacatgattgtgaaaccataattttgcactgagtccagtattaacagtttttcaacagagttaactcttgctgctttttgttttaaccctgagtgtctagaactgagttgggcaagctccttaacccacagcacaccagcagcctagaactctccaagatgtcacttggattttccttctgacctgcctttcctgatcccttgctacctcaccctatagacataggcttacttttccctaatattttcctgtactttaacgcatagctgtgtttttatgaaaaataaaatactggggttttatgctcaacttatttaaatgatatttcactacaaattatgttcttcttctatttgtttacatcattatgcttttgaaaaccaccagaatatgtatgtgtacctctggatctaagctgttaaacatagtagccactagccacatgcagctaccgggcatttgaaatacggctcatgcaagtggaaaactaaatttgtaattttaatttatctttaatttaaatttgaaaacctgtatcttaattatgagaatacttttaaatatttttggaatatcttgatgaatcttcttttttcagttgtacattttataaaacttaaatatgaatcaatcagttccaatgaaaatttagcctctgatttaagatgtactataaaatacacatcagatactgaaaatagtacaaaataggaatgtaaaacatatcagtaagttttatgttgatgatatactgaaatactactttacatatattaaataaaatacagcattaacatgatcacctaattctttaaatttaaaaaagtaaaaataaattttcttggtacttttttgtgtggctactaaaaatctttaaattacacatgtggttcacattatacttctaccagacaggggtgatctaggttttaattcctctaactactacaagtattctataataagcataaataataattttacttcattctcttatcagcaggcaaatagattgtttctaattctttaccatatcaaacaaccctccaaattcctgtttttatgcatcctcactaatacttattatgatctttcttgttgcttttggtcaacttggtggttatagagcagtgtttcttatttaaatattcatgtctcagaatactgaaagtgtacatattagccattcaaagttcccctttcgtaaactgcccatttatatctttgcttattaaaaattttgaattcacatcttttatttaccaattagtagaagtaaaaagatatattcccagtataaatctcttgtccactgttagacgtaatttttcagctattatacgtatctccaatattttcttagcttgtactttgttcatttttcccatagtttatttcattgaacacaaatctttaattataattaaattccttaaattttacctttattatttcaagaaattctaccctagtaagaaattgtgaagaaatttcatcttttctactcttggtttatagtttcgccttccatatttggatcttcagtccatcatgaagccctatagcacttagagcagcagatggttgccaacatcctaggcttaggtacttgccatttgagaatctgaacaaaactgaagactttcttactgaaagaatgtatgtgcataaaatactatatatataatttcaggctgttcccagacctctactgcaagccctttcatgtatccttatgcagtccacagaatccaggcgcaggatccccgagtctcacagattctactctctattcaaaaacttcattgtatttttcatggctttgctcaccatctttttctgggttatctcatattctcaactagtttatgagctccttacggacagagacctagatccaggcatctccaagatttttcatggcacctgagagctgggagtgctcaataaatacgccccttagcaagtgatattccagaaatcagactcagagaagagaatgtggtgtaaggcccaggggattactctaaagaggcctccattaattcatgcattcaatcaacagtcattgagcttgtccactgtttcaggtcctgggctacatggaagataatcaagggaaaggccacagtttgtgtcctcagagggttcctattctagaggggacagcaaaggagaagtaattataacacggggcatcaatgctctgctaaagtaaggaagtagggagcttctggtctgcataacaggagggtacctaatggggcctttgaggtaggggaaggttgggcctctcagcaggagtcatgtttaggcggagactcacaaaaatgcatagtgttaaaaaaattaaatttagcctgaggctgtctccgtaatttgagtccctacctaaggaactgcagcctaacctaacttagtctattaaacacaccgaaagcctaatttaggatgctttttttttttttttttgtaacagcagctgagcttcagccaatcacaggctgccaactgatcagaccatgaccaaataaggtgaacacctagacataacttaaggaggaggcaggatttgactgaggaggcagggctcggacaccagatcaaatcaaagactacctagaacagggacagagtggaagtacatttccgtaagatatgcccaccactggtgccatgccactttatctctccagcacttaatagattctacctgaacccctcaccctcaactgctattaactgaacctggaaatctgagtatctatatctgtagtgcattaatgattctatattttgcacccactgtgtattaatgacacaaaagtggaggtttcccttcaatgctttgatccaactctaagctgccaagtccccaaggctgtaacagtgtatacaggattctacttgtgagcaaggaaacaaaccatatatggtgacttctctcagataacaacatacaggaaaaaaataaaacaaacaaacaaaacaactgcctaatctgggaaggtaggagtactgacccactctgtgaaacaaagattggttgggtatctccattggaacagggcaagaatatctctacagacccaatttggcagcaatggatagatatcagatgttgtggagcctctatttgcaccccaactggactaatttttgtttgtggccattaatggggaaaagtcataccccatattcactcttgactaccccatgagccacttgtttttaggagtggctttcccttgtatataaaaaacttggaacagaggtgaatgtaggatggccactcttgcttctctaggggtcacagtctataatcccataagaaccaagaacaccagaaataaacaagcaacagcattaattctagcaggaatcagagcagcaatagaacgagtggcatcctggggcagctttgcctatcacgagtacaccctgaaaaactagactcaaactctagaatccctagccaccaacacaggtcatgtactaaagggaatcctagagtccttagaatctttggcaaatgtacttcttggtaactcattctgagggctgcccgattagttgactgctctttggtcaaactctgttaaattaaacttgtctacagtttttcttttaccagtaggcagctcatctgaaaacagtaggagggaaaagagggaatcctagaaatcgatctgtcataaacattgtgaactggctagagtgctcctgccttttcctgggaatcagaaagtagcagccagacaggaaaccaaaccacctgatcttttacaaacaggaatcagatcactgtactgccacatttaaagccaccaggggcatcccatctaggatgggatgggaaaaagtatgtctaaaatatatatacatagtgtatataaatatatattatatataatataaatagtatataaaatatataagtatatattacacatataattttttcttagtataagtatgtcccgcgtaatatttgcaatgtaacttacactaacaaagtatgtgttatttatcagaaagtcaaatttatggcagttaaacctgccagcccaaagcacttaaaatataaaattacacttaaaatagagtcttcagtattatattttctctggctttcatcttagtgtgagctctgcattgttccccatgcttcaggcatgctgaccagtgagaatgagaataagaatgccaagctccatcccatcttagcaccttggcttctgtatcttctttccatttagaatgtgttttccctctttcttagcgtggttggtttcttctcttctttcaaataccagtttagatgtcacctccatagagaggccttccctaaccacaccacctaaagtaggctatcccaattattttctctctagatacatatatatatgtcagtccataaacattttattctttcacttctaaactgttgccctcaccattatgtcagagacttctgccttttgcatctttgtgtccctagcccttagcaaaatgtctgtcacatacgagatactcaacaaatttttatcatataatggaaatcttaagttagtattttctctggtgcttccaagacatgcattttgcctagacatgttattgttcgtcatgtgaactggctatggcaaaacacattgccttcagagagaaagagccacacaagttggaaaggaaaggtcacaaggatgaaagaactctatcaacattaatgccttataaaaaaatctcttaagagataccaaaagatggaaagaaattgagtctatcatttgaagacatcccccacccccgcttttttgctttcctgcaagtcatatctgagtcatacctaaggcactttggctgtgcctccttgtggtcctctccatttcttactacttcatctcatcactttaccaccttcaaagagtcctttcctcatataacctcacatgatgttcacaggattaaaaaactccaaacgttcaatagagaaacaacattttcttaaaaatatacagacagacatatgcgaattctttcaacatgcttataaatctatccacaaccctactcagagtatgcttcaaatgtaaatcagaagccatatatattgtattcttccaagtgattactctggaaaagaaaaatcacacatatttattgagaggagaacaaatttaataattttgctcaatcatcaaaaacatttctaaatatgagctatgataggaaaaaaatcagtttaactttacatatgaattattttcctgttttaatcatagaattttttaaagttttggattagattcaaatttcttcagagaactaaatgataagtttgcaaacaattactggaaagaaataaggacaggtgagagcaaaagaaagaaaaacggttacagagtgtaaaactattttcaagcacaaagttaaaaacttctaatacagaacctggaaaacactttatgtgtgtgagataaatgaaagcgttgaggtcagattagaaaaacaaaacaaaacaaaacatagcttctactgacaaatgtaaatgcaccctgtgatcctgttgccaatgaagtggcattgctctgatgtaccactcccatcccaacccaagcacacacttgtcaatgagcaccagggttttcaaattatccagaactctatcataatgatggagctaggaagttctttcagcctcttaacagcagcgcattattttccctatagataatactgagaacatggcaacacttctgcctgatctgcttattaataatacccaacacagcatttattagatagagaactactagatgttaggtgctgggttaagcacaggaaaagaatcaacaaattctacatcattttctttgttgtgttggtggtggtggttactgttgtttataccttcagatctctttctacactaaatttttgggtagaaatgtttaaatatcatccttagcctccgcaataataatagcatttcatcactatcactggtgagaaatttgtgttttatttttgtttacattttacattaagaaattaatgaagtgggaatggctacctttgctgtatactccaaactcccactgatctgtgtgtgggttgcgtgtttgtctagagaggacagttgcccaacacaggaaaaaaaataccctgtcattatatgatttttcacagaactaaaaagaaataaactacccccattccaaagcgtggcctcctatctttttgctacacctcatatacttttctcacatggcaagaagggtacccttgactgctcagtgcctctccctcctcttgatgctgagatgctccaaaacaccactggggttcttcaggagggatttcattgtcaactccagcttgcagtacagggaagtgacatctagagtgggcctctttttgtcactttccccatactaccacacacataaaaatgcctgtcaaacactgtcctacatacatggatgagaaaaagaaataagcactctactatgaaagactctaactagaaaaagcaaggagatgccaactgacaaatgtatggtgatggactttctttttttttttttttccaattctcagatttatttctgaggctctcagccaatttctgtgtcataaagatggtgcagttcagagcttaattgctttagcacttgcaccaagaaaaactgtattgcaaacaatgaagaaagaagagaggaaaccaacattttctaggcactggccacgtggcaaccagtgtacaaggcatttagagaaagctttttgattccattcaatcctggaaaccaacatgttgaagggccagatttttcaccattttatagggatgcaaactttagctcagagaggttaaatgacttgccaacagtcacacaactagcacttagaggaacgggaaggctaactcggagctgatgctgcagcttacactcactccccactcccacgcaacacaaactctttctaggcagcttcgaaggtaccaaacaagtggctcctaaggactcagtaaacattcctgtcagctggccaagatgaatattttggataatgtccagacacgtgaaataccagctttaagttgtggaagtgcttcaggcacaaccaagtctcatttacgtcctttaaaaaatagtcatgacctgcccccttcacacactgtcattcttctggaaggtatctgagagcacagctctgcaaatgccaagagcattatgcagtttccatacatagggcttcctgagtcaggtttggcagggcaggggttcagtgtacaatatttctgccttatttctttaagtttctcttggctacagctcttaagagacacacagagggaatggattctgtagaagatttctcccagaaattttggtgtagattagaaagcttggtttgcttctggttctattacttgagatttatttggaactaaaaggttttctgcctgagagtaaccatttaatatattggggaggggggaagaataaaatgctccttttgttttgctatttgcaccaccctgtcccgattctattgtttgcagtaagttttgtaagagaaactcttctgcactccttattgtgttacaagtttagatgtacccaaaccatcagcagttagattccaagtatacgcttttgattgattcaagtgcattacccgggagggtgtgtgctttgctctgttgttcttccagccaactcccttgccagctgctgaaatgatgccaccaccggtctccatgtcatgcagattttacaccctgataccaggaaagcagaagcatttctcaaaagactttttgctggcttggcaggaaaacagaaattgctttttatcaaaatgaaaaaggttttcttcatgggaaacagcaaaagcagtttgaaagaggggccaatacttttatcctagataaggtgttttcagcagagcagacagaaaaacatgttttccttcctttcatgacatcaatcagatccccaaagccagctacctttattcacagaacagatggagcggtaatggtcccagaggccactcttcctggtctggggatcttgccatccctgcctgaaagttctcaaatccaagctctgggaacttgggatgcttttttctgcctctcccacactccaagaggaacacatccactattatgcatgtcttcattctttgtcctgggtggaacttctgggggtgggagaatgggtgataaagggggaagtgggattcactttgtgaacacctactagaagccaagccaggtacatcctatgcattatttcatataaaccttaccacaaaactttgagtggtattattatgtccatatgacagacgccaaagaagtagactaggggagttaaatgaaatcccaaaagtcatatactaatatgtggaatactagtaaaatctggaatgtgaaccctgcctggtctgttgcttcagagctttgatgtgccaccaacaaacacttccatgcctctctgcttagaggcccagtttaaaatgctatcctctggataaatatgtggtaggtccatacaatggaatattactcagccatgaaaatgaaattctgacacgttacaacatgaatgaaccttgaaaacataagctaagtgaaataagccagtcacaaaggatgatattgtgattctgaaaccaacccaataatcccatagatagttttttggatagacgtagaaattgacctttgtggtcttaatgcttgaagtttatatttgttttaactgagttccttcctcaggaaatgaccttcaggcctctcgaaaaaaaaaaaaaagtattggcaaactgaaactcaccagatcaccacattttgacaatgagatgctggacccctcattctcaggattgcttccttgcctctccctagttcctgttttcttatacattattacatttcttcctggctatataaacccctggttttacatagtctggttttggtcagggaaatggatttgagactgaactcccttcttcttggcaatactcatcatctcagtgactggttttctgcacggcaaacagcaggacctagaccgaacccctagtgttttggtaacaattccacttctgtgaggtacctagaataggcaagcttacagagacagaaaagtagaacacagattaccaggggctgggggagggagaaagtagtccggggaatagggagttattgtataatgagtacagagttgtgttttttttttttttttttttttttttttgagacagagtctcgctctgtcaccaggctggagtgcagtggctcgactcgatctcggctcactgcaatctccgcctcctgggttcaagcaattctcctgcctcagcctcctgagtagctgggattacatgcccagctaatttttgtatttttagtagagatggggtttcaccatgttgggcaggatggtctggatctcttgacctcatgatctgcccgcctcagcctcccacactgttgggattacaggcgtgagccaccgtgctgaccgtgtacagagtttctatttgagatgacagaaacttctggagttggatagtgtgatgactgcacaacattgtgaatgtactcagtaccactgaatgacacagttagaaatggttaacatgctaaattttatgttatgtgtagtttgccatcacacaaaaatgttccctgcttttccctttgaaagatgccacatctgccctgattccaaagctctttcttagaattgactcccactagctgtaaagtgacacaaaagatgatctactccaggcatgccaactcaaatccactgatagtgacagctagcaacactgtgttaagaaagattatgaggatgttttcagggccaaaaaagataaataacatgatcgatttgtaaaaatcccctcacaatgagacatcgaaatgttggataaaatacaacaaaatattaattgttctgggaaatgtgaattgggaaacacagaccaagtggcaaaagcttgggcagagagtcatggtattcagaggccatgatggtcaaatacaggttgatcttctaaaaacataggaaccgagtgagtaagaaaatcaaggcaactaaaacgaagaaaatgttacagtaggtaggtagtcaggcgtgatggggcaggagagggccctcccaacacccccaccaggaaagccacgctaccatcaggtgatggtcaggtggttgttaactctctttaaaataataatttgtcacagccagcaccagggaaagaccgtcttcctatattgataggaaacacctgtaactggtaatcagcagttttcaggagttgggcgagtgagcacaagcatgcgcattaagagacaaaatggcagaatatggttttctggggcattccactggaaaagggaagaaagcctcaggtgggcatacatacaacttcttaaacacactcacatgctcacctcccacatgttagcaggccacacacatgtgggtggcccaccttaagagaagaaccatgggaaaagggacacaaggcccagaagtacaacaacatataaaacccacgtcaaaaggtcaaacgttacatgtgaccttcacagtgcctgcttgggtctcttccagatatactttcctttctttcctgtgctaaagctttttaataaacttccactcctgctctaaaacttgtctcagtctcttttcctgccttatgcccctcagctgaattctttctcaggaggcaagaactgaggttgctgcaggcccatatcgattagccgccagtaacccaaatattcattgcccccaacaaaaagagcagaggttttctgtgcctacgaggttcatgaatgagggctgcctagagctccccccattcttgttgggtctccccttctagtacaagactccttgtagctttgcaataagtttaccttttccttataaaactttactagctattcttcaaatcgacaatggtttgacttcaacaggtcttcatggggtgatcacatcatgtgtcatccatagagggtaatttgaacttataagcattaaccgtgctccatgagttgttgttttttgttttgttttgttttccttttgctttgataaacaacatacccagatacatgggggaaaaatggtagtcatccaatttcttcatattgccagactcacagcaacaggaaagtgacgttattaaccctggggagcctctataacttcttaaaccataaacaaaaataaagaacataatggaaggtataattggtgttaaaaaaaaaaacccaaatgttttctgaattccatcctcatgttacacactcaaaaagtttctctgtaaagaaagaaaatctttgactcaagaatcaactttctagctatctcaaaaccaaattataatgaatttagaccgtagaatcaatactgggggactaactaaggatcactaaatcctgtgttattgattgcttggagaaaactatctttttaaatatgcatcacataacaaagttctttatttctaagaactttctccaaatcctcccatcacatggtttatgtaatgattaatcctttgtattaactactttatgtgtcagaaatattaaaatgcatattaactgttcctgggaaatggttctgcagtttctcctaaaagtatactacctactttgaataagttacatgaaaactgtggcacatttgggaagaaagcagcttagtaggagaaaaatgagatttgcaattataagaactcaatacatgggtgtcttaggcatttccagattttaaaaaagtataatgacttttctcccccagtgtgataccaaaatcaatggaatggttttggtttgttttctactggagtgtaccagttagatttaatcacagagggaaaaatcttgttttgatttctcttattaattacttcttggaaaaatgcactgtagcattcttattcagaatttcaggaacaaaaacttttcacttttcaaactgcaaatgaaggtggggtaaatgtgtgaaggagctaagatctagatatattagagtttctatctctgaatccaggaaggactttgtttatagtggtggaaatcaagcaaggagctattggttggtccacacaatgcctaggtgttggctgtcatgctccattcagacccacaatcccaatgaaacctgtcactttcaagagtgcaaataataggatggggaaagagtgttagagtaggacgttttctaacaagagcccagtggattcctacctttcatctaataaatttcaatggtttaagagagcagatccataggtgccacacagcgaaaggacctgtgtaaaaatcacagtgagactctggagtaagagatggaatgtgatggcccgaggccctgccctccaaccttgagtccacaacatacgacctctttaaaaaactccctccagaagccctacagtttcctctctggtttgcgtcttactgctgaagagtctgtttgtagagatggatatctgactaagctagctttccttttttatgctctttccctcaagaaccaagggtttttcacattccaaaataaaatgcaaactgagagcattttgtatttttgcatttcgattccctgttttgtcagtgagtaattatagcaaataaaatattgcagctgaatgtaaattgttaggcaaccagatcacagcaggatatttttcttccacaagttttacatcatagagtgttaaatattaaaatattgcaagtcaagtaaacagagagggttctttgctcaaaacattaattttaaacaaacatttcactgttattcagatcggatgctaggaaacaaatgacattttctttcaaataaggtgaatagatcatatgaaaggaaagcagacaagggaatcatacagaaggaagggcatttatgacacgagagatgaatttcagccagaagaacaggagagaattcacatgtaggagagaaagcaaaagaaagagaaattggcaaaacaacatggaaaagagcaagaaatgagaaagactgacttactgctagaaggggaaaaaatgaagatacgtctcatgtcagagtacagagacctgactcaaaataaggcagctggggaagaaatgaaattctttctaacatcatgaatttctgtttccttaggttattaccagaaaggtagaaaggagatgaattttcagacctccaaaagatcaccaatcaataaaataccaatcaataagcattgattgagtacctaatgtgtgctcaacaaccaagtacaaaattagacatggccttcttctgaggtaccttactatggagttgagatgaggagatgctgaaacaatgaatgagagtggaaatgtattctatgctgtggagtgaagaaaacacacagctcaggattcaatgataatgacaatgagggtggttgagagtaactgtcgtaacactcttattttctaagcacctcctacattccaagtactgtgctggatgcttaatattttcatttccaacatttaaaacaatccattaagaattatctcctctagtgaagaaaataaagcttcaaaacttaagttgcttgtattacacaatgagtaaatggtagggcctgaatttaaccccaggtctcccaacccaaagatcacgatctttcttctactgaagtgctggatttatcctaagaaggcattcttctgttaatccttacaccagaatgccagctaattaaaacagaaacaaaaacaaacagaaacgctgtttgagaaatgttctttgtaagggagatgacctaacatgaatttttggatgaaattataatggatatggaggagttttgtttttttggtttgagaaagaatcttcaggaaaacatatagaatttgcaggagagtcatgttcattaaaccatctcagagttaaagactggagggaatagatgttaatagccataaaggccttgcagaaaaaggcaaaccttcttttccagtaggagagaagaagtgaaaagggatggaggaggagaagagtcaactgaggagcaagaaatgttccacaatgagaccgcttcacaatatctcccagttcacaactaaattaaaataatgcctggggagaagactgttacagatacatgcaaacaaattgcacatcctgttaagtagggcaaaacagacacttggacagagaaaccagaggaagacaaaattcacagagaaggtggagagaactttaacttctcatgaactgtggaattggtagtttgagtacattatagttagatctccattgagcaacaaggtcccgactgacatctggtctacaagatcaactttctggcaatacggtaaattttttgacagttactaaatgagactgaatataagcaaaataaaaatcatcttgtgtttcaagaaactgatatactccagatacatcaccatagcatatggagatttctttaactagaaaaaatagtccatccaaattcacattggttgaggaagccagaacactgacttatccatgtttaccacagctcatctgccttccctcccttaataaaagcagaggcccagagtgactgccaaacaaaatctacctaaaaaacatgccattcaatttttttagaaggccattgaaagataagcaaattaaattaaaagaaaggaatgaagagattttccttctgtctggttgttgagagagaacatttcttgcatatccagcatttggcaatctcttagcaaaatggcaaattcacaaaccctttaacccagcaaatgcattgctaagaatttgccctacagatatacttccaaatagtatgccagaatttgtgcaagaatgtcctttgtagtattgcccataaaaacaaacaaaaaaatggagaagaaaacccatataccatccattgggttaaacgcgttttgatttatcaatacaaaacaatatgtacagctattaagaataatgaggtaggtctgctcttcaagatatactatgctttgaaacaagctaagtgtgaagaatgtatataatatgccatttaagtaaagattttaaaggctccgtgtcgttttgtttagatgtcaacatgtgcataatttctttttctgaaaagctacagaagaaacttcacaatggtaatatttggaggacaagaggccagcatgtcagagaagagaaggaaaggaaagttttcattttcctcttatacctttccttcctgcctgaagttataggtatggctaatttgatttaaatcaataatattaatgaaacataaaagtaaaataattacctagtaataataaaactatgttgtttataactcttatttgatgtttggattctcagaatttacttcactgaactccgaaatgggtggtatttttgaaatttttagctgcaatgaaagaacacagtataactgatgcaccccacccccaaccaaaccaccctcataccttgtccaccactgccatctctatcttgcatttgaaaatatgcagagaagactctgtttccatgctacagacagtacttctagaattttgaccgcatagtaaacagtcattgtatcatccacaccctgaatgatgagggacagggacagacagaacctacctaccatgtgagcagctctagagctgtcatagctatagctgactctagctcacaaagcagacatgaggaaaagcaaagtttgcatgtgcacatacacacaacacaagcacactgagaatgaaggagaacaatgtgagactatactggtcaaagagtatttaggatctgccaaataatccagttttgtttgtattttcatttacatccctttcaccttaaccattttcacagttatcaactctctaatacactgacacatgctgtgttaggcacttcgcaagtattatctcatttacttctcatttaaaatgccattggttaatatcataatcttcccattgcatatgaagaaattgacacttaaagatataacacttaccctactcaaagtcacacatctacatctagcaagtgggaggtggcattcaaacataaacacagctggcctcaaaggcactatgactcactgtattcattcctgattcaagtctcatgccttgccctgagactgttctttaggacataaattgggcaaagagcaatcaactcacaaaaagagaagaccttccagaccaaaactaggaagtttggaaaaatgagaatcatgaaaatatgcgtattacacatacagccaggttgaagaagacagaaagcattagaatgtggaggaaccttatgagctagaatgcttagtacttaaagaaatgtctttgggatcagccatgctcctgggatgaatcctgacctggccatgatctaactgtcaccttaaccatgtcaccgagaggcttaacctgcacttacttctttcatctgtaaaatggatggcataatagtgcctgcttcacagaggcatggtgagggttgaataagatcatgcacattaagtacctaggacccagtaactctctgtaattatgctgtgtttgagatcataaagctcttaatcattataaaagtacctgagaaattctggaatgctataacaggaaaacttctgaaaatatagactacccctaggcaagccctttgttttacacagcaagaaagtgagacctaatcagttagaggcaagatgcttctcaagtcagtctattgagtttttattttgcactgaattacacatctacagagcttcctgtagcaggaaactctgctcagtttgcccattgctcattcctaacacctttttctcctgcctgttcccatcccatggccaactactcattctctcagaccatcttgaagccagtgaaaatctgctggggaatactcgggggaagcatatgattttccagtagcaacactgctgctgccacctctctccctttcttcctaccgtgaatttgatcatggttccaggaaatagggtggccatcttgcaaataggcagattaaaacaatcactaagacactgcctacctccaggaggtcttcttgttaccaaagaaaatacacccctatttttttaagcaactgttaaaggcagggtttctgttacatgcagctgaactcattcccagaaaatgatagaagtcctttttccatggacattgacacagtctaggatgggatggtggggatagtacagggtactcaccagctgttggagggaaatccccaggttgtgagagctcttttatttaaaaaaaaattaaaatgtaagtcaaactcaggcttagttttgaagttcatttctcaccttgttctcatttttatcttgatactccgaatgaatttcccaacgatatctaagagcttcccattcccaggctggtccagtgatttttagtgaaattaggttttattgaaagtgagttgatttttacttattaatgttctgctaattagagcactttgtcaatatctccatgcatgcattatattctcatgtccacagcatgtgtttagaaatatgtggataacaagatggagagttagactgttctggccctaatgacctcccgccctctcaaaacgccaacataacttctggtcacgtaatcatgggccaccttgtactgttcactgactatttgttataggttgattttaatccctgacaaattttttttttttttttttttttttttttttttttttttttttttgagatggagtcttgctctgtcacccaggctggagtgcagaggcacgatctcggctcactgcaagctccgcctcgcgggttcacgccattctcctgcctcagcctcccgagtagctggaacaacaggcacccaccaccatgcccggctaattttttatatttttagtagagacggggtttcaccgtggtctcgatctcctgaccttgtgatccgcccacctcggcctcccaaagtgctgggattacaggcgtgagccactgcgcctgacagacaaaatttttaaacctgtgaatactgacacagcgcttcatgttttgctagtcactctcagtgcctatcacagaggtaggcaaatcaaaaattctcatgaagtactagaaaatagatgcacctgtcccccaaatgcacagcataagaagatacccagggactaaaagctcccaactccaaaataaacctattcatgaacatgagtctctattcctttgctcagggaattcagtgctaaagtagatagcaaatatatttatattaggggaaatatctaaaaaatggcacttatagatacatttgctaaatagatatggaagtctatctgaagacctagcactatgccagccatacaacaatctcttcacaaatatgtattgaatgaatgaatgaatgaatgaatgaatgaataagcacacatacacagcagaaaaacagactatgaatgaatatatatcctttcccctaaagaaagatactctaaaacaaatgggcagtcaaaactacaatctctcatttaactgggaaaagtaaagaaccctctatttcatctttgatttcctccttacatgatgtacaatgcaaagggcttgctagtcatatttgtcaagagagcccacaggtactatctggctcatcacagcttaacttatcaattgccattgttgtttggtggatattgatctgggaagaccttgtatcttgcgaaagtcacttctacagcaactcatcactttttctttttagtcgacatgaaggctcaagtgttgtggtatactgggaatttccacgcgacagccccattccatcattaaatacccagtgagagcttgttaactagatgaatgtcccaattaaaccagcacgttcttgtcgctgcctaacagtgatggtgggttcagactaacagtttgaagggcaataactaaaatggtttgaggagcctcaagtgtagtttcaatggtttcacacttatccattcatttgttcattcaacaaatcactcaggggcccagcatggtggctcacacctgtaatcccagcactttgggaggccaaggtgggtggatcatatgaggccaggagtttgagaccagcctggtcaacgtggtgaaaccccgtctctactaaaaaaacaaaaattagccaagtgtgatggcacacacctgtaaccccagctactctggaggctgaggcaggagaattctttgaaccaggaggcagaggttgcagtgagctgagatcgcaccactgcactccagcctgggcaacagagcgagactctgcctcaaaaaaaacaaaacaaaacaaaacaaaaagcatttttttggcaggtcccaatgtctatttccaagctgaaaatgtttgctttcccaaaggggcataaaactgtgatttttcttaacagcacagtttaagtggtcttgactctgcatcttaagttcccagggttaagctggagatcttgagaacaagaaaagagtaaaaatagcaacagtgcaaaactccagacatcatgttggctccatacggctgtgtgggttgtgcactgtgcaagttcagtgtgttccattactaggaccatgatacaaatggcagggaagtggtagaaaccccacccaaggggtatcctaggcccatagtgctccctagtacaagggccacaaactactaaatgtccaaaatcacaagtaaaaactgttcattttggtagaggaaatacttgatttcatacacatctaaatttcacaattaaagtctcaaataaaaagctgccaagtaaaaatgctcaatgaaacataattttttcctctacctgatttttaagtaaaacaggcaaagaagaaacaaggcaatgattgaatagaaatgctattcttgttttaaaaaaaattagacggtcctaagaatctatgctaaatgattacattaatatgcataaaatacataaaacatatgtacaaggatgtttattgtaagactgtttctctattactaaaatacagaagtggttatataaattatggtacttccatacatgaaatgctattaagtcaataaaaagaatgagtaaacttgtaattgctatcctaaggacaaagctccaaaacatactctgaaagacaaaaaggtaatcatagaaaaatataatatgatcctgtttataatcaaatctagataatgtacataaagggatattaagtcatgaaacagtgcttggaaagatacacaccagtcatctgacagtaataacctatgaagatgaacgaggaagtagagaaatttcatattttatatattgtaatttgaactacttttttttaaataatgaaaagtgtttgtgtattaagtgtattataaaaaatatccaaatagttcaaaatgacagtaaattacaggttatgtatagtttaatcccaacctgttacaattcatgacaaaacaaatggtttaaagttaaaatttctaatgtaacctatgtcaattacacattctgacaacatatattcattgagcacatacattacataaaacactgctccaggggctgcaggtccagcaaagagacaggtaaggcccctgcttgtatagcgcttttgtccaagacagtaaaagagactcatatattttaaagagattttcagttaaccatcattttcatagtaaataattcaactaactatgacattttgggcactgtggctgagaggtttgctgtgactctagtaaagtttcttcttggaaagacattctgtgccataaagagcattccctgcctatcaaatattcatccttctcagccatcaatcaactgaagttccctcaaacagaatccataaaacagtcatactttccatccttagaggggtttacacctttccaagcactttcacacatctacggtgtcctaagagatgggtgactaagatgcaggagcaaaataatataaatttaccatataaaaactttcttctgtctagcacacttttctcctcgctctttactcgctcaagttttgctggtccttcagtttgcaacttagaagtcacctcttccaggtggcattccaggctggtatagggatcccccctacatgcttttattgctccctattgcctccattccctcacaaggtgtggaccatgctgctttgcaatgaccaacttggtggccacatccaagtcacagggctcaggatcacctggagtgccctgggtccaaactcaccctcaagaactgactcaccaggtaggtgagtatctgacagtcatatttacagaagctctccaggtgttctgaagcagttaatcccaagatatgatgatggaggtgtggaccatgtctgtctctacatcaccatcattgaagccacggcttctgacagtgcctgatatattgctggtgcccaataaggagctgctcctttatctactggttctttcaaaaaatatttactgagcacctcagcatgccagacttctggtgaatgacaaaatgaaccaatcatgcatcatgacgatgatacagctttcattaataagactttttgagttatctgatacctgaagcaactacaggaacccaatccacacctgtccctctgtcccctgctgggtagattagggaagacaaacaaagatttgggagcttttgtcacattctttaggtgcttccgggatgccaccagtgggttccaactgctcagctatgtttagaggtcacaggcaaacagagtgggcccattgcagactgcgaggcagggtgcctctgttcaatataaggatatagtccatgagacagaaggttattacaatgaggttgcctgggttttcctccccagttttattctgtacgccttttaggtaaattccttaatatctttcttcaaaatagttggatggcatttgtcttacctttaagggattcggctaaaatccacttgagtgctggcgcctaggcagggaacaggcagcaattcctacaggtccatctacctgatgacatgaagactagtttatggttaacaaactgtttttcactctctttagaagagaaatctctgtcaaaggtcacataaactttaccgtagtcagcaaagccccttcttataggatcctccctctatatttccaccctcatctagcactgtcttccttgcttgccatgccctagtcctgctgtatcaatagagtagagccaccagccacatgcggctcctgagcacctgaattgtggctagcccaaactgagatgtaccagaagtgtaaaatacaacccagatttcaaacacttagtacaagggaaacagaaggtgaaagaatcctattcataattttctacacagcttatatgttgaaatcatactattttagatatatcgagttttaacaacatattattaatttcttttactttttatggtgactaccggaaaaactaaaattacacaagtggcttgcatcatatttctaccgggcactgcaaccgtgtctgtattggcctcttgatttctgtactataacaagcatttcccccacttctgaggctgtgtgtttttttgtcttcacatgaatgactctctttccatgtctggcatgcctgactgctgttcacccttctaaatgcagcttgtatagcatctctggaataagacttgttgaatgtctatctgtttatgacctgcagcaaagttagccaaaatgctcaaaagggggacagaattgtctgcccagacttaaggctggggctccccgaagctgactttccagtgataataaaatgtccccacccaaatctcatcttgaattgtagctcccataattcccgtatgttatgagatggacccggtgagaggtaattgacccatgggggcagttctttcccatgctgttctcatgatagtgaataagtctaatgagatctgatggttttataaagcggagttcccctctacacaagccctcttgcctgccaccatgtaagacgttcctttgcttctcttttgccttccaccatgattatgaggcttcctcagccacgtggaactgtgagtccgttaaacctcttccctttatgatttaccaagtctcaggtttgtctttactaacagagtgagaacagactaatacaggtaataaagacttgaaggacatgaggtaggaaggaaagacaaaggtagaggaggagaaaccaagagtgttaccaagccttagcctgatgacaacaggcagttgcttgaagagagacaaacactcttgctttaagaggaataaatcaaagtggcttcggatacattaaccctagcttgtcatttgagaagacagccctttatatttagaatggctaggaaagactccttctagatgatttggtgctaatgttaagaacatcacgcaaggtgtccagttcgatggctgtcaacaccttctctaaaccttgtggcccataccatatcaacaacaaaataaagaaaccaaccaagtcaacaacaacaaaacatcgtcaacaacaacaaaacatcaccaacaacaataaaaattagaatatttaagagcctgtgcatgcttacttatgtgctgggcactgttttacacattccatatattaacttagtctttccaattaagtcttcaaggtagccaccgttattgttcccattctatagatggagactgaaacctaaaaaagtcaaggacttgcccagcatcactgagctggtaagtggacgatcaaagatttaaacataggcagtgtggatcccaagcctgtgctcttaacccttgcagcatataccactctacatcttctgtactattctctattgacagtatctatgaagctagcgcttcatggtatcaggatatgatactttcttaattattcattattttgtctatgtatgccttcttttcccagctacagcattcactgtttgaagggagagattcaaccatctccttctctggaccccacacccaacttatcctgttataggctcatggtcaacagatgactgcactgtgttactaaatgccagggaatacacagaagttgtgactgcttacatattcatggaagaaaaccccaactcctatcatccaagtttgaaactaggtcttctttcctattgggggaaatttctgcaggtgtgagtaattagaaaattaaacattaattaacaattcaagtgactgattgtgttagcaagttgcttgctaaccatacaggtaaatattgtgcccccatatgatgtttaaaaataaggtcccttgagcatattaagtagtagagatggttgactcaagattcaagagtttcctgacccctttaatatgtcacattttaagtctgtatataacaaaactattgggaaaggggattgccttactcactcaccttgccttatcatcttacaaaatatcttatattaaaagagagaaaaggatgacagctctgtatctatcacctattactcattatcctgggacaacaaacagccccagaatctttctttaatgaatataggctctcatagtacatgcttatgttcgtctcacgtttgctctctctcatttcaaaaccctatttctcttctgccctttatgtcttcaaaagagacgctgatattaattaccttgcttctctaacccctcatcgttttcagccccaaacaatcagcttcctgcttttaatcttctaccaaatctattttctcatgatctaccgaagtcaccctactaagtaagtgtttctggaaaggtattttcagtgcccatttcccttgaccaacctgtggcccttgactcactggaaaaaatcactccactcctgccctttgtaatattattctcagctggaattctagcctctgtcctgcaacctccagcttgattttacaatataaacactgctacttcctaacaagttcaccagatatacgaaataaccctgtatttcccactgaagtaaattagattgttgttcagtaaatattcactctctctttacttcttattcctgagaggagtatactgtcacattcctttgatatcagacttgatttggcttaagacatgtgaatggagcaggggcttaaaatgtcatgtgcattcctgtctttcactatgagaagcagatgtcttagttttttgctgggtcttggagggtgacagacacatggacttaactcacaccctatagtcaaaacaagccaagctggcccacagacacaagaatcagagtaaatgactcttatttcaatccaccaagtactggggacagtttggtacacatgagttttatgaaacagttaactgatgcacccatacaaatgttaaacctttgttcactggaacaaaggttggaagttttctccaacctttgttggatggaaattttctcttgttcctctacttctatggtattacctctcccatgccacttctctaacttcatgtcctgtattctctcccttattatgttttaaactcctttgaagagcaaagcatcaaaagttcttatccctagacagacacaaattaaaatttgcttattcattcattcattcattcattcagcaaatgtgtggattttagaaatgagtttctgtctcaaaggtatttaatacaacacctggctcagcttcatggactagagacacattatcactgaggtcacgttgttactgtttttgctactcctgctaactgttccaaaggggaaaaaaaaacaacatgcactttaaaagcatgatgttcttgttggcagaaattacaatagtttcttctcttggtgtttactcccccaacactttcctcagctctttatttctgatattcaattaccctttttctgcctggcttttctcactttcccagaagacttaccctgggaaactttactgttttcactggtgtacatttgcactagttggtttaattaccaagtgaatctacagcctctcagaacatttgacacgtctccctttcactggatccaagacatgaagcaatgaaaacgaatgggtgaatgttacagcaaactcaaccaaaatttattttgcctggattcaaggattaggctaacatgctagccagtttctgcccccctaaaatgtcaccctctggaatgacaaaaaccttaataagatttggaaccaaagttcctatgaccagaaactgctcaacatatatgcgtcacacacaggaaataaaggcacattttaaactagagctgctgggtcatctttaaaatagcagactgcctgtcaggagaaccaatggaataatcaatcactcaatttaaagtggggagctcctttaaaatgctagggtgatggggtatgggcacaaagtgaatagctgtgacagtacagttcctcagccaagatccacgaatgtaagcaccagtgggaagagcactagaccaagaggctcaaaaatatactgtgaccttcaactagtcacttaacaagtgctcattgtatcatttaaaaaataatacaatagaactccatgaatccaattaaatttaattccatattattcgagtgtttgtttaaaatgatatttctcaaagcaatggtcaaatgagtttggaaatcagtagattaaagaaggttaagcaggtttctgttccatgcaacttctcagtaactttaatagtctactgtgcaccgtgaagctctcagacctggtggatgtggtatggaacattccccagactaataggaatcaaagatcctgtttgtttaccatggacagccttgtagaactcctattctctataatacatggccatcaattatagaagacacagagatactaaagagaatagttttcttgggtcctggtcctgaggcctggcattctcatgaagctgagtttatgccctcccctgtgatttatgccatacctctgaatccttataatgatgtccctttttgatcttaagatggctttaactggtaactatcatttgtaagcaaaagtaccttattaaacaagaaaaacagctacgtgtgagttctgagtaaatattgctaatttatgtctatctgcaattgttacttgggctgaaacaaaagttccaggtaagtatgatagtcattttgccagaggagcctcaataatccctgagctgaaatactttcatacatcaagacgtaatcatctaatattaggaaagccattaagaaatacaattactactggaaatgaagaccttttacaggagaacagacatgatggttttccttaaaagctcttcccttttccacatccactttcttctactttaaaatgaaagtgacttcattttcaagtgaccttttataaagtccaaacatcaagtgtcgtaaatattctaagtattcagaatgaggtccagtactgtaatattaagttggatatgccagaaactcagaaaagcctatttctctttaaatagccaacttataaaattattcatattgtcttcctggattcccattatgttcctcgtgcaagaaagtgaaagtgttttatacaagccacactgtggggtaatatggccaaactaagagctttcagaaggattcttctcttattctctacttctgcttctgctgctgctgctttttttaaacaaatgagatcagaggcatactgtgattagcaatgcatgtttatgtagtgagacaccagattagaaatgattattatcatgtcacctaacagagtgataataatggtactctgagatggtacagctcagctgttgaggattcctactacaataattattttaaaattaattttgaagagaaaaaggaaagaaagaaagatgattgaaaccattaaagcaatcctgataaataagaaaaaaaaacccaaacactatgttttattcctaaggcaagcacaaaaaataaaataatcaccaaagtgagacacgactgactgaaaggtaaaaggaacattcattttccccatccaaggaaaacaataactgaaaacaatttaaggcaaaaagttaagcttctattctgagcaaaggagagttggactgtatttatgtgctaataatctatttataagaaataactgattaaataagatagataaaacttagtagacagaaatatatttttttcatagcaaacaaagcaatcaaaagagaagtgttgctgaaaatattgacaattaaaaatcattcaaggactctgaagtatatttcaggcagaaagagagcagcctaaggaggacttattacaggattgaaagcatcaccgtgaattcataatttttaatatataaactgagagatatggaaatatatatatagtatgtgtataagtacacatgcatataaatacacacgcatgtattgcctacctctactcacagagaggctgaagcaatgataccccactataaattagcatacctgatgtccagatcttggtttctaaataccattctccaaaaaataaaaataaaaaaggaaccagacctccttggagaagtggttggctccattaatgggacaggacaggaacaagatgagattagaatatcctgtggtgccacaaagttacaaatggctaaaaaaaaacaaagaaaaaccaaaattgtggggacaggtcaaaagaacacatgaaccagaatgaagggattcccctggctaaatagggacataaaataaaataaaaactgataatatcccagagactacagaattaaaaaaaatctacgattttacttcacacacacacacacacacacacacacacacacacacacacacatatatagaggggggggggaggatacaaagtaacatgtaggatgaacaagtctagagatctaatatacaatatgatgactacagtcaataaaattgaattagagttttttgttaaataagtagattttagctgctctcttcacaaaaaaagtaactctgagataacagacgttgatttgctttatgtagtaaccatcttattgtatatatgtatcccatatcatactttaaacctcaaatacacaaaataaaatttatttttaaaaaaatgggaggtgggggagaaaagcccttccttacagaatttcaagtcataaataaggagtaattaaattagaaagttaccatttaacaatcatcacaaaagtaactgtttcaggtaagaatcagtagtagtgaatgcaaaaaaagaatgggtaaaagtataagaaaaaacatactacattttctacaagtatattcctataagatacttattgattacaaaaggaaaaatagcaattttccaatggagaaacctggtagacaccacaccaaccaagtgatcaaagttaataccaagaatgggagaaaggagcatcagtgtctcctgatataatgcactaagaaggatataatactacctctgtaggattctggccaatatgcaaaatctgattctaaccatgaagaaatgccacatcagacaaactcaaattaagaaacattctgaaaagcaataggctgtgcttttcaaaaatgtcaaggtcatgaaagacaaagtctggggaattgtttgagattaaagaacactaaaagacaggacaactaaacacaatgtgtgatcctggaatggatcctggacccaaataaaagacaatggcagcatttccataaggtctgcagaccagaaatagctttatatcaaggttaatttcctggttcagtaattacactatgtttttctaagaaaatgtcttgtttaaatacactaaaggagcaaagaggcatcatgtaacttgctttcaaatatttcactaaaaattatatatacatttatacacatataacatatatggtacacacactcatatataggtgagagagagaaaatataatggaagtaagtaaagtattaatatctggggatctgagggaggagggtagagggattctttacattatgcttgcaactttttttttttgcaactctaaaattatttcagaattaaaagttaaaaaagaaaagagagggagcttgacttaatattgcagctgtaccataaagtgttcttgaacaagtgacttgtcttcattgaggctcggctccccctttgcaaaatagagacaacatgacttcacagggtgatcggggtggacaaacaagatggtgctgcaaagctccaacccaagagctggcccctgaagcacacagtaagtatagcttgtttttggtaaatccaaaatacaacaacccattagagggcgttactgtctgaaagcagtttgggggcacccgaggtgatgtgcaggccgcagagacaatgctgttctaggtcaggagcagaaacacaggctcctcacacatgcttttaaatggggctttttactttctaaaatgtgtttctacacaattgaaaacaacattactttttccagagtgggaggatgaaagcaatcgtgggtgggggcttcttgagaagaggggttattttttttacttttaaaaaggtctcagaacagttaaaaatagtttttccttaagcagcctccctctgctccctgctcccaccagctgctccttctctcagcctgcccttctctttgtcccttcaccattttcccctctctcctttttgcttccagtcactcatatgccacccactcctgagaaccctaccttctcttatttttttgtttggctttgttttgaaaaaaatattaatcccaaatgaacaaagaagatacgtgggaaggaaataaatggtgagctcttccttacttcaccacctgtcaagttttaagtttttcctccaactcacactaacctcctgcgcaaccataaacttcagtgcttgccaaagcccagaaaattctaagtaaaaagcagaaaatgaatgcagggaagggggtgcattcttattgttcatcagatctgaaaaaaataatgcccagaatgtcaaatgatattacactattaaaaaggtacagtaaagatgtgctaatgatagattttttttctactccaatatgttgtaaatattataaactatcatttactgtcattactttaatgatgtagaatgttgaaaactcaatctgggttaatttacaaataagtaattttgaaaggagaaaaaaatatcttttctatttccgtgtaatgtcccattacttgacagtcaaaatgtggatacagccaaaagaaaaataatgaaggtcaaggaggatcaaaatttacctgatagagtacctatctgttagaaatcactttcctgaaataccttctctgattttagaaaactgaaaaaacagaaaatacactacctttgacaatgcttgcgattcagggttgtgcttgtgtatgggggtgggagaacctctgctaggataggagaaagctgccagacacaagttcagatttaatagaaatagctttcaaatcaggagtctagccatcaaccagttttagatggacagtcccagtttcaagtaaataaaatatttgcatattagagcctcgtagccctacttagctgcaagtaaattttctgagatttactctgccttgcttcatttcatccaggcactgattattttttcattctttattcaccaaacatttactaagcacttctttatacaataaattctgagcaaggtactaagacatgaagaataaaacaggtctggctggagactgcacgaaattgccagtctgtctgagcctgtttgaattcataaagtccccgagaaagaagaaataggtgaggattagcaaccctgtaagagcatttacaaagaagggagtgcaaaagaagaaaatagcaccacagctcaggagggcaatggtattacttaccaagggtgcagtttgtttgatgacaaatctcaaaactgaatgcagtgattgtgttagatgcaaacacttggatgaaatagatgactgttcttgtgaccttgccaggaaagaggaggagtgaaagagagggctagagttctagtctcctttctgagttttgcattcattggcaaccatgtacctctagacatgggagtgcaggcatctatctctatcaaggtacatgacatgtaatgaaaggaagggatagagaccaggcaagagaaagcaaagagagagaaatagacagggagatggaatgaggtagacaaatcttagaggaatgcagtgcttctccaagtttggtgcaggaatgttcccattagaatcacctgagggggttatttaaaatgcagattcctgggctctgacccaggtctggtgagcctgaatgtctgtggctgggactctaagatttgcattttatatacgttttggggggtggttctgcatattaaaatttaagatcagaccactccctaaatccaagggtgctattttactgtttacttgaccaacagtataaatgggtgtcttcaaagccttgtcaccacaaccccatgcagcctgatccacttacttctctgtatcacactccctcctctcccaccaaggaaaacagagtgatcctgaagttccttaaaactcaactcaatctactgctcctcattagtaataaggttctgttcaaggaactattggctaatcattcatatcctgattgagataccagcatatcctacccaattattaactatggatggactccaaccaggaaatccaaaactatatgctgcttactgaatgacaataataaatgtaggctcttatttaattatgctgcggtttattaactatccgataataaggaaaacccctagtttattatagatctgtggggtgtgtgaatatgtgtgtgtgttttgagagatatatacaggaccctaatcagagagagtgccaggaataacagccatgcatgccaggcatcttttcctgtttctttttcagttacttgaatccacctgtgataaacttgccaaaagaaagaggaagtacaataaccacaaacgttaagtgatttttttttttgttctacaaactcgatgagttcactgcattgtctacttatctgtttttgtaatttcaacttttatttttgatttcggggtgcacatgtgggtttgttccataggtatattgcatgatgctcatgtttggggtatgattaataccatcacccaggtagtgagcatagtacccaatagctctttttcaatccttgaccccctccttccctcccactagtccccagtgtttatggctgccattttcatgtccatgtgtaccatgtttgtctgtttaactctcacttataagagagaacatgtagtatttggttttctgttcctgtgttaatttgcttaggataatgacctgcagctgcattcatggtgctgcaacagacatgatttcattctttttttatggccatgtagtattccactgtgtatgtgtaccgtatttcctttatctaatccaccattgatgggcacctaagttgatttcatgtctttgctattgtaaatagtgctacaataaacatacaggtagatgtatcagtttggtggaacagtttcttttcttttgaatatatatccagtaatggaattactgggttgaacagtagctctgttttaagttcactgaaaaacctcccaactgctttccacagaggctaaactaatttacattcccaccaacagtgtataagcatccccctttctccacggtttcaccagcatctgtgtctttttggctttttattaataactattctgaatggtgtgaaatggtctctcaccgtggtttggatttgtatttctctgatgattagtgaggttgagcattttttcatgtttgtttgctgcttgtatgtgttgttttgagaagtgtctgttcatgtattttgtccactttgtaatagggctgttttttgcttgttgaattgttgaagttccatatagattctgggtattagacctttgtcagatgcatagtttgcaaatattttctcccatcctgtaggttgtctgtttctctgttggtagtttcttttgctgtgctcaagctcttcgattaggccctacttgttaaattgtgtttatgttacattgcttttgaagactttgtcataaattatttcccaaggctgatgtccagaaagacatttcctaacttttcttctaggatttttatagtttaaggtcttacatttaaatatttagtcaattttgaggtaatttttgtatatggtgaaaggtaggggtccagtttctttcttgtgcatatagttagccagctatcccagcaataacaatagggtgtcctttttccattgcttaatttgttgactttgtcaagatcaggcagttggaggtgtgaggttttatttctgggttttttattctgttccattggtctttgtctgttttcacgccagtaccatgctgttttggttaatgtagccttatagtacagtttgaagtcagataacatgatacctctggctgtcttctttttgcttaggattgctttggctactcgggctcctttttggttccatgtgaatagtcttttctaattccgtgaaaaatgacattggtagtttgataggaataccactgaaaacctgtatattgctttgggcaacattgccatattaatgatactgattcttccaatccatgagcatactgtgcggtctttgatattgggtcctgactaggccaagaagacagagatagactggtccctcaaaccttttctctaatgtctggagagtacatattttatgcttttcagtatgtatggcctctattgcaacaactcaactctgccattacagcattaaagcagtcatatataatatataaacaaatgggtgtggctgtgttccagtgaaactttatttacaaaaacaaatagtgggccaaatttagcctgcaggctcttgtttgccaaccccagctcaaatcatcctcagacaaaatttagggagctgctaataataacaaggccatgctctgctatagtgctattaagctattgcctcagcatcaaattcaccctttggtattctcttctgtgataactggcacgtttatgtattgacaagaaagatgaccaccacatattaagtggggaaaaaatcacactttttatagcaatatcactttttttaacaaaatatgatcctctatacgtacatacataatgttgtataaggattcataagtctcagaaaggataatactgaaaggttcagaggggtaacctctggaaaatggaatcaggagtaggaagaaaagattactctgattttttgctttacattcttttgtagtctttgaatttatttagagtaagcaaatattaccattgtaagttacaacaataaaaaggaataaatcaaggtggagtcttaacagtgctgaaacacttttgttaatccatttccccagttccaacctaagctttacagaggtgctattgtcaagcaatcactcattcgttcactctacacatataataggcatccactttgggccagaccctacgctatgtgtgaggaattcatgaagtttaggatctaggtggaaaaacataattatataagctaaaattgtaattaaaacaaataatgtacatgaaggagagatggcatcacatttctttattaatatatttattgggtattatatcccattattgctggaggataaaatctatgccagggaatataaaaagatgagacagagaaaatgatacgagtaaacacgctgaggactttagactcagcatataggtgtttggttcctaccatatcatctacataatttccttaaaactgctgtgaatataaaatcacaacagctgttttaaagagactgaaattgaaattcaatgaaacaaggcatttgtaagtcttccttggctttctacattgatagtgacttttttttttctttttcacactcttagaatcagggatgggttagatgttatgatcttgctgttacttcaggcatcttctgttatcattctccctagaggccaaaggcagagaccatgtcttcttttctatatgttggaggcactgtcttttgagttatatgccaaacaccttctctggaattggtttgccacttctagggactggctccctgtcgccatgtttgtgtaatatgacaacagacttaggcaagtgatcctagctgggccagaattccttcctcacacactcaaaacaggaacaaaagagagtggtctagattttacaatgtattaactcaagggatgaagaattccttataaactagacagagacaaagatcttcagagataaaagacgggtacagacaagcagagagaagattaccaagagcagatcattctgtccaggtgcctctgattttttgaggtctaggttcttccaaaggccctactacatcctttgcttgggtttttttccatatgacatcattctacacttacattatatcttcccttttcactgaagcatctatatataaattaaagcatcactaactgatgcatgtgtatatattccaagatgtttaatattgctttcctgacagtagggatttttatctgcagtgcttcagagccaaagcaaattctaatgttatttttttcctccggaatgttctcccagaaagtttctaccagtttgctacaagttgaatgccacttgttgtcatttcagaacctcatatacagtattctttaatagccagaaacacaattataggggaggtcagaagatacatctccaaagtcttctaagtgttctctcctgtgccctacaggccaaaatggtttatatatcaaatgaccttggacaagttgtttatcttttgagtttcagttgtctcatttgtatacaggcaattctgttggctctacagtgctgctggcaggataagtgacaaactctttggaaagtccctcacacacagtcagtgtcatttaaggtggctcctcctgtgagattttgcaattagggatatgatcagtcttagtccattttttgtttttgtgaagaaatacctgaggtggtataatttataaagaaaagaggtttatttggctcatgattctgatggctggaaagttcaagattgggtatctgcatctggtgagggcctcaggcttcttcatcatctcatggcagaaggcaaatggaagccattgtatgcacaaatcacatggtgagagaggaagcaagagagagagtaaaagggtggggggatgccaggctctttttaacaaccatctcttctggaaactaatagagtgagaacttgcttaacccaaaggacaggcatcgatctattcatgaaggatctgccctcctgacccaaacacctcccccaggccccacctcccatcattggggatcaagtttcaacatgtggttttgagaagacaaacatccaaaccatagcattccactcctggattcccaaaacccatgtacttctcacatgtgaaatacaattgtttcatctcaatagtcccaaaagtcttaactcatttcaaaatcaactcaaaagtttaaagtccgaagtctcatctgtgacccaaggtaatttctttccagctatgagcctataggatcaaaaataagatgtttgttttcaacatacaatggtttcatgggcactgggtaaacagtcccattccaaaagggagaaattggccaaaagaaagagaaaacaggccctgtgcaagtctgaaacttagccgggcagacatgatatcttaaagctacaaaataatcttctttgcctccatgccctacatcctaggtactgcaaggggtgggctcctaatgcctcaggcagctctgcccctataacttcagtgggtgcagctcaagtagctgctttccttggttggagttgaatgcctgtggcttttccaggttgaggttacacactgctgctgctgctggtggctgtataatttgggagtccctttggtagctccacttccatagctccactaggaaccctgatagagattctgtggtggctgcacctctgtggaaggtctctgtctatgctttcagagatctatgagtcatctctaaaatcctctgaaatctatgagtcatcaagcctccaccacccttgcattctgggtgcctgcagacgtaacgtcatgcaaaaactgacaaggctcatggcttgcaccctccagagaaggagcctgagctatatctggggccatttgagccatggctggagccagagcagctgggatgcagggagcaacatccagaggcagcccagggcagcaatactttaggcctgtcacctgaaccattctgtccatctacacctctgggcctatgataggaggggtggttgtgaagatctttgaaatgccttaagggcctttttcccattggcttgactactagcacctggctccattttaatcatgctaatctctttagcaatttcactggactgggcaatagcattggattcctcttctgaaaatgtttcctttcccaccaaatggccaggctgcaaattttccaaacttttacactctgcttcgcttttaattataaattacacctttagatctttcctttgctgctttaattcagcataacctgttaaaagtagccatgccactaactgaggtctttgcagcctagcattttcatccaccagataccccaccctcatcacttttaagttcgaccttccacaaagccctaggacatggacacgatgcagccaagttatttgctactatgtaacaagggtgacagttcccagtaagtttttcattttcatctgagaccttgtcagcatggattttacagtctatatttctatcagcattttggtcacaaccacttagccattctctaagaagttcaacactttcccttgtctttttttcttcttctgagacctccaaactcttccgactgctgcccattacccccaaccactgggtactaattttctgtcttagttcattttgtatcgctacaaaggtgtcactgaggctgtgtaatttataaataaaaggatttatgtggatcacaattctaatggctaaaaaattcaagattgaatatctgcatctgctgagggcccctggctgcttacactcatggtggaagatgaaagggagcttatgagcttatgtatggagagatcacatgacagagaggaagcaagatgtcaacaaggtgctagtctcttttcaacaattagttcccttgggaattaacagatggagaactcatcccccaaaggcaggcattaatctattcatgacggatctgccttcatgatccgaacacctcccaccaggccccacctccaatactggggatcaaatttcaacatgtgccttgacagggacaaacaaatcaagcatgatccttagaaacaccacatggtagagtggaaagagtatttaaatgttagtcaggagacctctattctagttccctgttctcactaactagttgcacggccatgctgcttacttctttccaagaaacctgtaccttcatgcataaagtgctattccctatgcccgagtatcatcctacatcatcatgtcatggaaaccccaactctaattcatgattcatcttgagtcctgacttcttcagcaaggtctcctcagtttccacaatcagaggagaacattcctttttttgcataaataaacactgtacttggatctctcttatgggagttattaggctcaaccctactttatagatctagcactactcaattccttcttatttactttctaaagacaattcatcttccaaagttatagaaaaacaaagtttagcatttgctgcatatgtccaacaaacataattaattggataagaaacttggcaggtaattagtactaggcataccatttgcttttttatgcccagaacctagaaaagtgcctgacacatggtaggtactcaataaatatttattaaatgaaaaaatacccagacttggttaggaaagactatgtaaggcaacaatttcaagggtatatgcttttaggccaattcagtttgccaaaatctagcccttgatgttaaaaggaagctggggcttacagaaatggaggaccccaacgctaatggcaagggcagaaatcatcatttatgagacatagtctcttgtttggtggggaatgtttgacagctagctgcataattccacacggttccacaggagatgattttggatgtggagggaacactccaagcacacttcttatgaagacctataatcagaggtcttaacaaacacaagtgattaatatttgttgacttcatgacacatttattttctttagagcacttaccacagcttactctaactttattaaactttttagtatatttttgggttttttttgttgttggtggtatcctcaataaactatgagttctgtgggggaaggaaccatgattccctgtccattgttgtacatccactacacagcacagagtagatgaagctcaacaaatgttggatgaataaatatgcatatagtatgatggatggatggttgagtggataaatggacggaaagaggccagctagtcacccatacaagcttctgggttatgaacctaaataataacacaagttcaacagcaacaaaaataatcccattccattataggctggatgaaaggcttacccactgtcttacaccattagcgctgctctaacaaaatacctgacaatgggtgatttataaagaacagaaaattatttctcacagatctgggaaatccaagatcaaggtcctagcatcttgtttctgatgagggtagtcttctgcttccaaaatggtaacttgttggcagctccttcggaggaaacaagtgatcacctcccaatggcaacatctcgtaatattgttgaattggggattaagttttaacatgcaatttggaggagacacaaatattcaaaccatagaacccacttagagatgacagaataacgaatatatatgaattaaaatgaatggaacaacaacaataacaacagccatcacttatgtagtgcttactgtgttccaggcattgatctaaatgctttacatatatgaattcttaattcctaatacaaaaaagtgagtgttccttcttgatctggagccaagactgcatctatcaaaatgggaatctgatcatctctcccatctgccccccaccccacgtacatcaatggtctacatgacaatgctacaattaattccagaagtaaacttaacctctcactaagtgcccaaccaaagagactgcatggtttcccagtatgaaaatgtgaaggatcaattcacaatttgtttcctgcaaaactgtcattcctctcttcatacccatcactggagaaattacttttcagaccattctacagcttgggaatactaaataagccctaatgagttcaaaagtcggtaatgacagtactaattcagtggcctgtttggtagaaagtcagtctcccttcttcaaaagcaaaataggattatcaagtgagctgggagcattttctttacgtgattgatgggtagaaaaagtaatcacctttgaagtgccacaacatataatatatctcctgtgttctctttcttcttctgacacccacaagtaattgaagggaagggagcctcttagaatgaccaacgaagtgaaggtgacaaccctttctctgctatctaccactagagtgacatgctggggtcttgaatagttgagaactgacatgagtgtctttgatgggctgctttgatgcttggttcagagtgtacctgccaccagtcaggccacacagactttgggtgaaacatacatctaaggagacaagtgttactacttcttagaagcaaagggcctgtgcacctgtgaaagaagatctgttgtctgagctctggggtcggggtaaggtccgcaaggtggaagtgaaggaagtcaaggagcaaagcaagttgaagcaggtaagaaacactgaatatgatttcaaaacagtttctcatcatactcatccataatgaccgattaaccacaatgttcagactgacaactaggagatcattagcctcttgacctcagctcactgatgcagaagcagacagtcgtctccttggaaaaggcactgctctacagtagcttactttgtaaggggatttttgcaactacaagtaattcaactgaaacagagttgacactcaaaaaccttaagaagcagggattatcaggcaggtgaacagttttattcttaagagctcactctttctgaactctcctaaagcccatccaggcaaggacatatgagtttgttatctgaaggaagaaaaatgctttgaagaagatttataaagaggaagggtctttggtttattgacaagaaagtaaaagactttctagagttgtaagcgaaatgtcgctgttcaggttctagaacttgctggctagagaacagatggctgccacttgttggcacctggagtgacaaggagttgaggaaggaagagagtgtcatccatgtgatctggcacagaacattcttctctggagccactcttataaagaagagactggcatgtttggtgggtttactgtatgatatggtttgaatctgtgtccctgcccaaatttcacgtgggattgtaatccttaatgttggaagtggggcacggtgagaggtgatttgatcatgggggcggtttctcacgaatggtttcgcaccatccccttggtgctgttctcatgatagtaagttaccatgagatctggctgtttaaaagtgtgcggcacctcccaccttgcctttcttctcctgctcccaccacatgagatgcctcactccccctttccctttgccatgactggaagcttgctgagacctccctagaagccgaagctgctatgcttcctgtatggcatacagaactgtgagccaattaaacctcttttctttataaattacccagtctcagatatttctttacagcaatgtgagaacagacaaatacaccatagtacctccaacctgctaattaagtcaggagtctccccctggttggctgctacccacaggctccactactggtgagtcgtagaagacaaataaaggcattttaaggaatagtacgacaataatctctagatacatctgcaatcaagtaacagtaacccctctcagaagctatgccagtatgttgcagatactgaacacacatctgttaaatgaatgaaaatgaatgaaagaataaatgattatacagtgtacttgtttcataattgtaactggtttatattgatttggttatatctgcttggtaccatgtgagttttgattacataaagatctacagtctttgtatgacatggcctcagaacacaagtcaacttcttcatctggttctcaacctaagaaataatgatctgttgcaaggacaggctggccatggtagaagtacgaagcaacattttatctacatagtactttagaggtaatgtaagagattttcaaaatcatgcttttacaatgtctacattaaggtctggcttttaactaaaaagtatgtgaaacatgatagcatttctagattgattccattcagaggtgcttttatttcacacatatatctcagaccaagggtaagtatggtaagaacaagtcactaggaggccagcaagagaggattaatgaatggaagaaatggaaaggagagtgaaacactggtaaactcatcccagctccagcaagaggggccaagatatctgagctagctggaacagcacaataataaaaataataacaataatgacattcactgtgagcaaaagaactctgtaagcaaatcaaaaatatcagtgctaagggtcttaatagctgattataatgaacttcctcatgtaatctcagggagcagaaaagagaaaatagattgtgcatctgttcaaactaaacatatttcaagctggaaccagcttggtgccaaagacatctctgtcacagagaagaaaaaattccaaatggaagaaaaattccacttcatgctcaaacaccatgaacttcgacaggaaaattaggtaaccactgcctcacttacaaggcaacgcatcagtttcctatggctgcagtaacagattaacacaaacttagtggcttcaaaccacaccactttcttatcttgctcttctggaagttgggggtctgacacaggtctccaggtgtgggcagagctgacaccttgagcctgacgcaggtctaaaatcaagttgtgcgcagaggtgacttcctttccagaggcttcttttccagtttctagagtccaactacattccttggctcgtggcctcttccttcatctttaaagtcagcaataatgggacgaaaccatctcacatcacatcactctgacctgcttttctgcctcccacctccacttctaagaatccttgagattacactgagcccacctggacagtctaggataatcttcctattttaacatcagctattgagcaacctcaattccatctgcaaccttaattccccactgcatataaggtaacacagccacagtttctggggattacgacatggaggtctttggtaggaggggggtattctatccagggatccccaaccgccgtgccacacagcaggaggtgagtggcgggtgagcaagcattactgcctgaggttagcttcctatcagatcagcagcagcattcatttctcacaggagcaagaaccctactatgaactgcacatgcgaaggatttagaatgcgggctccttatgagaatttaatgcctaatgatatagggtggaacagtttcatcccgaaaccactccctccaccaccgggtctgtgggaaaattgtcttccatgaaacaaggtccctggtgtcctaaaggttggggactgctgttctatattgcctactacaggcatcaatgtttcaaatttacttaaaaatctgttcaggtccagctaccacaaatacaagtgagtgcctctcatttgtgaaaaactgtgtatgtgtaaggtgtgagaatcctatcttattttgctaggcagagctgactatatgtgctctcagagcccccagaattccagaaaaccaaaatttaaaaaaaaatattgaagattaaaaaacagagagacagtgttacccagtgaagtttctaagagaatctacccactaacagacttttccccatctcaagttctcaatcattcattttgttacatttttttatatttgacaaatgatatctaatgcatttcattgctgttagcagtttagacacttatgagaaattaaaaccccattaagtgtgaaggcatctaaacaataccagatctgccttccactgaatatattttgggatgacaggtctgcttcatctgactcctcaacaagaacagcttatgaaactcacagttttagtgacagggcccaaccggcacctatttttgtatcacctggaaaaaaaaaatgcccacataggcaatacatctgatacagaaatgaaattaaatagaacaatactgaggcatcaaccactcagatccatttcactgtttcctattctgagacaacctaattgaaggtggcattccaaggttaaatcctagctctgacagcatctcctgtcagacacctgtcaaaatgtaataagacacctgtgaaagggaagtgatgccaaagccacatcattttcccctacaccttgattcctaacttgcaggattcatgtcacccagcaaacagagtggtagctgggtgctgctggcactgtgccaccatttgcaggtgagggagggaagggaagggaacacaaggggtgggggagagagagagagagaagaagagagagagagaaggagagagggagagaaaaaaaaagacaacactgcaaaaggaagcacccaagcgttttaagtttagcaaatgattatgagcataaaaggacaactctgaacggacttgaattttaggattcatccctagagtcttgatcatgatcagaagcagggaattattttttaatatctgttttacataattaaggggtggtagctttcatgcaaatgaacgctttgaatgctcacaacaccaaatgggcttcattagcttagctgggcaattatgaagcaggaagtaaaaagctgagataaagacttatctcaaaaaggtctgaagcagggcgtgttgatagccaagaggcacaacgatgcattttgtacatttattacctcggaggcaaaacttctaggattctagatagctttgaaagcagtgcatacattccatttaacacccaaatgaaacaggtggaatgtttaaagatctgtagaaagtcttgaaatcgttcccacacattggaaggttttaccaaaccttctctatttattctaagtgctttttctattgtttttcaattgcttctctcatttccctcccgtgtacatttcagagaaaattggagagcttaaaatgcgactaaatataacccctgcactaagcaaacagtgaataaatccttaagaaattatttttgaagcatattctttctgatttgatttaaaaactgcaatatcacatgtgagtcttgctcaggagaaaggctatttgttcacaagacgaccaagcatgtagagggaaagctgagggtgaagggactgaatccggttctcagctatttcaatacagatgtttttctagataatcggcctcattgtaagttaaagaatcaaacataaatcagatctctcacaggctgagaaaaggcaaaacaacagcctgttcgttctgtaaaaggaccattctagttggcctatctggtacaaccaccttgtttaaaagacagtaaactgaatccagcaaaagtttattgacttggtccagaatattactgagccaccaccacagccaggcttacatcccagagctcctgtttcccatcctgggctgtgtatattcttccacgtcacctccccaggtggctggctttgagaagaagggaatcataaaaagaccagaaataacatatacaccttgaaggagttgacacaggattttttcttgatcactttgcaagccagggacctctggccagtgacaccctgcccaggcctcactcggccatgctacttgctataggagatggcccgcccacttagcccgctcaggccgagtctgacttgcacactagttcccaagttcttgtcctgcgccccagcagaatgaggatacactgacaatcaaagaaaaagtcagggagttttattgagtgatgaaaacagctttcagcagagtggggatgcaggggtggtccccctatctgaaggcaggaaagtccacccaatttgtctgagtctggggcttttataggctcagaataggggaggggcaggcagtaggtagtactcgaaaaagcaacattagattggttcaacggcattattcagaaagaatcaaccaagaaaggtcaggcaaacagaaacgcaagttctcactctgggtcgcaggtttcatccaggaccagcagtctggtctttcagccttcaggctgtttctgttggttcggaggtgggatttcactggggactcacctctatctgactaggtatttggctgcctcctactgtcctcagagtcatctgttcatcagtttgttttccctgtaccttcctttctcacaaacattccattggcagatttctgttttgttctgtgtgtttcctttccttctccccagttcaagctgaggcagacgcatggacaaagaaaaacaaactgctggctaaatacagagcagagagtgtcatggaatgtttacagaggaaatggttttaggaaccagagagtaggaaaagctcaggctggggaaggggcaggaggatgcaagagggaatgactttagggtataaaaggaatggaaacggccaggcacagtggcttgtgcctataatcctagcaccttgggagactggggcaggaggattccttcaggctaggagttcaaggccaacctggccaacacagtgagaccctatctctgttattattaaaaaaaaaaaaaaaaaggaatagaagaactcgagtccttaaagaattagggtctccatgtagagtaccaggtggccaggtgaaaacatacccaaatatcaagtaaggacacccattggccagcacccccaaattttagtccagttattacacccaacttggactggcaatttatcccctacaggtaactgaacatcttatggtctgggaaatctaccagcccctccaaacagaagatgaggagcttaaatggaatagtaggaagggggagctttaccccttgaccatgatgggtctaaataaaatgagctgggaatttccctaggagcccagggtagtgctacaaagaggacacactgcccctgaggtatactgtgttcatttgggagctatctagtcccagttttccaagacagactccagggaaaacaggtctaccttgaacaacatgagtttgaactgtgtgagcccacttacacatggattttctttcaccttcacaacctctgagacagcaacaccaacccctcctcttcctcctcctttacagcctacttaatgtgaagacgataaggatgaaaagtctttacaatgatccatttccacttaatagtaattataattcctctttctgattttctttttttaatcttttcttaattctaccaattaattttttcttttttttaaaattttattattattatactttaagttttagggtacatgtgcacaatgtgcaggtttgttacatatgtatacatgtgccatgttggtgtgctgcacccattaactcatcatttagcattaggtatatctcctaatgctatccctccccccgccccccaccccacaacaggccccggtgtgtgatgttccccttcctgtgtccatgtgttctcattgttcaattcccacctatgagtgagaacatgcagtgtttggtttttttgtccttgccatagtttgctgagaatgatggtttccagtttcatccatgtccctgcaaaggacatgaactgattattttttatggctgcatagtattccatggtgtatatgtgccacgttttcttaatccagtctatccttgttggacatttgggttggttccaagtctttgctattgtgaatagtgccgcaataaacatacgtgtgcatgtgtctttatagcagcatgatttataatcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgacatggtatctcattgtggttttgatttgcatttctctgatggccagtgatgatgagcattttttcatgtgttttttggctgcataaatgtcttcttttgagaaatgtctgttcatatcctttgcccactttttgatggggttgtttgtttttttcttgtaaatttgtttgagttcattgcagattctggatattagccctttgtcagatgaatagattgcaaaaattttctcccattttgtaggttgcctgttcactctgatggtagtttcttttgctgtgcagaagctctttagttcttactaatattttcttttctctagcaaactttattgtaagaaaacagtatataatacatacaacatacaaaatgtgttaactgattgtgttatcagtaaggcttctggtaaacagtagtcaaattttgggagagtcaaaagttatatgtagacttttgactgcctgggagtcagcacccctaacccctgtgatgttcaagggtcagttgtattctgttagctcaccaatgtttacctgatcttacacttgtcctaacttctaatatggaaaggataggccaatgatatagtagagtgcttagatttgactgttgaccactggctctcaaagcctctccagtataactgcctctgcctcttcaccccatctcccactgtgcctaaaacccaacactccagccaaagagtaatcatgcgctgttgcctgaacataccccatacttgtctcctactagtctttgctcatgccagtcttcctacctcaaaggctctccctttgctctgtttacctcttgataacttatccatctaccaaccaagaatttttaacatctgaaatgattcacaaatggaatgggatgggctcaaacgataaaaataataatggctaatttggtgtcaggaactgtgctaagcatgtggaatacattattctcataattacctaagagggagctataataatcctcatttcatagatgaggcccaggagggtcaaagaacatttccaaggtcactcagctgggattctgacccaatcagtaggactttagagctgggctgttaacctgtaccctctatgcctctaatggtccttctaacactgtgaccctggcattttataatgtaactgtttctccccagatccctttctgaatgcccccaatgaggtgtaagccctccttactctggaagttatctcactggcctcacccgacatatttacatacttttttcatctcaccaaatacagatggtccctaacttcaatggttcatctcaaatttttttgactttttaatggtttactgggagtattaaatgcattttaactcatgataagtttattgggacacagctccatcatatgtcatagagcatgtatactgggtaagcttcatgaaagcggaaactctggctgatttacccacaatcagactgtctgagctgcagcagatattaaagtatttttcgtgaatgaacatctttcatgcttcacacagtagaagtgctccgtaaatggttgtggtgtgtgttgaattctgttcaaacaattatcaggaacaacagtcacagtttttcacagtagcacactggaaccccctttcttcactgtgagtgctgccctgaccctgacaatcaggtcaactggacagtctgttctcaccagtctcaatataggactgaaaagctatcttctccaaccaagttgtttggatcacctgaggtcaggagttcgagaccagcctgacccccgtcaatatggtaaaaccccgtctctactaaaaataaaaaattagccaggcatggtggtggacgcctgtagtcccagctactcgggaggctgagacaagagaatcgcttgaacccgggaggtggaggttgcactgagctgagattgtgccactgtactccatcctgggcaacagagcaagactctgcctcaaaaaaaaaaattgtgattttttgaaaccattaaattcttcactggtgtcatggtacaaacaaaatcacttgctttgactcttggccaagtccagaattgtgtcattttaaaaaactggtttttaaaaatcctaagttgtttccacctgcaggcataggcagaggagccttcgtccctcactacgctgaccccgagtggttccagtcccatcattccagaaacccctctctggtcttgtatcaaaaacaccacaaatcactgggattgctctgtcatggggtagaaggggctcgaggacaaagtttagcttaaaaccagagtgaatttatttctattacatatggttaaatcatgacttcttttctaatccctaaagctaaacagtagagtcatgctggagacacaccatcatctatgtcaatcagacaaaattaaaacagagaccaacatctccttgtttcatttaattttgttctcttgttactgcatgtgtgacaccaagaaccacttgacctttggacaaaaaagtagttatatataagccatgtatggctaaggtcctgttttcacaggccaggaacatgtaacagctctaattcttgttgactctatttctgaaatagagtctgaatatgtacacttctttctgtctcaaagtctaccccctaggccagaccaccattgcttcttacctggggaacagggcagtatctgctcttaactgacctgccggcccccgctccctattctaatcctttctgtatacagccgccagaagggcttgacacaaatgtaaagcagggaaccctgaccctgtgcttcaatgacttttcaatgcatggagaataaccaagcacattacctggcctgcaaggccctgcataatgtgatgtggcactgtacagatggccatgtccacctcgggccactctccctcacacctcctgcaccctgggctcactggcttcctctcacacctgagcacttgctgctcctttgacctggagctctcttctttcagctccccaggactggctcttgctcatccgttaagtttcagctaagtgtcaccttcagaaagtcctctctacctatgctttctacaaaggtctctgccttccctcacccaccccatgctattttctattacattacgtatttttttcttcctgctcctttttacacaaactgcaatgattgtctttacgtattgacttacttatcttcaattttccctattggaatgtaattccatgagggcacagcccttgtttatcttctttggcattgtaccccctattaacctgcaacacatcacatggatgtaaacagtatctgtgcaatgaataaattaacgaatgccaagttccatcacattccaaggtctgtcattacctgggcccctgccatcctttccagccttatcaaccagcgctctcccacatggacaattacgcaaggcacactgagccacttccttcaggaataggtcactttttcttgcctctgaaattttataccagctgttgcctctcgctaggatgtctttcttcccttcctcactcaagtctaattctgctcaaggatcagtttaattgttacttcctctaggatttcaaaagaatttttgaatgcaccaaggcaaagttaaatgtggcaacaatctgtcagaaaagctgccttttggtgggtgagtcccagaagtacagaaatcatggctaaatcgtacctttatcttcaatacaatacctggcacacaataggtgttcaataagtgttaggcaaatgagtgagtttaactaaattataacttcctgagaactaacaacatctcaatcactacgctcagtatagattgaggctgagggccgccaatgttggcagcagcaaagcctgcttaaatataataactacagctgcattgcacagaagtccagttagtgcagaagcataaagttttgagggtgtgtgaaaggaacaaagacaaagttcaggtgagacatggaagcaacgagaaatgcaacatggggcgagtaagccagcactttctgctttcacttctatcactttggaaacatttagtccagaatgatctgggggttcttacttatggttctaagacagcctccacattcctcagcatgtccagtcacaatcaccatctccccaagaaggcacaaagtaagcatctgtaaatccatagttggctattttggaaaattagtgttaaataagaataaaaaaaaaaaacccttcacctttatgtgtaataaagcactgcttaacaatcaaggtcacccatgtcaataacactccccaagcaaagcttcatatctttttaattcctaggctcataaagaccattgtcacttacatcattacaggattcaagggagaataacataaagagaatgtgcaggataattttcaaaataaaagagaaaaaaatgacacatctacatatcaaaccacacaagtcccgtgtctgataaaatcacaattatagatttggtgcatttaaccagtcatacatgccatgcatttgcgaaggtgccatatgggggagttgtggaaagtcaaataattcctagactttttctttctgagcacatgtgacaatgaatattatttacccctgtagtatagaaattatgaagcttaagaccccattgcttctttttaataaaagctaacacatcacagcttactgcttgacccagctccttggtctttgcacgttctcctctctgggcagctctctctcagttttaccccctaccacaggaaaggagacagctgtgtttctagacttgacagacttgtttttacttgataaacacattgtatattgtaggggagaaaacgatcacccctattcccctccttagttcttatgtgggctctttggcccgatctaggaaccaaattgacacaacacagattaacaaagaaaggcgtacacattttattaattttacacatacatgggaatcttcacaagacagtgaagttcaaagaagtgaccaaagcaacatgcttttacacgttttagacaaaaacaaacaaacaccacgataaatttgtgaagaaatgacaggataaaaagggatctggctagggaaaataatttctatgggagtgaccaggagctatatgaatgtaaaacaagtagaaggtaaggattatttcaggaagtttatttgctcagacacattgcagcacctaatcacagtctccactgataaggaatattctcttacccttgtacggagaaggcagccctcccaaaagaatctttatggcttgctacgtgtagaaaaagactggtcagttagccctctgcaattatactttttccaacgttttcagctcgaaataatcaacataccaattcgcatattctgggatggcatgtccttcactgcttcaggaatatgttttcctttgtgctttacttggatattaagttccaaccaattttaattacatgtcgcttgtgcataatattgccacttctaaaaagcagatcactttctgagttagaaagcttatctgctttccctccttatagacacttctgaagcagaaaggaagtaattcctatgctcctatcagatatgggctcatatttctgtttcaaatttaagtctgtgacccctacatgaggccaggattttgagaagagtgaggaaggtagactctttttaaaccatgccacaggcaaaaactcagaactcattttggggaggaaaaaaagtcctatcaaaccagtatactataaattaaacaatgtagcatcaaagataacttttcctttagttgttacccctgagtggtcacgtagccataagaaaatcacctccttgtcaacacatcatcaatcaaccagtgttcattaaataccaactctgtgctagaacctgcttggtataaagaattctattttgtgttcaatgtgtgcattcagtgctttgattgtaattatctttgaaatgacccaaatcattccaaacaactataagtgactttatattcagaatagcaaaaagctgacttgaacacacaatgtaaaagtcttgaagagagagtgaattaaacttttttttttttttacaacaatcagtgggcttatagaatagaaagagaaagagggggagaggtttttatcttttagaattgcaatgcagtgaatagtgatactagaagaacaatcaccaaaagattacagatgagaacttcagatgaaaataacaatgaaacaaagcaaaattcaattaatggccttagagaaggtgagatcagaaagagaaactgaaagttttttagacttctctttaagacagataaaatttagaatttttaaaaatccataataaaaaccagaacaatgctacctcgccaaagttgagttcaaatttagtcacttcagtcaccaagaatccaggaaacttagttactatgggaacagaggtcctcctcttcagaaaggagggcagtgtttctttcaaattccaccagctaaattcaagatcaatgatggttgtttaatatcctctcttgaagctcttactgtctttagtatactttaaaataaaataaaaactcaacaataatggagctcaattaagcataatttgtgtgcttcaacctttggctgggtgactgctctgtaccgttcacacttgtactgtagagcattgcaatttttaattaagatcactcattctatttcccctgaaccaaccaatgttgaggttattgtttggatacaaaactctccaggatacggcttcacttaacaaggactttgtttctttcaagtaccaggcactcactggttctgagtataggctgcctgccctactttaaaatgcatctcaactttatttcagagacagtaagatttcattgttactctacaggacttagaaataaatgcatgcatgtactcacacacaaaatctctcgataattttgcatataatacagtttttgtgctctatgccaacaaagaacagaatgtttagtaaatcacagagaaacacttttatttcttgagactgagatatgtgtggcttctctacttttctaggaattacatttaaaatgtaagaggacaagacctcattcaaccttttatgcctactttagtgatcagggtgaaacatataagaatattgcaacaccaaagctgtgtgtcactactcagctaatggtacctataaagaaacttctcttaattagctttaccctgaactaacttcctttgctctgccatgtataattaaatatgttagcaagacagaaatgtgagatgtagcagctttcacacccaaatttccgactccaaatttataaaaagtgtggatttttttttagttgaaagcccatcatgaagtattttacttttactctaaaaactttcaaaattacattaaaagaagaaaaagaaaatgggcaggaaaattagtaatgagagatgaattttcagagaaaagaattctacagtagtccctcctgatctgcagtttcccattcagtgctttcagttacccttggttaaccatggtccaaaaatattaaatggaaaatcccagaaataaacaattcataagttttcaactgcaagcagttctgagtagtgtgatgaaatctcattgtctctcactctgtctcttctggagcgggaatctttcctttgtccagcatattctggctgtatatgccactcacctgttagatacttagtagctatctctgttaccagatcaactgttgtggtatggcagtgcttatgtttaagtaactcttctcttacttaacgatagccccacagaagagtagtgatgctgtaaatttggatatgccaaggaaaagtcccaaagtatctcttttaagtgaaaagtcaaaagttcctgatttagtaaagagaagtcatatgctaagggtggcaacacctataggaagaataaatcttctatccatgaaactgggaaaaaaagaaaaattcatgctagttttgctctcacacctcaaaccgcaaaagtttcaaccacagttcatgataagtgcttaattaagatggaaaaggcattaaatctgtgaaaggaagacatgaacagaaatgtgttcgttcctactgatggcaattaggttcggtaccatctgtgatttcaggcacccactgggggtctttgattgtatcccctgtggataagggggtactgttgtatatcaaacaaaatctgaggtgcccagccaaggacagtgctgcttcccagaagagatgagactcccctatcctttctatcttcccaaagggtgcatgtagtgtacgcccattggtctctccctttcaggagtgaatccaaaagccacaatattgatggacggcaggaaacgtccagtatctgggctctgaagaaccttgaggatagaatccagctccaatcatacagttcctctgtatggataccttaaacaaaagtgtattttatcctttttaatttggcatcccttagaaatgtgaaacttccttgtgaaaactgctctttaaggaaacgaaacttttttattgtaagccttcccattgtctgtatataattaagaaaagatcagtgatagttcacggtggttttataataggtgaattaatcagttttaaaaagctgaattttacatgcatttgacaaccaatctgggcactattttcctaggaaaaggctcatttgattaaataaattttaacctttaaaagctttaattcttttttttttttttttttttttgtacacaaaggactcttttgtgatggttggatcaacttacacatccagagcacatgtgcatagataaaactttgcagtaaactatcctgttacagatagcttttcttacacataaaaatacattctgatgagcaatctaggggaaacaaaactaaaaaaaattaaaatacagatatacaattcatattctaatcttatcagaataacctactgttaaaacacaaactgaggcaggataaaattttaaagagtttatttgatcgaacaacaattcatgcattgggcagcttctaactggaagtcattcacgagctccacagagggaacatgatgggtggacttttataggaaggtcacaaaagtaaagcaagtcagtatgtgactggttatagctctataattgccttatttgctctatcccattagaaagtcactaaatatatatacataagtttgttggctacttccaactggacaggcttaagttctgttttcctttaatataggcatttgcaaggaatagcttaagtttcacttaagctttgcaagccaagcaaggtttaggtcacttatgaggtctgatatcatctgtttctttcaggcctagtctccattttaatttactttaacactatccataagaatattaaaaacaggcagcagatatgcagatattttatcaatacaaccttttataaatacaggaaagaatagtgttgacagtctaaatttgcttccttgaggcattatctgtttgaccagatttaatcatttaatttgaaacaaagaaacaaatactactctggggttgctgtgaaaggacattcagagtggacaaaacctctttaaacttttcttcaaggtttcatcttcacatatatgttagtttggttactttgacagattggtcaacttaatccaatacagttttatgggtccggaaagtgctttgcttgactttgaccgtatgtgtcatgtcagttaagttaaaagctaattcaatgtgtccacttcggggttatttccatcataaggcattatgtttttacttgggttgtatgggggagttcctctgaattgactagacagatgggaggtttagacacagtttaatattctgtacttgcagaagcaactattgagagctttgattacaactaaattcaagctagctcaaaagttggttctcagccatttaagtcaaaaggttaggtaatgtcactccctccaggggttcattgtccagtttttctgtgtattcattttgtttttatttcatgcctatctagtacccacccctgtgtcccacctatgcctgaattcttactgtgtaaactcttttggatgggaaatgaccagctcctgctactgaccacagccctccctcttgccagagcctgaaggacaggggactcctagctcgacagatcatgctaaaattataccttgtgcttagcatttcttggcctttaatcctgtcccagttacttctctttttttttttttttgagacagagtctcgcttttgtcgtccaggcaggagtccaatggcttgacctcagctcaccacaacctccacctcctgggttcaagtgattctcctacctcagcctccccagtagctgggatcacaggtgtgcgccaccaagcccagctaattttacatttgtagtagagacggggtttctccatgttggtcaggctggtctcgtactcccgacctcaagtgatctgcccacttcaacctcccaaagtgccaggattacaggcgtgagccaccatgcccagccattccttctcttttctaagatttgagttctcattgttaatctggtaattttctttttcacaccagataagcagagctggtttctgcattgctaactgggagcttcctaactaaaagagcctcacaaacagttaattctgctctagatgctgtaaaagagggggacgggggtaggggcagggagagagagagattacagtgataaaatgaaaatgctgtttcagccaggaagttttttctcccccatctcatatattaaaatgggcctgattttctaacttcagcataaaagcccagtaagaaatattagctcttcagttaatgtcattcacacaaggaatttatcagcagagtttgtgtttgaacttttcatgtcatctcacgcatctcagagggtattaaactccataaaacacaatcccaaaagtgaaatatttcccacttttactctataagtgagtcttagggaacggaaaaaaaaattccatgtctggcttattcctaaagagagagtaaatagagatatttcttgggccaaataatgagaagaatcacaacccttagggtttatgttccaaaggcctccaaatcccaacaggtccagcaaagcagaacagagaaaggggctgaatatacatgaagagaataacagaagcaagtggttaatggtttccttaaatgcggcagaaaatggcttatgtgtacctaagtatcctatagtactgagacttaccaagaagaaaaggtgaaaatggaacttgaggcccctggaagacatgttcttagctttgcctgctggctttctgcataaatctgacctttctgcaggtgaagttcttctttacagcccagtttctcctcttagttggctactgacccacagtagcagccaaaattaaaccaatgatgtatttctcgtacttccccaaatcacttttctttaaataagttaataataatccaaacttgcatttttcagctgagtgctttgatacttgcttctcaaaaaactacttggaaggtaaaggagttttcttttcgagacctcgatcagaaatactccatgattcacgcactcagttaggcctaaattagcccaatgttatggctataaaggaaacaggaaacctgtgttccagggacaatcttcttcatcactctattcccagcgtcctctcatatgaggacacggggggttgggctacctccatagaatgataataaaagtttgcctccaaaataatttggaatttttgggttaagcatcaggacatttcatatcatgtaatatactaacattcagtataaatctctaagcagggtaagtgggctcagaataagtcacaatctctcaactcatttcaccatcttgaaaatttcttccatggagcacaaagatgaactaagtaatcaccacattcctcgcaacatttatactttctgatcaggacaaaatgattctaaggagtgattaaagcagggtaagagagtcttctcaccctaatgaatccaaagatcaccaaatagacacccagtttatggcttagtgatgtaaaacaggtgtgattcagagccaagtttacgtaagttcaaattctgtttccatctttggtagctgtgcattcttggataagttacatcacctccgagcctcagtttcttaatctgtaaaacagacatactaacatgacttcatagaggtgtttgaaatagattatctaaaataagcaccaagtgttacatataatggttatttcagttattcattgatttaattcaattaccattaaggttgagacctggtcatcattacccagttaaggaaggggtttgacataaaaaccactcaagatttcttcccactttaggactttatgattgcctttaatttttcatgtttcaattatgtaactaaaatcttctattccatatatatcagaacacaccccatctaatctctgctaagtgtttctctactctgcctgtcccatgaaacaattcccaaagcctaggagagtctcctgtgatacagataccaaaatgacgtgggtcagaagtaactcatacatccatattgtcagaggtgaactatacaaaatactgagtacactacagagtgatctgataggccaagaagaaaaaaaagtaatctgatagaccgagaagaaaaaaaaagtatatgttgtttctctactaaagaatgtcaccgcatattgatttttctagtcttttacaaagactgtgttcagaatttagatcagtgttagagaaattcacttataaattcacatatacccgtatataaggatacagtcctgtatctaaggataaagtcctagcttaaatctggaatgagtaaaaacaaagtgtaaagttaaaaatgcccctctggtaagacaaacatatgcttttcacccaaaggtgcagttaaagaataacaacaaaagttggtagtgagatccctctaaaaccactgatatataatagactcctactgacaccctagaaaaatgatgccaacccatgcagattagtttcttccagcaatgtaattacccatttctttggggctatctttccttcaatggtgatttgagaaatacctttcatttatactccattttgcacaaataaactacatttaaagctctataattagctgtcctttgctactgtaaaattcagtgtttttgtccaaaaggaacagactattgatttacaaagaagctgaaatgctgtcaaactacccactgaagaagtaagaaaaaagtggtccctatcttggctctgcctctagactagctcttgtcctacctcagctttgtatccacataccgagccttctgttaaggtttagacttgcacagccaaggcctcccaggcatctccccattgacatctaagagacacctcaaattaaacatccaactctttgcctgaaacaccgttccttaagggctttccagattagcccttttttgcctctattatttgtatctcttaaatgcttactattgcaagatgtagaaaatcccaactaaaacgggcataaaccataagagaaattattgtctcacacactaagataagtggctcagtgaagctaagtatgggattatttctctttgctcatgaaagcatcaatgtgtcagttgggttcaagtacaagaatcagaacccattctagatattttaagcaggggagatttaatacagcaaagttggtgctggagaaataacttggagggctgaaagtacaactctaggtagagccttcagtaaggactcccagaacaatatcccattgacctcatggaacttgtaaggagccactcctcctgaagctgtcttggagccatagtaaaatcaagaacttgtcaccattacaactgactctactaatgcaagaaaccatagaatgcttatctgtagctgtggtcccgagtttcagaagcctgatcatagcgctgccactgctgcttctgccatcccaaccatttcgtaaaactcagaaagctggagagtgggcagaaaaacacgactgcagggaacctggacattgccacagctacgtttaccagcagaaacagccaaaggagggctgaaatatggcctccacatggctttcaccttccacacatcacatatacacatctaattggagaagactttttttgaagctggctaaaagagaatctgagaaatgatgcttttagttttgcaacaactttaacttgaatgaggatagaatggaaactacataaattcatctagagcatacgaaaataccagcttcctgggtgagtctttacataggagcatgatggaagcaagcagcaatcaaggctgccacagcctttgatatgttctaacagtagagaagaaaaaaatctctttcctggctatggcatagaaggccttcctttactccttatggaaccactttaagccatttgctgactcacagtcgaataccactgaccatggaatgctatgggctgattggctcagatggacaatctgttgagtgtcaaccacagtgtagtctatagtgtgcctgcttacataacatctaatcattgagggctttcctgaccatccaatctcaagtagcctcttctcctgacccatgaattctgtgtctgcttaccaataggtaagtcttcatggcacttaatgcactctgaaattatcttgccaatttacttatttgcctgctccttatctcctttccctactaagacgcaagctctgtgaaggtaaggatcctgtctttttcacgtctgtatccccaacacttacagcagcatgaaacacataccaagcattcaataaattgtttaatgcataaatgaataggctataatccatgtactacagaaaccttaccaataaaatgcttatgttcttcccagttaggccagcttagcagtttatttaaaaggggatgagaaagagagagctgttcaacgtgtgtgtggccatacacagtgaatctactaactggttagtcttttgggattcagtgttacatctactatgcgccagtcactgtaccctactattagcgatgcataaatcagaaatcttggcccaaaggaggactactggtacatgaagattaagattctacgatgacagctgcattggaaaacagtatcatgaaaagtgttttggagacgggtgcacaacaatgtgaatgtacttaacacttctcaactgtacacttaaacatgatcaatgataaattttatcattgggccgggcgcggtggctcacacctgttatcccagcactttgggaggccgaggcgagcggatcacgaggtgaggagatcgagaccatcctggttaacatggtgaaaccccgtctctactaaaaatacaaaaaaattagctgggcgtggtggcgggcgcctgtagtcccagctactggggtggctgaggcaggagaatggcgtgaacccgggaggcggagcttgcagtgagccgacatcgcgccacagcactccagcctgggcaatagaacaagaccccgtctccaaaaaaaaaaaaaaaaaaaaaaaaaaaaaaaaaaatatatatatatatatatatatatatatatatatataatgttatatgtatcttaccacaattaagaaacaaaaataaaaataaaaaatacattataaaacaagcacaaccttttatgtaaattacttacttaatcctcataatcagacaaggtaaacagtatgaatattcctattttaaaaattctgacccagtaaggttaattagcttgatcaagtttatatagctacttaggagcagggctgcgactagaatttaaaaatctccaactcctaagatcatgagcacacagatacacaaataagcaatagcatcatgttttcaaacagtctggtctcttccctggctctgtctgaatgacagactctcccattgtttcttgtaaacaggcaattaattgtacacactaatacacagaaatggcccttaaaataaggaagaacaagagaaatccttttttttttttttttttttttttgagacaaggtctcagtctgtttcccaggcctgagtgaaggtgcaatctcagctcactgcactcttcacctcctggactcaagtcatcctcccgcctcagcctcctgagcagctgggactacaggttcatgccaccaagtccagctaatttttgtattttttctaaagatgaggtgtcaccgtctttgccaggctggtctcaaattcttgggctcaagcaatgcacctgtctcagcctcatgggaaatcttgcactgatgggctaaacttattcaaaaagaaaaatcttccttaaaattaaaaatgaagagtaatagcaattgttggaagtgtactgattcaagggtatccaggtcaactgacagaagagagaggccagaaaggaatcatagtatactgaaaagccgctgtctgataaaagttggcaaggcagattctaggaagaaagagctcttcaacaaacaatggctaactatttaaggaaaatatgttacattgttttctcatctcatgtcaaatattaaaattaatcacatgcttattaataaaataagagcagaaaattgagccatattatacacagaagaaacttttatctggattaaaatagattttaagtataaagatcttaaaacaaaatgacaaaggaaaaaatgaaacataacgccccagaaaattaaaactttcagctccccaaagccattatcaataaaatgaagtgaaagaatagggagaatatgtattgaaaaaagtattaaagacgaagagctaacatcttcagacagagtgctattcaaatcaatatggtacaaatcctttattagaaaactaaatttaaagcatgagtagttcacagaataagaaatatatgtggttaactaccatatgataaaatactcaacttcactatattcaattaactacgattttaaataataaaacggtaattttgttggaaaaataggcagagtattttcatttatattcaagtcttcagaggccacaggtatatgtcactataagggaaaattggcctacatatcaaaatatttattcatagcgttctggcaacttatgccaatgtaatgatcagagacccacacaaagattagttgtaaaacatttgtcacagttttatgtataaccataacaaaactgtaaaaaactaaatgagagaacaaattctgatacacaaaggtgaatacttgaaagacattaagaaatcaggttttcaatacttcataaaatgaaaaagtattgacatagtaaagtataaaaaagtagaacacaaaatgtacaaacacgaataggtattatgtgcatgtataatacatatatattataaatctacaaagacctatccatatatgcatatatgcatttagataggaattttttaaagcactggaaggaaatttactcaaatgttaatgatggttatagatgagaagttgaattaatgttaactcttctctttatttctctccatttttcaaatattctttaataaattggaagtgtattagaaaacatccaatgatgtcatgaacactcattccctagacatattaaatctgttagcgttaactatagactagtgtactatgctaaggtgttatgacaaagaaaaagaagcagtagacagatacaaagacattcctgacattaggagaacttctggagaaagagacacatgttggtacaaaggctgtaatgtaagtaaagtagaaatataaacaaaaaaagcatgagaattatattgtagttgaaagccagaaaggcttcctggaaaaggtggtgtgtaacttttatatgaaaaagctggagccccatctcatggaacagtggcacaaagtattctcgatagcgggcatcaccatttgaactcgatcctcagccttcaataaaaatcataaagcccatcttcagagcccctcttttcttgcttctccataaattatgtactttcctcttttctcacctccttgagatactgtttacctaggaatgagacaattcattttttacagcccatcatgaacaattctgaaaaagaatcccctcattcattacaagacagtatgaattaaagctcaagaatgaactcttcctggcatttctaattaaatatgtagtctacctatcctctaatggtgaaataaaaagtagccccaatattaaagcaattccaaggatcaagcaagcaggtaaggcagattggccaagaaggaagagcaaggcactgagaaatcacaccatgacgcaaatgactttctctgttgatatgaaaattttttcctgccataggtgatgttgatattctaacaattttaaaacacaaaaaaattaaggggagtaacaaaatttcccttctattttttgagttatttaccgctaacaatctcccctctagaaaaagttacggaaatattgtacaaaatgcaccatgggttaaaaaaatgatttaaatacaggaaataattgttattaaatacatcttctagggagatccactctgtcccaatccttaaattagaaagtcagcaaaaagatgaactgaatccctgatgttaattgtacaggcttactggattagaactagagataattaattgctaaattttaatatgcattggactaaatggctgataagatttccagtagttggcttgaattccagaagggaatgattatttcttccccggcctgggagccctacaagccgaagacatttaaaatgtctgtatttggaatgaaagaagttgggtaaatagtagaataggttacagaatggcaaaaacttctagaaagaaaatatggaagttcaaattgccttttcccatttgaaatttagaatataatactgtatagaaaagaggatttaaatttttttatttttattacagcttcagtgattagcattcctgtactataatgtcaatattaaatccagacagacccaaagtctattacttcctatctaaaaaaaaaaaaaaaaaaaaaaaaagacactgtttatcacctaggtaattatattttttatgttcttaagaatttaggagcttgctatggttaattgggaaaaatgtgaattatggttaagtcgtgcctttttttattaaacttgtaacaaagcaaatgatgaagaaccaacaacttgccaatgctgagggtccagatgaacagacgcgcagagaatgcagatgagctgattccattaaaaagttggctgcaagggtagatgatgaaggttaagaagatgtaggactatagaggccaccagtgaaaaggaaaaaaaaatcccctgcttcctctgtacaaccttcaggatgttcaaggaggaagaaagaccaccaactgcagggtcagtacccagatgccttaggatatccatgaggctgtcaggcaccagtgaaaatcaggtctggttgtgcatcagaatcacctgtggagtttgttaaaagatgggattctgacctccattcttgcaaaatgctgatgatccaagcggtgagtttgagaccaaggatattatttatcttttaacaaacctcacagtaatcgtgaatgtacagcaaggtgttataatgtattttgatatcttattttttagagacagggtcttgttctgttgcccaggctggagtgcagtagtgcaataatgtctcaccgtagcctccagtttctgggttcaagcgatcctcctgcttcagcctcctgagtagctaagaccagaggtgcacaccaccatatccagctcatttttaattttttttttttttttgtagagacagggtcttttccaggatggtcttgaactcctggcctcaaggaatcctcctgcctaagcctcccaaagcgctgggattatacgtgtgagccactgcacccggccctgttttaattttttaaatttaacttttaaaattcaaatataggtagcgttttggtaatctcttattttaatctgaatgatggaatatgtcaaggggtgactgacagtagggaggcataatactgtcaggagcttcctacagtgctttcttcaattactttagaatctttggtctccccagaggtaaagtgactcgcccaaggtcacacagtgaattaacaaaaataagaaacgaatgctaatattagaaagtacatacctcctataattacttgcttgggcaataaactagaagttagtaaatattaagaacttcagggtccgggcctgtaatcccagcatgttgggaggctgaggtgggggcggcgggggggggggggtggtgaatcacctgaagtcaggagtttgagaccagcctgggcaacacggcaaaactccatctctactgataatacaaaaaaaaaatagctgggcgtggtggcgggcacctgtaatcccagctactagggaggctgaggcagaagaatcacttaaacgtgggaggcggaggttgcagtgagctgagatgctgccactgcactccagcctgggcaacagaggaaggctccatctcaaaaacaaaaacaaaaaaaacntcagggtcattaccctatttcttcaatttttaatttattttttatttttgagacagagtctcactctgtcatccaggctggagtgcaatggcacaatctcagctcactgcaatctctccctcccaggttcaagtgattctcctgcctcagcctctcaagtagctgggactacaggtacctgccaccatgcccagctaattttttattttttgtagagacagggtttcaccatgttggccaggctggtctcgaactcctgacctcaagcaatctgcctgccttggcctcccaaagtgctgggattacaggcataagccatcatgcccagcctatatttctttaattttaagatgcctattttatgtttttaacataaataaatgaagatgcatcttgtaattgatatgtttaatatggaagcactcattttttccaaaatatgaaatcagtggtgtacttacaactaacagcattataaaatccaggatatatgggaggggtattgcatatttattgtttctttgaaacaaggttttctatgaattaattttgtccctgtatgggtactgtcatcgtgtcgggtaaggaaatcaagactcacctgtgctagaaacctggaaataaactgttggcatatacttgcctcctatggtcagcatctaaccactcattgagtactggtgactcaatttctacctcttcaggcttttttcccttcccagttttaaaacttcaaccgtccctccagtgtagcactaatcaaatctaccacagagctgtcacatttatcctcattaaacacatacttgattccatgacttcctttttataaaactctactggctccccagtgctttcagaatcaagcccaaataccatcaaatggcatttagggtcctgtgaaatctgtccttaccctgcctttctggtatcacagtcatcagctgcttcttccctgcttaaaaaatcagcctaatcaacattcctgaagcttacggcactgttaccacatttctaatagtttaaactttcaaggcccagcttgaacatcacaccttccaccaaccttttccagtcctctcattaaaatcaatttctcccatctcagcattcccacaatatacagcacaatgagcatgtagtcttgcctgatgtatgcctgtctgtccacccaactggacagtaaactctctggcagcagaaactgggccttaatcatttcagtttcctccacagagatcagcacagtgcctgcacgtagtagttatttgctaagcatgaaatctttaacaaagccagaattgattctgaggcagggttaaagatattataaataaaacttcactgaactgaaattcatagtcccatgcagggcacctgcatatttttattaggtttcaccatggaaggcataattttaggtattattatgctgatgaagcacaatcttcctgctccaacttggccaaacccagggaagcaatttcctatttgattaagagtacgacagcagcgaggactggagtataaaaatttactgtagggttgagaatgtaagcttaattgtggatcaaatgggaaacattctaaacagcattttttaaaggaagtatttgaacagcctattttaaaatattcaatatcatcttcagcaataggcaagttttggaaactagcaagtttcaagacaggtactcactcattctctcttctgcaggatcctaaagatggtcctggggactatcagttacttaaatgtctcaggttattaattcttactttaattatatctcagctaagtgattttttttttccaccatttgctcacatagcagcgaacaactttacactgttatcagtcttcacatagcagttcccaaattttgcctttaggtttatatcatgtgcaatgagttttaaaaggctttctccacaaaatcataagagagccttaagagtttcattctctgcctgacctcctgaaaccctcaaaagataattaaagaatcatgaaatcttcttgtgatttcatttaaaaaactttttttaaatcattgatcatgtcttcattctactaaaccatttaagaagtgggcaatttaaactacccctataatggttcactagcctcagcaatcaaggctgtaagaagacagaagcctatgtccaacattattattagtagtaattatctgttacatattaatgctactaaagtaaaatgtgatctatatataatcgataatatgactataataatgtatataacaatccaatatagtttccccctttatctgctgtttcacttttcatggtttcagttacctgcagtcaactgcagtttgaaaatacatgtgtacaggccgggcacagtggctcatccctgtaatcccaacactttgggaggcagaggtgggtggatcatttgaggtcaggaatttgagaccagcttggccaacatggtgagatcccatctctaccaaacataaaaattagccaggcgtggtggtgcgtgccagtaatcccagctgcttaggaggctgaggcaggaaaatcccttgaaccaaggaggcggaggtggcagtgagctgagatcatgccattgcactccagcctgtgagacaaagcaagactctgtctcaaaaaacaaacaaacaaacaaaacaaacacacacacacacacacacacacacacacacacacattagccctgtgcctaatgtcacagtgccatcccttggtcccactccaacaactatgtatgaaataaacctgtgatcctatcagtcatatcccttctccaagcctccctttctgaaactctatgcctctaattctatgagacatttcacaatgttgtatctacagtcaactaagaaataatatatttgggtttatttcactctttgctcaaaccaaggataatttatcaggcctgctaagtataatctgctttcctaagtattgtgagaaatatgaaacagactacacttgcaaatcttaaattgtgatagaagaaatgagagaatgcacaaaagttttcttttcttcagaagagaaattgcaactaaaaaaaaacgcctagagataataaaagagacgttagaaagcaacacacaactgtcaactcaaatgtactgctaattactctagaaagaagtgttcagcattctaataaaaacattatattagtataatgtttgtcattaacaaagagttgcttacaaccacatcaacagataagatcctatgatacgtgttgtctggggcaaagcagggaattgtgggaaatgtaaaacaaatttgtgttgaatcccggccctcagggaacatttgagttcatgaaataaaactaggaatcagaaagactgggcaagatttgttttgctaggaattcaggatacatgaatccatgaggaaacatgaacgtcttggaactcgaacaggaggtggtggtaaaaatctaggagttaggtaaacagtgtctagccacaagaacagaggaggggtttaaacctctaagagatcattttatgggaaaaagcagcccctcctgaaaacattcaattcaggacacgaaggacagatagacactcagagcctcagagaaaaaagtatctggtgaaatctcttctagaaactttggctggggagagtttggaatgttgacttaaagacccacagtgaagtctagaaaaagatagaggcagcttgttacaatttacaccaacaggaaaccatttagaagggaagaataaatgttagttaaactttaaagattaaattacaaatttactcaagtgattttaacttttactgcacaagtagcaattttaagtcataagggatctgaaatgtttccagagttttaaaatggactgttttacacaagtgaaaaaaagattttggcttctagtgctgagcacagagcaatcctatgccttgtaatgggctggtataattgtgcagtttcattaaaataattttattactgacttcctagttttctgttaattatcatttcagagtaagaaaaactattacttttaaagcctatattaaagtaggcttaagcaagcacggaaaagaaagccagtgagagaaaatataaaaagaagctattaatattaacagttacagttggacacttgttcatttcataaatctttgcagtattagcaagattgatgagaagtagtacaaatgagaagcacatgagataagcgatcatttgttatcattactgaaatataaagtatgattcagtgtttcataatggatgttaaacttgatttaacatatggttggctcatttgctgaaaactatccttaaagacataaactcattctaaagtcaaagacattgtcttaataacagtctctgaattatctttctataagagactgagtaacctcaataaatacaaacttagggagaagttgtgaaaaggctgttccttaaggagaaaaaaagcaaatgtgttatatactctgattcattaaacatattatagagaattctaaaatatcgttgaaagagtaaagaattaatgtgttttaataccaacacagagtcttttgaattgattttcaaatgatgagtagagaaacccaatcactgctgtcagtgcttcagcagctacctaagaaatcctcctttgtcaacttcatttctctaatcatgagagaacgccagtgcccactttaagtttagtggattaagcagaccactgcaagtgctgctaaaataatttataatctatcattatacttcagtagtgatagtatactactgaatgagaatacactggattctcattcaacctggaatgagacacttaaaaatatttgttacatgagtatattcctatccacgacttagttttgtctgaattctcacttccattaacagaaatgcactaaaaatatatatatatatatatatatatatatatatatatatatatagagagagagagagagagagagagagagagagagagagagagagagacagagagagagagagatacaaagtctcactctgttgcccagactggagtgcagtggcatgatcatggctcattgtagctttgaactcctgggttcaagtgatcctcctgcctcaccctcctaaagcactgggattacaggcatgaaccactgcacctggcctacattttttttaaaacaacaatttatgtacctcctagagacaccagaccagtttgaagactagccgtcttcaacagtccctgtagcaattatgctcagaaaggcttatttcttgagctagcaagtatctgccctaaaaccaggttcattaataaaatgtctatctttcaaaaaaaaatacttgaatcttctgttttccctgatgtttgtgtctttcttcatccttggatacctattcttataacacagcccatgctcatctgaaataagtgacttcaagtcagctccattatcctgcatcctgcctgcaaaaatgatctagatatggggagtagtgcttccccttgttctatacactatatcaatataagttgttagactgcatcttctttaatcaaagtgtcatctaattcacatttagccatcagaagcatgtctaccaaagagcaatgcagccaaataagctttatgcacccatccttaggttatactccttagctaatgttactcttatttggcattgatttgatttattgacaacaaaaatacccatgtttgacaccaactagccttgatgtgccactattactgactctctcgactttgctcccccaatttgtaaaatgagaagtccaagctttcagtgattcatgaaagcagagtccactgtcagcctggccacacaactagcccctgaggatcttgctaggggtcaaaacccacatattagatctgatggggccctccaaattctctattttagtaagttcccaaatgcttctcacgcatgtctcttacagaatagatatagctgaaacaatctacaatattatatactgaactcattcaaccattagctcaaaggaaatgcatgctaaaccagctgcacaatccactctgtggagaaatccagcagccactccaagaagctgacctccaaaggtcatggagcaagatggagatgaagagccagccagggtctagagttcccactttgctctcttaccagctgtacaactttggacaagtctgttaacctctcagagattaggatatcttttctgtaaaatggtggtaataaagcctaccttagagggaaattgtgcaaattaatttttaaaatacacatgtaggccaggcgtagtggcttacgcctgtaattccagcactttgggaggctgaggcggtcggatcgcctgaggtcaggagtttgagaccagcctggccaacatggtgaaaccccatctctactaaaaatacagaaataagccaggtgtggtggtgcatgcctgtaatcccagctactcagcaggctgaggcaggagcatcacttgaacccgggaggcggaggttgcagtgagccaagatcatgccattgcgacagaacaagacactgtctcaaaaaaaaaaaaaagtgtatatatacatatgtgtgtatgtgtttgtgtatatatatgtgtgtgcgtgtgtacatatatatatgtacacacacacgtatgtatatgtaatgtacttacaaaatgggaggagtagagacactcgggaggactgcatttggctttattcattgttccttctggtatagcagctaacacacagtgagtacactaaaaaaacaatgctttgaagaaacaatctaatccaactacccatgacacgtgttattcattcagaacagtttattgagaggcctctttgtgtgaaacactgtgacagtccatttgctccttcaaatctcttcctccccttctttctctgttctgtgctgcagaaggctgatctatgtggactacactgacaggccccttggtgttctggcttctcctgcaagttggccagtgagggcttcataaggataccaaatgagaggaaaaacaagaacttggtctgatctagcagaaagatcagaccaaggccccaatcacagagatctcctgtttctcccaaagtactctgttttcccaaacatctctcctactgtgttgcagtaccactccctcaccttatccctttgggcttgagtctttaaaactccactgcttaccatccccaggttcctgtactaaccttgtggttcctctaaaccccaccagtgcctctctatatcgtccctttataaagaagttctctggagcgcagcctcagttgagtgtaccctctcttccagttggaagtctgatataaacaatgtgtttgaagttagggaatacagtaacaaacaaacaagtcatgatctctcatggaattctaactactaccactgtcataacaaacagctaccgtttattggacacatatcccatacaagctctatagaagttgtatacctgaggttgctatcatcatctctgtttttcaaatcaaaaaaccaaaccttggaaatataaaacccacatgagtatcaaccaacagaatttgattcacaacagaactcagattcaagccagagtcaacccaatccacagcacacgctcataaatgctgaagtattaccacatttacctcaacaatgtccctgccaaatggatcttcaatgtgagtcataagaaattttccccaatccttctccccatgccagatctggggattttcagaaagcctagtgtgaaaattcaggagacctgaaatgtgccctcttatcatatctactcaccaactggcttgtgagtttcctcctctttgagctaatacctgcagggaggtgcgcgcttccgtaactagtggcctttgttctaaccaccatctctgccatttttcctgtgaaatttcaagataaatgcaggcaagcaagggagagagcccttggacactcttctctagtattctaggacttttcaggcctgcctggtgagatcaggtaccttatcactagcttctacttgtgcaatctcccaattacacaagcgatcccatctagatttacaagtggccatcctctctgacccacaggccagagaactcagcccacgcaatgtttttaaaatagaccccaacccaggggaggctgacaggcacacagctgcaccaactttattaatgagtacccagacctttagataattgatttccactttgatcccagcctacgcatttctatctctgatatctaaatagcaaatcatgttatcttacaattaagtgataatcttcatggcagaaaagttgacaggtctataaatggcttctgcaagtgattaaaataacttcctccccctttccacccagccctggaaatgttctacaacttcacaaggctattacttgttaataaactccccatgatatgaacctcattcatattcaacaagtttacatactaagttactctccagaaatgatatacatcttattttttatgcttaaataagaacattttatttattttttatatctatttttttggagaaagggtctcactctgtcaccctggctggagtgcagtagcatgatctaggcccactgtagcctccaccttccaggctcaaggatcctcccacctcagcctcctgagtagctagcactattggcgtgctcctccatgtcagctaatatatatatttgtatatatccatggcagccaatatgtatacatttgtagagatgaggccttactatgttgcccagtctggtctcaaactcctgggctcaagtgatcctccagctttggcctctccaagtgctgggattacagtcatgagccatctcatgcagcctgcaagtacattttattagccttagtaagttacacaaagtcagcaaaacctttgactttaatattcaagtaatattaagattgttaaattttgcatgtatatgcatggatatgaagtatatacaagtgcagagtaacttgaagatcagtgttgaaacaacattgagtatttaatatgaaatgagaataaatgactaaaagaagataagttttacttcaataagtgaattgaatattgaaccctgatatggtttggctgtgttcccactgaaatctcatcttgaattgtagttcccataatccccacatgtggtgggaaagacttagtgggaggtaactgaatcatggtggctgttccctcatgctattcttgtgatagtaagttctcacaagacctcatgttttaagggacttgacctttcacttggctctcattcttctccttcctgccatcacgtgaagaaggacatgtttgctttcccttctaccatgactataagtttcctgaggcctctccagccatgctgaactgtgagtcaattaaaactctttcctttataaattgtccagtctcggatatgtctattagcagcatgaaaatggactaatacaaacccttactatgcactgaattctggggcaagtacccaagatattacagcaaacaatacccaccaatctgcttctatggcagaactgggccacatgcccagaaggcaagtaagaattactctgcaaccaactgatcaccatagtaactgagcatcaggtagaaagagtgctgggattgattagcagagtctgtgatttggattggacatagaaatgatatagtccattccatgtatgctcaatgaacactgcacaggtgaacagataaggctgtgacctcctctgaggcaagctccctggttattccatctccatatacctcaagactcctaacacagttctttgcacataatagacattcattttgcaggacagataccaagatgaattgcttcagtttgtttttaacaacgtaattctatttccaatttagataattcattgatttcacacctttccttcctggttactctatacttaattttcccttttcttctttccttttttgtttgtttttttttttttttttgaaacagagtcttgctccattgcccagactggagtgcagtggcgcaatcttggctcactgcaacctccgcctcccgggttcaaacaattcttctgcctcagcctcccaagtagctgggactacaggtgagtgccaccacatccagctaatttttgtctttttagtagaggtggggtttcaccatgttggcagggatggtctttatctcctgaactcatgatccgacctctcaaagtgctgggattacaggcatgagccactgtgcctggcctcttctttctctttctaaaagcacatcaatttacatttctacatctgcttcctacaaagaatttcctctgaatgaattcaacaagtgtcctgtacatgtaaatatatgtatgaatcttttgtacctatccatgtcaaagggtttttgaagccaaactgaaaactttcctagactacatgttgatgttctgaatatccacatttcgaggctcttaacaaagctgtatcaaactccttttcttctgagtaatatattatgtacgtaaagtcctaggagatgccctaagtctactataagtgaatttactttttgttttctgctttgcttcattcatcctgctttgctttttttctcatcccaaatataaacatctgttttgttatcaagttaaagttaaggagatataaaaccctctcagattaatgtacagcccattattgaattctggatcttagtgatatccaatatattatcatgaattttatagaatatactgaacttttaattcttatctgatttatcttcttaatgatgcttagatttccattcaaaaatcctgtctcttctcaccctttccacactgtgtctgtttttgtgcccttttctagagttttacatttctctttaggattatctctctctttctctcgctcacctacatacacacaccacacactccatgtccaaattcacagtctaagcattttggtgatatgccattcctcttctacctttgttagaagttcctctttcccatggaatcaattctaccggaaaaaagtgaaaaggaaccttagagagcaatcattaaaggtgcaaagggaaaggtccccatgtctgggagtgtctctaaccagctgtgtgatacgtgccatgtaatatctggctttggttttctcatctctaaaactggagggtaaaacaagactatgtcttgaaacctttctaattctgaaatgttcactattatcagttaacatttattgtgcttttctgcatggcaggcctcaggctaacggctggctataactagcactatccatgctcacaacaactccataaggaaggtgccacggttatcctcattatgtcactgagaaaactgaggttctgagaggtaaagtcatttcacacctgatgggatatggatgtaagactggaactcagacggcatgactctcaggttacagattctgcatcacatgctcatatcaactgatctgtatttttatacaacttcaaaaatgaaaacactgggcatgtgacctataaataatgaaatcatatacaaaaataaagaaacaccccacattgttgaaaaattatttcctttccaaaaattacttgaaagggcatcagtaagccctggcatatttgttcaaaatacagtcttactgaataggggtgtgtgtgtgtgtgtgtgtttgtgtgtgtgtgtgtgtggtgtgtatatacacacatatatatgtgtgtatgtgtgtataggtgtgtacatacatacacatacatgtgtatacatgtatatagacacgtatacatgtatatacacacatacacatatatacacatatatgtatacatacatatatgtttatatatatacatatgtgacaataaaccagtagaaaggtatatatatacacatatatacacatatatacatatgtgtatatatacacatatatacatatgtgtatatatacacatatatacatacatacacatgtatgtatgtatacacatatatacacatatatacacacaaacccacagtcatcccttggattggtttcaagacccctgcatatacaaaaattagcagttgctcaattccctgatatgaatggtatagtatttgcatataaccttcccacctcctcccattaactttaaatcatctctagattacttataatacctaacacaatgtaatgctatatagttattctaacatattgtttttatttgcattatttttattgttgtattactttttatggtttttttcccaaatattcttgatccacagtggatgaaattcacacacgcagagcccatggatacagaggtccaactccatttttaaccaatactcatattcgcacagattcatataatctcacactttcaagtaacgtaagcactatatgatcccattatattatcagcttgtcaagaaaactgcctatgctctgtgtcctttataaaacaatgttcctacctaataagggcagctacagcctttccccccagttctccctgctataaggtggcacccacagatatgtctccttctcttttgcctaagaaggcccttttgatttctctttcaatcctgtccccaagcctgaactcatcagtatcccctactgctgccagtctaggagagactccaatcatcttcccctactgctgagacagcagccttctacctggtagcctctgccctcctcagtccattctccacactgcttgctttcctatctcttctcaaagccaatcacataggtcccttcctcacttaaaacccctttatgactcctcattgcatcagaaataaaatctgaactcccttccactgtttcagaggcccactctcaagctctccacatctataaagtgccaactagtctttgccagttgtcaaacagactgagcttagctttctctcaacccagaacctttacataccctggctccttgatttggagtgctctctctccatctgccttctacagtcggaccttcacatctttcaggctgagacagaaccctcctccagagagctttccatgtcccccttatttagtctgacccaagcccattattctctcttcactcttcatttgtttccttcataataattctgattgatcattgtgttatccatctccacgtgtgtgtgtgaactatattctctcactatcacacaagcctccggaggatggaaagcagctggccttgctgatagatacatcccatgcatttaactcagagcttggctcaggttagatggtcactagttatgtatttgttaaacgaatgaacatatgacctcagatctttttgccttaagagaaagaaaagtaaaccatttgaaaaggggggaaaaattataaggctagcaaaagttaatggtattggcaaacattactacaggcccttgatagatgttaaaagaatggagaaagccctttaacatatttaatatatcatccctagttggaagatacttttagaattgtgcctatgcccaaaagttaataaatgggtgaggatattctgtgtgactaagaggggctaatgaattgataagtatttctgtgagatttactggatggttgaaaaatctctgtacattttcccctgattgtctctacctttctgctggcttattgtcatgctgatttttatggatctacattcaacagctaaggtaaataaggtaaaatgccagagaataatccaccataatatagtagaaaacttttttaaaatcaaaattcctgttgctaaacccaccatctaacaccttttatcacatttgagtgatctttaaaagaacatcacacttaaattcgcttttgagttagattactgaagacaaatgacatactgaaatagcatctaaaagcgttaatatacaaacatctacccaatacagatttaaatatagcagtgactgtacacctaccgaaacatgaaagactaccaggagacagggatttaatgtggattgatactaaaaagctaatggaaatccggtggtctttatgattgagatggaacatctttcacggctcttaaaaccttaggctggacagtgaagacatgggctggtgctgatgaaggagggctataccccaagcctgggaatctggaaatctgatgtgttcggccagagaaactccaaagttctccgtgtttctgcctttctctacccccacaaacttcaattcttcccttgctaataaaatactggaaactgagtaataaaaggcaaatttcatttcaatcctttgggctcaaagccagctccctgccaaaacttctcctgcctggaggggtagagcagggaatgagttggggcaagcacagatgtcctgcttctactctagagggagagatctgcaaagggtatggctcagcatcttgtctaccagctaatgtgattcataaataaatcacacagggagaagtgtgggaggcccctgtggttcaattctttatctctttttctcttccccagtgtggaagattgtcctgagagtgtggggaccagggggcagagtcacctacatggtctgctgtacagcagctctggcagcttagcacaacccattcacatactgggcagagcccttccaatgttaacctctgccagagctcctcctgacttttttttttttaatcctaaaagaggaagcatttcaaatgacctaaatctaaaaatagagtacttcatgctcatgactattttaaatagcatctaaaataaagaattaaaaaaaaaaacatgtttccatttttgtgacagtttccccttcccttgaaaaaaagaaaatactgtagagcttgtcattcaatctaaaatcagacttcgtgccagctggaatcctaggtttatttattactgtgcacagttcttacattaactgtttgttaaagactgattttaccaccactgagacacaatgtaagtgaaggtctttccatgttttaccaaaaagagtgattcaagcatgacccgtccaggagaaatgatattaaagaaaagggacagaagtactactcagtcactgatccaactatatttctggagaaatcaagtttaaacataagtaattgcctaatggagttgggccaaggtggagataggaaaatatccatgacacttccagtatttgcaaaacaggttcaaaaataaaattgcaacattttatggtctgtaacatacttagtcacttagtcgcagagacatctggaaaaagataatccaatggggcaggtttttattctctactttagaaaattgttcacatttattccctatcatagtttcaagtagaatggttataattcatccaataagcttttttaaaaagcagggaatcacagtttctgggcgtggggcccacaggcctttacaaaacttcataggtttatacctacataggtcatagattgtgaatgacacacaacatgatgactatgttcatgaacacacatgctcatatacatatatacatgcagtcaagctcaacctagattcacaaatcttacaaggttttacttccacaataatgggctcctgttcagtctctcttgccagccaatcctccaagagagacaccgacaaatgtagacacgtaaacatgctcctccaaacatggaatagctatcacttatttcaagtcatcaaacgtatgagtcagctgtatcttgatacaattagttgaggttctctttcaatgtactccttagacactctgtggtgtcaagctgtggtactatggctctttcactagctcattaccacctccagcagagtctgccttggtatagcctcagaggcacagagcaagcactcaataaatatggagtagaggaaagagaaaggtggacaggaaaaaaggggggagggaggaaaggagatgaaaaaggatagaagagaaagggaagccagtgagggagtgaatatctagctgagaatggaggaggaatctcaaataaaaagggcaaagtcagaggacactcagaaaaacagaagtggatggacaacagtgccacaggaactcaaaggtgcaatgttttcaaaagatagatagattccaaagatggcacccactgatgaagcttttctattaccagggtcacatacaaacaaatcaattcggcacccagggctgaggtggtacagcgtcacgtccttaaaatgccttcagggaccaggcaaatagcataaatataagattataggcgagaaaatgcttaagtttcaagcacagcatctgtttcaagcagaaaaactgtgcagatcaaacagctcagcccagactctatccctacaccctggagctaacaaatcaatttgattcaaatatttgtggaatacctacaatggggttttaatcacaaaactttacttgaacagctgcaacctctagcctctccaggcttctttcctcatcatggggagaaaaacacaaacatttcaacatttgttgagaggagaagaggttctacatgaagtaacccgactgacttatttgtactgagaaaggaaaagcaactaaccctgacctaccagaacttctcacctcgggcagtggcagtgagcagaggtctcagcagcaggagcctgcacaaccccaaaggacatagcagagactccaataccatgtctgaagcaacttctttgaaatcaaaatgctgatcttctcacatgctgattacagacacttccattatcaaacagaagaatttggggcaaaatggattcttaatggtgtctgtttcctacattttcttatcagtagagtggctcaaaatctaaatccacctaaactgtccatcatcgccccctccccaccaacaatgctctcattttatcctgtatgtgtttttataaaacgtctcaccatctgtaacaatatatgtatttgagtaattgctggtttactgtccattgcctccactaaactgtaaactccatgaggtcaagtacagagtctagacttgctcatgactaaatcacctgcatctggcacatagtcagcatgggatatatatttatctgttggcccaacaaatatgactcttgctgctatctgattttacacaagcacacctccactggcacaacacaaggagaggagaagagggaggcatctggagagctcaatgtcaaggttacttcccagctgccattccttgtgtttcctgaatgcaagtgtaactagtaactgtactaacagagccaagggctatatattcttcttcatcccataaacagaaaaataaacagttctgtggaactgtgcaaacccaacttaaatttcagattccagacccattatctggcaccctttgctcagaaatactttactaccactagaagacaatctaacccctggtctcacataccacataatgctgaaattcttccccattctgtctcaaacctgcccacaactccgtttcatgagggctgagccactatccaatttctatccttataggggttcggttttagactatgctcacaaatcccaaattcccagtgagttcaggaatgatgcttccttaccttaccttacataggaccttgaagatttctattacccgcagatgtaacatgcagttgttaagaccgcacattgcatcagcccacgaaatgagttgggggctatccagcctggcccctctcacgaggccatgtaccttgtgggggagctgtgtctccacaaaaggagtatctttttctattttatacaaacatgccctatggattagtaacagtctgatactagaaaaaaggaagctcaaaacttcacaggacatggcaaataaaacccagtgacctgataagaggtacaatatctccttggtttaatatttcacctcttctaattagaataaaatattcactaggaaaaatttttatgatagtgtccttttggcattagcatgaatacctccaaggagccgtattattcaaacaattttctatttcaaaatacacaggtagtaagaactaacaaatcattacatttccaccaaatgcacggaaacaacaaacttaactaagaaaatactgaagcagcttttcccaacggtacctcgcctccctagagcggaatggttttcttttaaggaatccctattgatgccagaaccaccttggaagaataattaatgacattttgaaaactgaacttccttctcactgcctttcataatgcaaagtgaaggggaggcggggtgagagtcccccaggaacacacaatgcatttttacaagagcttctaaagcccctcagtgagacagaaacacactttctcatttaagcaaaactttagaaaactaacaattaaaatgtgagttaaactgaggaaacatcttacatctgtgattctccctccagaataatatgactaggtagctagctgccagacactcttgtttcagcaatcatgtgactatgtgatgagggctggcttcatgattcaggtggaactgatcagggcactgacactgatggagacaaagcttgtcaggcatgatgtccttgtaggcaacaatacctgaaactctgttaggaaatctgaggtctttggatagaaggaaggaaataagccaaaggctagagtcacacagtcagtatcacttcagacaagtcagcactggatcaacctcttcacctgtaaaatgagggtaagaatatccactcaataagtatatgataaaaagaaagtgacaacacaaagtgtaaatgaatatttaagcaacatctacacataagagaccctaaatgaatatccgttgaaataaaagcaatggttacatgcttctcatatcctgtggcccactgacctcattagtcattatcttgaccagctccacttgcacagcattatgaattacatgtgtgcagggctattcaattgtctagtttgatgttcttaaccttgtgaggcagtaaatatccattttaaagatgagaagactgaagtttacttcacaatcttagtggctccaatcgaagatcgtccactgtaaaattcagttatctgcctcatgatttcacggcttatggctctatggaagttctattcttaacatgacgcaaaggaagtcagaagttgcaaaactctgagttagataattaagccatgaaaagtgattgatgctaagcatctgtacacaacatgtgaaccaagggaatgagtgactagaacccaaagagagtttggagttatttggctgtgactgagaaatgatgggctaggaatccaggtaacaacaacaacaaaagtaaatacacattgtctctcctctttgagaagatgaaagaaaacatctttttcagttcaatgatgcttcctgtagacagaaattttctcattgaatggacaaaactagcaagtgcacaagttaataataaccttttacccaaggttccatagcaagttccacatgctatgctatcatctaggctccctgcctgcctcttctcattgcatcctcatgacaacctcataagttgtcatgctatctccaagttttggatagagactgagtctcagtagaggtaagtttgtttttcaggcagggttgagcttttcgaagtacagagagaactggggaatggggtgcttcaaagtcactgaaagagctgaagctgtgggctctagaaagacatccaggatgaccacgaggagtaccactacttctgccaccatcagaaaggcagagactcaggaagtcaccaacagaatcattattagaagtagactgtctgaattatgaacatggatcagaaagctgctgtcaccaacacagcctttgactttataggaaagccacactagcaacaaaataaacgctctatccactgcttctcagtggcccttcactgagtggccaggtactgaaagatgagtgcccaaaagcccgatgtctcctccaatgttctagccagcaaagatcacagagaatacagaaagttggcttcagtctcaattctgtcttccaaaactcaaacaagtgcatctaactggcaaacaaggaatcagatccagggccttagctgtaaagcatctggaaatgtaatgtttgaccttcccgcctttcagtacaggaaggcacgtgatgaggaggctagcaaggttcctgagagctcaatcactgtgtctacttcatcagatttgccatcccatagctgattcctaattaaagggagtgagaaccaaaaagggggcaaagccaagtatatgagtaaatgcacagaaacatgacagactaatttaaccagagaactaaaaagggtttagcacccactaagtgaagagtgcatttggaaacaaggtggaggatatagctggagaggcaagaaaaggccagatgatgaaaagtctatcaccccagcttagaagctttctcagcctaagctaggatatcccttctgaacttcttagaagccttgcacaatcctcagctactcattgatcacacagaattgtaaccattcatgttcttgcctgctttactgttccccctgactatgagggtgggaggtcaagggaaaggaggggctattccactttgtatttctagaacatagcacagtgcctggcccataaacgaaagctccagaaatacgtgttgtatggaattacgtcccgaggttccttccactatcaatcatctacttaaaaaggagaaaatgctctctttaccttaagtacctttcattattaaaaaaaaaaaatggttaactatggccacgcaatggctctcacctgtaatcttagcactttgggaggccaaggtgggtggatcatgaggtcaggagttcacgaccagcctggccaagatggtgaaaccctgtctctactaaaaatacaaaaattagccgggcatggtgacacatgcctataatcccagctactcaggaggctgaggcagagaattgcttaaacctgagagacagagtttgcagtgagcagagatcgtaccactgcacaacagcctgggcaacatagtgagattccatctcgaaaaaaaaaaaattggttaattgtagattacagattgataattgtaagaatatattcctatagacatatttttgtacatttatgtacagtagtagacaaatgttgtttctgttaactgaaccaccattctcccattctgatgatagtgcctcaattttcctgtaggaaaccacagctactcccctcacatgaagaaattcacatgaggggtatgacctcagccctggggtttcagtttggcacatgacatggctggatcaatgaaagttctccgtgggattcttgatatgagcaacttggcagtgagggggaaaaagttgctctcttatgctgagattgctactagtggcaagatagtaacattgtatggccaatgaccaccacatgagacaaggtgtccaaagaaggcaacatggaggaatcagagcccatggagggaaagacacagactctattttttttttttttttttttgagacagagtttcgctattgttgtccaggctgtagtgcaatggcgtgatctcagctcaccgcaacctccacctcccaggttcaagcaattctcctgcctcagcctcccaaatagctgggactacaggtatgcaccaccacgcccagctaattttgtatttttagtagatacagggtttctccatgttgatcaggctggtttcgaactcccaacctcagatgatccacctgcctcggccttccaaagtgctgggattacaggcgtgagccaatgcgcccagccgggagagacacagactcttaacaacactgagtactcggatctagggtgtcaaagctgtcatcggtcagtaaatttctttttctttttcttagaaggtctaggatggtttcagtctggtaacaccaaaagaaattcaaagttttaagtttaccatacataaactattagttgaagaaatggcaatgactaaatagcagaagaatgaaactcagctttgggggacatcaatctgtcagtcatctactgtgcagccatttcgaggggggataactggaagagatgaggctatcacctggacattcttaagagaattaaaacataataagccctctccctgtctaaatgcacagataattgattaacagaaaatgatcattactaaaatggcttcagagtttttcagggttgtgggaattacaattgttctgaaagaaaactgattacttacagtttcctcctaagattgtagttgtgcagtaatgatattgagacagcatgatgcccattaaaaaaaaaaaaaaaacactgaagactttacaaataactgagccaaatgagatattgaaaaatcaaagcgagaaagtcccatcactaaaagtatacaaatacatgagaatcagccagtaaaacaggaagtcactctcatctaaaatggcctttgcttgtcatcaaactcatatagaattcctaaaatctgtcagtgtagtagcttctaagtgatatgtcaacaaatatattcactgagaatacttattctgcctagagccaatgtttttagaaaaacatcctaaagagtcaactgttaaatcactaaaatgaatgttttgagcaggtgtttggaattgtgctgatttatccatattttccagtttaatttccacgtttaccaacaaacttcagcaagaaaacataaaatgtacctggaaggattatgttcatcataaatacaaggacagttgcgctaaacatatctgtactggtaacagtgattcataaaccatattcattaacctaaatccttaaagttttctgtttaaactgtagtgattggaacgccaagtgtcagagtttaaaatggtatttttaagctattagcagttgacattttaattaggcatatttatgacagacatggggggataaaaaagaaggtaagcaaggaataaaaggtgcatcaaggacacaagaaaagagaaaagaattaccatccattcctgttatccttttcttttagcatatcaataggaaagcagtataactaactggtcaagaatgtaagatctaaagccagcctttatcagctcaaatcatgactctgatatttaccagctgtgagaccctgaacaagttacataaactgcatctgtttccacagggataatgccagcacgtagctcataaggttgctgtgggaactgaattgggtactgctcaaaaaatatgttgcacagggcccaagaggaaagaagtattcaataaatgctaactactactatattatttgtaaccttacttaccgggtcaagggctaatagtggtagtaaattgttgcttaaaattttatttatatatttcttcttgaaccagaaaagatgccaggctatttattttttaattttttgttgttgttattgttttacaaagggtttctcagtctgttgtccaggctgcagtgcagcagcacgatcatggctcactatagcctcaaactcctgggttcacagagtgatcctcctgcctcagccacccaagtagctgggactataggtgcacaccactatgcccggctaacatttttgcgtttctttttttttttctttttttttttaagagatgggatttcactatgttgcccaggctggtctcaaactcctggcctcaaatgatcctcctagatcagccactcaagtcactaggatcacaggctcagccactgtgcccagcatgcaagacaatttaagaggcatacaaaagacaaaaatataactcaacttaagaacagattaagaattaacaagataagaatatttaagaataggttaagtaaacaaatgtcatagacaaaactagagtcaggaacaagacaaaggataagaatcacttagatatggctgctctaagcagctactagtttgtcttcagctttctggcatccaacacaagaaagaaaactgggtctgcggcacaattttcaatattcgtgagattaaaatatactaaatgcccagaaagagagagtacagtgattttgttagaggccgagaacataaggaactaaggccatgcagcaaatcttcagaggggcacatcatagccacggtagatagcattgccaaactcaatttcttagccctccttgtatccacacctgtatatggcctctggggccacacgtatttccccacctcttcagtcaaagcttggtcctaggacttccttaggccctgatatatggggagaagtgacagtgcatcttcactcagttctcaccctctgccttaaaaggtcttaagcatttctgcttgccttgctgcatctccactacagccatagaagtaagtgacatagttggtgtggttgctagtctaagggagatgaaaaacacaaagcagtatggagcagagccatccactgagcccagcctagatctgctaaaccccagatgattcactaagacacaagcaaaaataaatgattattgttttaaacttcagagttttgggataatttgttatgcagcaatggaaaacaaattcagtaacaaaatgatgacactttttaaagcagtatttctattgccaactataagtcaaacagtatgccttctaaatggcttaccataacctatcttcataactttgatttctaaacttattaaccttgttactgtaatttcagagaccctcaacaattaatataaattaaatttgtcactcaccctactaaatgaaagtactctggaatacagtcaccaaaattaaataaaggttgaggtcataggcctccaaatacaggccatacagcataagcaaaattaactgggaggtggggtagggaggcaagcagtaggtcataccttaaagagagaccaacggcttccaaagtaacaacactaggcatgaaagtagcccatgtgtggccctcaggagagctgccatgtgtatgaagacacactggactgagaaatcagtctcttcaaatgtgtgctttattcaaaagatatcagggcagatgtcccacaggatttgtgttgatttgagttgcttctcacatgagcaaagctatccagcatccatacggcagaagttgttatggggacttattcatttacacatggataatgaaactcatgagcaaggctggggagaccaactaacaactctaataacaacagtaatagctgaatcccattgatatggatggtgctagtcactgtgttaagcactaagcatcaattatttcattcaattcattgaacactcataataacccaaggaggtagttatttttattcatttctccaaccaactttgccttttgcttttacaggcaagtattctggagcttggagagactgagggacctggctatagttacaaaggcaccaccttgtttgacaggggctctcaggcaaaattagaacaggtaaacttgattagtatttgctttaggtaagtcttgaacattttctcagttaactgaagattttttttaatgtttatgtattttttaatgaatacattataattgtacataatatttacggggtacaatttgatgtttcaatacatatccgtgttgtgtaatgatccaatcagggtagttagtatatccatcacctcatgcacttatttggtgaaaaccttcaatagcctcttttctagttattttgtaataaacaatattttactgttaatcatagtcaccctaccatgcaataaaataccagaatgtatttctcctatctggctgttgattgtagttttaattcttttcttaaatatgaagcttctgtaacttcaactggtctgtgaaaatattatgccaaatagaaagcactttttgtaaataaagggcgtgtgatgcactatgaacacctcccaaatgatttggaggaaaaaaacatcaattccagtgatattgtttcagattatcccaatggtctaggtttattccaaagactttgacctaaatccctcagtattccccttcaactaactctcaacccatttgaaatcttattcatatgttctcactgttagattgtccacctacaatttttttttgtcctttgaattactttctactgaaaataatacacagacctcggtgttattggaaattgcattgtgaatacacaaggttttttgtctaaattttaggtagttttctctttctgttgctacctcaaagagataacagattctgcagtcacattatatgtaaattatgtacaagcttcaccacttgggcttgtacattattctactgattttctacagtggcgtggggggcacataatagccagcaacaaattattagaaattaaattcaaacccagtgtatgctggatatgagcatttccaatgcattttgcctccaatttagttcagatgactaaaaacagacctgtgggactgtttaaaggcactaaatctccacagaatcatgcagtgctatgacataggcattctgttctcaaatattcatcatttatcagcaacggaaacaaacataggattcacatgtgcaaagtaacaaaatagatggtcctagctgacataccagtttgactcaactgactattacccttacaatgagcagcttcttaaaccacacttatcctggtcccctttatctatgttagagaaacaagaccatctctactattaattctgtctcaaaacttcaggttacctagttttttccctcaaagattattcatcttcgacagtcaccactgcttcacaaaacagattttattgttttctttgccaattaagggctccccaagaacagtgaataatctgtcaggttgttataaaccatcaaaagttctagaaatgtcacattacctccttcaaatattttttaacatgcaacagggacatacagctttgtcatcaaaagctgtattggtttcctcatattttctaatctacaccataaagggaagatgtttatcataatggcaaaataaataatttagccagtccaaatctcttacaattgcatgtggcaaaccaaagtcaaactgaaggagaggagggtggaatagaggttaatttgctcacatgacaagaagccttgtgactttatttaggataggtctaggcagtgaggctggtaaacatttaacaatatactcatttaaaaaaaaaaagggcagggggtaggagggggctgacttgcagccaatttcaagctaccaacacgctgtcaaccagctcacagaattcctgaacatttaacaataggctattgtatgctgggatgagccatccccagcatgatactagatccagctatcaaacaatatcataaacaccccatcctctcttctctttttcctgctttacttcatctgatttcattctcaaacagatttactcaaagatgactgcagaggaatgttctcagagggctctaaataggttggctttggatctgccctcttaaaactaaacattaccacagaggaatgaagtattctgatcacccagtttgggagctagagagaatgggggtagctacgttcaaaccatttggatgaggcaggactcgcctgaaatggggtaagtgtagccctcctaagaaagaagcactgtgcggatgaacatcatgaacaccatccaagtttcaacatgtctgagattaaatctgcagcaaaagtttactccatttctgggtgtgtaaagcagctaaaacttcctaccatgcgtccgctatccatggaaatccggaacaaaagcttaagatccaagaaaataaaatgtgttttgaagaaaaatatgctcttgcaacataaagaagctgtcttcagttacaaatagatataaaatgtgaagatatataattgctgcataaatttattaatagaagtgctaatgccataaatcgtacatctccattttgacacgcaatcctttattttcctttcactgaggaagaaaaataaaggagcggaactggtaatattgcttgcaactaaattggattttccaccagagaaagctgtttagaaaaagctattctaaaaaagcaaaatagtactcacaaaagggtattaatgaatccaaccaggaggaaaaagcctccaacaatacaaagctttccaaaacctctttcaggactgaaagccaaaaggatgctttgaactctctgtctttgcagaaaccatctcacctacaaaccgagtatgagatagagttcaaattttagaataagaactcttaattcaaactacaagtcttaactgacgattcaagaggagagactgcagcagctctgggtttcgaaggaaaccgatacatcctgccctcaaactgtgaggcactataggagcaagatgtaaaggatgcagtgcctttgcgctcccacctccgccaccgtgggtgtcataatacagaggtgaaagttcaacatgcgacaggtagggatgcagcagactctgtggctttatactgcataggtctttcactgcttggtcacagaatttctttgaatcctatttgtttatacactgatatttatgtaataacaaaagagtaagtaaagagcaaggaaacagccaagaaaccctgagcaaatttttttccccctaagaataaaggagttgagttaggctatcttcccggagcttctctttatcgctagatgcagtcagctggaaacatatgcctgctaattgctgaatgtgtgcctcatggagcaacggtgcagttgtcgaacgacctcggggaaacaagtctaggcctatttgtgcatttctttctttcaccatgggactcaagtgcttcgccaggccactattaggacagtggaaaatcaaggtggaaggctctgatgaaatcaattatcactaagttattttcactggtgaaggggtttcctcacaggggtttaatagtaaattattctttccatgggatgtgctagattaatggaggaaacaaagcaaacaaatgttgcctggtaagactaagaggagggtcccaaaatactaatatttactgcccatgaagagatagccacattcacaagaaaataaatgtaaacctacaattccagaggcgaaaaggaaaaagaaatgctaaatggcagttatttcctcagtgttatacattacacatatcaataaaccctagagtcccatactatacatgccatatggatagataaatggcatatgtggtaatagtctttcaaactggatgatagtactttgcacaagtcagggatgcagcaattgtttgaaaatagggaaaataaccattttctagcattacctagtgaaatgtaagtgtgggtacagtttgggagaatctgtatagtatttatttttatcctagcaaactatactttacctttctggtagaattttaactttggatattttacaaatatcatatatagtcttggtaacatcttttatttaaaatcacaaatattagttggatagatgtgttaagggagatttaccagactgcatacacaaaggaggccatcagacatgggcatctgaattgatataggttacaccacaccgtagttaaagaccaaatatctgccagtgttcccaataaggaaagataactaagataaaagaatgtctcttgcagaattaagaccttgggattcttttaaagcctgggtttacatcctttgctcagaagagaaagacacattatttcaatatattttcattcattcttaggcattaactgtcttaataaaggcagtgcttctcacttaaaaaataaatttagctttaacaaagtaagtgtaaacgtgaccctaattttcactctgctgtcctttcttccctgttgtgcttattagctgctgctctttgaccttgaacagtaatcctttgagcatgcctccttccaccatcaagaggaggttccctacggtctggtagtatttctatcatagttgttgacatgccagggaaaataatttcctttggacactataacccttctcgaaaccagctccttcaaacaactcacctaattgaacgtgaaagacatgaaaccactggtgtcagaaattaaatataggtgtttctttgttttctttggcatttcttctatttactttctgtcatctatgccataggatttagaaaggaaagctatggaaataggcaccatcaactagaactcaaagagagaattttgtatgaggaacacagtccaccagcagaaatagaatagtgttggatatactcttcaacatgcttttttttttttcaggatcaatgttgatggactgtattgaaaacaaaagggtaattcttctatggagttgtcttgcaaaattctattctagggttttgtctttgtcctttgtaagcacaaagcaaatgagaaaacaagtatatggtattttgatcaaaatatatctgccattaaacctaaggttccggagctccatggtatctggaagatgctttagagggtaggtagcctgaaggtgctgcggtgccatcaaagggcaatgaacatctgttgccccatagcccctttcctcctcctccagcaacaaccctgacatcatttgggaattcaatcatctcctcctctcagtctataaggtcgcagtagaattccatccttagacatgaagaatgtgcctcaggccaagctaagaggcacatcttactcccctatgcccctacccccctacccccctacccatagagatttgctgtgggatagacacatgacctaatccattctaatcagggtgactctcaggatgtctacaggagctataatgaaagagttgtaatgtctacagcagaaataatgtcttctgctggagcttctgcagccatcctgccaccactggttaggctggataaaaggcaaacctttaagccttttttttttttttttttttttttggtgaccaagttttgctacttgttgcccaggctggagtgcagtggcgcaatctcagctcactgcaacctctgcctctggggttcaagtgattctcctgcctcagccttcctgagtagctaggattacaggcatgcgccccccacgcccggctcattttgtatttttagtagagatggggtttctccatattggtcaggctggtctcgagctcctgacctcaggtggtccacccaccttggcctcccaaagtgctgggattacaggcatgagccactgtgcccggcctgcctttaagcatttaatgggatgttaggaatacggtactgtaatttctccttgggtataaaatatattggagtcaatcactgttgcccctaccctagtggggatatggcaatgatctcaccccataaggcaaacactagaaatttatgcttcagaattccatctggctttggttactttttgatacttatgattattatttttatttgaaacagaggctcactatgttttccaggctggacttgcattctttagtctcaggtgattctcccacctcagtctcgaaagtcgctgagactataggtgtgcaccttaattattttaagaaaagaatgtaatggctgggtgcagtcgctcacacctgcaatcccagaactttaggaggctgaggcgggcagaccgcctgagctcaggagttcgagaccagcctggccaacatggtgaaaccccttctctattaaaaagataaaaacttagccaagcatggtggcgcatgcctgtagtcccagctacttgggaggctgaggtaggagaattgcttgaacccaggaggcagaggttgcagtgagccgagattgtgccactgcactacagcctgggtgacagagctagactccgcctcaaaaaaaaaaaaaggatttaatttttaaaaatcagcatgaactgaaatttacttcacaatggaattaaagacccccaacaagtcataatatgcttatatggcaatatcacattgtttgtgtgagttataaagttggatggatttgcactggcatcttttcacggttttagtgagagaatcatgcatcatccaaggaactctgatgtaaaagactggacatgagaattattacagctttgaaattctgtcaatttcctacccatttagtcagatttaagaacagtatgaacctatcttacccaaaaaaataggttctaaagtcagtacataaattatataatcatgtgatatgactttatcatatcagtttacattcctgaatataatatggtccaatatcttcaaaacatatcaagactctgatcacttcttaccattcacaccattatcatcaagttgaaaccaccatcacctgttttctgagttacttccaaagcctcctaatcagtccaaacttagtcccatgcaatgtattcttcaaagaaccagtaaattcttttaaaaaataaataaacagatgagatcacagcactacttaacacctctaacgtcctcccattgcaaaatctgtaccgtgacttacaaggtcttctcgatttgatttgccccatccctatccatctaatcccaattcctaccactctccctctctctcacaaagcttcagccccactgtctttcttgctgttccttcaacattccaagatctttctctcctcgggggctttaaaccttcctacctctgcctgcaattgttttcctcttaatacttccaaggtctcccttttgaatccattcagtttactgcaccaatctcatatcttcaaaaagtttttcctagacctcctaacaaaaataaggcccctttcctaatactcactatccccttattttcctcctagcacctgcaactatataatttccctgttgacatgctgattatccatcttatccactgaaatataatccctatgggcacaagtacttttgtttatttgctgctgaatcatagcatcaagcatagagcctggcacctataaattgctctataaatttctggtgaataaatgaatcaatcaataaatgaatcttccaacaacatgatgcaacacagaccaacgttcagatcctacaaggtctaataatgtggctaaaggggcacctgttcttggttccctttggtgaaaacctgataatcaatgaatggcaagcatatttacatatttaaaagtttgcctgcaaggtaatcttaccttgaggctgtgtaataggagtaagtatctattagctcgtaggaagcacatgcacacatgtatgtacacacataaactactctgatctctcatgtcttcaacaacttgactacatttttacctgaaaaaattattgtagctattactaatgtgatgcactaaccagagagcagaaacaaattgagttgtttgtttctccaggagggaaagcaggccgcagctacttccagaaggtcaagagatcagggtatgaatacctaagacatgtgtgtgtatatttctgccacagggagttttcacacaatacacaaatggaggatcaactaacaggctgccagtcaaggggagattcaagaagtttcaaagaaatgctctgaaccccaaaataacaaaggaaaacatgttttgaaaagtacacaaagacagttctcttaaaaatctgccaggactccttgccaaaatggcatgttacacatccccttctctataacctataccatctgggctttccgtaccccaccagcagggtgtaagaatgcctattcatttgcacccctgcccatataagttattataactttttaaaaatcattcccaaacctgtaggttaaaacatgatgtctccctgctttaatttggaggtctctaagttgcttacggtacaacctcaggatccattcatgctcattttgtagctacaaaagaaaaagctctaaaggaaggccaagtgaaatcctggacatgcagtgtgatgaagaaataagggctgctgcttaaccaagagtcaactcaagcagtctctgtgaagttctttctcactgcctctgtttattttcctcctcagccaacacacgactaacagcagcatcttgaatttgcgttacaatttaccaagcacctttattttcctcaatgatcttcataaaaattctgtactatggataagatgactctgttttccagatgcagatccagaaaatggactttccctcagtgtctccagttattaagtagtaaaacccagactagaacctgtgttttctcatggcctcttcaaagttctttctacgatggcatagttccttaagataaaccgagtgaaagaaaggtaactttcactcacaattcaccagaaaaaaaaaaaaaaaaaaaaaagaggaggtgggggagaaagaggtgctacactcagctgagcccacctgtttggtttctgttagctttgaccaaagtgccagtcattacactaaaattctattttgaggtttatcatgaatattggtttctacaaaattcttcattaattaatgctagaaaacacagctctcagtcaattgccatggggcacaatacccaggcactgcttttctttgttcttcccagtcttagggacaccaatccagatagaattacgtccaaaagtagcctaaggccacgtttatgaaataaaaacaccaaggacacaggctgattttagggcaaattttaggtctggcattttatcattctgctctagatctaggggttaaactctactgaaataactatggttgcttttggtggaaacccccttccccaggcccttccagccctggccaggattcaatcatccattcaacagctattcactacacattcacattgtgctaggtgctgggcatacaatgaagaacaagatagacactgcttttgttctttagagatgacatactagtaagagagacacactaaaaacaagtaaacaaacaaagttatgattgactataagtgtaatactctaaaggaaacaaacaggggcactaatggagaataacgaaggcaccttctttgtttagggtggccaagcaaggcctccctggaaagtaagttagtaacagaactgccattaacccacttaggcctagtgttccattactggaatgccaagcatgtgggagttatccatatcctactgctcaaagtcatcgccaaggtctgatttttcactcatgcaaaaattcaaaaaattacaacctccggcatatatgagtcaataagcattccttccttgacctacacatgcttcaatccatattattttccttagtaggtggctgatgaacaggtcaaaaaccaaacaggccatggtagggatggcatcaggcataccgaaaaattctgctttagaaatcagtcatgaaaggtcattccagtttaaattacaatcaacatatagaagctagaaactccaatcagggcaaaaatggcctctttatatcccatcaaggaatcatttatctaagatgacaagaggtatattgccaacaaatccacaattctgtttccaattaatgcaaacttataatattccaagctgttattagatttcaattaataacctgtgatgcctcattaatgcaaatatgctcttcgtggtgctaaaccttcattagtgaaatgggtccaatgacatgacggtttcatatgataatggaactatgattaaaaggcacaattaatcattttcttctactacataatctctgtgacagtttacttatgcctatatgaagcatttgtttcttgcaaacagtcaatttatatttaaactattcaatagcagaaagaaaagcagaaatatcatactaaattatctctaatagttgcaaagaatcccagcaccaagttaggttgttcaagaataaggaccaggcacgatggctcacatacacctgtaatccgagcatcttgggaggccaaggtgagaggatcacttgagcctaagagtttgagaccactctgggcaacatagtgagatcccagttttacaaaaaaaaattagccaggcatgcacctgtactctcagctactcgggagactgaggtgggaggaccacctgagcccaggaggtcgaggctgcataagccatgatcatgccactgcactacagcctgggtgacagagtcaaaaaaaaaaaaaaaaaagtcacagagctggtgccattctccattaagagcataaagtgtgaaacagaaaatctcagtcacacggctgtcagtgctttttctttctcttgtctgtgtactttccattctttgaaccctgaattgctccaccagcaggttcaagccagcaacagatcctgaaccaaacacagcaaaaacaggacactattcccacccctcattttctccccaactaccccacgcagcaaagtctgacttgaagcgaagctgcctggaacagtccattactactacctgcccagtgtccttccccaattctgacaataacactgttttgcctttgcagaactgcccatctctcatatccatgtgggcctggttgggtggtcaattgcaactcttccctcaagcagccagagagagggtcagaagcaaggctgggccatcaaataccccaatactcagcacagtgattgatccaggaatgggctcctgaatccagcagtctcctgggttttttttctgacattcatttactgctaataaagaataccacgttgactccatgcgttagctttgtttgctgtttgtgatttgtggagaatcgcagaagtgaaaagtaacaaacacatgtcaagggccatccaccccactccaacctccacctcaaccgtcacccaagtaaagtccagctcctttagactccctctctctcagtccccagtgttacttattgccaagagacataaagcgtgcaaaagccacacacttctccttctaaagtaaatatagttttaaaaatctattgagatttcattttaattgttgcttagtaaccattgcaagattggaactgtttcctagcttaaaaaataacactataaaaaagatcatttagggccgggtgtgggggctcatgcctgtaatcccagcactttgggaggcccaggctggaggatcatgacgtcaggagttggagaccagcccgaccaacatggtgaaaccccttctctactaaaaatacaaaaattagcagggcgtggtgatgctcctgtaatcccagctactcaggaggctgaggcaggagagttgcttgaacccgggaggcagaggttgcagtgagccgagattgtgccactgcactccagcctgggtgacagagtgagactctgtctcaaaaaaaaaaaaaaattagatatttaaaattaagctgtctaattgttttaaaactcagatgttatagtagctttgcatcggagatacaatcctaaaaaatttaaaacaaaacaaaatgactgggtgcagcggttcacacctggaatcccagcactttgggaggccaaggcggaagaatcactagagcccaggagttcaagaacaacctaggcaacatagtgagatcttgtctctataaaaatttttttttaaattagccggccataatggtgagcacctgtagtcccatctactcaggaggctgaggtgagaggattacttgagcctaagaagttgaggctgcagtgagccatgattgcaccactgactttcacctgggcaatggagtgagaccctgtctcaaaaataaataagtataaagcaaaatgtttgaggattttatttcaataatgccaatctattcctcttcaacgttttgatctaatgtatgaattgtgactctgtcctcttggcaacaaaagtaatgctgggtcttaatcaatgtgcattagtatgctagcaaaatgatacttcttccatatgtagttatatattaaatatatataaaatagaagtgttagatacgactcttatgattaagatatatctttatttaaataactatcccttactggaaaataaatatggatttatacatttttgattaataaatcaatactcatttataatctgatttataaatattttttatttataaacatttattgatttattaagtgcacatgatgtaataatggtttcagtgcctctgccaacaatcactggctgctaagagttgctagagtaatggattgaaaaatgcaaaagggcctgaaagcatggtacgaaagaccacagtgaatgatcggttatgtcggccaaggatgtgggactcagaaatggtagcaggcacatcaagagctttttttaaatctaccgcaacgtggaaaagtccagttgttctaccagtaggtgcttcacctttgtgaagtcacaattctctggctggctgtctactcatctttaaaatgagagttttgattagatgacctcttatgtcccttctagtttgaatattctatgatattctgaaaaaaaataataataatagctcttgtattagcatcccaagcagtctggtgtgggactagctaaatacaggcagcagtgagcttcgaggtgaaagctctgaggaaaaggcagagtagaagaagcaaactttcactgagctgtttagcctggagaatgatacctaaaaagcaaattaccctgtaagaggacttgggaggaaagtgcacagtgaataagtccatcatcttctcccatatattttcaaaaattattcctggaattatgttgcaaaggagtctcaggatgtttgcagccacaggaactggaaactatttcacaaaataggaagtgtagagatcgggcagattcagtgacctcacaatgttatgggtgaccccagatcttctgagctttttgctttagtgaccttgtgaagactttgtcttcaggctagttccctgaatggtgatgagatggctgcatgtagcaattggtgctctttgcttccttgttcggttcctgaaagagactagttgttcttccttagaagcatgagcaaagttctccttaccactatgtggtccaaattggttcctaccagctcatctttgaatctttggcaagacagatggaagtattctgataaggaacaaaagaagaaaaaagcaaacccttgacatctggaaactactcaacacatatagctgggcctcactgttagaaactaacctggcactcatagccaggccacattattatcctgctgggcataaacaatgtcacagaacataaacagctcaagaaaacccactctgagaccatgataaagtaagacaaaacaagactatttcataatttctctctcttttttttttttgagacagaatctctgcccagtctggagtgcaatggcgcaatctctgtgcactgcaacctccgcttccagggttcaaacaattctcctgcctcagcctcctgagtaactaggattacaggcacctgccaccaggcctagctaatttttgtatttttagtagagatggggtttcaccatgttggccaggctggtctcaaactcctgacctcagatgatccgcccgcctctgccttgcaaagtgctgggattacaggcgtaagccaccgcgcccggcctcatactttctctaagcgcagacaaagaaaaggtcactgcacaactcctgagataccaaacatccccgtccattagctactaagagtgactgctacttcattatgaaaaacaggtttagcctcactttagactgtcttccctttagagatgtgagatatccaatcataaaattatccccactttgtgacagcaccctatgcagaatgaatctccctcccttccttagactctcccccaaatcacccaaatgaactccaaattcgttctaacaccctcttactgagatatgctatggttctctgtggtatgtgttctccctcactgcaatgagcaaagaacccaacttcacctccaagtgtgttcctggaggtctctagctagagggcattaattctgattttatactaatgtttgctaacctttttcattattaccccccaaggagcctctttagacttttttttctaatcatcccccaccatttaattccacagatatactgtatatgtttgaggggagggggtttgaaagagggtctcactttgttgcccaggcgggagtgcagtaacccgatcatggctctctgcagcctcaacctcctgggctcagatgatcctcctgcctcagccctccaactagctgagactacaggtgcctgccaccacacccagctaatttttgtatttttagcagagacagggttttgccatgttacccaggctggtctcaaactcctaggctcaaaggatccacccaccttggtctcccaaagtgctggaattataggtgtgggccataatgcccagccgatgtgtgttttttatatagaaagggtaagattctctcccccatacatatcctcacaagccaattttcgtatggtttaaattaaattataagggggtagaaaggaagttgaagagtctaccacaatacgttaaaaagcacacaccttcttagcaatctacctttttagtacagtaatagtaacactcaatgctttttagcactttccacacaccaggcattgcttttatacatctattaattttacacagattaaataattttatccatccaaaaaatctacatggtagatgctagaattatccccagttcaaagctgaggaaactgaaggacaaatgagccaagtgtcatgccccaagtcactaggttaataaatggtggagacaccaaataactgccctctaactccagggaacatgctcataaccatgaggacacattgcctcacactcaacagcggctccagaaacactccgctcaatgcgtgcacaaatgagcaaacgagagtcataatttgcatgatactacactgccttgttccaaatacaaacaaggcagtaaaaattacggacataggataagacttaaaactaagatgtctgctatacagagaaacatattgacggaaatctttcggggcaaatttttaaagtctgtgctgcatgactcaaatgtttcagaaaactaatcccattctgtgcttatgtgtgtgtgtgtgtgtgtctgtgtgtctgtgtgtctgtgtgtgtatgtttacaaggtggaaaatgccttggttaagaaagggaggaagagagggaagaggaaaaggtagtatgttttcccctaaaaattagagattccgaagtgatgatgacatcctccaaccgctagatggaacgcagttctcccacaccatggccatgactgctcatttgaacttgctgcttcatggtcataaggccaggacttcctggcttcctcatgagccaccacattttccatatttttagagcattcttcctacagaagaaacctattttgcattgtttttacaactatcttttttgttgttgttctaatgttgccaaggaatcaagaacctcaaaacctatcttcttctgaggtcaagccatccactcacaggacttctcaagctggagcccttagttgagctgattttacacaatcgagtagagaaagaaaatggctttttgtggtgagcatctgctgttttgttaaaaatgtggttaaagacattaacaaaagtgacattaccagctgttgtaatgtcaagcagcttagctaaactgttttttatcaaatgacaacatatgacacccaaatcaattccaaaccaataacacattgttacttgtaaaacagagctgaatgagagtgagaatgagagcatgtgtgtgagtgtgacagagagagagagagagagagaggttaattaaaatacaaattcaaatttctcctgaagtaggaacaacagacaatatgatcctgataattttcattaagaaatttttaactttatcccagacaaagcaaaaaaaaaagacgattatgcaatccatattcttacacaagaaacagtgtatttcttttgtaaaattcttgtaatagcaaaaagatatgacggagtttctggccacttaaaatctgacttggcttctgtccttcagccatatacctcctaacgagtatgacaataacagaagaactgacttgtgtggctatgtttggtctctctatttttatctgcccatcatgtttaattatcaggctattaaaaggtggcaaatcggtagcattgccaactgcgttgtccctatggctgaaaagcctgtggcagttgaaacaaccaaacccttcccatgggcatcacgaagcttgtaaaagcaaaacggcacaacgtctgcctgcctgccatagtcatggccaatcctgaataaatgtttaatttccacaactgtgatgagggtagggcctgatttgtgccagtgcttaggaatctccgggtatttcatgtgcacaattattaatagtgtaattcacaaatgccaagtctacccttaaggcctgagctcagtcctgctctgctagagttggtgtgacttagtcatcaagaaagaagacactttcaagggcatgattcctcctggaagaaaaacaaaggagtgtgcttaggggataggacgcttgccaggaacagaaggtatgctgcacatggagagtgtttcgaggtaggtaactcaggagggacctgcatttgggggaaaaaaaaacccagaaccaacagaagcagcagaaataaacaagcaggtgtgtgcctctatgtctactacatgaaaggaaaacagggctgaaagtcacaatcagcatatggagacacacaaagaggggcacctgggaaaatcaatgtgcatcaggctcgatggtgcctgcttcctccaggagctcactgcattatcacaggtggataaagtcaccccttcaatgggcacaagtagatcactcttctctgctgagattggattaaaggcgacactgatgctaacagcaagaagaaggtaaaccggacgttggaaagaattttcaacagcaaagccacagtacaggacagatcaccaggagaaatgtatggggaaatgttagaaaagtatggaaagccctagaaatttcaaaagtccagctctgtgaggagacagaggaaggggcagaatgacctgaaaggccattctagtgctattactatacataggaaagcttccttgagggcattacgttttaggtttccaataaaggagagaccattttcaatattttttaaaattttgttgtgtcattttataataacttccaatgtagatcttttaattttactcttgcaataaacctgtacattttctatagtcacctgcctatttaagtcctttattacagaagaggtagaatataggccaaatgccagaagtaagggtcggttacaaattctcaagtgcttgtttatttctggattactttattgactcatttatgtaaccaatgagatcgtgcagtccagcctcagtttccctaaatatttagaaaacaggttgaccatgggatcatagtagtggggcatctggttttcttctgatagtgctatttgttaaatattctgtattatcagatgccctactgtgtgcctgtatatagacttcatcttattctaatgctaactttatgaaatgcatttcatttttaccttctttatagatgagaaactcgctagcaatcacaattaatatgaggagaagttaaaattggaacccatgactgatttcagagccaacattttttagtcactacgctatactcctacctataaacttctaaaaacactgttcacaagtacatcattcccctatggcttccctggatattgagagacctggattataattggaatttttgactaaggtaaacatttcaaccacaagacctgatagaatctttcctatgagaattggtctcaggcttacaacaaaactagcaagttcttccagagtacagagcacccctgtttgaggcaagacccagaactttaaaaaattctaacaaaggtcctagtttctcacacagagctcttggttttggataagacgactttagcctaggctggactgaagacatgaggggaagttctgcaaaagacattgtgcacacattatctctttcactgccctatggcccgtaagatgttcctaacctggaaactgagaactgcacaggtcaagtaaggtgtccaaactcacccaggtcctaagaaacagagcacagattcaagcccagttgtatctgcctccaaaatgagtgctcttttctgttacaatacatgctactatgtcacctccaaaggtaggtaggtactacctttacccacacgcgtgttcttgaactccccttacatctcacctaatgtgaaaagcctgcatgaccccctgggacatataaggccctgggtagtccacaaccaccacccctccacgtacacatcagccccctttcttcctgttaactgccacagaagcctccttctgttcctccaaggccccctgtgctttcctttgtacatgtggttcccctgtcaagaaaactgttccctacccatctctgccaccttgctgactcctgctcacccttcagacctccctggaggaagcctctccagcatccctggccaggccagatttctatggtttacagcagagtttctcaccctcaacactgttcacatttggggccgggtgattctttgttgtggggtctgcaccgagcatcatggaaagtttagcagcattcactagatgctggtagcacctacccctcagttctgacaaccagaaatgcctccagacgttgccagaagtccctagaggacaaaatcactcctagttgggaaacactgatctattgctctttagaatcactttccttatcttcagagcactggctccagagcacaggatgtgcttctgtcattctttgaccatctcctccacgtgaaaatgagtttcttaaaggcagagacagtgctggcttctgctcaccctcaaatgtccagtgttcaggggcatgcctggctcaaagcaggattccaacaaaaacattttttttggaatttctccctaaaaaaggtttggtgggagatcataaacttaagtaggtagctagtggaagactgctgaagcttttttgaataaaaaataatgccagcagagttcaggtcaggggaaatgaatccctggcaggatggacattaaccaaacacctaacacatcagcagaactttctgccaaaggtgttgagaggttatcagcagcccccacagcacaaacaggtgtcagaatgacatcccaccaaaatggcagcagggccctaattaaaagaagaggctgttctttcaagtattgccatgcagccatggcactgctgggatgtgtcaaatcacacccatctaaaaacacacaccacgacctgacatctttgcccagctgcaccatcccacgtttccgtgatggatattagaaaataatgtaacctcaactgacaagtttattaagacacagaagacattacagaggcccttttgacattccaatctctaacgcagtcagggggagatgctgacttgccatcattattgaaagtaattggtcaaaaaaaaaaaataaaagaggtgagagagaaggagagcaatcctataaagctgtcaggttaattatttggcctacaggtgtgctcagtgctcttgatctgcctaccactgggcttgccagtgctttgccagtgttttctccaccctcactcctagtttgggatagttcaatctaaagctaagagagtacatttaaagcagaattttaccttggccaagttatttccttgcctaattatacctacgtaccagtccaaatctccattcttccctatggctctgtcctgttggcataccaaactccaattttccaggacagataacccagttagaaacaaccgacttgtgtgaaatgccacagagagtcacaacgcaaaaacaagttttattcagattgaatttaatttcctaggcagtttagatcacagatccgaaacccagacattttcacaagccaggcaaataacctgaatgagtccagtgagtcagatgggagccaaaaggaagtgatgaggatgatgacaaacaggaacagcaggctgtgagctcagtgttagcagagaaaacccaccgtgccagggaagctgctgatgctactccctggctctaggtccaccacacgcagagtagatgctcaattaatattcagtgaatgaatgaatgcctgcccaagcattcaccctgttgtttccatgtctgttatttccaccagaagaatgttttgtaggcttaaatctccagtgccttcagcgcaactgtcatttggaaagtggtgaactttaggaattaaagaatggaaacaaagagtacatgggagtcactaatgcatgtgggagatactattcatgccacttccaagaatggggaatccgtacagctcattgtcataagtgatgttatttccaacttgttatgggtgagcattatttagaatagcttggaagaccacaatattttgcaatagacatggtagcctgtcagggatacaaaatgaagactaagactaagaatgtcaaatgagattataaagatacctatctttgctcaaataagcaaagggaaaaagtacaccctctgcctcttctcctctccttaaattccttttccccttactctctcaaggagtaaatatatatgctcatatataccaacataaaaaggacattggtagaagcaaacaatacagaagagtataacgggaaaaatacaggtcccactactgagaggtgtcctcggtgaacaatttcagggctgtgtgtgtatatttacgtgtgaaacataaataggatcgtgataccttacagcaacttctgtttttttcaccggacatctatggcatttttttatacttacaaaaatgcctcctttgctctttttatctactgttccataaaaactcactttataaacacaaaaggccaatttttctcacattcatcaaggaaaggctcctgtaatattgtgctcttttttctacctccaatattatgtttaagcaaatcatgagaatcaattaaaaagtggctaacattggcttgtttctactgtaaggactgtttttccataatttgggcttgaaaaaaaatagggttgtcaaagcatgaggtaagtagaagagaagcattaaccaggggtgttaggaacaggaaatgtatttttgaggaaggttttggaagaggagttatgcatccaaagggttcagaattatgggccaactattcctatgtacaaattgaagacattatataaacactacaagaactgaatgcatactcatctttggctgctatttcaaacttccagggacaaatatttgtccttattataaacatacatccaatatgtgttaagtgctcagaacatgtcaagcagtgtgctaagcagtacccatgtactatctcacttaattctcagattcaccctgaaagtaaggtactattattatctccagtggaaagatgaaggaattcaggcttaaggctacacaaagattagtgagacagcaaagatgaatcccagcaatctatctccagaacttggaccctatgaccttcacattatacgtttaaaaatgtcacagacagatggacacataaaactgtgttgctttcatgtcctgggtttctcttctaaaagcaaagcatatttttgttttctctttccctaactagatttccattttctttggtgagcttaagggagtgccctgccaccttaataccaaatattatatctagggtgagaaggagagaataggaagagcaagcagcaagggccttcagaaactatttgtacttgcctcccaagatagggcagcttgaccttatccatgtggctgacagtccagttgctctagtcatgcacctgtgagactactttctgctccctaaatatgccaaacacacaccatgctttgcatgggaactctcccacccctcgacactacccagttattcacatgaaggagtcttcactttcatcagatttctgctcaaagactgtctttcccccctttctaagagttctgcctcattaacctcttatcctataatctgttttgtgttatttttggtacttgtggaaataaagtgccatacacagtcaagtgttttgtgaatgtcaccatcactttaagcctcatagatatcccacttctggaacaatagaagtatgatgcttgataactatttgttgactaaaataatacattgcatactacttgaaacacacctcttattctagtaggaattatctaatcaaagtttgtgcatgtatgtaaatatatccatatatacacatgcatatgtgtacacacacacacatatttgcattttgcagtttagactcttaattaccaatagaggaaactcagtaagtagcatgatagaaatgcaactagtataaaccaactgaattacaaacacaggacttagaggataactgggcattgcaataattgtgaaggaagatgcttagtgaatgattagagggcaactatgttctgatatctgtgaatgaactgcacagtcttcattaatttcacagaaaattcatttttgtcctgttgcctatcctgccatgaaagtggagaattgctcagaatctagctttagataataacatttgtaaaaaattaaaatttgtggcagggcgtagtggctcatgcctgtaatcccagcactttgggaggctaaggcagatcagttgagctcaggaatttgaaaccagcctgggcatcacagtgagacctcacctctacagacaaaaagcaaaattagccaggtgtagtggtatgcgcctgtagtcccagctttttggagggggaagatgggctgagcctgagaggttgagaactcagtgagccgtgatcacaccagtgcactccagcctgggtaagagagtgagaccctgtctcaataagtaagtaaataataaacaaatttgttatcaacttgtcctgagttgatcaagttgctatagttaactatgaatttatttctgattttgatgttcatagttgcagaaactccaaaaactcctagtcagtacacagacggaggcctggcaataaacacttgaaagaattgcctgttggatgaatgaatgaaacaagagaccgacagacttcatccctccagagagatatcttctactgcttctctatgattgttaggccgatgtaattaatctaacacatggagcagattttacccttcattttcaagtacattgtctattaacagcgtccatgagccctctgattatgcaaggttcctgttaatggatctctgccaataccaaccatcaagctaatgatctgagcttgccagctccaaggtgaaggaccactcttgggcatatctctccaggactcaaagaagaatcccctctccaaatgatcttggagaagcaggtgtccactctgcctgccagaggctctgccagcacagggtgggggcatcaagggaggagaaaataaaacccagtaattcatatgggttgagattattgacttcactttcaaagaagataaagtgaaaaaggaagaaccgtgtttttgaaaggtaagacaggggacattatcctgcgtttcatcaagtcagctttttcatgtcaggcgatggtatatctcctgtaacttgtcaatggcaccacacagtgaagctaaaaggttgaagattatttttgtaacgattgatactctttctgccacagcagtcaagcatctgaagattcttcctttctctcctctgctctggtgaatccttttaaagttcttgggtgaaagagctgcaaaccccagcagatatcaaacctgaaacactaacttgacatatcgggatgtgtgctgctatattcactgcttggcttcaggccccttccagagcacttgaaatacagttggaggattctttgaatatggggtaaaagtacgtggatgacctagattgtcaaaggattctcttcaaccaaataagaaagtaagtttgggtcagcacatgctatcagctagaaagactgctcaaaattgtgtgtgccaaaataatgaaagaacgtgccaatacgtcaatccacgtttgtttcctgcccccgttcctgccacttcacagctctaaatagaaacacacgaagagaaattccaatgaaacaaaaggaatatctgaaggatctcacagctttcaggggtactgtaataccctgaaaacagtgtggttattccgggctccacaaactaggtagaaataaacatccatcattgcatagggcaggaagaacagcaaaagcatgttggctaatttataaatgtcacatacagtgttctttgtttcattgcatagggaggcaacgtaatgaaaacattaaaaaccatcttttggtgataattgttgttttaaactgacaaattatataagtcaaagtgaaataatctttgcaactccatagagaaacagaaaactattaaggcccttagaaacatcacaacccatgttcccctttcaaaggttagaataatcctgagtatattttgggaaagtaatatcctaagtcagtaaaaggtcagtgacagggaagattcttccacatcttcaggagacaaaaagtcccctggagaagagaaaccaggttccctggtgacattccgcagaaatctccagctgttagaagaacttggatctccgaggccacccaaacttcaacttaagaatgcaacaaagtggggatgaaacagttcccgggagggaggaggtagaataaaaatggaagcaaagctaccctacagcactaatctgtaaacctgcttcaattggcaagaaaaagaggaagtactacacatgcctgaaatgacaatgtagcacatggaatggacctctgctgttttcgatgatccagcattcctcctgattttcctttgggagaatcatttttcacctactcacagttcacatgattggagaaggcgccttctgggtacaggcatataactaaactgaataatccattccctgacttcatctttcctgtgcgagttggtccaaggacttttgttgaaaccactggaagagagtggctttcttgacagcaggttaataagatggatggaggtaatcaggttggcaagtggctgggcaactgtccttatcaccatacaaaggaaatcttccagagaacaaaggaatcacagaaggaagtggatgtgaaagacagccagagattcccaacaatatatgattctgtaaatccaaccatgaatgaagcttggtatccccactatttgagccaataactcctcctgttggctgaagttactttgacatgcattcttatcacttgcaactgataatccatcccacgtgagtataaatgtgaagaaatcattctaagtacatccaccttaccaaatggaccatgttttgctcaccagtgtgaccccagcacttaggacaagagatgatgtgagaagacttcaaattattgttcaataatttttttaatgattatttgttaactcatgaattatcttccatattcatatcttttaaaaatgaaagaaaatcaaagcaggtttctcctttctgtctaaatcctagcaagatcaaacactggggaaaaaaataacattctcccatatctatctgaccccagaaaaattattacttccaaatagtatttagtttttggcagttatttatgaacaggtaatctatataatttaatagataaacctatttaattatctattttttctcccacaaacaggaagaccagtgtcaaaatattgagcaactctcctaagaacaaggcatgcaatctcaaattcctggttttcagaaaaggttaattggacaagcaaaaacaaggagccaacttattggggagaactggaggcctaggaaaaagaaaaggcccaactttctatccccaacagacactttgggaactgataaaattaaacatttttcaaagaccctccatttcctattaccacaagaaagtcaaaatatttctatcttttaatttaactttatcttgcttttctttttgaaattttaatttagggcaatatttctgagggatgctatttttttttaaataccttctttccttcagctaatgtaaaacaaatagttactcctggaaattactttttactattggttccaaagctacaatttgcagcaaataaaaggactcttcccttctacagaaacattcagacaactacatattgagaggaaggtttatgtgtacttggagcctttgggtgatgttctctttggccatatgatgtggtactcccatcagcctgccatttagtgactcctatcaaagcaaacctctctaaaaacagacacttcaaagaagatgactaattgtgggtgccaactggatgctgaattgctgaatttctgaatggtttccatctcattttccaaagaaaatgtaaaatttcagagtaaaattgccacttttcttttttcacgatgtagtatttggtggcttttaaattcacagccttctattcttggaattttttaaattttaaattaactttccttccttcattccacattcatgcattcatttagtcattcattcattcgtttttttggagacaggatcctgtcctgtatacagcccaggctggaatgcagaggcatcattacagttcactgtagcctcgaacttctgggctcaagcaatcctcttgcctcagcctcccaaatagttaggattataaccatgtgccaccctgcccagctattttttttttataaatgggatctcactatgttgcccagatttgtatcatactactggcctcagtgatccctcttgacccctcagatcattaaacatttattaaatgcctttcacgtatcaggtagtgaaccaatgctgagaacataatcatgaacaaaaatccaaacagccccagtttttacagaatatccagattagtaggggagacaggtattattcaaacaagcacataagtttcttaatacaacaaaaggcgcatggctcttcaaatacaagtaacagaggaatgaaactgagctcaggaagtcaggagagctagttaagggagtgaaaatacgagttgagagccaggtagtaaataggcctagaagaagtatgggttttttgtttgtttgtttgtttgtttgctttgagatggactttcattcttgttgcccaggctgcagtgcaatggcacaatctcagctcactgcaacctccatctcccaggtttgagtgattctcctgcctcagcaccccgagtagctgggattacaggcatgcaccaccacgcctggctaattttgtattttttttttttttttagtagacatggagtttctccatgttagtcaggctggtctcgaactcccaacctcaggtgatccgcctgccttggcctcccaaagtgctgggattaaaggcgtgagccactgcaccaggactgaagtgtgttttgttagaataagagaaagaaagacgtgggataggggcagaaaaaatgttgggaaaacggaaagaacagcaggaacagagaccctgtagtggaaaaaacttagtatatgtgaggaactaaaaggcagccagggtggctggatactgagacaaggttggtgtgagatgggcagaggctcctccaagcaggactgtccaggctgttgcaggaaagaggtcttctgtctactagtaatagaaatgatccaatttactccattaaagaaacaaaactggatatattcaacacattttctctgtatctaacatttcagtagaagtgatataaagattgctaccacatattctgcttgcttcacctacatcttactgtatgatatgggtaacgaataaaacacattccccctatctccattctgtatgtatataccattattttatttcatcatggtatctgaaaagcaattataaatcatgattacagcagctgaaatttgctgaagacttactatgagcacggcattggaccaactactttctgtccatttccacactaaaatcagctacaaccttaaacagactgtcccatccaaagctagcctctcaggttgaaagatcatgatggattatgcagcagggacccaccattcccagactggtatcttagggtccagattccatccatcaggcacacctgggaagaaggcaacctcacttggccttctattcaccagtgaatctcaagtatctctaatgatacttgtggtagtgcagttttctgagtcagccaccctggtatgaattagactgggtaaagtgaatgttcatccatggatgcagctttccattttttagtggcttataaccaaggcatactgctcttaggagtttatttcagagaaaaaaagtatgaacagccaccatccttaaatgtacaaccttttctctgcaacagcttgtccttaaatccaggacacaggatgacaaatgggtttccctgccaggtcctgagaggtctgtgggaaggtgaggcctaggcaggagtggagatcaacgaagcatgaaatggtggatgtttccggggctgcagaattttggagaattcctcacgctgtctgctcaactggtctcagttctcagtggactctgtggggtcaggaggagccctttctctgggttttccctctttctccctcagcagagaaaatcgagaaaaggacattaaattcagtgcagtcactgtgggtgctaaaatattttcaggatcaatggtggtgctaaactatctccatgtttctaatatatatatatatatatatatatatatatatgtttttttttttttttgagatcgagtctcactctgtcgctaggctggagtgcagtggcgcgatcttggttcactgcaacctccgcctcctgggttcaagtgattctcctgcttcagcctcccgagtagctgggattgcaggcatctgccaccacgcccagctaatttttgtatttttagtagagacagtttcaccatgttggccaggatggtctccatctcttgacctcctgatccgcccgcctcagcctcccgaagtgctgggattacaggcgtgagccaccgtgcctggcctgtttctaatatttttaagactgaagtgctttttaaaaagaaaaaaaaatcttatggctacaccacaaaaatgcagtgtccttgggtaagggacccacccaagccccttggccttttactttccaggtatcatttttccctttgatagtactcttgtgtctgcaaaaaatgctctgtcttgatatgctcctggactgtaagattttgattgttttgttttatattttgtttatgtttatatgcatcttatatttccctgaaaactaattaacactgttggcctttctaactggaaaaaaagtctattatttttatactagtgttacaaaacagaagttcagagagaaaatataatttggccaaaatcacatggctaatgagaagtcaagttggaacctgattataaatctatttgctttcaaggtccatgcttttttttttcaagctcagataaatttcacataatataaaattaaccatttaaaataaaccactcagtggcatttattaatatcaattcataatattgcacaattatgtctatctagttccaaagcattttcatcatcctaaaataaaacgccatgcccactcagcagttatttcttattttctttttccccagcccctagaaatgaccaacgtgctttctgtctctatggatttacttattctggatatctcatataaatgcaatcatacatttgagtcactacagcagttaacacagtgcctggcacgtagtgaattttaaaaaatataggttgactgtgtgaacgaaaggataggggtggataatgattaaaccaccataaaatcctgagatattgttctaatatccactgcatgctctccacaaatgctccttcgaattttatcttctgtgacgatgacactatgtcaacctatccacagagcccagcagtgttaatgccgcatgttaataaaacacccctctttccccacagagctggatttttataaaatgaagctttagaatctagataaccaggacacagtacactgaatgtctactcctaatatgtttgcacaaagctaaactacacatattgctacctaaaatataaaactaatgtgagtgcctacagaggaaaatgtggaatgctgaatagggtgaaccccctgctattagcctggaaatgatgactctgttgtgaatctgtcctacagggtatctcagggtctgagataatagcataattatatatgctaactcttcctagttataatatcttggaagacaaaagatatagggtaggagggaagaaaagttaagccaaacaaaaagaaaagactaaattatttttactcaacataatgactctttgggaagtctaaatggcaatacgagcaaagttacaatgcatacttcagaaaggagaggtaagatagaagataaaagctgtgcacatttatacacatattctacaatggacaataaaatgagaaatgcacagtttttcagaagggcaacaagaacacctctacctcctctaaaaattaggatatcaccaacaaatcgttcaccaagttagaagctgaagcattttaaaactcaatgctattaacagcatacttgatataagcagaagacagtgggtttcattactgttaactaccctagtacaacccatagaaaccatgactcagtctgaagtagcacactctaatagaacttcctgtgataatagaactgttccagatctgttctgtccaatatggtggccactaaccacatatatttactgagcatttgaaacggggctaatgtagctgaaagacgagttttaaatatcattgagttaattaaactcaaagttaaatttaaatagccacatgtggccaggtgtggtggctcacgcctgtaatgtcagcactttgggaggccaaggaaggtggatcacctgagtcaggagttagagaccagcctggccaacatggcgaaaccccgtctctactaaaaatacaaaaattagccgggcatgttggtatgtgcctgtaatcccagctactcaggaggctgaggcaggagaattgcttgaacccaggaggcaaaggttgcagagagctgagctcgtaccactgcactccagcctgggtgacagagtgagactccatctcaaaacaacaacaacaacaacaaaagccacatactagtagctactatattagagcaactctatcagatattaattagtaaagaatatagaaatactctctagcatagtttacctgcatttcataagggcaatcaaaatagctttaagcatgtgtagtacaggcatacttctcaaactttaaggctgtgtgatatataaacaaacacctggcaactgccatatggaaacggacaaacacctaggtaggtggggtagagatggaacaaagtggaaaaacacaagtcaggtaagtaaaaaagctcatcgagggctgaaatgtcccaaagacttggagagtcaggccttcctaggagctttccatcttacaaagctgagtattggcaaatgttaccagagagatttagcacgaggaggaagctggtttaatgaaaagagctgcgtcaatcatgagccgatggaagtcctgctctagcctttggctatcgagccataaaatccgttgcttggaaatatgaaacccttttggctacttaatgttttctccaattcctctaactcagggaaaaggatcatggaaagaaaccaaggagggcaaagcaaggagaaaggccagaaatccaaagaggaagaccagaaacaggaagaaaaaatacaacataaaattgtgggagaaaaaaaaatgctcatagggagactggatgctcccagggtgaaaatgatgaaaaatctgtgcgaaagagcatgcccaagcagttagcaaagacctttgtgaatttatgtacaaaaccacaaattacacacatgcttcccaggaacaacaaatgctgcccataaaaataaatacctgccattaaaataaataataaggaggggaaggagagagagggtcagggaaataatacaataagccaaggttaaaaaaaaaaaaaagctagaagaagttgaacttgacctagaatttgatagtcagttacttaatccagaaaaaatgaaactgccaggcaaaagtactagcacaactggctatgaaaaaaactaaaggcattcacaaaggtattggtaactcgtcttatgatcagtttctccctaacactaaagtttccaattaaaaataaaaaacaagtgaggtaaaaggaatgattctaactatagtcccttcgcatagaagtaggtcaaaacagaagaggcttactgggatggggaaacagacaaattccattttgtaatacaccatggagaaaggtgtttattgaaagtggcagctttagcaccattgttttgcactctgagattagtgatttttgaatcacctcctatggtattacttttactgtgcatttagcaatgtcagctgagatataattatgccaaacctagtgatatgatcatctacctttcaggttcagctaaagagttctcactccatcaagacttctttttctctgaaaaggattcccactaaaatactgtcatttcctttgctttgtcacaatcacattttggtataggctggactgggtcagtgctgtgaatctgagaggagataatgtacttcaagtcccaaagtattttgagttgctggtatgccacataggattacaatcacaaaagaaagttaatagtgtgactcaatgctgagagtcctagctacgggaaagtgagacaagattggtttcatacctggcagcactagaatttaacgttaatatgaagtgtcctgattagctattatataaaacactgaaagaagaaatttctgttcaggaggtattcagaagaactgaggaggatagctggctatttagtgccagagagccaagtcaacttccaatccccatgggcttcttcagtgcacatgacctatggccaagccccatctttttatttcacaaatgttaacttcccaaatgggttagcaagggaaaactatcattattataaagaagcgcagataaggcagacacaatggctcacacctgtaatcccagcactttgggaggctgaggcgggcggatcacctcaggtcgggagttcgagaccagcctggccaacatggtgaaccctttctgtaataaaaatacaaaaattacctgggtgttgtggcgcacacctgtagtcccagctactcaggagactgaggcagcagaatcacttgaaccctggaggcagaggttgcagtgagccaagatcataccactgcactccagcctggacgacacagcaagactctgttggtggcggtggggggagggagaaagaaaaagcacagatatgtcaagtcagattcacttcatcaactctaagatttaaataatactaacactttactcactatttaaactacgttgtttttcgtccattagctcttcctcagcaatctgatcccatgtgatatatattgaagaaagactttcacagatcaaataaggtagggaaattctgaaaactaaactgtattcctagaaatataccatggtatgagcatattaaagaccctgagaagttctgcagtaaagaaatctgatattgccctctgtattctcctaaagcgttttagcttggggacgattttccctttgttctttatataaaatacgtattaccatctcatattcagagccctataaaatatacttcaagaaatactgaggggccccttaattacactataagactcttaacatacagtaggtttgtaaaaagatagtaaaaaggattaaagattcctcagaattagcttttcatgggcagcaaaagaagtgagaaaagaatggtatttattgctacctaccacgtggccgcattccattaggcgcatttcagtctcagtaaatcaccgcaacaattctctagtaggtatcattattctcttttatgcagaagagaaaaccaaagttcatagatgccacacagcccactcacggtcccagagttaagagacggcagggcagggatttgaaaggcctgtgccctttcccctatatcacagtggtgtaatcttttcacactatgcatacttctataaagcaaaaccattttgaaatatctgtcctgtgtgacatcacaatattgttaatggtttccttctgtttccagttgtctgcttagtataatgaaattaaaccattaaaatggaaatggaacttgttccgtgaccttccctttgtgagaatatgccaaattaaatcaacatgggatttttggaggatgtgccatttttttttaagaacagggtctttctgccaagacaggaaaacttataagaaattcaactacctagctacaggacctcaaatattaggttataatacatgtttctgtaggttgtaagtgtgtaaaaaaaaaaataggttccttcaggtttaagaaatccaaggtcatgaaaacaggcatctggccccagctagaaccctggtctagaacactaaggaaaagctaggccatctttcatttcttcctgacatcttggtctctctaaacgggttctcttcgttctgcatgctacatgaaaggaaacagctaccattaattccccagtattgctctctcctcatatgtgaggtcaaatagattcaagatggaatctgaatgacaattctaaattctctgaggaattagagcccaaccttggaggcaatcctccacggggactatatgtaatatatttatgtaatgtaaatatggccaatggaaattacacagctgtaaccacacaaactgggacaagcagcctctggagagcatggagagcagtggtgtttaggccaccaaaacagcttatacaaagacttgacaaaaagcacacaagctcgtcaatggaaaatttatgagataatgctgaagtgatttttaactaggaagatcacgggcagcaaagtgagtcaagttttaaatgaaaagtagaaaaaatataccgtgctgttgcaacaaaaataacccaacttgtgcttatgctgaagttataaaaaggagaaagagaaaaacttcacacctgcaacagcatcattaaaacataacaggatggtttgggtttgtcagaattaagggccacctgctgttccacacttcaccctcatcccaatcccagtccctgaaagaaatgaaaagaaagctgaaggaattttcatggagacaaaatcgagcagagactggatctgccaaagactatttttctagtcttcaagaaatatcctgaagtactgtttctaacagcttcattttaaaaaatattttagctctttgtttgtcttaggcattcagaatataaaatgtacattttatattttaattctctgttagaaaaacagggcatatgttgtaaaaacgtatggaggtcttcctttataatttgacgttgatgctttttcacagataagcatttatctttcagaatctaaataaaatgccatatttaaattttggaattttaatctgtatctggaagaaccaaacagaattttcaccatctctaaattactggattgcaagattaaagaatcaagtactttgatcttatttaacttgtacagtactcacaaaatttaaaacactgcacatattttaaacaaactaagtaagcatttacttatatttgataatctggatatttttaaattttctattttaaaatgaaggtgagtaggaaaaattacagtctctttaaagtaccatgagttaaactgccacattgatggtaccatttaccaaccagctatgagaagtaacaaaataaagttgcaccaggaatattactattactctctacaatcattacacagattacaaatttttttaatttttttttttttttttttgagactgagtctcactctgtcaccaggctggagtgcagtggtacaatcttggctcactacaacctctgcctcctgggttcaagcgattctcccacctcagcctcccaagtagctgggattacaggtgcccaccaccacatctggctagtttttatgtttttagtagatacggtgttccaccatgttggccaggctggtctcgaactcctgacctcaagtgatctgcccacctcggcctcccaaagtgctgggattacaggtgtgagccacagtgcctgaccccagattacagattatcctcattttacagatgggaacatctaggttcaaaaaggtaaaggaatttcccaaggatatatagctataggctaggattcatggcctggtctaatgtcagaagcaccccctattaccactggcatcaacagaagaccagagtagagtttaggttgttagtaaagacatgtttaataagcacaaagcctcttggtaataattaaaattgaaaatcttcatacagatttgtgatctggtctcacaaagtgaaaagctcaatgcatttcttttgcatttattgactttaattttcatttccatagctctttatagccttcaagatattgtcacattatctcattctgacagttatatccttcatattttagcatttattaagttgttacatgtctgactccaaaagaaatggaggtacaccctcctatatatatctctacctgtgatacatcatagcaatcaccttatgcatgatgctctgaaaaacaaatccgaaatatgcaacagcctagataaatgggatcacaaaatccctggtggggacttttaattatatgctaagtaagaggcaggttatgcagaactttctgaaaaaggggcagagggttttcagaacgatatgagataacttctaggctgttgccatggcacttgtaaactgtcctggcgccaatgggagtgtctttatgctaatgagcaatgaaggcaactagaggttgctttcctccccacctggtagttttggctggcttcttcactgcatctgaaaacgggattgactaaatcctgcttctattagtgggaccatgacctgaaaacaaatcctacaggcctcctacctcaacaaggcagcatcaactgttctcacaataaaccaaatatcaatgattccatgatttggtgagagcactgcctattagcatctttaagtagcacaaaacatggcagcagacgctctccttcatattaggttgcatctagtcactaggcaaaatcttggttagtttcctttcattttaaattttgctcagaggcccagtgggcacagtggctgacacctgtaatcctagcactttgggaggctgaggcaggcagacagcttgagccccagagttttgagaccagcctgggcaacatggcaagttcctgtctctacaaaaaaatataacaacaaaaaagtcaggcacagcagcacaaacctgtagtcccagctacttgggaggctgaggtaggaggatcacttgagcctgggagcttgacactgcagtgagctatgatggcaccactgcactgcagcctgggtgacagagtgagaccctgtcttgatcaatcaatcaatcaatcaatacttgtccaaatgagttgttagttcctccttttattctctataaatgctgccagtcgggggcagtgtgtaaaaagcagaaaaacaaagtcaaaaaataatggagggttaaaaaaaaaaaaagaaaaaaaagaaaaaacaatggagggttccactcctttaaaagatattctgtccatgacaactccccctctgcccatttcctgaaagaataaaaaggatatgtagttctttctctctgacatcttctgaataaagtatcaccttcaattcaaacaggtaaaatatcttgaaaaagtggtcagaggagctggccaggcacggtggctcacacctgcaatcccagcactttgggaggccgaggcgtgcacatcacttgaggtcaggagtttgagaacatcctagccgacatggtgaaaatccatctctactaaaaatacaaaaattagctaggtgtggtggtgcatgcctgtaatcccagctacttgggaggcttaggcaggagaatcacttgaacccaggaggcagaggttgcagtgagctgaaatcacaccagtgcactcaaatctgggcaacagagtgagactctgtctcaaacaaagaaacaaataaacaaacaaacaaaaaaataaaagtggtatgatggaggattgttttgaaagtgttttgttcaatttgaagtcaacaccgtgactaacaagtttgactgacagtgtccctcaatcagacacacttagaagctccacagacttgaccagaggttccacagacattctgggtacttcaaaaaatcacaccacaggctcaagtgtgccatgtcacactcttttcaaaacttgacaatgccaagtcaatcaaggaaactgattaagtgatgccgacaccctcttgcctccccagaatccctttaaaaccaagaccaactgtgtccaatctctattagggccagtaacttttactaagaaaaaatatttcctactgtggcccagatcctgatgacagtcaacagcgttaacgtttttactttttaattttagactagttttaaatctacagaaaaattataaagagttcagagttcccatatatgccacacctagtttccactattattagcaacttccatatatgatagagttgttacaatcactgaactagcattcataaattattatttatattaatttatttttcgtttttttttttgagtcagggtctttgccactcaagctggagtacagtgacgtgatcagagctcactgcagcctcaaactcctgggctcaagtgattctcctgcctcagcctcctgagtaactcggattaccgggcattatcacacctaatttgttttttattttttggtagagaccaactcttactatgcttcccagactggtctcagactcttggtgtgagctaccatgcctggcctctgagacattactattaacaaaagcctctattttattgggatttccttagttttcaatctaatatgctttttctactccaggaccccatccaagataccatattaacataacttatgttgcttaagacttttcttagttgtgacagtttatgagacctttactgtttcttatgaccttaatagtactgaggcaagtatgttgctgaagtccctcagttaaggtttgtctgatgtctttctcatgattgcactatgtctatggttttttgggaggaacaccacaaagataaagtgccatactcatcacatcatagcaacgtccatattatcaacatgacttatcaccgatgatgttaaccttgatcactggttgaagtattgtttattcaatttttgcattctgaagttactcttttttcctcctttttaagctgtacactttggacaagaaaccacgtgtggccgacatttaagatgtgagagctaggctccagctccttgcagtatttatgagaactatccggaattctgctaaacagatttttcaattctacctcatttatttgtttattcaatcatttatttccatccctatttattcaaatctttttttatattttgggttataattcaatagtgtttattctgctgttcgaagcgacccatctttggcgcttgggaactccttgagttggctcctatgtccctttaacacactcccattattgtgatttattttgttgtgttttctgagcactgtcttacttcttggcactataacgtgctccaggctcatcatgtatatttcttgctgaagtcccagaatttgccatttctccaaagaaccttggtttcttttattgggaaatggaattagaaacaaagatctgggtgttaggtgtatttgttgctcccacggtttattcgtgaagcagaaatgtaccctggttttagtaaatgcagaatgtcaggtatccaccatttacagcgtcaaattgaatagtttcatggtgtggggaaaaaaaaaaatcgcatgtttcacctattaaacctcaccccagaaccttcagtaacaatgatttgtttaccatctccatggttttgtctttaccagaaagttaataaagttgcatcatgcagtagatagccttttcagactagcttctttccttagcaatatacatttactattcatccatgtttctatgtatagttcattcctttttattgctgagtaatgttccattctacagatgtaacagagcttgtttattcattcacttattgaaggacattttggttgtttccagtttggggaattatgaataaagctgagacaaacattccagtgcagggttttctaatttcataagttttcatatcagttgggtaaatacctaggtatatgactgctggattgtatggtaaaactatgtttaactttgtaggaaactgcaaaactgtctttcaaagcgcctgtgctattttacattctcataagcaatgtatgagagtccttgttgctctacatcctccctattaatggtattgtcagtttttggtatttggtatttgctctacatcctccctattaatggtattgtcacacaccagtggctgtgtgatagtatcatcttgtactaatttgcaactctctaccaacatgtgacgttgaacatcttttcatatgtacgttttccatctgcacatctttagtgagctatgtattcagatcttttgatcatttttaaaattagcttgttttgttttcttactgttgagttgtaagggttctttctatattatggatacaagtcctttatcagatttgtattttgtgttctcccagactctggcttggcttttttcttcatagtgtcttttgcatagcttaagttttcattttaattaagtgtaacttacgatttttttcatgcattatgtttttggtggtgtatatacctactaacacattaccaaatacaagatcccagatttttttctagattttatacttttgcatttcacatttaggtctattattcatttgagtttttttgtgacatatgcaaggtctttgcttaagttcatatttttacagtggatgttcaactgttctaccaccatttgttgaaaagttatcctttctccatgtagtcacttttgtgcccttgtcaaaggttgactgaatttgtgtgagttagtcaactgtttttcaaaaaggctcagcattttcgaaaatccaagaaaacaggaaggtttaacttgaagccaagagcaacttgacagtggcagggcaatgtcatcactactgtgtatgtaggtcaaaccaagaatgttacacagtcataacggaggtgggctgcgtacagaacaccctgcatctcctaaatggtttataatcactgattaatcctctgtgagtatagacgggcctcattagctctagtaacaaggaaagacagtgttagattgataaagctaaggttgggaaagagaaattagagcagaagagctgtaaaaaggatggaaagtgccatgcccgcaaactttgtagatggatgtttttattgtatttgtttttttttttaacaaataccaccatcttttcattttcttcctatgttctacactccctcaaattaggaggcataagatatttaaattcaaatgggagctttctactctagctcccactgatgtgtatttcttattaaagctttgtgattattttgtattttaccagttcatgcccgtagagtgttgaggcctattttatcaaaactgaaatagctcgtgattagagcttacttaaaatatgcaaaccaagacaaggtcaaagcaacctttctttcagagggtcctgtgggggatcaaatggtatacattgtgattcattttcattcttcttctgtgtgtttacccatgatggccagggaacacaaaatacaagcctctcactggagtcagcgtgcaaaatgtgaaaccccctaatgtcaaactgcaatcaacacatcacaagcctgtcattaaattggcttcacaaaataaaagtgagaaaaaagacaaatgaagttaccacacgtaatacagaattgaagtggatgaggctgaagtttagaagagaagttgtcctctgaggaccgaagtataaatgcagtttttaaattaggccatggagggaaactcttggattgttccattgctggtgccctcggaagccttcacgggtttcctgtgaaacacgcaatgtaaagcagtgaatgcagaatatttgatcctatctttgtgttaatgagtcttcaatctagagagtgggtgatcacttacaaaaatggccttctgctgactcaccagccctgcctattacattcaccctgctcctgcacaaagccagaaaaactgaacaacaagcagcaaataaatttcaataaacagatttattgtcctatttcaatacaaatcacagtctattaagaataatgcactctagtccaggttctgacagtcaaagatgctgatttaagaagagaattgtgctcctaatttaattcattcatttgcatctctctcttctaagtatgatataattcagccttactgatcatagctggtaatcactcctctgttttatggttaaaattgtgcttttaaaaaattacaattctacctatttatgtggggatttttatatattatggttctaggatgaatggttattagatgacaataatgaaaaaggcaaggtttatcaaagtgacctctgaaattaccccatacattttcaaaatgatgcacctgtattacacagagcatcatagattccaagcacattttccataactaatgatatgacttggaccatctacaccttttgtcagcactgttttctgatttcaacatagtacaatccattgaatgtcagactctaacaggtgtctatgaactcagggatcttgacagtttctttcttttttttttttttttttttaccattattacattaaaggcaaacagaattcagttccttcaaaattagacattttcaacttatgtcccagctttctgttattccacctcacttttgtacttggtaaaataaatagatcacaccgtagatgctgacatgcttctatcacatattatgatattttggctttattttttagttgaaaaagtgactgtattttgtaaaattatacacaaccaagagtttaaattggattcaatgtgtgtatgctttccgctgaatgattcctttttctctgggtcttgcctcaaacaagaaaccattaatgagtagtgaaagctttggacacagattttgtgaagtttcatatgagttaaggagtgccttcatttcatccttcaaattttgacagtaactatttttataaagaaattaattcagcttttccaaacttctttacattgcatcataatatatatcacaccatgatgacaaacattgaatctatttctattaaagacaaacatgcacaatttccatctcaagtgaaatcttgagcaaggatggaaacttctcaaagaaagaaaaaatagtaagccaccttgtattcttaagaatgcagaatttcaaaatgagacatttctgagctgcctctcacaaagcaattttttttttagccgcagggcaccccagtagaagttaaaaatagattacacttctattcatctaaaagaaggacactaatatgagcactgtagctttctgcacttcagtaaaaatcagaaatgatctgcagcccggtgaataaagttgattcacttagagaacaccagcatttctctcctcacctagcttttgaaagcaagcatgagacagcccctgcctacaaaattgcagaggaattactctcaattacaggcttctgtctgttaaaaagtagagctggtgatcagtctgaccttttttctctgacaagtcaaataaatgaaagggaaaaaaaaatctgacaggtgttcaatttagaagctgggggtgggggggaaagaggagaaagaaaagaaaagcttgtattctctaactagatctccggatttttttgtattattcatcctattttaaaagttccttttcagtgaataaattgcatgtggcaatgtaattttcttaaagtcactcacctaatgttttaatttgagtatcatttactgaaatcttcccacaatcaatcattcaggcttttagtttcatactttagatactttagggcaattctgctgaatgctacaactccgccctacccccattcttccttccttcttataagtagattacaaatgaccacagaagaatgacttttctggttccctgcatttgctatatttattgcaagacatggcttgtaaacaccagcctccacattttacctgataatgcgatcattacagaattcactagaatttggtcggcattggtattatttgaatgtgaatgttttagtaatgacatgaatcgtttttcagctctctgacatttacccacgttttttcatttcaaaagagttaactactttgctaaggactgaaaaagttgttctgatgaaagttaaattctaaaacattctgtattcttcggagttggttggttaggttcttgataatccagcacttgttcagcaaaactactaattagaggtggaagccatgtatgcattgaacagttacctcttcaagtttcaaagagagaagaaggaccaaaggatgctctttcccttaggaacccatctgacctgcatttaggccagttaatgatgacttccattcagctttgaaacatgtttcttttaagtcagctacttttcagtagggaaaaactattttgagaattaatcattctcaaacatcatacagaagccaaccagttaaaataccacaatcttaaacagacctgcaaacaacatttggaaagttgaattgtgattgactgatgacatcacagaaccaaaataacgtcccacattcacttcttgctctgttatttttgtttgcttcataacagtcagaactgcttttctgagatggctgagacagttttctcagaaatgacgcagtgaaatggctaatggccagagagtgggagtgagatgagaccagaaaaaaaaaaaagaaaaactaaaagaaaaaaggtggaaaagaacaaaggtgatgtacacatacccctaaaagctggccaaaagatagttatagtaaaaattctaagggagggctgggcacggtggctcacacctgtaatcccagcactttaggagtccaaagcaggcagatcacctgaggtcaggagtttgagaccagcctggccaacatggtgaaaccgtgtctctactaaaaatacaacatcactggggactgttgtggggtgggggagcagggagggatagcattaggagatatacctaatgctaaatgacgagttaatgggtgcagcacaccagcatggcacatgtatacatatgtaactaacctgcacattgtgcacatgtaccctaaaacttaaagtataataataataaaatttaaaaaaaatacaaaaattagctgggcatggtagtgcacacgtgtagtcccagctacttggggaactgaggcatgagaatcccttgaatccgggaggtggaggttgcagtgagccgagattgcacccttgcactccagcctgagcaacagagtgagactccatctcaaaaaaaaactaagggagattttgaagttgtgtctttttcctgtgactgggaggccctgggaagctaagaaaattttattgaacatctgctttgcttccaggagataaagtcttcctgatacttccttctaatttaagtgaggcagtatcccacaattaaaaaaataaaataaaataaaaaaacaatggttcctttctccaaagagtcagccagcaatgatcaagaaaacagcacagtggtgtatactatacagctttggtaccaatgccaacaacccaaagtgataaaaaattaagaacagaatttatacaaaaataatgcttaaacacatgttttattaaaagctatagaaaaagggatacatttgaaataaaaatagcagtattttctgctttaataaccaactgttgactagtctcgtacttagaaaacggcaggttgtcacctagtgaactactcaaaaatctctctaactagcaagataaaaagcagtatttcaagtccactgaactgaaatgaacataccatacgaacataatggcagtgtacattgctcacatacaaaaccacatcataaagccgtagtgattagaagggcatagtgaccaaagcatgatcctctcctccagaaacagactcaaacacacagaaaagtagtatttttttatatgacattgcaaattcatgaggccagatgaattaatcaacaaatgttattttgggaaagtgaggacattgaaaagaatgtgaaccctacctcacaccttatcccaaataaattggagacagattaaagattaaaaattttaaaaataaaaatgtttcatttaaaacataaagcattgaaaacagcaaaatgatttaaaatacttttaaaaagtcatttttaaacatttttacagtgggagaaacccaaaagaaaagactaacaaagccaattacagaaaatgaaaagttcagataatacaaaccaaacagaaaacaaaccaaaacacctacaatcaaaaaaataaaggtaaaaggctgggtgtggtggctcacacctgtaatcccagcactgaggattggagactgaggcgggtggattacttgagaccaggagttcgagaccagcctagcaaacatggcgaaaccctgtctctaccaaaaatataaaaattaccaaagcatggtggtgggtgcctgtaatcccagctactcaggaggcggaggcaagagaatcgctcgagcccgggaggcggaggttgcagtgagctgagttcacgtcactgcactccagcctgggcaacagagcaacactatgtctcaaaaaaaaaaaaaaaaaagttaaaggatagacaggcaaaagttcaatggcctttgaaaaaggtaaactgagggctgctgaaagccctaaagcaaggagacaaatgcagatgtaggtttaggactcagcatgaatgctgtggctggagacatggggtatggcagatgcctttcatgaaagccaacagagactcatctccctacctcccaaatggctgtggaggagtttccgttctgtgactctacctctcctgtatgggtggacacgtaaccagaggtaagcatctgatctatgaacaatcaacacagagattgagttgagccatgctctctacagggcattcagaagtaaatgggatttccaagttcaattagcagagttgcctgcatctcatatttgacacctttaccctacatgctgcttacctgcccaggatctgaacttctggatatgtatctttatttcaccccacactctgagtcctaactttctaccctctaaaatgattccaccaccatccgtgaaagcagaactgataactacaggctgcgtgactcatgtttggttttgacttttcgtaaccacgatccacattaagagctttttcaaataattgtttataggttatatgaacttcataattttgaatgacacaagtttctactgaagtgattggtctgccacttccactgccagtgaaagaatattctctctgtgttcttaaaatcattcattctaaatgacactggggtaagatgaccgaaaactaaagggatgacattttgcttaaaaggtagaattgtaaacaccagactgcactcagaaaaatggagatttctcaaaatttaaaatcctcaaccatgagaaggataattaacaaaatacacttcagaaatatgaacacttagaatgcacttagtcactttacgagaactactgtaatcgtgcccaagcctaaatgcggatgtgagtataatcactgaccagttgcagcaacactgctgctgagaatggacctgcatcagaagacatgccgagggacagagctggtctcagcacccttaggtttcaatgcatgtaagagccagtgttcaggctgcaaaggtctgggcatttgtctttccaggctaacagaggaggagacaatgagactctacatcaatttcccagtatattctgcaaagtgataatgaatttctaaaagaaaactaaataaaaatatcatttagttggctaaagagcttccagaagaaaggcctcagaccatttcaaaaagaaaatggacaactctcaaacacagggacatagatgaggcagaaaagaagaaatatgcatacctataaccatggccttgacaagtcattttatagaaaggtaagatccaagtcttgaggcacttgctcaagcattcaaatatttctggggccaatcaagtgctggctgtggagatgccacatcctgaccctgcaaacagtttagtgggggacacaggctttcacatatatgactgtagcacagtgtgatatgtccaatgtcaggggccagtaatgagaacatgggggcaggaaaggaaggagagagtcctcacacctcagccaaagtggttcaggaaaacatcccaggaaaagaggtgtttgatatgggtgttaaaaaatgggctcgctttccaatctaaagaacttgaaagtatcatagacgacacaaatgtgaagacatccaatgatcatggattggaagaatatcatgaaaatgatcataatctgattatccaaagcaatctacagagtcaatgcaattcctatcaaaaaaccatttttttcacagaaatagaaaactcaatcctaaagttcgcatatggaaccaaaaagagcccaaatagccaaagaaatcctaaacggaacaaatctagaggcaacacattgcctgacttcaaattatactacaaagcaatagtaaccaagacagcatggtactagtataaaagtagatttataggccaatggaacagaatagggaacctagaaataaagctaaatacttaggaccaagtgatctgaaacaaagcattaaaaaacataaactggggaaaggacactctatttaataaatggtactgggaaacctggatagccccatgtagaagaattaaacgggatccttatctctcatcatatacaaaaatcaactcaagagggattaaagacctaaatctaagacatgaaaccataaaaatcttagaagaaaacctaggaaaaactcttctggatattggcctaggcaaacaatctatgactaagactccaaagcaaatgaaacaaaaacaaaaatgaataaatgatacctaattaaactaaaaagcttctgcacagcaaaagaaacaatcatcacagtaaaaagcccacagaatgggtgaaaatatttgcaaactatgcatctgacaaaggactaatatccagaatctgctaggaactcaaacaaatcagcaaggataaaaaacaaataatcccattaaaaaatgggcaaaggacatgaacagacatttctcaaaagaagatatacaagtggccaccaaacatgaaaaaaatgctcaacatcactcatcatcagggaaatgcaaattaaaaccacagtgagggctgggtgcggtggctcacacctgtaatcccagcaccttaggaggccgaggagggtggatcacctgaagtcaggagttctagaccagcctggccaacatggagaaacgctgtaacaactaaaaatacaaacattagccaggcatagcggcagggagctgtaatcccagctactcagggggctgaggcaggagaatcacttgaacccagaaggcggacgttgcagttagccaagatcgcgccattccactccagcctgggggacaagaatgagactttgtctcaaaaaaacaaaaacaaacaaccaaaaaaaaccacagtaagacaccattttaccccctccagaatggtcattattaaaaagtccagaaacaatagatgttgacatggatgtggtaaaaaagggaacatttatacacttctggtggaaatgaaattagtacaacctttatggaaaataatatcgtgatttctcaaagatctaaaagttgacctaccattctatcttgcgatcccaatactgggtttctaccgaaaggaaagtaagtcatgagatcaaaaaagacacctgcacacatatatttattgcaacacagttcacaattgaaaagacgtggaaccaacctaagtgaccataaaccaataagcggataaggaaaatgtgatatatatatatatttatatttatataattatatttatatttatatataattatatatatgtatatataattatatatattaatatacatataaacatgatatatatacacacatatatatatgtataccatggaatactactcaaccataaacaagaaaaaaataatgtcttttgcagcaactttcatggaactggaggccattattctaagtgacgtaactcaggaaagaaaaaccaaataccacgtgttctcacatacacagaggagctaagctatggatatgcaaaggcatacagaatgttataatggacactggagactcagaagggagggtgggaggggcgtgggggattttaaaaaactacatattgggtaccatgtgcacaactcaggtgatgcatgccctaaaatttcaggcttgactgctatacaattcatcacataaccaaaacctacttgtacccctaaagctattgaaatttgtttaaacgaaaaaaacttgaaagtgatacagttttaatcaaccagttactgaggatggacatattagtttattattgccgctgtcacaaattaccacatacttagggcttgaaacaacacatatttatcctatcgttttggaagtcagaagtctgaaatggctgtcactggggtaaaaccaaaaagtaagcagggctgtgttccttctgggggctctagttcagaatccattcccttactttgtccagcttctagaggaagcccacattcctcacctcatggtgccttcccacatcttcaaagccagcaacatcaggtcaagtcctgctcacaccacaacactcagacctctgcatccctcatcacaccttctctcactctgactcgcttgcctccctctttcatttataaggacccttgtgaatacattggacctacctgaataataccagataatccccctatcccaaaatttttaacctaatcacatctgcaaagcccatttggtcatgtaaggtaacattcacaggtgttggggattagaattaatacctctttgggggatcattattccacctaccaaagtgggttagggaccacacacccgccctaagtgcagacggaagcagcaatggcctaggatgtgtaacatacatacatacatataaacatatatacagacatacatatataacatatattacacatatatacatgcacacacatatccattacatagatgatatcatacatatatacaatatatacatactatgatagtaaatgttttatttgtaaaaaaaaaaatcaagcaggattatattagtctcatttcttatactttgctatgcttttgtgtgggcaaaaagccgtatggatcatgtactggggaccacaggtaagtacatacagccatgcagacaccccatgcatataaactccatccaacatgtagattactgcaccccaaatagatagatacatatatacgtagacagataaaagaactgcttttcaagtcggtgttccccatagtgtggtacatattccatttactaattcaaactttaaaattcgaaaagcagcatacttaacatgcatttaaaaatatataaccatcatgtcagtcatgatttcataaatgccacagcttggaactattctgcccatagtagtccctagccacatgtggctcttgtcaatgtaaactgtgactagtccaaactgagatgtgctataagtgtaaaatacacacaagatttcatagcattaaaaaaaaagaaatctcatttaaaatttcttattgatttgcatgttgaaataataggatacagtgggttaaataaaatgtaaaattaatttctcctgcttctgtaatatggcaactcaaaaatctcatgtgccttgcattatatttattttaacagtactggattaaaacaatgccaaagcagttgtgaagtgaaaacaaaatgagttgagctaaagtaaatattagtaaagttagcataaaggtattacaaatatcttgaaatttcaaagctaataacctatgtttggtaacactatacaacatccctggaaaatggaatccagcttttgaatattttctggaaagggtatcttagtacttccgaggttgttcaatgtagtggtagagggggtcaaatgaaaaacatttcttctttgtattgactggaaatctgaaaaacctttgtacatttctctccaatgcccttagttctggcttataaagcacagcacaaacctacccactactatccataactagctggttctggccttttgaacctttagtttcaaggctcccatgaaaccaacacagcagctttgtaacttcacaaacttgaaagaccacattgttggaggaagattcttactgcaggccctggcattccccattgatgagctgaaatcagttattatgaggttctgtatacaccttctgatgatggataaaacaaatgcatatgcctcacaggcacagcaggaattaaaaatacattagttcatcgcaacttcagatctgggattgaggaacgtttggatgacttttttttcttttcaaataaagtttagatgaggcaggaatttcactacagagtagagttctgagactctccaggtccagttcagcacttggagagaaatcaaatacatcttatcttaggtatggcactaactttcatcaaaaaattatcatatgctcagtcacaaatggttattgtaaaatctttactaacctaagtgcatataaaaattgtgaattcctaatacaaagcagtatttgacttttaaatttcattttaagcttggcccgttcacttggaatgtgattacagagtaaattaaaaagtaatcacatgtgaattacatttcctcatgaatgtaatgacttcaggaggctgattaatgttaagcagtgcctgtcctactgcatgcataccttcccaggtgagatatgcaagatagctgtcgtgagttgtttaattttcttttactggtattccagggagactgcctgaacacataataggctcagcacattcattaggactgaggatgttcttccctttggtatgctcaagtcccacgtgcaaaataccatcaccgtcaacttatggttatgagaaaagcccaagggaggcggtgcagctctggtaccattttctacctagccaagtttcaatttctcaatctctctttctatctttttggcaaattcttcatatttgaatggaataattccagagaatcactgaaaaatgcatttgcaccagtgtaaaggtaacgaattgtctcacaaggaatgaaggcttattaataatctacaacagtattactgcagagaacaaaatttaaactaagtggagcacaggatcattaacatatttcctctcaggtaatggggaatgtagcagtctaaaatatttactcctttctgtagtcaggttaaggcattgttttctaaaggagttgtcagaggaatcacgctattgttagaagtggaaaaggcttggtgcttcattatttctgtgcaaaagaagagcaaatacagtggatttagtagccagccaaggaaagccaggtactaaaaattaccttgggacaaaagttggtcttttattcctgtgattccccattccactgggaggaacaatgaactagtagagcagcctgagaacatgttacatcataatctagaacatatagacagctgatgtcatgaaactgtcatactatatgtgatgctctctgacatcatctattatataaaattttgtttttcttttttaagtttggtgagacaggctaaattgaattcaaaatccatcagtgactcatgaccatcagttagaaacattctggattgggagcctttggaatcacaggagttgagagactgccagctcacttcattgtcatttaactgtgggtcctcaaaggggaatgttccaaatgtcatgtcttcccagctttgtgtgggtggtgggaaaatgaagaggggtaatagcgagagaattaatgtcaggagaataagacagaaaaggcctacaattctgtagtttctcctaagactggcttcaggattcctttgagtttaatatttctgttatgtttttatcctgagatatttaaatttccagaacattcaaggtcaatgataagactattagaaagatttttatttaaacataaactcaaaagcactcaaggataaagaagaaacctatgagaactctgagtaggtaacctacaattcttctgtgttaaggagagagtagagagaattactcttgtgtttcaaactgggggtgtcaaacataggggactaaaaatgtgaaatataccagtatacaatataactccattgccttaactgagatgacagacactaatattcttttgttgtactagggtttttattctgcatttgttgtaccttataacatttttaaggcctttactaacccactgtgtgattcagaagagggtgatcaagaaagtgagtgacctagagaacacaccacgggataaccaatcaacatagacaaggtaagacttggacactagggatgggattaggaacagggtgtctccatccagaggacagtactgggtccaggctataaaggcagagacactggattgtgggtgctccctgacgtgctaatgagagttctgttaccaacaggactgggataatcaatttcccttctctgcatcccctttccacattttagggcctgatgtttgacagccatctaatgagctaaatgaattctacgaattctgctctaccatgttggatttgctcttgtggataatactcagcagaccactacaatttctagtgggtcacaatctacttttgacctcccccttctctaggacatatccctggcattttcctatacatgaccaaaattacttttagagaatgtaattttgtataaaatgggaaaaattaattaaatcattaaaatatgaaaaggatcctcttctaacaaggtctttcctctacagggcatccatgctttgaactctagggacagcattaaactgaagcaccagtgtctttcttctggaatcagaatccctttgttgcttttgggggaaaaaaaaaaaaggctgtcattgaacttttaattaggttccaaaaatgtgacctgaggcaataatagaatgatttattttaatgctacactgctcttgatgatattcggttaaaaatgggccagcctttgaaacaccctgacaccacacactggcatctacaatgttgaggctactgattcagttttatttcccaagatgtctttctttactcctttgttcaaccacccatccttctgtccattcatccattcaacaaacatcaacatttattgccaggcattaaggacagacaagcaacaaaaataaaatggtccctgtctccaacagaacttactaaagttcagctgggaagacaaccacttacccaacttaaaatagaacaacgtgggtggaaagtactcagtccaatttaaagagaccataatatctaagttttggtctttactgctccctctagcctgggttttatgtttggtttagccatttaaccaccactatgtataacaacacgtatgttccactgctgattttaccaacagaggccagtctcacggtgggaaacgtggctcccaatggtatcttatataccaaatgatcgtctatggtagatttcaatcatcattctaaattctacattgtgggtttgtatttctgagtgccaatacaaaccacaatactatctattttttaagagatggggtctcactatactgcccaggctggccttgaactcctaggctcaagtgatcctcccacttcagcctcccaagtagaatatcttaaagtccagggccattcagaggaagagagatgctacactgggtagataatcagaagaaaagaatcatttaacaaccaccctaccccccaaaaaaccctttctctctgcaaaatggaagggccatctagaaagaaacagaatcattcatacatatttattttaaaaccaataattaaccacctattgcagtactgaagttcatggcctacatgggatttattatactgattagtccacttctgtgtatatttaacctatctcataactttttttaaacagtcaatactaataaatagctgagttcatctaaaatatattggatctaagactacccaaattttcctcaaacatcctaactagaccccagttaaacttcttttggagtctcagggagaaaaaaaaaaaaatagaatgctttagaaattcttgattgaattttgttacattagctcagcataagcattacagccaccaaaaccactcttaccagtaagttctccatagcaagagatggctgcctgtcccaggattgcccacatatgtcttcttaggatactccaggaacaaagaggagaaaaataatcttggaaattctgtagactgttttgactttttaacccattcattcaatccataaaaatgaacaaagtgctataatgttacagtggaaagagcatcttttcagaggaagatagctggaattttagtcaagacttcgtcactaattatcattgtgcctttaaagcatatcacttcacttttctggaccacatttacttacaagaaaaatgaggaagttggaccaatgacctagtagcactcgtttctgattctcagtctgaagtcaatggatgctattaacatggaagtattttgaagctgcatttcctgcaggggcaaagcaatgcttcctccacattttcctgactcctttcaagttctcctagagagctcctaagacaattcataaagagaaagggggtactgctgcccaagcacacatcctttgtcacggtgtgtggtcaggcactagttggcattaatttacttgttcacagttgtacatgagacattattggtagagtagttatggttgcctgattgtggatgtgtaactaattctggaaaaggatgctataaagttacaatccaaacaatctcagcaggtgtcactgtagtcaggagaacatatcttcacaaatactcattatttatttatccttaagtaagagaaggtccctaccagccagcctaaaagtactgagctctgtttcccatcataaggccaagaatcatcaactttgtaagatcaaaagggggttttatgtatgctctgtcttcgtgcaggtctaagtggagccatgacaacctgaggcacatttgtagatattttttcaaggttataggcagaatggcactccatagcatcagtcagaaagctactcccatgccctactttgtctatgacctcagctttatctacttttatttatgagtgtggagcttaggatttcagtgacagaataatttgtttgacacattacagttaaaaaaaaaaccccaatagaagtacatagacatacacacacacgtgtctgtaaaattggtaaaatctgactaaactctgtggattgtaccaatgttaattttctagttcttacatgagactatagttactacagttaagcaagatgctaactatagagagtttgcatgaagtgtgtgtgagtctttgcatttttgcaactcctgtgaatgttgaattatttcaaaacacaaagttaaaaaaaaatgacaaccaccaaataattaagaaacctataccttcaaaagcaagatttaaaaagtaattgtaaaagttcaggaatagtgtaatgacacggttcatcatcagtgaacacctctccttcaaaaaatatttgtatgataataaatatccctcaacaaaggcatgtaagtcaccagtattcattcccaggaaataaggactgtctctttcaaaaatatttagaggacctgagatgacccttttcccctaggtcacaccaagagtttttatcactgaaagctcctttttgcaattcatagttttgacaaaaaagattttagtgatgtgtctgtgtctccagatgcactgctctgtgcaactatataataactattacctggtcaacctatgtcagcccattggaactgatctttaagaacacaaaaacatatatgtacacactggtatgaacagcaaatcattcttaaaatatttgatttagaaaaaaatgcaagagagatgatagttaatatccacaaaaggcaacacaatttcacaaatagacaagaaggggacaaagaaaaactaaaagaaaaaaatgggggcaaagacaggaacaggaagacaaacttcgcatgttctcacttattagtgggagctaaaaatcagaacaattgaacttgtgaagacagagtagaaggatggttaacagaggctgggaagggtcatggggaggggggtgaatagttagtgagtataaaaaatagaaagaatgaagaataagagctagtgtttgatagcacaacaaggtgattatagtaaataatttaattgtacattttaaaataaaagagtataattggattgcttctaacacaaaggaaaaatgcttagggagatggatactgcatttacattggtgggattattactcattgcatgcctgtatcaaaatagctcatgtactccattaatatatatacctactatgtacccgtgaaaatgagaaattaaaaaatgggcaaatatatggagaggtattttatttattttattattttatttgagacaaggtctcagtctgtcacccaggctggagtacagtagcgtgatntcagctcacctcagcctccaccccctgggctcaagcgatcctcccacctcagccttctgagtagctgggattacaagcacgcatcaccatgcccagctaatattctggtttttttttttttgttttgtttttttagtagagatggagtttcaccatgttgcccggactggtcttgaactcccgggctcaagcaatcttcctgcctcggcctcccaaagtgctgggattacaggggtgagccacccttcccagcctgaaaaggtatttttaaggtgggacaatataaaaagccaataaaaatgaaaagatgctcaaatttaatagaagtcagaaaatgttagagaaaacaatgagatgtcatttagacctaatgcactaatacaaatgaaaataaggggaaatacctgctctggatttagataaatggatattctgatacatggtagattaaaatatcacttttaaggctttatgaaatgtaatgtaacaatacctatcaatatttaaaaagtacattttcttaaatctagtactttcatggctgacaatctatcccattaaaagtaggttattagtgagaccccatttctaccaaaaaaaacaaaaaaatctggccaggcatggtggcatgcaccagtagtgtcagctactcaggaggctgaggtgggaagatagcttgagcctgggaggcagaggttacagcgagccaatatcgcgccactgctctccagcttgggtgacaatgagaccctgcctcaaaaaaaaaaaaaaaattatatgagctttttgtacagtgataagacaaaacaaaaccacacaaaggctggatcccaccagcagaaaatgttttaaaattatgttaccgccactggacataatgaattagatttatacagtagccttgaagggatttcctcaaagaattattgaaagataaaagaatgagtaatattccatttttgtaaaacaatgactgaaaaatctctccagatatgtatatataaatacacgtatgtattaacatattagcaggttgacaaatacacaagtataatcataggtcagaacgtcccaaattctgcatcttggcacaagtataagataataacttttatctaacactggggtggaaagataaaggttgttcatcaccagaaatgatgagccaaaggatagagccacctaaaaagcagtatttgagcaaaggagttggggagttcaaaaggaagttgttgcctgaggaggattctgggagcactccaggaagagggaggatagagcatggtggatgaggtgggtcatgtgtacgggaatgggatagtaccgagtgaaaacatgggaacaaaatgacgcaaagttcagaaatacacatacatacatttacatatatgaatacgtatgtgtattcttgaatttcatggtcatatttatgcattttcggtgaaattgtgtttttaaaacttactttatgtcttaaaaataacacttaaggctgggcgcggtggctcacgcctgtaatcccagcattttgggaggccgaggggggcagatcatgaggtcaggtgattgagaccatcctggctaacacggtgaaaccccgtctctactaaaaatacaaaaataaaaaaaaataaaaaaataaaaaaattagccgggcgtggttgcaggcacctatagtcccagctactgggaaggctgaggcaggagaatggcgtgaacccgggaggcggagcttgcagtgagccgagattgagccactgcactccagcctgggcgacacagcgagactccgtctcaaaaaaaaaaaaaaataaataataataataataataataattataacacttaaaaatgagcccaggtagatgatcttccagtaatttctcccttgattttcttgttcttgctgctattaaaatcaagagggcaccatatttctccctttgctcttctaagatccagtacttatgataagaaaaccatagtccaacacaccctatgtaagttattctgtgtatctgagcttcagatgtaaaggagctctttcagacttcagggttatgagagtttctgaatagccacctggcaaatctgggtagatgttgactttcccagcaggccacgatttattgccaaaagcacaatttttttcttttgttttgacttaacatgccagaaaaaaaacacaagactataagaattaaacctaatgcatcacagctaagctctctaaggcatgaaagaggcaagggctgcaccaaaacgaatttatcaatcacggaatgcaggaccccttgtatgattagcttaattatttaaagaatgcaaaagaggtggacggttctaccattaaattatcctgtttaaagaaaatgccaactcggtaagcatttctaagtggacaggctatttcaatagagtacattgctgaatgtgtgtgtgtgtaataataaaagaggctgccctttaaaaatccccacaccacgtacttttattaatttaatttggtgtccactgtactttttagttcgctccagttgcaattactattctagtttaatttcacatatatttgcattgtttcatggaaacccttacctcggtaaagagtaaaaatagatacctcccactagacccacctcaaaaggatatatgtgtgtgaaaacatacatacacaactaagtgggatgaaagtgatctttagagatatgggataaaggaaaaaccatttgaaaaaagtctcagaacactcctaggaagaccatatgtacttcctcatccagcaaagtgctatttcaaatgtgttaaataagtagggagtgtgtcagtgtgcgtgtgtgtgtgtgtgtctctgtaccaataaacatccagaaaaaaagaggggaaaaagtcaatataaaaatttagaaattagaatatttacttttagttaagaaaatttctagaaagttttattttgatatacaaaatataagacagccatctcaacaatcgtgtccagtcattcagcaatcagccaccactgacaacctacacctttccttcctttcaataatggccttccaacagacctcgaaaggcttctatatgggtcacttttcttactatatctgtattttttttccaaacctaatcctgtttgttctgaattatactgagtttctgataaactttaaaatgtttttcttagatccagctgcactaagagtataaagcgaatttagaatcaccaccccacagtccccccgccgacaaatcatactatttaatatggcggtgatgagaacaacgtatgtgactaccgtgacactcaataaaaatgctatgatttgctttttaaaaagtcagaaacctatagaattcgtatgtgagttccactcattgtttctataaaaaggtcattctgatatgttttagggcattgtcatgagaatgtgtgaaaaatctataggcttacaaaacatgaaaactcaagatactggttggtaaggacatggtaggggtaatgtattcttagaagagaggctgcatcatttctgcagataaatttgaaattttcttcatgcaatttggaatgtaatctcttactagattaaattttacagctcaggaaggtgaggagctggtaagagcaaactgcatgagacaagagtatagatatccaacaaacaatgaggcaaccaacctgattcacttagtacttgacagcaatgcttttattagaaacactttacttatgacctattaccagtggttcctctactattgggatacatttaaatctgtcattttaaatgtgtttacactttttctgtgtacaagaactgctgacaaaggcaagcgtgatatgtcatactgatgacgtgttaagctgaggaaatttccactgccacaggcaacactttaaccttatgaaacattttaatcacatttttattgaagaagcttattaaaagatgcaggctttcagaactcgacaaattttcttgatcctttgccaaatcagaggtaggcaaagtgtactctgaaatcacctccccccaaattgtaaattcattttctgaaattagatattgacatttaagcatcatataaaagtcaaacttttctaggatggctgagaagttgaaaatcctaaatgcccacattatgagaaaagaagttaaggcaaaggccaatatggtgagtaattttaaatttacacttagcatttagccccttttctgcattagtcccatgttaggaaccaactcattctttcatatccaacatatgtattttcagtatttgctaagaaataatcctcatttcaaagcattggttattattttctacaaaagcttggtttctcaatagtataattctgtgtttgcagactataaaagtatagctctgagaatatgaaagaaaataatcaccaggacaggcaatcgatttctgtgtgggcaaaaattttagaccttttttgtaggtgaatgacatcagagagccatttagctctaagtttccatgactacctgtaaaatggagatatcattcattcactcattcatttgataaatatcaagagaacatccacaatatttcaggtacagaactaggtggcattggggtgacagagaacacactggttttgcctttaaggacatttatagtctacttgctttctgtccacttcgactcagacataaagaatatttatcaaatataccggaagtcccagaataagggtactctaaatacatcattcaaatttcaaaatagaacctaaaaaacaaatgccaaaacatttacccaatgtattcaggccttatgaacctagtgattaacatatttttaatatgttatttcagctatactgtaactatatggtgaaacacaacaaaccaaactacttggtttatttagtttagtataaagccacatttagtagtattccaactcagtgctcttcggcaagtatgtgcacagctatattacgtctaggcactgtaacagtggctagggagatgatgacatgatgacatgatgatctgttagaaccctgtgaccttaagaagcttatggtccagaaagacatacaaatgtgtcattcactatgtgatactcctctcaatctcttcctctcaccatctcaccatctttcttacattcctactcctgatttggtccagacaatccacccatcttccagagccaagaactctgttgagccaatagtaaaaatctcattccctctgcaaaggatttgtttgtttaggaaagttgtgtgacccagtttcagccaacaaggaaagtgagtgaaaaaccattcaatagggcttttgaaaaagacatggaaccaatctaaatgcccatcaatgatgaactggatcaagaaaatgtggtacatatacaccatggaatagtacacagccataaaaaggaatgagatcatgtcatttgcagggacatggatgaagctggaagccatcatcctcagcaaactaacacaggaacagaacaccaaataccgcatgttctcactcataagggggagttgaacaatgagaacacaaggacacagggaggggaacaacacacaacagggcctgttgggggtggagggtgtgtggggagggaacctagaggatgggtcaataggtgcagcaaaccaccatggcacacgtatacctatgtaacaaacctgcacgttctgcgcatgtatcccagaacttaaaataaaaaattaagtatcaatccaaaaaacacaaaaacaaaaaccaaaaaaaagtttcttcactctttccaaaaagaggtaaaagataaacccaagtgaatggagaatttggtatatgataaatatgctatccttaaatcactggggagaagatggagttttgatatgaactgttgggataagtggatagtcacatgaagaaaggtaaaatcagatccattccttagactttaaaccaggataaattccaaatggatcaactatttaactatgaaaactaaaattaaggactagaaaaaaacatggtaatatgtcatctcaataacctaggaatggggaaaacttttctaacaattatttaaaatcccaaagtaataaggaaaaacatggataccagtgattacataaaagattccagaaacaaattgggagaacacattggtaagcttcactagagataaaaatccccaatatacaccagggctgcaaaatcaggaaaaaaacagcccaaaatcacactgaaaaatgagtgagaaatatgaactgattagctcataaataaatgcaaatgggccttaaacataagaaaatacactggactgtgctgttaatatgacaaatgcaatcgaaaacaatactaatataacattcctcacctatctgacaggaaagtcttaaagttcaacaatatagtatgttggccagacttagggaactaggaattcttatatagttgtggtataaatacaaagagacatatgcaaaccctatggataagtgttcatcaatacctagcaaaattacatatgtatttatcctttgacacagaattgcacttctgggagtctatccaaaagacacactagcaaagataaaatatatgtttgcacaaagcaattcactgcagcattatttaaaataacaagagattgaaaataaaaatgtttataaataggggatggagtgagaaaaaaacatggtacatcccccatgatggagtactataaaaccgtaaaaaaaaaaaaaaaaaaagaagaggaggaagaggaaaaagaagaaaagaaatcattctagaaagtgcaactaaatgctctccaggctatttttctaaagaacgaaagaaagttgaagaaaaatgtatagagtatatataacttttcaaagaaaggatggaacacaaatataaatgtatttatatacatacatgtatgtatatccacatacaaacacatatatgcaaccttatgtatatattgtatttgtatttaataaacagagtaagtattaaaaatttgggggaggaagaaacagagtataagggagatatagaagttatactactttgaacatactggttttatagattgattctgaaatcataaatattctacataattataatgcaaaattaaatctaaaaaagcaatctctataaattgaaagtaaaataaacctaatttcatatccagttgctatcataagcactcacagaggtgctatttctagcgattttatttaagatacataacaatttaaaggaaaactctaaactgctcatggtaattaaattatttgtagtaggactggtatcgatattctgagactcttgtgcatgtactgtgaataaatcaaagaattatgatggtatcattaagtgctgaggttttgttggggaaggagagtatggttgaaatgaaataaggatgtgagatcaatggggtaaggcattctgactggggaaaaccactctcccaaagatgagcctacaagttgccttagctggttctccaggcttctgtttctaaagttattgtcatgacatctttttaatgttcgcttttcatatgatgaggccaatatatacatattaaagtacatttacatgcatatacacacgtaaacttatttggatagcatgttctcatgcatcgatcacatttctgatttgagataatagtacactaggttaaattcttcctaattgactgtggccaagtctgctcacgcccagcatcggacctcacattctttcctacctacttgttttaagctgctggctccttgcagtcacttggcagaaaacacttctcctcaaacttgcattgtatttctagctttcactcatcaatatgaattttaaggctcccagtgaaaaccaatttaaggtatggagcctgtttaaaacaaggactggctccagtcacacccttattttcagaaaataagcctctgaggcactcccaacatagggacatgcagccaggacgccaagtggtatgctttggtagaaagaattaaaaacaacttagtataaaaacgttagggtatttgttggatttaaaaagtttagctaatgtacatgacagcagacctcaaagcaccagaagactcccttgtctgtaatagagcttcagatagaacacacctcttgaaataatactaatatctattttgggataatataaggtattttctccaaaacacatatctctttcacataacgggagacatataagtaaacagaaatatctctgaagacaactaagtgttgtttaagcactaaaataacaatctaatgaattagtaagataagaaaaaatctatggggagaggaatattatttagtttgggaaaataaatatggtttgcaaggcatatgaaatatcactgggacagaggacaggaaataatactgggcctgggacaggatatgagaaaaacaagatgaaatggaagatgtgagaattcagaatagacaaagaaaaaggacatggcggagcaatcctgggcgctaatgattttctaagaaaccagcaaatccgggtttgttcctgaggatgttccaagtggagcagctgtctatctcagggattttgctaactccagaagccatcagcctagtgcccagtgaatgtttaatactgagatgctttcatgccacctgaaagaaaagcaagagagggatctgtgtccctctcaaagtacctagtactttatggtagcttcattggtttattgcgttgattattcaagattccttggctgacgatgacaagaacacaaatcaaactagcctcaactagaaagagaattaattggcttatataactaggtattccaatgatagagagaacatgagacaaatctggatcaaggcacataccctttcttgctctctctccccccatctgcttctttccgtctcccaattctgtttgtctctgatcagcttttggcctcatattcttcttccatgagcagactctgaaatcccaaacccacagcttttttgtgtcaagtcgtctctctacatagatcagatttcaccgaagcaatcttactgacagctacatgggagatgcttcagcttcctggaacaatcgctggggcatattcctgtgattcagacattggacagacccaagtcaagctcccacaggccactacactggccatttccaccacaaccatacaggatggggaaggagcagttttccaatgaatcccaacaacagatttttcccactatccttccaataagactatttttcctccaagggcatggcctctcaaatatttttggccttctccacactttaccataacatctcctaaatatatgccccataattaaacagatggaaaccagaatttttattgtagacatcatcagtgaattattttcacagattgcaaatacattccttcaatattccattacctgattgtgatcacctaattagcagatgaaaactattcagagtatcaggagcataagaggaacaaggacatgtcaatttgaaaatgatatccttagaaagcatgcctatctacatctcctatctctaagtcataaatggaaagcatttaacatacttactgaagatttttatatgtgaaaaatgggatggttcaggtagcctacagatcctgcaaccgtggtgtgtggaacataggtgtcatgcagaataatctcatgtaataagaggttcagagggtggtcgtgactagcgcaatgggaagctaagtagatacgattccaggccctaccctcactacaaacagaaggtccaagatttcatcctctttcttatttgagagtttcatatttttcatttttttgaaaaagcaattgtactgccaaactaaaaaacttacaaacaagcaacaaattgtattagtctaatcacctcattatactaaagatgaaatagtttctaaatacagatcctaaacttgctgtcatttaaatttcaacacagctatccttttacttcaccaggctgcctttcttaatttgattttacaaaggaaagctttttaaaaaaaactaaaactaaaaaagcatagtattctatgcttgagttcttagactacacataaatatttaggccgtgcttatcagaattttagaattctgaagagcctccctgaactgtcaaaacctctaaaagccacaccatgctggtgaggcgacagagtaaagggaacacttacatactgctggtaggaatgtaaattagttcactcactgtggaaagcagtgtggaaatttctcaaagatcttaataacagaattaccatttaaaccagcaatcccactactgggtatataaccaaaggaaaataaatctttctgccaaaaagacatgtacactcctatgttcattgcagtactattcacaatagcaaagacacggaatcaaccaagatgcccatcaacagtgaactggataaagaaaatgtggtacatatataccacagaatactatgcagctgtaaaaaaaagaatgaaattatgtcctttgcagcaacgtggatgcagctggaggccattatcctaagcaaactaacacaggaacaggaaaccaaatacaacaccctctcacttataagtgggagctaaacattgaatacatatagacacaaagatgggaacaagagacactgaggactgcttgaggagggagatgaggaggggcacatggattcaaagcctgccaatcatgtacgatactcactacctgggtgacaggatcattcatccaccaagcttcagcgacactcagtttacccgtgtaacaagcctggatgcacacccctggaatctaaaataaaataagataaaagtaattcattcaattaaaaaaaataggctgggcctggtggctcacagctgtaatcccagcacgttgggaggccaaggcaagtggatcatgaggtcaggacttcgagaccagcctggccaatatggtgaaactaaaaatacaaaaactagctaggcatggtggtgcacacctgtaatcccagctactagggaggctgaggcaggagaatcacttgaacctgagaggcagaggtcacagtgagcagagatcacgcctgtaatcccagctactagggaggctaaggcaggagaatcacttgaacctgggaggcggagtttgcagtgagccaagatcgcgccactgcagtccagcctgggtgacagagtggtactccatctcaaaaaataaaataaaataaaataaaatggcacagaagcatcaaatgtggatagaagaaatatctacctatgcctctgttgaaatatcaatgagtctgtctaataaatgcctgcaataggctacttaattaaaatgaatagctttagcaatcaccttggttgacaacattcagaatgaagagcaaataatagttaacacttattctacataattactcttcccttccgtacacaaaacatgtacagagcctgggcttggtaacacgaaatttccaataatctatgagagaacacttaaagactttacacttaagaagaataatttttggattaattttgaatctattttccaaaagtaaatgactttttaaaggcctagtcagttaccatgataaataaagacatacactccaagtatttggcacatgtaattacagtaaaatgaacacaccccatatcaagcacatctttgtaggtcaagatggcaataagaaagtatttttcactctggtccacagtgatcaaagggggatcaacactgaaactgtatttcagaatgccagccaaaagctttgaccatgaaagagaagcagtgctggccagttgcccacaagactgcatactacattaggttttaatacatttcaaaaacagagaatttatatagaaactgtgacaatttgaagaagtttgctgggataatcttagaagactgatctaaagacagtctaggacagctgcatgcaattctaagagtcagatctgtttgtttgtttccgagataagcgtcaaatactaatacagataagagctaaaactaaaataccaattcagtgaaaaagctaaaacccagaagacgttttatttcattacctgtctgaagttatttttaacagtgacaggtcatgttctatttcttcactggggtaagagagaatatttgaatgtcccaaatatattaaagttataggcaaaaatgctcacaaaccatttagaaaatgattcattttactgtctacctaatactgagctgaaatactctactctaagctgactgcttagagtatgtttactatctgctaatcctatagctcgcacttaaacaaggctggttggatagataatccagacaaatgcagggttccataacagagcatttttaaatgtcttaggctatcacctaagccacaaacaaaattgatttttccagacatgttccagtgtctgcttaccctttcctgctaccaactgtcatctcactcccctgataaaactcttgacatgttttgcagtatcctctactcccttcccattccaaacagctgtcttcccttcctggcagaaactccctgacatctggatactcaggatggctactgttatgatggacagattccattttatccaactacccagctccgagaatataaaaatgagcaaaaggaggagaagtgtgatagtttcaccagctacacaaatactagttcaagtaatggctatattaaagcattagcatgttgaataattttcttttaaaagtccaattttgtgacatctgtaaaatgatacagaatgttaaaatgcgatgattctgaaagaatacacaattacaagcttcctaaatttctactcaggtaatgacaacaaatccaagcccatagctcaaacataggatttctgcttcatggcctaatttgatgtttttttactagatttaagaacaaaaacatgtgtgttagatgaagacagatgagtcgaagaaaagacaaaacatgagtcactttccttgagctcatcgcccatatcccatcaatcaccagttccactttgtgctgcttcctaaatatgtatcatctcttgcatattctgctacactggtttcttaaactgttttcctatatccattctcccactacttcagtctattctccataagcagccagtgatattttattgaagtgcaaattgggtcatatcaccctaacaccccctttctaaatccaatcagtggtcccccttccttgtagaataaaacctacgctagtccacatggaccctaaagctttgcataactctggtcccagcttctctctggcttcatcaggagcctgtcttcccctcactcaacatattcaaaccacactggccttccctccattatccaaatgcatcaaatttctcccattcctaaggtctgctttagcacttttctctttgcctggctccctcctgcccatggttcagatctcaatttatatgtcacttcctcaaggaattactctgcaatcaactgcaatatgttatgtatccttttatatctctcatgggatcatggaatttttcttagcagcacttttaacaactgtatttaattaacatattaagtcagacattaaagagatttgcaaaactataaagcaatgccattctcaatttttggttttgaaaaattgttaattcttgtttaaaaatgttatcttaatgtgcaaaatgtttattattgttttaaagtattattttaaaaaaattttaatttctaatatggcaaatatcaatagatttaacaacataaacaaaacttctttcggtcgtcaatcttttttaggagtataaagggattctgagatcgaaaagtttaagaaccactgaataagaaattaaactatggcttgtgaaagaatgagatactacattttaaatcctttaggaatacttaaaattgtagttaaatatattttatgtaggaaacaaagctttcaagtaatgttgctaccttagaaagaaaatgcttaattcttatatactgctaagagaattataacaggattgtacagctaggtcataagcaatgtgtcaattataaaacagttgataagaaagttcaacttgccatgacaaacatagtttacagctttaaatgaacaattttttctttgaaagcattctaacaaatgttatctttaataacaaacacatatggcctttaaactttcaaggcaaagattcttgaaaatcataattaaaacaaacctttcgatcttacagaaaagttcttaacagaagactaacaattttgcaatgacaagatggtgaatatgtgctcaatactaattacagtcatgatgactgtgatatcaacaaacccatatatggtacttttctaagagcttagaaatcagccttagttactattattattagcccaaggatatgtaacttaccctgcatctgacagctaagtaagtgacataaatgaggtttgaatccagggtctgagctcttaactctatactgcctacatacatacatacatacatacatatatacatacatatataaattaacctttcttatcctgcttctaaacaaaggtaagggccacccagtcaatgctttgtattcttccaatattctttcctagaacttcttcaaaggctctcatgaagcactggtgaaactggaaatcactgaattttactaccattttaaccaaggctgaatcaaataatttagaagttaatattgtttatttacccagggtctatctacccacattactctcattttgttcacaaattatctaatttcctactgcatctggctttgcttattttgggttttcattgctcctgaagatttttctggcaaattctgggtttctgcccctcgtaatccttctgtggacattcaacatgaaatactaacgttcctaggccactggactcttggaaagctaatgctgtgaaatctttgctttgtaatagccctatactttgttcaatatctatttcatctgtgtaacaagtattataaataataaaagttgggagtctccagtaactgagaaaattctacccaaagtcaacatatttatgttaaacaaaaggtagtttgtattctcaaaatgaattgagttattgggtctgacatcctcctgattaaaatgtaaacttattattgagtaacgaactttgaacatagtcagaattttagagaaacatcaatttaaaatatataattaaacagacagagggctgtaagttcatctgacagaatatgtttacttttgttgaaatgttaatgatgtcagtgatacttccctgtcccccttcattaatcttgggaaaataaactatctgtttctcctcaaagctttgttctcctcactccatttcttcttgtcctcacccagaagctaatgaagtaaaagctttagggcttcttaggctaacaccccttctaagatcttgtatctaaatgtgtggttataattgtgtaggctttatcctaaagaggataaaaattgcataagattcagacgctactcaacctggatctgccttacgtgagttgtaaatatttcagtcaacttgcaattactgctcatatttttgtttctctgtacttgcagccgaggaaaatcctttggagtggctcatggacatcagtccccctgatacaaaagcttattttggcaagaaagtggcaaagaattacaagtcaggatagaggctaaacatgaattttagatctaaatttctatcaataggtaattagatgaaaaacaataataaggtagatccatatcagagacaaagtggaggcctctagtcctaaatgggcctgaataatttagaaatgtaacttaaaaatgtttggttttgggaacattttatgtaaaaattcaggtgtcaaaaatcagacctgataaaactgggtataaatgctctggcctgaatatatttcctatctacctcccttcactcattttcaaggcctgcctgtccccacctaagttaaatttaggcaagcccaaagggttattattaaagttatattcctcaaattatggaaataatgcccaagagatattaattattaaaaaaaataaatcaactgacataatagcattcataatagcattcatactatgtttcaacttttattttaaatgatttatataatttctaagatgaattcaaattatttattatggtatacagtattttttaatattcagcagaaaaaattaagcacaaattttattttaaataacatttcctaccacctttaaatataacttcagtagcagacactgtgttgatggtttggctaaaggaggacaagaaaataggacctgctcaaattcatgcatggtggcaacaaaaattcagggatcatggcaccaaaaatcttgttttccaggatggatcacagactgaggaagcacagattatacatttagagccgacattcatttcttcacagcagtattagaaaagaaaagccacagtcgatgccatttccatctagctgcatccaagcctttctgcatacagagaaatatctaattacccaatacactagagcaacgtgtggggattgttttaatatatattcacagcatgtgtcattatggctcctggcggctattaaaagggtgggctagcaacatgaattaacaataacacatttggtatatgatggctttataatgcctaaagcatttagctagtctcattattcttaatgtgccctacagctcacaagaatcatgtaactgtgtattcagctggtcccaaatgctaaatggaaagcaaaatatctcctaaaagtagttctgagtaactgctatgtctagttttcttcctttttcatcaactaacatggcatatgttataatcaacagatagttctgttttcagaacgtttttttccttttgttttagacaagcagaacaactcataatagtagacaacttcaccaggagaacagcagttcagtacaacaggaaggccagtgtctccccagtaccacctgcttaagctactacaagggttcccttaacagagatgcctgcctctatccatcctcctacagcccattctccagtcagcaactatagacatctgtgaaaatatcagatcgtatcacattactcttcagctaaaagtactccagtggcttcaatatgtactaagaataaaatgcaaacttctggtcatttcccacaaggctccttcatgcggtggctgcctacttatctctgcaacttctgtttgtaccattctcattactaaacctgaaacacggcgcacacctgtaatcccagctcatagtcattccagtcattccacacttttagcatttcatggaccctcagcctggaatacccttcccatagatcttttaatgactggctccttctccttcttcagaattctgcctaaaattgatctcctcagagactatcctatctgtagcaaccattttttcccaattctctatcgctgtcctatttaattttttttttaattaggcctagtagagtgaaattagttgttttttcagcatgatttcttatcaactatccctatataaatgtgggtatgcacacacacagaaattcgcattccattaggagcacggccttatctatctttcctattatcacctccccagtacgtggaacagatactggtaggcagtaagtgctcaaaaattattgggcatggacaaacgaacctgctagttaagcatttccatccaggagacaatcaagggagctcaacttgggaatgtattcaaatcaactctttgaaattccatctaacaacacaggaaatcattctctcttatttatttattcatgcattcattcattcattcattcattcattctgagccaggattcaagtcctagtccctcttactagggcagaaaaagtataagctctcgagaagaaattatattcttctaccctcccctccctgttcttcaacttcagtcattcacctgctctctggtatggtttctgccacttctgtgtattacaggtaccaactttcactcaatgctcttttcacctttttacaatagcctcacactaagcattaggttggtgcaaaattaattgtggttcttgccattaaaagtaatggcaaaggccaggcagggtggctcacgcctgtaatcccagcactttcggaggttgaggcgggtggatcacgaggtcaggagttcgagaccagcctggccaacatgatgaaaccccgtctctactaaaaatacaaaaattagctgggttaaaatattattttaaataacatttcctaccacctttaaatataacttcagtagcagacactatgctgatggtttgactaaaggaggacaagaaaataggacctgctatggtgtggtggcacacgcctgtaatcccagctactcaggaggctgaggcaggagaactgcttgaactcgggaggcagaggttgcagtgagacaagatcgtaccactgcactccagcctgggtgaaagagcgagactccatctcaaaaacaaaaagtaatggcaaaaacctcaattacttttgcaccagcctaacagtaataactttaggataaagagtttgctaggactagtttttcctgaattacattacaattactccttgactattaaaacacatacccatacgtatgcatttacacgtatttttccatctacaatagtctcctccaacatttgggaaaactggatcagagatgaaggaagactttcttccagggatagaggctcccctcaggcagaatgacattgcagagtccctggagggctcctaacttttactaggcactcagtggtgtcatgctctgtgctttatttattacaatacccctttgaggaggtattcatataatgtattttgcaggggaggacccaggtacagggagcttaagtcaataggacaaggtcacatagctagcaaaaggcagaagtcgtgttcaaattcaggtccatctgggcaccagatccattcttggaaccgctgaatcatacatcatctttgcaacacgtaagcgatccatgctttgttttacaatatacttctttcctaaggtggtaatccgagagcttttatttacttattttatttactaatctaaaaactgcacacacccaccttcccttcaatattcccaagtaacaagcttgttgagaaaccctactgaaaacaagctgagccttcttttcattactcagtgatttttaagtgttgctagtttttataccattagacttttattttcataattataggctgccatgggcttcttccaaagccccctgccaagtcttcattcctacatacaggtgctaattgctttcttagcaccactggttattctctgaacctttggatttcaccacctacaataggaccctgggtttttctccccttcagtaacccttagcacaatggtcacagtcactccatggctgacttggttctggcccacaagtctcatctcctcattctcaaagcggagtcaagttaattctgtgcccgtgctgcgtcctgttctctctcaattcttggtcgtggtgcttgatcctcaggttaaagcaactgaactctagtagctttgaaacaaacttgtatgtttcctcctcccctccatatagtgtgaactatatataacttaaacattaacaataatagcaaacttttattgagttcctatcagtctccacaccaaagcctctcaacaaatttatttcgtaaaaaacaaacaaaaacgagcaaacctccctgtggaggagtaccgattttatcccccttccgctatcttccagaagacagcactgaggttcacagaggagaatccattcttcctggttccagagtccgtactctaaagacccactacccactatccctcttgtgaaaactgtcccaacctgatcctgatgcaaaatgatggcaaataaaaggcagtagatagatttttacagtaaaagagaaacagaagataattaacttgagttgtgaaaagaattcaagaagggagatgcttcctttcaagacatataatctgctcctgtatgtctttcacttgttcttcaaggaatcttcgaaatgttcccctcacaaagtttctccttatgctcatatccctcctaagccatccatgagggtacccatgaaggcccagttcaccggagctgcctgacgtactgattatccctctctaaagcatcctcttttggacaacaaattatatgtccacccaaaccataatctccatgagggcagggatgtgccttattctcctttttatctctcaccaggatttttattttattttattttattttattttattttattttatttgacagggtcttgctctgtcacccaagctggagtgcagtgtgtggtcttggctgaaaactccggctcccaggttcaagcaattctcttgcctcagcctcttgaatagctgggattacaggcatgcaccaccatgcctggctaatttttgtatttttagtagagacggggtttcaccattttggccagactggtctcgaactcctgacctcaagggatctgtttgcctaggcctcccaaagtgctgggattacaggaatgagccaccacgcccagccaggattttccgattttaaatcagtactggagtaatgcttgctaagaagtcttccccccaagctaggtagaatttcgtcattactaagtccttcatagcattttgtgttcgtctctcttacagaaattatcacatgccaactttaatagttcacagaccatatatgccatgcctctgtggcaggcctgagtctccactcatctttgtatccctagatacctgattagatactttatccagtgacgtggttaactacatgctgaccaactgaactcaatattcttttgatatcctcattttgcaggcaaactcttactgtcctgccaatggaacagaaaatttgagagttgtgagatcaatgatacaccaagtgctggaggaaagaagacagagtatctgtacctggagaacaggagaaagtttagaaacagggctaaaggactaggaggtattatctaggtataaatgtctgggtattagggatgggagagagttgagagaacctcccaggaagagggaaaagacagggcagatacaagacagtctgcacgcagaatggtgtgagtaggttgtgtggctcctgatggctgaagtttaaaatcagaagggagatttgagtagacgcttacttctcaacaggctgttctgttaaataccagagcaacagtaaataagcatttaatgcaaaacttgccctcttaaaacagcgactttgggatcatcaaaactgcattgtaactgaagataacagacggacaggggagcaaatagatgacctcaggacagcttatttggggctgagacagaatacagcattctctctccacttttgcacttccctcagcagatctacagaactgcagaggaccaagtcctgaccaggaatgtgaccataccaaagggaaaacagtcatttcaacatttctgtgggtgcctgtgctgaagggacccagtgaggctgggcgctctgtttataaaacataatacgaatcatgggactaagctatttagcagagcagcaatgggacagccccacagggagagaaagggtgaggagatgttaacaaatggtctcaggggaatccatttggggaagaaggtcccagtggtgaagaaggaccagaggacttgtacaacagagctgtcttctgttcaattaaaaagcactgttggctgggcgcagtggctcacacctataatcccagcactttgggaggctgaggcaggcagcccacctgaggtagagagttcaagaccagcctgaccagcagggagaaaccctgtctctactaaaaatacaaaattagccaggcatagtggcgcatgcctgtaatcccagctattcgggaggctgaggcaggagaaccgcttgaacccgggaggcggaggttgcggtgagctgagatcgcaccattgcactccagcctgggcaacaagagtgaaactccgtctcaaaaaaaaaaaaaaaaaaaaaacactgcctgcctgcactatactaacatgttctgtaatccctctcctttaccctaagcctttactgttgctgcacacaatgattgcaggattaaagcactttggaaaaatgaaaaactgggaacgtgtccaggctgaaaggaagcatggagggaaaacaacagttggttgtctctcgagactagatatagaggaaggagggagaatcaggaaggggacttatggggtcacatggatgtgtctagggataagaatgagaagcaaataatcatacagccctatggccttgagaagtgctggttttggagcacgcatctatctgtggacactgatatcccatcttgtctctattgtcacgccacttctctatgtgaatgtgagccattatcttctcctctggctagaacatctatctacctaacgtagtaaatgaatcaaatttaatttaaaggaaaatcaaaagtcatttccatgcactgacataagaaagcacttaatctcaataaactagcagttaggatgatgggaaaatctacaagggctcagaggtatgcagcaaatcaaaattctccccatttgtataatggaacaaagccaaagtaagctttcttcctggcctaaaccacataacctaacacctgttagaaaaatgggctggggcaatgagctgtgaccaccggtgattcaaaggaatcactaaactctccccaccagtttcacagaactgcattggaaaatgacttttaccaagattcttaataaaatcaacatctttgcctgtttcatacattattagattttatggcatgcatttcagaactctaataccttaactctgtctacaagtgaggtgggattcccgaaggaccaccatcccacctctgaaaatattttcattacccaagtcagaggaagtgaagaaatgaaagcttcctgaatctggccagctaaatagcttgattcaagtgtgttatgttttcattatttacatttcccttggaatttgagggctgtcttcaaattttgtgacacctgtatttttttcacctacttctgttcagtgatttcctggaagaaggaagaacacggctgaaatgaacaatcaacgaacactgatttaatctataccacatttacctccaattaggtaaatcatggatcactgtttaaaaatatttttacaaggccattggataaaaacaagtattaggtatcagtcagtgctctgatttgggaagagccatttacggtctctaagcttatgtcatctcatctgtagaatgaaagtgactgattccccacatggcttccaactccaagaacttctggaatgctgtactgacactcatacagagctgatttggggttaattattgtttttcatttctgcttccttttcttgatggattttatcaaaaagtgaaccattttaaaaagcaattactggacattttttaagaactgcaggggagctggagatagttgcaagagggagacctattaggtttcctttttcttttactaccacttaactttttcctccaagcctcttgcctcacaataaacataaaaacagatgaccctatcactccagactgtccttcataatggcaacaacaacaataatacaagcttttaatttttgaactcccactgtacggcagacctttatctcattattggaaggagtataaagtaaggcatgaaaccactggctctgacatactgtatgatcccatttatgtaaaatgtccagaatagacaaatccacagacacagagcaaagaaaattagtggttgccagggacattaagcataggagaatgagggtgacttcttaaccagcacagggctttcttttgggaagacgaaaatgttctggaactattaatagacaggagtagttatgattgtatgaccttgggaatacactaaaaaagccactgaattgcatactgttaaaaggtgaatttttttggtatgtgaattatatctactaaaaagataaaatttaaaaaaataaaacacacatccatggctctggatggagattgtccaggttcaaatcccagccctaccgcttctcagcttttctaagcctaagtttctacatgtataaaatgggagaaatgacaaatacctcacaaggaaattagaggactaaataatgctacgacttttaggtacaaaggccaatttatagcgtgttttaaaaatattcttacgagacccttgaataaaacaatattagataccaaccagttctttgatttgagaagagccactcctggtctctaagcttaagtcattttgtctgcagaatgaaggggactggttccctacatgagcatcccataaattttcctattcttatgtaatccccacaatagttctataaaatacgtagaacattactgattttagagatgaagaaacatcagtaaagggcaaggaagttgctgagccactaagtggcagaggtgagattcgagaaatgtcagaatggaacctcacactcttgagtgacacaccactgcctcctgacccacatattaataacccagcatatgtacgaactgcttactgacttcttactatgttgcagaaactcagggacagtgccctcaagaaagtcattacctggccacttgcagtggctcatgcctgtaatcgcagtactttgggaggctaaggtgggcagattacttgaggcaaggagtttgagaccagcctgggcaacatggtgaaaccctgcctctaccaaaagtacaaaaattagccaggtgtggtggtgagcatctgcaatcccagctacttgggaggctgaggcaggagaatcacttgaaccagggaggcggaggttgcagtgagctgagctcctgccactgtactccagcctgagcaacaaagtgagtgagacatcatcaaaaagaaaaaaaaaaaaagaaaaagaaaagaaaagaaagaaagaaaagaaagcaagccattacccaagatgggagaagaacaacagtgcccagggattaaggaaattaaggaacaggtgtacacagtaaaagtataaaagtagatatttttaccatataattcagaaccttctgtctttagaaggggactttcctatcagggaaaatccagagtaactgggctgagaaaaaacattatgtagatgaacttttgagagtttctaagaaaataattaagagactgagtgctgtggctcacacttacgtataatcccagcactttggtaggccaaggtgagaggatcatggccaggcattgaagactggcctgggaaataaagcaagtccatatctctaaaaggacttttttaaagttagccaggcatggtgatgcacgcctataatcccagcttctcaagaggctgtggcaggaggacagcttgagcccaagactttgaggctgcagtgagctatgattgtgccactgcactccagcctggccaacagcacaagaccctatctctaaaaaagataacaagaattaagtgtaatcggccactcacctctatgccaaataccatattttacttaagatttcaaatctcgttgttcaataccgtggccactagccacatgtagctaaatttaaatatattaaaattgaataacgttaaaattttggttcctcagttcacaccaccacatttctagttcacaagagccacacgcggccactggctgccataatgaacagaccagataaaagagcatgtctttcaatgcagaaagttttaagggacagcactaatctaaatataaaatcacatcattcacagtcaaataataagagaaaatgcaacattttatttcatatcctaaaaagagatttggtatccaagtgaatacctggaactactataaatgctcacctaagttgtaagatgacattataatttcttatctacactttaaaaataacattatctgatcatattgctctggtgtaaagattttccagaaaaaaaatcactttccgagactccttatttttaaaaatcgcagatagcataggcaaacagataatgaacatgtaagctcactgcatctcagttttgaaatggattcaattcactggtcttgaaaagaaaagttcaggacattggggaaaactcagttgctctggtctctgagttaatagccttatgagtagaatgcctttttgtccaaagaattctcaaaatagtattatttttgtttatttgtgtttttgagattgaatctcactctgtctgctcaggatggattgcagtggcatgatcttggctgactatgacctccccatcctgggttcaagcaattctcctgcctgagcctcctaagtagctgggattacagccataaaccaccacgtctggctaatttttgtatttttagtagatacgaagtttcgccatgttggccaggctggtcttgaacttttggcctcaagtgatctgccctccttgacctcccaaagtgattacaggcgtgagccaccactcctggccttaaaatatttcaataaccattctaatgtgagcagacatggtagtggcaacaactcggaaataaaataatcttatgaggtttggtcaaatacgccaataaagctcctctgccatcttgcctctgagccatgctcatatttgtgaaatgggaggaaaaatttttctccttctttgcagatatattattctccttctttgcagatatatatgtgtgtatatatgtgtgtatatgtacacatacacatacacagaagcgcacacatatccaatagaagttggtatctatcatccagtacttcagtttttaagtataactgacacacatatacatataaattcaattaattattttacagtctgaacactttcatgtaaccaacgcccagatccagaaatacagtattaccaacacctcagagtctacctgccgcagccttccaggtaccctcaagggtaaccaacaacctgacttctagcaccactggtgaactttgacagtttccacatcttacatatgtggcactcttttgtgtctagcttttatcactgaacaagacaccatctagttttgacagatcttcgccacaaggcagccatttaatgctttcctgccttatagaataactaatccttattgagcacatattatgtgtcaagtgctttacgtgccttgactcctttaattcccccaaacaagcttatcagtaaagtattattattatccctattaaatagatgagcacattgatgtgtaaaattggctaggctatagttcccacttattcagttacatactaatctaggtattcctgtgaaaggattttacagatgtaattcaagtctctaatcatttgactttaagttagggagattatcctgggtggacctgatttaatcaactgaaggccttaaccatagggctgaggcttccaggagacagggagcataaaataaggagggaagggggcatttttctggagcagataaccatgagcaacaatcatccattaacttatacatgccaataacagatgtcacaccaactcaaagacaaggctcttcagttcattcttgaataggaacttgtagtagaaatggtatgtgccacattatttttcaagccagccctgatgtcatttgttcatgcacactgtccctgtaagaacactctcatttttcaagtcctgcatcatatttcaagttgggaaaaataaggtcactctacacatggtagggtgatggaggtgtttttggacagccagacttttcagatttactcatctttaaaagcaatctcagtgaaaggcttctcttgagtggatctaaatagatctcaagtaaacctaggagattttttaagaacaggagcaatttcttccattatcttatcccccttaacatatatcattgagcaggactgaagggaagtcttggtaagtacagatgcatgttatcatttgtctcctctttttctattgaaggctgattttaaggattttccattttcagaggtgaaattaaatggaatccttagttttcccttccaaccctcaagacttcctcctcaagtcttctccatctcaattattagcgtcccacattcgctgggtttcctgggccagactcagtagtgatcagcaagtcagttctgcctccaggcatatcccaaagctaaaatcttatctccatctccatctccagtataagcacccttgttctgaccattctgtttgctaaacacagacaaggagacctgagtgatctcctggcttccactcctgcccctctaaagccatgtcatatacaacagagagctcattttaaagctgcaaatgtagtaatatcactctcctgcgtacaactccaaatgagactggatatgtgatgacactaaggaaatactgtcaacttttagaagtgataatgatactatggctatagtttttaaaagagttctgatgttctagagatctatggtgacaaatgacagcatgcctccttcaaataacactgtgcagtggtggtgactgggaaggggtgcagctggagagaagggataggtaaaataagatagaccatgagctgataattattgaaactcggcaatgggtacattgggagtcactatacttttctattttcatatcttataacatttttataataaaaaactattaaatccccaatgactcctgactgcacttagagagtaaaatcttaagaacttgtatggctcaaaaggtatttaatgatctgactgatgcctggcaatccatgattttatccagtacccagctttgtccattaactgccaaacagctgtaacagccatcccgtgccttccagccctttgccaccataggaccttcagacaggctcttttcagccttagagggctcctccccaagatgtgccagatgtgcccagtgttgggctccttctccttcaggtgtccactccaacaaactcctcagagagggcctcctccaccatgctacctaaagcaccttccctccccgctctcctcctgcccacccctctgcacccttaccactctacctattttctttcattatttcttcataatccttatcactttttgaaatcatcttttctcttaagtccttttgaaaaataagctgatatagtttggctgtgtccccactcaaaactcatcttgaattgtagctcccataattcccatgtgtcatgggagggacccggtggcaggtaattgaatcatgggggcaggtctttcccatgctgttcttgtgatagtgagtaagtcccacaggatctgatggttttatgaaggggagtccccctgtacatgccccctgtacttacatcttgcctgccgccatgtaagatgtgcctttgctcctttatcttctgccatgagtgtgaggcctccccaaccacgtggaactgtgaatccattaaacctccttcctttacaaattacgtctcaggtacatctttattagcagcatgagaacagattaacagacaagtcacttattatcaatatactccccatactagaatacatgctctgagatcattgggaccttgtctgtccagttcacttgcatgcttccagtgcctatgatagtgcctagcataaaagtaggattccaatgatgacacattacacaaatcctttaaatcagaccagacaattaaagctgtgtacatagcacagggacaacaaaaaataataataattaatgccttggaaagtgaaattatccttacatgtatatatctgtagtattaatgaatagttaacactaacggatttcatttgaattaaacatatgtcaacataatgaataactacttacacatattaacacaattaatgaataattaatacctgtgagttttctctgaattgcattcaatatatccatacacaatacatgcacatacacatatagtctttatttcattattctgataccgaatatataacaccattgttggcttatatgtaaggaatatgacagtttatgattgctatatctcgagcaggagattttgctaaatgtattgttgccagagcttagattttaaaattcatttctaagtcttagctggtgttaaaccatgtcagcataataagcaagttttgatttcctttcagatgttcctggctgctgaaagaattgattttgaagattttcccattgacctatagggctgtgaagaagagatagctcttcttaatctcaaagatccaaactgagtttacattccccagcctttgtttggatgtcaccttcagagcttgcttcattatgtgtctcaggagaaacacagaagtattagtgataggacactgactggtagactttaatccttctttgagatgttgtttaataatgatggtttagtatcacattcgaggataactgtagttagttaatatttttacttttaatatacctactttcccaagtacaaatttatcctggggctacgtaggtgacccaagtgcatcaggagcagtttcgaacaaggtgtaacttctcaacgttacatggaataagagagagattcaaaaatcacatccaaactcaaacatcatttcaaaggtcctttcccatcttcctctccccaaaaacaactaaaacatggcatattgcatctttcaaccatggtcaaaatccttctctgttaagtagattctatgtatttttaaatatctatgcttttgtttgttgttttttttttttttgagacagagtctcactctctcacccaggctcgagtgcaatggcgtggtctcggctcactgcaacctccgcctcctgggttcaaatgattcttctgcctcaacctcctgagtagctgggattacaggcacccataaccaagcccagctaatttctgtattttttagtagaggcagggtttcaccgtgatggccaggctggtctcgaactcctgacctcgtgatctgctggcctcagcccccaaagtgctaggattacaggcgtgagccaccgtgcccggccatatctatgcttttaagtattgttttccttctcagacgtttgagaaactcaagaaggaaacattgtatacagactcagacttaacctcaatgtgaacatacacagcaacatcattgacagtctacagttacatgatctcaatggcaagtgtggtccactgtgatgtcaattttataaagggaagcttgaaaaacatcacaacagaaagaaagctgtcatgcttgctttgattaaagaggatgtagtatgtttcataaacaggttagttctcacaggaaggttcaataaatggaagcaaaaagcaaaaactcacaatggagatcctcccagtgtttgaattttaaaaaataaaggtcagtttatcactagagcgttcaattggctccagggttcatagggtattgttagactagagctccttttgctaaaaaacccagaggacttcttgtattttgcttctagctatctgggtctgcttttaattcctcagacatactcttctgctgcacgtagttctcacacctcaagacccatgagtttgctgtctgcccaaatgcatcttctctatctttcaacatccaagttgaatgcaacttctttcagaaagccttccatttccatgactagtacctcattttcaaatcaattccattgttctaagtggtttgaccttgctgggttcatgctttaattcctctgattgtaacaataaaaagtaatttactttctatgtgtttgccacacatactagatgaggcccttgaggacaaagatagcatctcatttgggtctgtgtccccagagacttcctcctcagaaaatgttgaatgaaagaatcaaataaataaaggaatgatgaatgaagcaagccaacagcacccttcaactctcagtttgcttcaaatccccactactacccttccattctatccccagtagaatttttctattctcttttcagtcttaaacactgttaaaatttcaaggtaagcatcactgaaaactgaagtgctgtggcacaatgggtttttctaatgaattatttatctgtaagcagtagttcatattcacatattttttagagaccagttgcctttctttgtgaatggatatgttcatgtatccatctattagatgctattgtcttgttttgcaaggcaattgagtgttttatttccttttttttacttatacagtaatatttgaaaatattctcactgtaaaaaattcaaaccatatagaaaaatataaaaactcccttatcactccttttaatccactttcctccccaaaagcaatctttattatcagtttcagatctttttctatgcatttagctacatatgcacatatacaagctttgtgtttgggtaggagtctcatgcatatgtagaatcataaggttttataaacttctcccttcaattaaccatgtatctcagagatagatagtcccagataaggaacatacctcatccactttaagtactagcattccacactttggatataccaacatttattcatcattcccatggtgactaaaatatattgatactccattttcactcttacaaatcctagatcatatttctttatgaaaaagcaccaagagttttcaaaaatagaattactaggttgaagggtatgcacagactggcttcccagagtatggaactgtttatttctccatatccttaaaaattgtgaatattaacaggttttgtttttccatttttttttttttttttttggttaatctgatgatagcacctatttcctacatgacctaaaccagttgagaaatgcccatatttacacctaccatggtgtgttgcgactggaacaggttcaagtgaaatataccaagtgactgctaacagcctcctacctaactcctttcagcttacatcccagtaacataaacagggatccacactgaattcacgtttaattatcagaagacagggaccttgatgagtgtcttcacataaactatcttgtttaatcctcttagaatcctgtgaaatagaaacttttattcctgttttatgtttgaccacagtgaggcaggccacccaagatcacaagattgtacttgattccacaaagcgctccactgaccccaaattaagaaactgccccatacttgcattcggtttgcagttttccactgttattgcttcttggtgcctaatgtaactacccacataaaaactgaagatgtctctacctattattttaggaaaagctctggctttgaaaatactgaatttttctgggagaagcagctggttagaggcaggtagaaattaagaatttgtgggccgggcatggtggcttatgcctataatcccagtactttgggaggccgaggcgggtggatcacctgaggtcaggagtatgagagtagcctggccaacatggtgaaactccatctctactaaaaataataataataaaaaaaatcagccaggaatggtggtacatgcctgtaacctcagatacttgggaggctgaggcaggaaaatcgcttgagccttggaggcggaggtggcagtgagccgagattgtaccactgcactccagcctggcaccaagcgagactccgtctcaaaaaaaaaaaaaaaaaagaatttgtgtatcagcaacaaatacaaactttattggacactccctccctttcttaatgagttcctcaggttttttccagaactaaaccaagtcatgaaatgtcagataataaagcccttaagtattaatgtacagtataggtgaatggctactgtacttactctatcttagcgatatttaataatattaaatgttttaaaactatcctatctaagaatgaaataaaagaaagccatggttttattatcttaagaaatttataccactcaactagctgtactaagcaaaaaaaaaaaaaaaaagtcacagcaccatggaaaatgaacacaaaagatgctttctaaaatgctgaaaagcataaaataaaagattaaaacatttcactatgcatatgttatgctggaaccttgaagctatcgcctacatgagaatggtactttaaagattactgaatatgttttctgaaagtatagaatgatcgattcatttttcaaacccttagtgtagttgcactcttcctttccctgacagatgacaaggctcagggaaagcaaagatcagagctgaggaacaacaaaaaaagttggcacctgattcacttccccttcatgccaaccctgtttttctcccttatcatacaacaaagcaaaaagaaaagtattgaatatgaaaaccaaaaagattccccatgactgagctttggcaagtacaaatgcattaggaatggagctgattcctgtgaccttttcaattatgataatcctgcaaagaaaattaaaatcattttctaaaacatggtccaaggagttccatagataattgaagaaaatatttaggaacatccctggcatttttctaagaatgtatatacttagcccaggtctgttgcacactgcagccatttcagccatgagtatttgtgagcaaaaggtcaaattaacttgagagatatttttgcaaagcctacttccagagtttttgcccttcattttttcttttgtatatatttacattttgaaatgggaagactgaaaaagagggaagctatatacttgtttctgctttggtctgaaaatttggtagttgaatgtacttctttttgaaagcatctttttggctgggaggagaggctcatgtctgtagtcccactaacttgatttggaaggctaaggtgggaggattgggtgagcccaggaatttgagagcaccctgggcaacatagggggaccccagtcttttaaaaaataaaaaacttggctgggcatggtggcacatacctgtagtcccagctactcagggggctaaggcaggagtgtggcttatgcccaggagctcaaggctgcagtgaaccatggtcatagcactgcattacagcctaggcaacagaccacaactcaaaaagcaaacaaaaaacagaatctttttgttttgggcatgaaaaataagtgaagaggctttagagttcctaggatctccactggatttctaacaagcaaaagtttccctaaagcatggaaaaacacacagatttaactatatttaaagtaaaatgatccacaaagctcatccttgcccaattctcatttaatgaataagaagactaaatacttcagaaaatcaaagactaccttactaatagacttagataaatggatttcagtttagacccaagaagggaagtcaaatctatagatacagcatctaagaagttgagaccttggttctctattctactctccctattattggccttatgaccacaagttggtcagttcgcctccctaagcctcagtttctcacagggaaaataggaatattagcaaatgacagagcaaattcacaggactgctatcataggattaaataaaacaacacaaaaaactgtaaaaattatataatacaatgtaaacaagcaaatggcataataattatttgtccttgttcaccaagttaggttttcaatatcaatatgcatctccctaccacagcaggacagagacagctacagttactggaaactataaaatgggttccagtcaacaaaagccattggactgctttctgattcttctaatagaaaatcagagcattagtaggagagaatggggaaaaaaaggctttgcttcaaatttatatttctgttcctgatacctattaagagccagttatgtagctattaagctacagcttgcaatttaaaataaataaactgataacaaaacccttaaatttccatcatcagagcagatcaaactacaacatatgctaccgaggatgcaaagcagctaatgaagacttcaatatcaggattatgacccttaatttcaataggaatgtgttctgttgtttgagctcacacataacgagaaaaaacatcacggaagcacaaataaactgtctcattaaaaagcactttgccttggtccaaatataatttcgtttttatacaattcaaatgctatagaacaaagaaagagaaggaagagggatgataaatgcagaggacttgggagggaagcctgttctgcaataattgagatggaaaggagggttcaacctgcactcctttgtttgtggagacaaagtcctcaacagctggcagatagcaggaagtagaatgctgatggctttgcagttagcttcaaaacctattagcaaccctcagatccaagagctgtacctgctttgaaataaaccaggaaatagggaataaatcatttcttctggagggaaaaaaattgtttaaagtgattaaaacatgccacaggtttctcacacaggaggaattaaggaaactatttcagaacttaatgggacctgttaaaaaaaacagatttgtaagaatttaaaagtaaatatttctttatgcaaacttatcatagtgagtatcttttaaatactaaagctagggatgcacttgcaacagtttttaggaaacgggggtggaatggggaatcacttcactgaagaagtttaaagacatatttattcctctgtggattccatttcttaaaagactgccctgaaacttcttcctaaattctgtcataattccctaagacagtaccaagggaattatcattctttattagatgccaaagaaacataacaaggatcacaaatgaaacaccagaaaatttatcaaataagattggatgtacagacccattctaaagagcattccttctcccccatgttttaagtcaaatttatattaaaaatcttgaattttctaggaattttaagtactgtcccctaattttccattaataagcacgctcatgagtatgaaaaaaatatttatttacatgcatttattataatgggccaagaaaatatttctatgtaaaggtactatcttcctattaatctgtagtttttttgctttttttgtaagggttgaaagaaagagaaaagcaacagattgcaggtggggatagaggcaaagagagataaacggtagagaaaccagttctgaaatgtcagggaattgcctggagagagttaaatatactgtttctgcggacccattcccagataggtaccgcctattcctacatatgaagagagaagagatgagttatattcatgactagtaggagttagtttatcttgcttctgttttttaattttactctaagacaaagggactgctataaaagaggaagaagtggagcttactctaattactctttattattctcttgatcatcatcacctctagtaattttgtaattcattacagtaatttatctaagtttccaaggattttaatatgttctttagctcctaggtagagaaaaattgtggtaacaatcaaatgactaatcacaattattggttaggaaaatgaaaatcacaatgcaatcattataaaaacagggtgtgtatgtaattacactaaaacttcattgatttaggccattattaatatttggtaacaactaaaaatatgtattatctttcacgttttatttcttcccagcttctccagtatgaataagaatgtatacaagaggatgttaatgaaaacaatcttacagcatcacatggtattaaatagatttttatctgtagctgtatatttcaaataaaattgatattttgcttattttcagaggaaatttgtttaaaatcctataatatttcatgttggcttcaaactctatatatttcaccccaaaccgtttctcagtacatacttacatccttttttcattaacatgttcacaaaacccatttgggtccttatttttctgcaaagtacatattatttccaggcatgttctatattcgtgtgtatgtatgtttgcttctccccaatccacataatcttcatgagataaattatattgccttcttcactactatctgtagcttcaacacttagaacaatgccttgcagagagcaggtacttgaggcaaagttgactgcttagataactccaatacctcttcacctcttcccatcagtaactatattatttatttttagctgagcacagggatccccgaaataaagaccacatcttctaatttcaagttgactgcttttgccccttcttctctctttcattctttctattggttagaagatggtcataatggctgaaaactctattagacagcactgctttcagtccttcttcctcatacaaacacatatgttcatatatatatatttatataaacacatacacatatgtgaacatctccccaagcttctccatctccttgctttttgtcagcatattaacacaccaggagaagtagatgttagtctaatctccaagccactaggtctttacttgaattgataggcacattttcaagtgaaccacaatggccttgaatcagcgttctcattttatcagtgtgatgtcaatattcagtccaaaactaaaaaaaaaaaaaaaattagatttgggccactcatatttaacactgaatatgaagcaaatggattgttcgcctttgggagggtggtctatgattaaacagaaatacagggttacctctaagcagcttcattttgctcacttggataactatctggttaagtggtattcacagatgggaaaagagttaacactcaatgaatgctatgttgtcattaattcaacaactgaacaaaagggacaagatccccacactcataaagctaacattctagtggggcaaacaaagaaacaaataacatcaacaaaccacactcaattggtttcttcagagaatgtaacactactgacaaattagtattgtcaagaactactggccatggagaggcgatggggagagcttgacctgtgcctgcatacactctagggactgagcttaaaatcttgactttaagctcaacaaatggctacatcttttgaccaaattccatcatgctttaagctccacggtttaagcccctgaagtcctttagaagatagaggcaacggctcttatttaatctatagacaccagttcaacagcagaaactattatcttgaacagggtaacacctacaaccgtgaggaatgataaccaccttcttaaacgttgaagatataatctgtacgacagtggcaggtgatgctttacattgttttataatattatcccaccacccagttctaaaataaactttaacttttttgttttttaaagccaggaaaggagataaagaatcaatgaaaggtcaacacagaacagacagaaagtaccagatgtgctctctaaattatgttctgtaagagtcagcagggagaacagaaataatttatttcaggaatcctgacgttaccatcatgtacactcggttaaatggtttgtatagctgaaaaactcagacaggtcttacaccattctcctttacttctaccacttagagaaattcaatcaaaggctgaggttaaagataccagttcccatcaagccagtatatatattaaaagtggcttttctgatcacagcaattctcaggcagtttaggtgtagtgataaacctaaaaatataatctgacaaattttcaactgttcattctaatgttcaatacttcagttattatacttcatattttccctataaatgtcaaggaaagggaattgtctataggatacacacatacctatatacacataaatgtatggggggagggatggaatttccattaaataaagagagaaggataaaaggtcacacaattgtcactttctaaaaataatttcccaggatctataatttctcagagctgtagtaaattagtcacttaaacttattaaaaccaaaaatttaaggaatacctctgaatataactcagaataatgtaacaagataatcatgagcctttacaagatttcatgttgattaacagtaaatagcttttttactgactgatttctgcttccaaatgacaccgcctaaacaaactttgttgccacagaagccacaaaattgtaaggcaatgaatttctgaattggggcctcaatgagaagtttgatttttaggatcttgagtgttctgaattgtgctcaacagtatttaccacacgtgttgcttgtttatgagacagagactacaaacatcttgaatgggacttttatttaaaattctagatgtttcacatttatattttaaagcaaaagatcttacatttgatcagcgtggcttttaattttagttatgattatttaaaaatatgctaagatattcctgacatctcaaaagaacaaattattactgtctgtcaatgcatttttagaaaaactgtatcataaaaaatgtatagcttcatataattaaaacattcaggtagtgtgcattgactaaagtaatatggactattaagtaattcaaaattgtgtttagcggcagcagctgtttaattaaaaggtaaaaactgcaactaatccactatggttgacagaaatacagcctatatcagcagtcagatcccctaggatagagaatatggatatgaattcaagaagtcatgagcttcatttaatgaatataatgaaaataaccacaataaatcagtactgaaacatactttatatctaaaattatctgtatgttggcccacttttaatttccttgtagctaataattttgcatttcgatgtagcaaaaaatcctttaacatacatattgtcaaccatcaatgcacacagcttttatcagagggcccatagcataagctcaacttataaggaggctagaaatgttcttagaatcagatgatcccttcaaagttctaaacttcagggttcaatattcaaagtactcactcataattaccttctatcatggagaaatacaaaatggccaataagctcataaagttaatcaaccttaccaacaagtgactaactgaacattacaatttcattacaaaattattttcacctacgatattaggggaaaaacctttttgttaattgaaaaaagaaactagtgatgttgaggatgatatagtcatttgtaaagataatcaagcaatatatatgatattcccagcccttgatccagaacttccaattctagtggaattacacaagtgggcaaaactttatgtacaaaaatatttattgcagaaatgtttttaatatcaggaaaatgtttaaaaatataaatcaatattggcaactgatccagaaactatggtaagcatacagtgaacaattatctgggcattaacaagaactggaaaaaaactatctgtatgtacattttatgtgacaaaaccaaaacaagccattggacaataaatgcagaataaattcatttttatacaatgaataattgtaaaatcaaaagatataaaaaaaattttcttaaatttgcctatgcttatgttaaagtaaactgtttaattcccttcataattttctgcttaaaaaatgcttatttttatattgtttaccctggctgtgctttaggaaatagatcagaagtatggaatgaggcagaccagtaaagaggcattgcagtaatacaggcaaatgaggtagaaatggaaatgtagagaaaaacaaaattataaatggcaaataaatgaattctttttagaacagttatactaaaataaaaagtctacctccagcaaatatatatagagagttatctttgaaggaggaaaaccaaatcatttcaacagtgttcttttatttccaggaggggaaaaatgtcctattaaaatggcagaagagaaaaggggaaggaaggggaagggtctctcttttactttacaaactagaaacaaacagttcacaggtttcttaacattcgtatcaaatgtcccgtggattttatttgcaaattatgaggccagcaaagcagaaaatgggagtctttaattaggaagaacaggtggctgagaggcacaaggtgagtattagccacatctctgcctggtgccaaaaaacacagatccgacctgcagaacaaattttaagggtgagagcgtaactgtctccagttggagtggagcttgagtggagctcaagctctgtattcagcttttctgaattatatttactcctatttaaagtgaaatggtttgctcttcagctttggttggaatttaccaattacaaattattgaccttcttcatattgacattctccacacagtctacaatcctctctgctgcagttgaagcaaattcttgacctgccaaatgttcctgtttctcttactgggttttcaaaatgattctcctaaacagctgattacgtattttaagttagaatgacaatatagggcttataaaagtggaacacagaggattttcagtgcattgaaactattctgtatgatactctaatggtagattacatgcaagtaactatttgtccaaactcatcgaacatacatcactaagagtgaaccctaatagaaactatggactttgggtgtcaatgatgtgtcagctcatcaactgtaacaaatgtgacactctgatagggaatattgataagtatatgtggaaggggagggagtattcgggatgactctgtaccttctgctaaattttgctataaacctaaaactgttctaccaagtaaggctattaagaagtgctcagagctgggtatggtggtgtgcacctgtaatcctagctacttgggaatctgaggcaggaggatcacttgtgccctgaagtttaaggccagcctgggcaaatatcacaagaccttgcatcagaaagaagaagaaagaagaaagaagatagaagacagaagaagaaagaaagaagaaggaagaagatgatgaagatgaagatgaagatgaagaagaagaagaaaagaaacttaaaaaccacttatacatagatacatattttttaaagcttttctgtcattaaatgttttgggtttacaaaattaaacatttggcattcttgctcaaaaacagcagtaatcttatcttaaagttcataataatcatatacgcccagcctctggctctcaacttatgagtctcacatttaggcaaatttttatgaattgaaccaatggcatttcatagtaacgtaagttcatgtccaagtgccacagcttgccacttgcttgattttaggcaattttcataacatcttatgcctcagtttcctcatctctaaaatgagagaaattcacatatctacttcactgagttgtgacaattaaatgaaagaatgcagttaggagctcagtgaagggcttagcacacagtaaagacttaagaaatgttaactctttttgttatgactaactacaacttaatgtaaaagggaactacaagtaattttttaaatcgataagcacatggagccttcgaggagaaaacatgacaccttcaaaaatgaatatgcaaggtttggaattcgttacttcagagtagaattttaccaggttagaggaatgacttataaccatatctaaaaattgtcattcttcagtgcattgctcttcatctgcatttgaagctgcctcgttataaaaaagctgtaaaacgtcctcaaagtaactttagttcttccccctaagagttcaaaatccactccctaggtttattctttggtacaaaaaccttcaaaagctgatttgctgatgataacaaatttgttttcagaaataatattcctgatctgaggtgataaacaattcagaactttcatatcattggggaattacatttaagagatcaactggggatctgtgaaataagaagcatttaccttgctagaggaatgctagcctgcatttaattgtataatatttccccttcagggtgtatgagacagcgtgttggaaaatggaatgattcttggctttattcagaaagagaacaaaggagagaaggcaggtaaaggacacagcaccatggaaatgacatttcgtttccatttgaattctaaagtactgaacttttaaaatcttcatttgaagaaactctgagaaatttgtcaggagggagtaagaaaaatgatatagcctaccacttaagatagggtgccaaaaaacattaacaattgttcaacctaaatggttagtattcaggttgaagggtggcagaatatgccacccctacatatgccactttagcataaggattattttgagctaaaggcacttaaaaaacagcaggtgctagaagggcgctgtgactcacccctttttcttcccgaatgcagggataaaaccccaatacagaagatgtcctctttataccagaaggaaagtcacatttttatcatcaaggatgaaaaggtgagacctggagaatgctgcacaaagataccatgtgaaaataattcttatcttcctttagcctgcctacagagttcacttacttttccacaattgcatcttttcagtcaatcgaatataaaagcatctaggttttgccatttctttatgtcttcatttcctaatgagggctccataaaacttctattaagtatatttgcatgcttttcttctgttaaactgttttacatcagtttaattctcaggcccagccaaaaaactctaacaaggcaggggtagaatttttgccttcctcacaaggtgttcgtttttctattcttgaaactttccgtatgtttcacaatttttataaacaaaagttgggggaatgaactattactaaaaaatctggaagacaaaattctgttctcatttgacacaccgagtatctatttacacttttctcggaaacagcgtcttctcctcctccacaaaacccatgtgctctgagggaggctgactccatcacttgggctataaggataagccacagctctggtgaggacaactggcaaaatcccatcaccctgttcatttgattggctcaggggatgagtgagagatgaaagttggaccaataaggatgaaggatttttttttcaacagttatcagaagagcctttccattttcctacaagacatgaatggacaaattagaaaggcccagtgccaggagtgacattagaaccatgatctgagagtctcctggagactgggcacaatatcaaggaaatacagccaagacacacacacacacacacacacacacacacacgggagaagggggaaggaaaaagagggagagtgtattaatctgttctcacactgctaataaagacatacctaagactgggcaatttataaaggaaagagatttagtggactcacagttccacatggctgaggaggcctcacacgcatgccaggtgaatcaagagcaaagtcacaccttacatggcagcaggaaggagagcctgtacagagaaactcctgtttataaaaccatcagatcttgtgagacttattcactaccacaagaacagtatggggaaactgcccccacgatttaattatctccacctgtccctgctcttgacacatggagattattgctattcaaggtgagatctgggtagggacataaccaaaccatatcagagaaaaacgtagagagaaaaaaggggaaagagaaaaaaaagagaaggaaaggtagaggaagagaggccatacatgcactagataaagtcgcacctacagctgagcaagatagtttccaattatcctagccaataaattctattgtctgcttaagctagaatgggtcacatttttagttgcttactagtgaaattatcctaacatgctaacaggcaagataaaaatagtctgagcaatgactaaaggagcacattttttacctcatatactgacaattcaagagcattattgcatcatttgctgccaaatggagaggaaagttggttcctaaggaccccctcggccagaaaagtacaaaacatctgttgaagtcatgggtgacttgttagcaaagttcagcagcagtaaagcttcctaagaaacaggtcttttctcaccagcgggtattgatataattagggtcaattacaatttagaatttccagggcatggggctgaattacagtggcatttaagagctctgctaaattttcccattcatcttgaagatttctggaggaacctgttgtaattaagtaatcttcttcttttcatttttatgacaattttcttcttcaggctttgcaattacccactactccaaagtaccttcctttagaagaagaattaaaaaaaagaccacctgattttcaatcgacaatgagacttggttttgctgcctgctaagtgatggattgtgatgtgtacagcaatctctaaataagctgcttcaacaagattttttaaactcccactgccctcaccaaacacagataatcccaaaaactcattgtctgagtgggtgatcaaaaacgaaagaggtgacattatgattgctgggcatcctttacccacgtggtttgtaagtagccctgggagatgtgcaaacaaactctattacttccttgtgggttttcacatatgcttcccccatacagattttatgaagacataccttttgagctttatgcaatcgaggggaaagagctttcactggattaagctattccaattgcatttaccttgggcaacaaagtaaaccatatccataaaaaacagccagaggcttttaagtattaggtcaatagcacttgagtatcatatagtcccaaaagaagctgtaacagatcatgttgattttatggaatgccttggctctctctggggagggagtagtacatagggagtgaggaacattatgacacctattactatcaaccactgttcagtgatggctttctatgcaagcacccaaccaccctgagaaaaaagtactaacatcttcaattgcacaaaagaagagggaaaaataattacagttagttgtctggtctgtgatcatccagctcaagtgaaaaaactaaaatttgaaaacctcatctttccaattccaaagtttatatttaaaaattgtacttccagtgttgaaaagtatctttgggaatagttatgccagtttctgactcacaataagatacactccatgcatgttgtgtgtgtgtatctaaaaccatccttgacccagtacaggcacttctagttaatctttcaactgatcttatccttgtccagcgtgtgggccactgctcatgccatttcttctacacagcatacctttcttttccctcccatttccacctatggaaatcttgcttgtaagtcaaagccctgctgtgaactaactatgtgcaagacatgacaaacacagcagtcagacagatgtagcctctttgttatctattccataataacacgaggcatgtaatagtgtttcacagtttatgaagaccttccaatgcacttccagaatggccaaaattccagctaactctggaaaacgcattccaaagagaaccaactagaataaatggggaaaaattttatgtcatgagtaccgaatgtgtgccaagtatttccatatatgcctaacttaatcattggctgtatgacaaaatatgattgcaagcatattaatgtattaattcaaaaatatttttgcaacagctctgttgttaaaggttctgtgttagacacttgatgcaagcaacacaaagatgaatcagacgagaggaaataaagtctacacaagtagacaaagaaaaacagtgctttatattggacattaacaaacaaaaggaacctgtaatcccagaactttgggaaaccaaagcgggaaaattgcttgagcccaggagtttaagaccagcctgggcaacatagcgaaaccccgtctctataaaaaaattttaaaaatttaaaaaatttaaaaaattagcagatcataatggcaactgcctgtagtcccagctactagaaaggctaggtgggaggatcacttgagcataggggggtcaaggctgcactgcggcatgatcatgctactgcactctagcctgggcgacagtgaaactctgcctcgaaaagaaaaaaataaataaatagaaggaaataaacgtgtgctcaaagggtattatggtagtagacacctttattccagcagctagtactgtacatgggaaagagcaaataatgattatttaataaacagataataaaaaaagactgggctgggcgcggtggctcatgcctgtaatcccagcactttgggaggccgaggccggtggatcactaggtcagaagatcgagaccatcctggctaacaaggcgaaaccccttctcaacttaaaaaaaaatacaaaaaaaaattagccgggcgtggtggcgggtgcctgtagttccagctactcgggaggctgaggcaggagaatgccgtgaacccaggaggcagagcttgcagtgagccgagatagcgccactgcactccagcctgggtgacagagcgagactccatctcaaaataaataaatgaataaataataaaaaataaaaacaaataataaaataaaaaacactgtggcctcatcgagtttctactgtagtacaccattgaaagagcacagaacactgaagtattcattgctacttatatttttaagtttttatttccattctacactccagtgagcaaatcaaaatgcctactgccaaaaaaggctcataattaatacatttttacttacaatgaaggctatcattagtatatcaccaattaatgtcagaaaaggaagatctgtcatgatattctgaatcgacattgtaaaaaggagaaaatatatggatggaaagtattctggcatgtttctagttattaagaacaactctgctgaacagcaatttgggatgatgtgaaatgaaacaaatgatatcactcattgtattcagtgtgatgatcagttggcaacaattacaaaaatgtaccagtaaggatataatatcaaatgtctatagatagtcaaaattgcaaatggcatggaaaaaacataagagaaaaccatcacacctttctctctgttttgcagtcaatgattttctcatttgtattctcctatactgtagacttcccaggacagagattacctgaggttcttctctggatctctagacaaagcccactgtccaatacttaatatatgactgttaactatggaaacaaggaaggaaggaagtcacaatttcattctgaaaactaatccaccttcttatcagccaatatgtcctccttcaaggagcagcactggaaaaactaatgaaataaaacaccaggacaaaacgtggtatccttctccagaatgcacaggaaatttctgaatattaccaagaattaaatatatttgattgttatatagcctcaaatgggccagcacttacttgtgagttactaatctaatctcaactatttcttttctttacaacattgtatttcaaaataactcaaacctacaattggttgcaagttagtacgatgaatacctgcaataccctacttcaactgttaaggttttatcatatctgctttctctcttttacacacacagacacacatataggcacacactcagcaatatcatcatcattttcccaattgcttcttagggcacaatggtttgggtattcaagaaaacaagaataaaagtcatggcatcctgcagaccaaagcaagacctaacccttgtgtgaggtataatcagtatcttgagtgaaatcatttccctggagtgaagagttcccagtgcaatgaacagtgagaactacaaccggaaaaacaggtagcaaagaccctaataactccatattttatctaataagaaatgaagtgctgaagatttgtgagtgggcttgtaaccaaataaaatgatttttcccaatataaattagagatactatatcaaacgcacagcagagacaagaaggtggtggcaggaaaatcaggcaagtttaaaacacctagagtattagcaaaaaaatacataatataactggatttgttctattcctctaacaaaatataactaaaagggtttgaaaagtcatcggccaacaatatttaatataacatactcaaatcacatatatttcaattaattaggtttctacaggagtaatgtggtatttggacttggacattaaatcaatactggccttacagttacttcccatgttcttcagccctccattacaatccactcccctacccaaaaatcaataccaaagccttatatgagacagaaaggacagtaatctttaagtggaaataggaatctaaattacaattgtaaatgtctaaagcttgtagtctggggattttcctaatgggaatatttgatgtgactttttgttattcttatggttgtgctcataagcacatcacaaggatggtttaaaggcccgagcaccataaattagatattctttaagaaatcatgttcttgacatattttttcattatctgagaagaatgaaacagattttttttgttaattagtgctaaggcatgtattttgcattagcattaagtttaccaaaatggctttaaaaacttgaacagatggcagaattataataacttttccttatgatttaggttaagaataaagtgtcatgagaattctcctcctacctaacttttctataaagttaatgcatttaatagatatggcatgtttgtttttctcactgaggtgtaaacaactctatcacacctcagatgagtataatgagatgcgggaatacatttcaatactctctacctagggtaaagggattttccagggtttaaacatcaaaccacgcagaaacaactccaaaccttcgacaataactgcacaggatggcacaggggttgcaaagacagatgtctttaggggcctggcaggtactgaaaacgagtaaagtagacttgctctgaggataatagggagtagtgggaactgcagccagccggacagagcaagcaccacccggggcgacaaacccaacttctcaccaactgctttcaggaatggaatgaaggccctgagtagctggaatcacttattttccaaaagccgccccaaatctaactttcctatgtgaaatgtcccaataaaaatttcggtggctagtttatatttttttaaagaaaagataaaataaaaagaaatgaggactaaagaaaacagtcagtggcctccaggaggaaccatgagacattagtctgcagccttagatggatatctataactggtgttcatggacctgggaggtggaggttgcagtgagccgagattgtgccactgcactccagcctgggcaacagagcgagactccatctcaaaaaacaaaaacaaaaaaaaacaaacaacaaactggtgttcatggttagtgctatggcttatttcatgccctgtccttgagggggatctcagcccctaagtgaaacacttgaaattagtaaactgggtcggcttgcaagcctgatttttgaaaaggtattatggtgaaacctggaaacctgcatgaattctaatgtggcccacctttatacctatgtgagatgatcttgagctctgtaacctccattgatcttaccagtggctcagctagctctcattttatttgtcttcttgactctcccttaaattccccatcgtgcctattcccaatttatgcctcttaaaagtcattagtaactgaaatgagcaaagtttaagaactggtgcctcttcctggcctccatatgctttaatttcattgcagcattggatatctcatcttcccatgtctcttatcatcaacctcaagctccccaaatttccttgctctcactaaatttacccatttttctcaagccttttaagatttcttagaatccagaactgtaagcaataaatatttgttgtttctaaatcacccaggctaaggtattttgttatagaagcaggaactgactgaggcaaaatgttatcttgcttaattcagaagacagaccctatggttacgccattttgtagatgagctaactaaggctaagagaggacaggtaacttgcctgaggttacacaactaggcagaagccaaatccaaataccagtcaagcactagccaccaggctctcctttctcatctcccacttctaatcaattgataactttggtagatcccaccttggtttagtaccttgcatccacacctctgtgccatcccagcaccatcataattctaatcatacatttcagtatgattggtcaggtgcaatagtctcctaatctccttaatatctctagtttctttctcttcaacacaaatttccacactctatgatcttactaatattcagctcccatcatgttcttcagaaaaagaaaaatgtgtggaacctacgcaatgtctaggtctgttcagtgtcttcaaggtattttacaactctgttacattacaggtaactaatagtaatgcaaaatattaagacatgcaaattatttcctgtttgatacaggtttactttgacctccttccttcctgccacctggaggaagaaaacagctttgcctccattttcacacacatttcaatattcctgttttataaacatgcctgttgtttggattatcttttaaaccagttatatcatctgcagcttcccttgtgaattaaataaaatctttaacacaggttcatttctgtatctgtctgagagttatgacttaacctattgctgaaaatgttcttctaacatgtttagctcctaacagatccttgctctaaaaccttcaatggacaccagttgccaaatgaattaaatccagaaacgttaccctggaattcaaaactaagagtatcatctactctgtcagtcatatattacactgcttgtccattcacatcctgcatggacaataaaagaaactccgtgggtgccacacatttcactctcccagttttcttcctctgctgatgctactctttcaccctggattgtggcttttcatagagtgttcaacataatagctgctgtggatgccctaacccatgcttctcaaacatttcacagtagtaacatggcatagggattaacatttgcttcactgaagtaggggagcaggaggaggacaaggaaggtggaggtaaagtagactgctacaagcagaaatttctttgatgtctcatgctttagctcaaaaatatatgcagattaaaaaggaatgagatcatgtcctttgcagtgacatggatgaaactagaggtcactatccttagcaaactaactcaggaacagaaaactgaataccaaatgttctcacctgtaagtgggagctgaattatgagaacaaatagacacatggcgggaacaaaacaaactaaggcctgtcggagggtcaacggggaggagagagaatatccggaagaagagctaatggatgctgggcttaatacctgggtgatgggttgatctgtgcagaaaaccaccatggcacatgtttacctatgtaacaaacctgcaatcctgcacatgtaaccctgaacttaaaagttggaaattaaatacacacacacacacacacacacacacacacacacacctctgcagattttgtacacactccatcatatatcagcaggggcttttgtgaaaaataatattgccacctccaaatattacaataaaatttcccttcctggcaggtgactagtctgtggtgttgtacatcccatgaaacactctgtgacaacgttcaactttacctgagccctgtgctcccagaaaaccagaattaagaaatcttcaatcctttctgtaagatcccatctccatcgttcctcaggattcccttgtttagcggcctctctaaaactccaggcccacttcctcttcttcaaaatgttctaccataattaatgctctccctgtagcagtatcctaaataaaatcacctccttaactgtccagtgcattatatctttgacatatggcatcccttctttgaaaagtccatgattttagatggtgcttcctaagattattactttaaaatattaaattgtgatagtagtataggggaaaaatatattttcctcactcaccactaagttcatggctgaggcacctataacaaaaggtagatcaacaaggaaaaagcatataaatctattgaatgaattttacgtgacatgggagccttcataggaaaatgaaaccctcaaaatagggaagcctgtgtctttttctatgttggtttgatggaaaagtggatagtaatgaaaaagtattattggatgaaaaaatatgatctaatggtaataagctgggagggactttggaaggcctgtttgctaaatcttctttgtgtccctgtatcttcagagataaggatgttccctttctccagatctgtggagggtacctcttgaatgagggtcttatgagaaggggaaggggaaggggaaggtaaaagagatcttcctgcttctgctatgttctcaaatatcaagatgccatattttgaagtcatgtgtcctgaaccctattcagttaaaaaaaaaaaaaagacctaccttgatgtggttccgaaagatttttttcacctgtccccatttaaaatgactaccaaagttatagccgtcaaaactacataggaatctctgcagcaggccaggaattgctgaggtagagaaatagaagaagtgggcagagacctttcctatcacccttaaaatatctgaaaactaaaactactggaaatagacactagttttcattcaatctttctttcaacaaatgttgctcagacatagcagatgagcggctgggtactggctatacaatctgttcaggggaaagctatggaatcttgattaaaactttgaaatccaaaccacagataagatgaaaaggaagaagatgagtagtgggtgtggagagaccttcaaagccggaaggctacaaaacatcaaaacattctgaggacaggatgggaagaccttaagttatggcaactgcaaataataatggcttacatttgttttaagggagtatcttaaaatattcaggaactaagcttagtaatttacattcatcaccttgctaaatccttagagtaactccaggagctaagtactattattatccccacttaacataaaaagcaacacagcctcagagaggttaattaacttgcccagggacttgcagacagtaagtagctaggctgcccaactcaaaatcatgtttcaataatgcaccccaagtgctgttaccatgggttttctagaaagggtatccaatataaattggaatccagagtgaggtggagaaagagtaaagagtgggtcagatttcctatgccaactcagggagtgtgaacttcaccctggcaatgggatgacaaggaaataattcaagggagggaaagcaagaggctgggacctagcaatggatacccctgtaccactgggccccttccagagcatgaaaatgaatgagaatagggtagaatacaaccacaggctcaagtgtctcaataaccacaaggtcagaaaggatttgctttaaggcaatatttaaacgccagtgaacactcaggtctgaattctgtgcatctaaccactacaagttagaagagaaaaaaatattagtgttcttaaggaagatctagcaaaaccatccttccagttctaagggccgtagagggtgtaggaggttggttcacacttcagggtgtaccaattaagtatgatgactgcagcaaaatagtgagtaacacagctagatatttaaaagcctcagttactggattcctgccactgcaggaaacttctgtcttgactaaatttaaaaaaaaaaaaaagaaaaaaatagtgtcaggagaaacaaagtgtaaaatacagaacttatttttcttcctgccaggtgtaagcgttaaaacttggcgtattcactattgtttagaagtttgaaaacttttaacaaaacaatagaacacagaagtgaaaaagtgattgttggggctttagacttaacacaaagcttttgcaaataaatgcctctataaccttaatgaattctaataaaatatattatgctatttttttcttgtatctgtcagaggtgtttgaaccagagcaactctatcttgaatagcggctgggtaaaataaggctgagacctactgggctgtatttccaggaggttaggcattctaagtcacagacgagataggaggttgacacaaggtgcaaatcacctgataaaacaagatgcagatgcgtaaagaagctggccaaaacccatcgaaaccaagatggtgataaaagtgacctctggttgtcctcaatgctcattatatgataattacaatgcatcagtgtgctaaaacacactcccaccagcgccatgacagtttacaaatgccatggcaaagtctggaagttacactatatggtctaaaaagaggaggaacccaaccctcagctccgggaattgccaaccccattcccgggaaagtcatgaataatccaccccttgttcagcatctaatcaagaaataattataagtattttcagttgagcagcccaaactgctttccaaataaacttgctttcactttactttttggaatacaaaagtattttggaataaaaaaagtacttatccctttactttcctaataaagttgatttcactttactctttggactcactctgaattcttccttgcatgaggtccaagaaccctttcttaggctctggattggtacccttcccagtaacatatccacgacaggtgagaaaagaaaaacaaaagacatatatatcatattacatcctacctaagatggtaccaatcgcaaggaacgtattaatttcagagacggtgagtattagaatcatcaaaatacactataattatcacattcatgagtcctgttgatacatttattttactgtctaaaattcaggagtttatggtaagggagtctatttgtaagagaccctgttgattttcacaagtcaagaaacaataaacttcaagacatactaaaaagaaaccagcctgatgtcagatcctcttcaacatagaaactatcctcatagtaaattaaattgaggaaatatttaatggataagcttgactttgtaaacgtgccttcctgaccaataggtacgttactgatgacgttcaggacaccccactttggcactggaggaaacagcagaagcaagaaggtctcttggaccttcttcctgcccttctcctctgaagcagactatacagtaattctctgacctctgcagtacatcattaagactcccatttcagaggttctctcactgtacctggagaaaaggaacatctctgtctctctgaagacaaagggacacagaagaatctgaacaaacaggccttcccaagtcagcccagtttattaccattagaccataaccttttatcctcctataatatttctcccctaccatctactttatcaaactgaacattaaaacatgtacatttccctatgtctttgggtcttcattttggaatgatcctgtgtcacataaaacttatgttaaataaagttgtatgtttttctccggttaatctgtcttttgtcatagtgtctcagtcatgagtctagtgacagatgaaaaatcttttgtcccctacagcatctatgaagatccaaagaatgtcaaagtataatttttaaaaagttacaaacattgcttttagataaatataaagcaaacatatcaaaatgaatttcttaatgagggaaccagtagcatggtgtattcatacaaaaagaattaaagaatctaagtacaaataggccctgacaatgtcaaactttacctgagccctgtgcttgcagaaaagtgatggttaacaaccacccctacaaaccttttgaaaattaaaggcaaaacatccccaccctttttggttctgggaaatggctgctgaagagaactacccttccccaaatgacttagatatgactattcttactctatcataattttcacaaaatgtgcagaccaccccttttgtttacctgtaacaaggccagaaagagacccaaccctttttacctctagccaatttcccactctgtggctcaggattgattagctaagattagaactctttttacccctaaaactgctagacgctgaaataaacatttcctgttcagctaactgactgaaattccctgacggcaaaacaatcccagctgtgaatctcttacctaaagagttaaccaaataaactctttatgtggttaggtactttatatgacttagtacatataaagtacaaagaaaaaaagataaaaaaaaaagacttggatttgaagaacaaagaactttagttctttgaaaggcacagtttaggaaataaaaagccaagtcacagactagaagaacatatttttaatgcaaatacttaataaacgacttatatctagaataaaaaataactaatatctcagtaagatagtcaacccaattaaaaatgagcaaagtacccaaaatgacatcgtacaaaagaaaacataattacaggaaaaaaatgcttatcattagtcattagggaaatgcaaattaaaacccaaatgagatactgctacacagctaaatagaatggctgaaataaaaagactgacaatatcaagtgttgacaaggattggcagcaattaagaacttccaaatgttgatggtagagtgaaaactgatataaccattttagaataccactggcaattccttgtaaatttgactttaaatatagcatgtgactcagtaattccacttgtaggtatgcatccaagaaaaatgcaaacatattctccaatagactcatctatgaaaaattatagctttcttcataatagccataaagtagacacaacctaaatgtccactatcagatgacttaacaaactgtagtataatcatgcaacaatactactcagcaatgaaaaggaatgaactgttgacacatgcagtaacaagaaggagaaaaggccccaggaacaaaaagatacatgctacatgattccatttatacaaaatacttaaaaagccaaacctaatctatagcatcacaaagcagatcagtggatgcctgaggccaggggtggtagagaggaggtggaatgcaaaactgtggaagaaacttattgatttgatgacagtattctacagtaatccacagtgtatgtaaattttatgtgtgttgctgtatataaatgatatcaaaaaattaaaactaaagaaataaagtctttagcttaaatgcatctttcaacaagttcttcatttgcaatctagcttatcacattagaataattggcagtctcctaggaaactggtctggagaaagtgagtgtttttttttttaaatgaaaagattttagatttacgttgagaattttaccaatcatcttaaatatttttcctttgaatctatttgatctgttcaaattaaacttgttatgtcctgaggtggttagctaagggtaccatcaacaaagtatgtggcatcagcttccagtgaattccccaaagtgggggagaaaaatattagagatggatccaaagagaaagcctttcaccaaaatctccattcagccttgcttttcatcacttaaatcctagaagaaaatgttctctgaggaccactctgtatgtaggagtagcctgatgagcaaacataatacttctcaagtatagacatgataaagcagcaaagtcaaaaccatggacagattcaagtcataaaaggattttgaatacatttagccatgcactcactgataaagccttcctaccaatagttcagctcatattacatataacaaggaccagtagctagaaaagctaaagcttaaaaagaaaaaattatcacagtggaaaattatcattagaaatactcaacttaagaaaagacttgaaaacctcttctgtacacacagcactttatcactataagttactggttctattatcttatttaatcctaataacactaacaataatacattaagagagttaatagagagttaatataaaagcacaatagagcaaacactgcatatagagcatttagaagtccttcgaaagcctctgctaggaatggcttcaaaacccagggagttgaatgtggactctccttttctcctttcttttatttcagtggttcttgaatgttcaagtacatatcaatatatcaaaaccatgtactcattaatgagccacttaaggaaggaatttttaaggcaattgtgatgaaatgcgactttcacctcactgtttctcaatctttttttcatcatcatccctgcaaggagcgttttctaattgcccccctgaaattttaataccacagattttctttatatccttatacgtattgtctctatgtctgcgctttacacataaaaagaatgactttttattgctcccaagaattaattttcaccggcttgggggtgatatcactcccactgagaatgcacgacctaacctggacctctagcttaatatgaacctctcctgtttatcttcaatggctcctttcaatgaaaagtctacatcccagagccttcttggttgaagcatatctattaaagtttgttttctttataccaagtttttcccaacatttctgctgaagtacacaatgatagtggagaaggaacatacatgctgaaaatgaaaaacatatatagacatatttagcaagcaggaaatgtatttgagctctgatatcttaaaacattaagcaaacagagaaagagtagtctttttaagagatggtccttggacaagtggatatctacacacaaaagagtggaaggctcctacttcatagaatatataaaaattaactcgaaatagatcaaagacctaagagtttaaagtataaaacttagaagaaaacatacatgtaaaccttcatgagtacggattacacaggggtctcttagctatgtcagcaaaagcacaagcaacgacagccacaacaaagaaaaaatatatataaattagacttcatcaaaatgtaaaagtttgtattttgaaggacatcattaataaagtgagaagacaatcaaagaggaatgggagaaaatatatgcaaatcacatatctgagaagggacttgtatctagaatatataaagaactttttcaactcaataataaatagatgattcaaattttttaaatgggtaaaggttttaaatagacatttctccaaacaagatactcagatggccaatacgcaaatgaaaagatactcagcattaaaagccatcagagaaatggtgatctaaacaccatgagtcaccatttggcacccacaaggtcacctataactaaaaaaaaattaataatgatggggaaaaatcagaacccttacatcttgcaggtgatcatgtaaaatgatgcatctaatttattatatacataaagatagtatatataaaggtatatatattacccagcaattccactcctagttatacacccaagagaaatgaaaacatatgttcacacaaaagttctatatgaatgtttataacagcatcatccataaaagcctaaaagtggaaacaccccaaatttccattgatggatgaaaagataaataatgtggtacacgcatacaatggaatattattagcaataaaaaaataaagtactgagacacattacagcatgatgaaccatgaaaacattattctagctgaaagaagccagtcacaaaagaccacaactgtgtgatttcatttataggaaatgtccagaacaggccaagatataaaaacataaaatggaatcataatgcccagggccgcggagggggcttcatgagaaacagaaatgactgctaatgcatctggggtttcttttggtggtgatgaaaatggtctaaaaatgactatggtgatagttgcacaattctgataatgttccgaaaaccacagaatatacactttaaatgggtgaatggtatgctacatatattatatctctctaaagatgtttgagcaggggaagggaaaggattaaggaggagttagatcctcagatcccatctcccactcctgatagccaggagattgcgacaccccctcatcctggccagtgacttaagctttgttcctgtagagagtaaaatagagggtctctgacatagagtaccccagcaaaatgagagagcagggctgcaggagagatgtctctaggaagatgaaagtgccagaataccagaagtgcatgaacatcttgagaaggtatttagacaaccagtgaagactttgggggctaagacagtgataagtatttacaaaaccaagcaaattaaaaaacaagaaaattattacatccagagaaatcaaaagtcaggcaggatagaaagtgtgatggtagtttactccacacttcagctttagatgacatttcaatactgtactaatatgaatattaatttcatcaaatttgcagtaaaattacattgagataagggacagaagaagagcgtgtgcaatagaagtgaagggaagactagtgatattagttatgttctctgcttccatagtgcaaaatcaatagaaagagcttgaaatgtaaaaaataaaaaagtatacatattacttagagatacagagataaatactaaaataatcagtttaaaagaaatgagggagaggaaggagggacaatgtaggggttttgaattattttttagtaacaagccttatagggctacatgaggtcacatatacacacacacacaataaatgggaaatgcttgcaaattgcataatgtaatgaaaattttcaaatactttataaaaataccatggaaaaattatgctattataagaaatgttatgtgaattgtgttctcaataatatgatttttgtcataatacaaaaatattttaaattactcagtaggtaaagtatttaactttgttctcaaataagcaaaattcctcaaaagatgcagcatgtttatcctaggtctccacgggcctctgaacacaatagcaattaccactataaaatcccagtctgagattttgtgcttaacatatgaccgttcttccacacttagcattttctactgtatacatcattaattcgtttagtaaatatttaagcatttactaatgatcaattcaagtaaaataaaaatatctgatctaggactgatcctaacaaattagttttctggaattatattttttctagattgctgatcaccacgtacatgaatacaaaactatttattgaagatgtgtgatattcagcctaaatcttgtaaaacttggacttgatagtctaagaagctattatgtgcacacatatttgaaggacatttttaaaagtgctaaactataaatattctgattcactgctctcttacatgcactaaaaatgacttcgtgcaatcactaaccaggaggtaggttttgtatcttactgaaaatgtcacttaataaataaccttcaaatttaaatgcaaactgtggatatcattcatagaacctcaaacttgcccttgaagtctaaatgggcaaacaaggtaactacaaaaagcttttcaggcgttaacaccctactgcttcaactccttgaaaagcagtctgaacttttgagtttttagcataatattcttatgctgaataatctctatctcctatagcatttaggctgaggacgttaagtatgatgtactgttgggataatttgcaattttcacttctcattctcagattagattactaacagtgttggaggaaatcactttactgcatagttcattcatagcagttcatttgtctattcaaaacctgatgtcttgtttatggctgtatatcctaatgtgttgcattaaggtgttaacagaactagttgcaaccctaaaattggactaggcaacatgacttgggactggcacagtcagagaccaggaagctggacatttattgagtaagaagaaagggaaattttgagacagagaatttgcaattatgtattatttacattatgtgaagttgactttttcattagccagtatacatccttgattgtgactgctatatatagtttacttttatatcctccatagtatctgtgttcacagtaggtgtaggtgtggtcgacagaatcctggccacctatagatgtccatgtcctaatactcagaacctctgaatatgcttacatgggaaaggggcattaaggttgcagatgatgaaggttgctaatctgctggccttaaggcagggagatgatcctggattatctaggtgggcccaacataatcacaagggtccttaaaagatggaagagacaggctgaagagaaggtcacagtgatgaaaagtgagaagtcaacctgccctttctggctttaaagatagaggaaggggccatgagaagctggaaaagtcaaagaaacaggttctctactagagcttccagaggaaacacagccctgctgacatcttgattttagcccagtgagagccatttaagacttctggcctccagagttgttaaatgattttatttttgttgttttatgttactaagttttcagtaatctgttatggaagccatcaaaaactagtaaatgattaatttaaaactttcaaagtaaaaaataagaactaagaagaacacctaaaggaataagtatgagccatcaagatattttcagttttctacgtctttaaccttattgggaacctttggttgatgtagttaatcactggagttttcctgtccattcatttgaaatctagaatttctttccatttgaaatagttttcttttactgaccagaagctaaactgtcctggatcacctgctggctgttcttttgagaaatcttggtattttccagtgagttatgactgcactatgggatactacttcctgagaacacaaaagttgctttagcttatcgctttaggcagatatttttgcctcagttatcttttagctgtgtatgacttaaacacaaaaattttaaaaatgtgggagtgcaaagaaatatcttttgaggtaggcagtcttttatctatttctccattcaaccagcatttgctaagcatttaaaatatcctagcattgagccaggcattgagtatgtgaagactgaacaacacagggtcattttcttcaagaagctcacagtctagtgaagcagatagaaatgttggaacaaataagagtttaagaaaggaatctgtaagtgttacaggaactttgagggagaaatgtctaacttcattttaaaaaactgccatttcggttcataaaaaatggggagttacacccctatgggtgaacatttgctgaccttgtaattagttataaactcatgggttggttagaagattcttttaagtatctattcaggcccatagctttctctgaaaatgaccaggcctcatacgacgccagaactaacatgaccaagggggtgtatctgactctacactgggccagccaatcagattctcagtccagagaatttggaattagaattcatgggatgaggttgtatctgttgtgacagcgaagtcaggtgacagagactcagtggtctaagagaccaggccacgcaggcgcatggagccccagcacagaaggcagcaaacagagaaaaagaaggccaaagcacagactccgaccacaactgcagttcttgcttgcctcccccagtgaggctttgttgccctctctctttcctgctgcagtgagagacacatttgtgtccttcacatacaatccctattttggttaaagttactttgagtttctattacttgcacagtgacatggttctacctttttaaaacagattccacattttcaccagtccatttgcctcaataaccttacctgcaatatgggaagaggaaagcagtttcctttcagggaaaaggcagtagaactcataaaagatgttcaagtataaaagcacttggactataaattatcatacacatgcagaagattgaaatctgtaactggttatgaaatattgttcacaaatgacccctattaaaagccaaatggaaggattttccagcaaaaatgaggtaggaaaaaagctcaaataaaaatgggccaagattctaggcagagctctaatattcagtttcagagattagttcggctttggccatttccaagtgtgaaagagggatggggcgaagaaggtaatggcaaaaagagaaagaatctacaaagaaccatggggaggaacaccggcaaggattttatccttccagagaaagccatatctgctgttaaaacacagtgcacagcagactgacaatgatcttcttgcaataggtcatagaaagggcattaaaagacaactttcaaaggtctcaaactagataaaccgaaatcagtaatagaggacttatgctggacctataggagattttcttccaggtgactattaccagaggaatctacataacagtggactgctgctatttgggggctaacttctgctgcccacctttgaagtcactaatagcttgttagcacagaagccacgctccgtggctcacacctataatcccagaactttgggaaacaaaggtgggcagatctcttgagctcaggagttcaagaccagcctggtcaacatggtgaaaccctgtctctccaaaaaaaactacaaaaattagccaggcatggtggctcacatctacactcccagctactcaggaggctgaggcaggtgaatcgcttgaacccaggaggcagaggttgcagtgagctgagatcccgccactgcactccagcctggggaaagggagtgaaacctggtctccaaaaaataataaaataaaataaacgcccattagcatagacaaagagaaagacaagaaagtaaaaccttagcttatgttattccctattagcatctctgataatggatttgttcattaacaagttaggaactaattgaactggagattcaaaataatctaaaaatttcagttcttgatgttagtactgctgtctctatgcactatcaagtgcacggaaagtatagaggtcaatgtatggcacatctgctttccattaccatgaaattcacttcaacacatcactgtcataaaaaagtcctatactaagcattctgttgttggtattgatccttcccttccatgttatgaagatagttattcatttttgcagactcaacatggcataatgcctggcacagagctaatactcaacatctgtgaatgtataaaagagcagatagtagaggctccatgcacttctgaattgctgaccataattgttaacattttctgaaaacttaccaaactccaggtgtagtaccaagtgctttatgtacattgtttcattaaaccctcacaacaacccaatgaggaaactgaggcacagagacctgtccaagatcatagactactaactggaggaagtgagatgcagacagaggcagcctggttccagagctcaagctctacaccacgctgcagtactgcctcccgtattctagtcctctcatgaaggcttgctgatggtctagcacatccttcatgctctgcgggacacaaaaccagacacaattttaaccttgctctttggagttaagagtgagagttaagtggtatttatacaattaactccaatatgaagcagaatttaacaagtatgtctagaaatgaggctgaaggtacagaagacaggaacacaactcttagctaggatgggagagaaatggaaggttgcatagaccagggacacataggctgggccttaaattatatagaagatctgcaaaggcagagatagagaccagattatagtcagcaaaatcatcacatgtcagaaaagtcagtgtgtgtctggggctatctggggcacagggtatcttcaggaagcagtaatgatgaatcctttaatgatactctaccaattcccccggtgtgaaaacatatcaaatcttgaggtacagaaagggggacaaaccgaggactcccaaaactaatcaaagaatactccttgaagttctgaacattaatgaggatgaggacctcactgaatggccacttctgtacaaactgagtttgaagtcacagaaatgttagaactgtaatcctaaaactcagttaagagggaagtgcatctacaaatcaagacagacctccagctgaaaatgcctcaacagacacttgcataggccttccttccacctttccgtgtgcaaacggatactgtgattttgagaatgaaacatgatagctcctgcatccactactaacaaaagcaagtgactggcaatgagggtaaatcaggcctcccttgagttggtccttgaaggtgctatcaaattaacgtatgtctaacaattctgtctccattcaaatcaattcgcctaggtagctaacctgctcactgtttctctaacaaggtaaacaatggattagtaaaaactacacatatcagacctggtttcttacaacattaggctcaaaatgcaagatttacataaagagaacatctatggtgagaaataatttgcttagacaggaaattttatcactgccattcagttagttggaaaatgaagatttagagatttggggaattctctaatgttctacataagcatagggtaaaataaaaacttcgtatttctttgaattaatatccaattctcttctagaggaaattttattgaattggaagtgtaattcttctgtttaaaagaaagcctcagccaggcatggtggctcacacctgtaatcccagcactttgggaggccgaggcgggtggatcacaaggtcaggagttcaagaccagcctggccaacatagtgaaatcctgtctctactaaaaatacaaaaaaaattagccaggggtggtggcgggtgcctgtcctcccagctactcaggaggctgagggggagaattgcttgaacttgggaggcagaggctgcagtgagctgagatcacaccactgcattccagccagagcaacagtgcaagactccgtcgtctcaaaaaaaagaaaaaagcctcattattttttataatgatcatgctgatcatactgctattctagtcactgtcaataaacaaaatgacaataaataaccattacaaggcagcaattaacatgatggtacctcctaacttctaagcttgtttctttaacgtgaaaacactatttctattggcaagtatgtagatgagagctgagtcttcctgaaggacagattgaaagagttttcacaaatatttaaaatcacagaaaaagtaatgttctgaaacatttacagaaattaataaaagtatctcatctttgtgtagattaaatattaaaatgcacttatataacttttattaaaataattaatatttaacgaagacaattgaaagaacacaactatgacaaattacattttggcagtaatgataagcctttgagttctagttctttctccttagggatgttacatatctgttttctctacttaaatcactctgcctcattatcatctctgccttctactctcagttcagcttgaaagttcatcttatacagggttacacgattttataatatcagataactctctttcacaccacttaccagagctctaatactaacttatgtgtctcattcttggttgaacatttctctacctcactagattataaactccttgagggcaggcactggttccactctcttccactaaatccccaactccaaaaccctaacaccttaacacctaatatatatatcaccatttacatatcagtcactcaataaatatttgaagaacgaaatgacaaaataccctttacctgaatgcttacctaaaaatgtatcttatatatggaatgaatgatccacacttactacatggatgtataaactcaaacattatacttttctttgcacatttgagaatatgtgtcataagctatgtttacaatgatatggaaacaaaaacttgtctataacaaaaacatgcccatagcaataacagcaacaacaagaagtggttccaaattcaaggtggtagcacagcttttttcaaaaatttgagaaaaaacaaatctattaaaacagaagatatagtctcttggactccactaaaatgagtctgttcaggtctactacaaaacacatctttaagagagattcatggccttagtagccagacagtaggtatggcccagaccttcccagcacagcctatgtattgaagactttagtgaaaacactcatgtcagcaaatttagcatggataattgcaataggaagttctataactttgctttagggaaaaaaattctattttaattttcattcccaaacagaattatgttagaataacaaaataaacttccccacatttatctgttttttaaaaatgatagtctcaaggaagagaaactttcttttcattcatttaataaagatttttgcattttatttaaagactccttatggctatattttaaggattcaagttcatttatttgtgataactagaaaaattttttgtccctttgtgaaaattttggaactaggcatattttcattactgttttcattattactgacaacttggctccctgctctgggaaatatttctggaagaaaagaaaaaaaaaaaaaaactatgaatcaactaacttacttagcaaggtcatcagcttactcaccagggcttatttcaagaccctctctgtgccacaaacacaagactactttgtctaaactcttgtccaattccaatcatttctctgacttgcagtacctgccttaaagtaatgcagaacaagcccagaactccataaatgtgctctcctaatttatccattttgagcaactaatcagattctctcaatcttgtatattcttttcctatagatctaaaatcatagctttgcttgatcaacaggtttttccggtagtcttgtggaaacttgacagtaggcattcatcttatatccactacacagaaacctgagttcacagatgttgtcttagtcaatgccatacacacacacacacacacacctgtgaccagcacagtggttggcacataatatgtgatcaataaatgcatacttaggaaagaagattttgttctatagtattacagagggtcaaagttcttataaaggagagtcagttactaaaactaaactgatattctatcttctcatgtggtctttcggcatcagtcctatcctacacaataatgccttgcaatctgtagttgtgaaattagacttctttttatgtgtgcacaaattaagccagtttctacaaattaaagaacatccagcaattattgctctccttcaagctgaccaataggataagtttaagcagtagttttgagaatttgtttttgcaattttttttttttttgagatggagtctcgctcagtcgcccaggctggagtgcagtggcatgatctcggctcactgcaagctctgcctcctgggttcacgccattctcctgcctcagcctcctgagtagccgggactatagatacccgccaccaggctggctaattttttgtgtatttagtagagaccgggtttcactgtgttagccaggatggcctcgatctcctgacctcgtgatccgcctgcctcggccacctaaagtactgggattacaggcatgagccactgcacccggcctgtttttgtaatttcttatactacaatgtttccttctggagacagaggaagtccagcagatgaagtctaaaatactctgcttattttgtgaaaagaccaggcattcacacaagcgtttttctcaaagctgagaaaaaggaggctgaaggtgcaaaagatatcagagtactcattcagaacccaagagtctataaaatataaacctggtgagagaactggcctcagccaatggagatgcctcaatagtgtttgtgtcacgagcgaacaaggtgaatcataaaaatattttttaaacttctgtttcaaaggtgcaaaaggcatatatattagtctctttgcattactctaaaggaatacctgagactgggtaatttttaaagaaaagaggtttatttggctatggatctgtaggctgtataggaagcataacactagcatctgtttggcctctggtgagggccttggggagcttacaatcatggcagaaaacaaaggcgagccagcatgtcacagggcaagagagggagaaagagagagagtagaggaagtcccagcctcttttaaacagccagatctcatgtgaactcacagactgagaacaaactcactcattactgcaaggatgacaccaagccattcatgaggaatccaccctcatgtcccaaacacctcccaccaggccactcaaccaacaatggggattacatttcaacatgagatttggagcggacaagcatccaaagtatataagtacagcagctagaactttcagttacttaaaaaaaatcttgctgacatcttaattacctgctgaagtcctggtggtcagcaagaaagcagtgaaaacatttaaaatttcaattttcatattaatggtcctaatttctggatctggttttctcttttaaccatttgcataaaaatgttttgtgagggacatataaagaagttggaagctgcagatataggcgttaaaaaggaattatttagcagacagtgagggtatggagtcctccgtaaggttttcctttgaatgaaaagcagccgccaaatcattttcttttctaacaaagagcagcctgtaaaatcaagctgcagacccagacaagcaagctggaagcttgcaatggatgaatgccagcagttgtgccaataagaaaaagctacctggtactaagcatgctcaaaatggcagctccatcttcccttttctttgccagccacatgtagagtaacgagcaggcaacatggcgccagctgggagaagtcgccatttgcttaagatcagggtagggcatccagcttcctcgcatgttatgtaaacatcacacctcgtccaaccaatctttgggccctatgtaaatcagacaccgcctcctcaagcctgcctataaactccaatgcactctgccacaggctggaagtctcattcaggcacccttttctctctcaagagagaaagctgttctcctttctctttcttttgcctattaatcctcagctcccaaactcactccttgtgtgtgtgtgtccctgtccttaattttcccggcatgagatgacaaatctcggatattatcccagccaatgacactgcttcactgcaatttgcaacaagaaaaatatttacgacaaggaaaaaagatgaaccaactggaaattaatgacttttttagattcagcagagaactgaggtccaaagcaaactagtatccccaaatttggagaaacatgtaaacacaaagaatcataagatcagattacctaaagcaaaaacagaaggacctaggaactgatacgaacacgtgtatgataattttgacaaattgctggaggctcagtgcagactagcttgagagttaaaaactcttgcagcctagtcttaggggagactatacttttctgagttttatgtccaagaaccctatcatgttctcatggggaagtctggagaaaaatctcagggaagagaaaaagtaaccattttggaagtttcccagattgttctctgtaagaaagacacgtcctttcagggaagctattttaccagagttctatctgacttgggagaagggcaattagtcccctccagactcttttagccttcctgtctaatgtcaggggacgaaaaaagggctcagaacatttcagaagatcgcagcctagaaactcaggctcactaagaaaactgagatgtaatcataatatacaacaattatccttcctgagacctcatcaccacgtgaagaggtctttggtgattacaactgagaggtgaaacacacagactctattgaataaggagctcttaggaaagcccaaagacaacagggaagacaaaaaatacgagcacacagaagcatctggaacttaaagctacagcaagcattaaacacagtccagctctaagctagattaacataaaacctcataacaaaaaaaaaaattcttagttcccatcactcgaggtattatttccagctttcaacaacaaaaataaggcatgcaaaaagaaatttcttaaagataaactttaaactattttaaactaaataaaaatgaaaatagagcttagcaaaatttgtggaatgcaaggaaaacaatgctttgcaggaaatttaaagaactgaacacatatatcaaaaaagaagaaagatctaaaatcaataatctaaacttctgttagaaacccacagaaagaaaaacaatttaaacctaaagcaatcagaagaaaaacagaatagaaattagagcagaaatcaattacattgaaaataggaaatcaatcagagaaaaattaacaaaaccaaaagctaattattttcaaaagatcaataaaattgctaaacctctagtcaggctaaccaggaaaaaaagagcaacaatacagattactaacattagaaatgaaagaggggtcatcactactgatctcacggatattaaaaagatgataaagaaatatgatgaacaactctgtgatctcaaatttgataacttagataaacagaggcaattccttaaaagaaacaaactaccaaaactcacaaaaagagaaatagataatctgaataggtctattcaggttatatctatatctgtatctttttaaaacattgaatcaataattaactttctaaaaataaataataaattgggtccagacaatttaactgatgaattctatcaaatatttaagcacaaaatgatagcaattctctacaaccttctttagataggtaaagcagagggaacacttcctaagtcattatgttataccagcattactctatagcaaaatcagaatacacgtgcaaaccccattaaaagaaagaaaaactagaaattaatatcgctcgtgaacatgatataaaaagcgtcaacaaaatcttagcaaatcaaatctaataatgtataaaagttattatatactacaactaggatttatttcaggtacacagctggtggaacgttcaaaaactcaacaaacattcctagcactttgggaggccgagacgggcagatcaggaggtcaggagatcaagaccatcctgactaacacagtgaaaccccgtctctactaaaaatacaaaaaaattagccaggtatggtggcaggcacttctagtctcagctacttgggaggctgaggcaggagaatggcgtgaacctgggaggcggagcttgcagtgagcggagatcgtgccaccgcactccagcgtgggtgacagaacgagactctgtctcaaaaaaaaaaaaaaaaacaatagaagaaaaccaaacaacaaaaaaaactcaacaaacgtaacttagcgtatcaactggccagagaagaaaaatcatataatagcaacagatacagaaaagcactgacaaaatcccacactcatttatgagtagaaactctcagcaaactaggaatagatgaaacttcgtcaactcgataccaaaaaatctacaaaaaaacctacagctaacatgacatcatactcaatggagagaaactggatgctttaagatcagtgtagtatagtaggctgactaatgatctcccaaagatatcaggtcttaacttttaaaacatgaaaatgttaccttctttgaaagaaaggactttgtagctgtaactaaattaagaattttaaggtgagaagattaccctaagttatctgagtgggccttaatgctatcaatcataaatatccttataaggtagaggcaaaggtgaaataacacagactcatcaagaagccagtgtgaccaggaacacagagatcactgtcacacccacacccacaacccaaagaatatatggagctaccagaagctgtcaaggaatggatttccctccacagcttctgtgggagtacggccctgctgacacctagattttagacttctggctttcagaactgtcagggaagaaatttctattgtttgaagctaccagtctgtaataatttgatatagcaagctactgagaacaaggcaagattttcccctgttaatactcctattcaacagcataatggaagacctaggtaaaagtaagacaagaaaaggaaagaatattaagaaaaagatataacgattgggaagaagaaaataaaactgtttttgctctcatgatatggctgactatgtagaaaaatcctaaaaaattgacaaaacattctctagaacaaataagcaactgcagcaatgtttcaggataaaatttttcttttatcctgaaaaaaacaggataaaatatttctttccaatatgccagaaaataacaaatggaaattgaaattagaagcacaatatcacttatattagcgtaaaaaataaaacacatagatgtaaaaatctaacaatatatgtacaggatctgtaaggaaatataaaaaattctgatgaaagaaataaaatctaaataaacgaatagatattctgtgttcatggataggaagacttgatactgttatcggttcttcccaacttgattatacattcaacgcagtttcagtcaaaatcccagaaagttattctgtgaatatcaaaaagctgattgtaaagttcatagagaagggctcaagatccagaatagccaataaaatattgaagaacaaagttgaaggagtgatactactcaactttaagacttgctacaaagctacagcgatcaagacagcatggtactggtgacagaataggtaagtgaatcaaaagaacagaagaggaaatccagaaatagaccaatacaaacataaacaacttgccctggacagaggagcaaaggcaattcaatagacaacaaatagtgctagaataactggacatccatatgccaaaaaaaaaaaaaggggggatctacacacagaccttacaccttttacaaaaataaactcaaaacgcatcacagaactaaatgtaaaatgaaaaatgcaaaatgtaaatcctctgaaagataacacagggaaaaatactagatttgagtttggcaatttgtttatagatataacaacaaaaaattatctacaaaaaaaattttaaattgaattgtattaaaatttaaaacttttgctctacaaaaaatactgttaagagaatgaaaggacaaggcacagaatggtagaaaatattaacatcatatgtcattaggggattacaaattaaaacaatgacataccagtatatacctattaggatagctaaatccataagactgataataccaaatattggcaagaaagtggagtgatgggaacgttcatgcattgttggtggaaataatggtaaaatggtatagccactttggactacagttttacagtttcttataaatctaaacatagtttcaccacagaatgcagtaaccaagttcctaagcatttactcaactgagttgaaaactaatgttcacacaaaagtctgcttagggaagcttatagaaactttattcataataatctgtctttcacaacacgagaatgtataaacaaactgtggcaaatccatacgacagaatactagtctacaattttttctttaaaagaactcttatgccataaaaaggtgtggaggcaccttacagacatactgccatatgacattatggaaaagggaaaactatagaggcaataaagggattactagttaccagggatccaatatagtttcttagggcaatgtagactattctatacgaaactgtaatggtggatacacgacaatatgcatctgtaaaactccatagaaccacagaaggccaagagtgaactttaaagtaaagtatgaacttcagttaatataaatgtgtcaatattggttcattaacttcagtaataaatgtgccacactaatgcaaggtattaatagtaggagacacttggtggtggggcggggatgggggaatagtggcgacacggaaggaaaatgttatggtaagtctctcaactatctgcacaatttttctgaaaatctaaagctgttctaaaaaataaagtattttaattttattttaaaaagtacatcttagaaaacatacctaggatgatctctaggctctggatccagaaacccctatttcaaacaagtaggaagattcttatggctgctaagatatcagcagtccatggtttcaggaatacagagccccaaggtgaatacaacaaccagactgaaataagtgcagttccaagaatggagcttaaactggaaagactagagagcagctggctagctgtttagaggtaacagatggcagaaccctcaggatcaagtcatcctgaatgaagaaagacctttggagagtgcacacttgagtaaatagcggcctctgttcatgttctccagtaacaaagaaataaactaattagatggcattcataagcaagctaaaattcctttcactggaaatctggaaagaactgatttaggagagcgaaaaacagggatatatacacacacacacatacacacacacatacatgtttgtagtatcaggaaatgctcaactttgctccctcaagtcatccagttccaatgttttatatatgctattatatgtgacaaaatcatataatatatattaatacatatcattaaaaatatgtaactgttaatgtagcataggtatatatttttcacataccataacatttatccttctaaaatatgtaattcaatgcttttcagtatattcagaaaaacatgtatccatcaccattatctaattccaggacccaattttgtttttaacacatctcaaatgtagattacaaaaaaagaattgatccactagggatacggtctgtaagaagcagcctagattttttaaaaatgtttttcttctactctacatgtaaataagtctgcatcctgtcagtatttaaggttttctttctttctaacaatcatgtaaggctggtattttttaaagtttccactcagaagactgtcttcctgacctgtaaagaaattaagtgtaaaaatgtatgcaattggactaaataatgaaaaagaggttgagaagagtgcaccgaaagaggtaaaaaaaggagactatgggccaaaggtatacaatagggaaaataaaagaagtttctagggcactgcagaaagacaatgtattctagtgattacctttattagactctattggatcaggagccagttcattaaacattaatggcaggggaatgccatccatatattataaatagccattaagttgagatagacagctctgcccagggtcagtatgaattaataaaaaaaactgaagctggcatttcagaatcataaaaagataggtttagtagaaaatattcaataagaaggaagaagaacagtatatattacactatttgtctgaagagcaaactgaaaatgagaacaaacttaacataaacctaaaaagacccttcatgaatgaaacacttatttctcgaaaatggatgtcacttacatttaagaatcgtaacagtacaatgtgtgacattggcaaatggtaaatgtaaagacaaatgaggtgtagacgttcagctagaaattagacaaaatgtgaatgcaaacaaaatatcctcactgaacacagttccaaacatagtatgtggcagcaggagaactgaagttattaacagataaggtctaatttccaatttatctattgagttaatcctgaaacctatcccacttgcctgtatttacaaggtaggtcatcttagttttaccatgagttttcactattttaagagagaaatcatgttatgaaacatggtactgataagatacttacataaagagctacacttttttaatttatttttctcactttctttgctaatttacacccattgtttctgagtaatctgaagaatgagacattcccatttttttatgtatcataatgtttctaagataacgcatggactttttaaagaatttcatggtagcaaatattatgactcaaagtcaatatgaccctggttaacaaaaatgatcaaaaactaggaaataaagctaacagtagtggtagcaatggtgtatgtggcgtgtctgttcaatactgtactagaattttgttccccaagcccactcaaggattatttaattctctaaaagaacatatctgtgtttggctttgctatatacattttgattattgtaccaccactgtcaagttataggttaacttgtagtttttgtctagtacgaaagaaccactgaagtttatggtttaattgtcctgtgggatactaatcagtcttgtataaaacctagtaattttattcaaatattctccctctccaactcctttttaacaaaatgtctagaagtacccaggtcctcaaaatgcccctggattgcactggtttcttcattaaagacatattaaatgttggtatatatttattctgtatttttattatagtcatattaacccttagaaagtagtatttttcactccaccaagcacctgtgtaagattttttaaaaaaataaacatttgccaatgttttgagaggtgaattaactcaagtaaggcataaccagtaatgccaaaaataggtttatgccccatgaattatctctccagtggtctgccagccacccataaaagtacatttttaagttatactatagaatgagtgagataaataaaatgaataatgaacggcagacttaaaaattatgacattttcttaatcttcataaagcctgtgatggatttttcacttgtctacttggctaaggtgaactacagtccctccccacttgttcaaacacagatctagatgctgctgtaaagagatttttcaggcataattacagtccctaatcagttgagtttaattttaggaaatcatcttgggtgggcctaacttaaccagtttgaacactttaaaagaagactgagaaagtcttgtacttggtgttggctgccagctgagatcttggctgagactgtcagctagaactctattttttaaattttattgtttaaattgacacacagtcgatgtacatagttttgaggtacatgtgataatgtaatacattcatattacttagcattgggatatccatcaccttaaatatttgtcttttctttatgctagatacatttcaattattttcttccatcaactagaactcttataactcacggctagccactccacgtgatttggcttctctcacagcatggctgttggattccaaagaaaagcatcccaggagagggtaagtgggtgtagagggggaggaagcaggggtggggagcacacaccaacatgcatgaggtgaatgctattcactccacctgcactgagtgcatcctactctattctctatcctagtttcaacagaaggaagagaaaacagactccacctcctgatagtgtatgacaagaatctggaacaccacaatgaactagaaatgcaggtgtggccacttttggaaaatgtaattatgccacaacaatctttgactatttttctattgtatcattttcataatggtttttagaaacttggaataaattagagtcattagccctatgtacataatatgagttgcaaatatttttccctcaaacaaatgtatttttgttattcttacgtatcttttatctcagaattctaagtcccttggaagtatgcaaattttattgaagggaattgaatttttaaaagaagcacttgtagaggacattttcaatattagtgctatcagttaagtaatttacagtaactcttatggtacccaatctttctctcacagtgatatttacaagtttaaacattttttatctcaaacagagtggcctctgaattttcctcctaacaaggagcttaatctactatagcaaccataatgaaaatgttatttaaaaatcagacaagagcaacagggaaagtcggtgtttgctatttaaattgtttttgtatcaatgggcttagaacactgtggagctatatcattttattcagttttctttcattttaatgtcactgaaaggtcaagcaataatccagagatcaatttaccatcccatgcacattgcttccctccaatttgggaatataaattcaaatgtaagatggtcttcacccaagctcttccctgcaaaaaaaagttaaggcctcagatatttttatatctacagagcagagaaggctttacttcaaataaatgctgttgcaattagcctgatgacccttcttttgccttttaatattttgatattagcaggttctacttttcctcctgatgccgaaaaaaccatgtcatgttaacaaattccttaaatgttgaactcagtcagatcatctataaaatgcaacaatatcatctccctacctatctgttaagtttattatgaagacaaagtaaaatttccatttttttttcagacagagtcttgctctgtcacccaggctggagtgcagtggcaagatcttgcctcactgcagcctctgcctcccaggttcaagcaattctcctgcctcagcctccccagtagctgggattacaggtgtgcgccaccacacccggctaatttttgtatttttagtagagacgggctttcaccatgttagccaggctggtctcaaactcctggcctcaggtgacctgctggcctcagcctcccaaagtgctgggattacaggcatgagccaccacacccagccaaaatttctgtctacttctgacattagactgctgagagtactacatatatgacagtttattagtattgcttttaatacttagaacactgtttgagacacatattaagtgcttaataaattttacctggtgtttttgtgatatgctttattttatttaagaatttaaggggatcaagtgtggaaagagaagacctaccatctcatcatcaagtattatgtgcatatagcatgagaggaagagagaagaaaaatggggagacaaagaaggaaaaggaaaagaaaggattcagggttctctgattatctctgtgcaggtaagctgagggaaactgcacacacttcatcagcaccagtgggttcccatccagcctctttcatttactactgatatgaccttgggaaagatacataacccctctgtatcagttatctattgctacttgacaaattaacccctaaaattcagggcttcaaaccaccataaatatttagtatcttatacaggttctgcaggtcatgaagtttgaagctgattagctgagtggttctgactcaaggtctctgggaaactggagtcacaacacccaccaggttgggaataatctgcagacttggctgaagctgaagcatccacctcaggttcacttacaaggctggaagttggcgctggctgttggaaagaaactttattccttgctagaggaagctctccataaagctgtttaagtgttctcacaaaatggtgactagcttttcccaaaatgagtaagattttatgacctagactctgaagacgcacactgttgctttcactgtattctactggtcaaagagataacataatacaaggtgggaggagatgtcactaggaggagaattttaaaaggtaaggatcactggaagccacctggaaggctggctaccgtgccctcaaagtctctgatccagcatctataaaatgagaataataatgacttctacctcacaatgttggtggaaagattaaatgacaccatgtattcaaagtgactgtggtccagcacttgctccacgaattgcaaacctccttaatcattctgttttctaggttctggcacagtgtgtgtgtgtgtgtgtgtgtgtgtgtgtgtgtgtgtggaggggggtgtgggtgtgtgcacgcacacatgcctgggtccatttggccacctgatgaagtctgtgtacaacttccaaaaatcatacttttaaaaaaaagtacataggattatgagaatacagattatactagaacatagccatgaaaatattttaaaatatatgtaatacactaatatttgtttctttattaagacattatacaatgaaacccaatggaagctttaacaactatatcttcaaaggaatgataagcacaaatgttttgggatacatataataactgaaatatgattagacagtatctgtgatttctattggtgagaaagtcacaagtactgccaatgccaccgtggtcttttgcctatattcacacttgaaagaaaggctaaaatctactcagaggttagtgtaagtgaagatatcatttttttaatccaagtttaaagttttcataaacactctccacaaacccaatggggttcaccggaccctggactaaacttaatttactttaaaagaaagaggaggaaagaagaataagaagaccattctagtatttaatattctctacaaataattttcttcctattaaatttcctactgtacacaggaacatctgttctccatggttctctcatttcaaaatgatcactcatttcattggacatatacctacataatactttcatttaaacatattttaatgaatctttagacctagataaatggatttacagaagtgctacattaaaaggccattttaagtttgggatcgaaaggacctttaatttatagctccagaaaatatccattccatggctcaaagatccttgtggattataaaagaggaaacgactaacagaaaaggaattattcaccacattattaaacatgacaaaaagcttctgaattggagcttaaaacgggctatttaagattccagcaatccctaggactttggcaacaaaaatgttcaaaagccttttatagttgctgtcagatttctgtaaagcatttgagattcctgtgaacttatttatataacaagctaaaacctgaagctgacttgaaagtctttctattctaattatgtagaaatggaaatgcctagaaatgatgttccgtgttctcccaagaatatcctcttgaaatggtggtttcagaaccgggtatttagaagaaggaatgagagtgtagctgctatggtttattacacggaaccattcagcagatatacaaactatagtttagcaaagtggcttcaaagaactgccatttagttattctctctgcagcagcacattctaaatgactgttcatattgttccctcctggcccactacagtggtttatttctgaagctctatagttcatgtgtaatcatgtagcaaagtaattcacgatataatgacccaccaggatctcagctgattgtggttcttatcacaatactgtttctgatgctatgcgtggctttccaaagccaactttttaacctcttatgcttcagcattccaatttgacaccaggcccctctgtgttccgagaagtcagcacataccctaagctagaaatgctaggagatattccaacagaaaaaataagatgggttttgggaaagagtactgtgcttgacagcttctaaaatggctcctaataagcccaccacctcctgctattcacacccttatgtaatcttctctcactttgaatgtgggctggacctagttatttccttttaacaaatagaaatgtgatttgtttataaatgactgtgacttcatccttttcaccctttctctgccctcttcctgcttgatgagacaaggcaagctgacctatggagagcctcatgtggcagagaactgagaccaacagtcaacaaccctagaagaactgagtcctgccaacaaccgtgtgagtgaatctggaagtggaatgtctctaatcctgacaataagatattgacaccaacagcagagatgttaaaacatgtagggtctcagaccttatcaaggaaaggtctagaaaaggaatatgaaaccatttttttctagttccaaagcctgtgcttcattcactgcattacactgtgtctccaaatgagtcctgttccaaatactgaattgggttttgcctgtttggaagttggaactcatttccctagagataaaatggcataactgaaattaacagagatctgacacaatagcagagaggggaagacagaggacttggggtgggagggctcacaaaggtggctgtgccaagaactcctgagtcttagcagtctgatccaggcagctcatgggggctggaggagtgaagtccaaaggctggactgagaaaatcacttcctgatttgagttagcttttacttgatactaggatctttgtggattaattaattaaaaatctccagatgagactaaagcggcctcattgtctgggatgataatcaggttcattgtctcacagctgaggaaatcaaggctgcagacacacaaggagtgaggttaaatggggaagtttaataggccaaagaaagagaatagctctctgctggggagaggggttctggaaaaatgggttgccggtccacagggaaatacagggggttttatagatacctggtgaggaggcagagtctgatttacatagggtgaaagactagttggaccaggtgtgccatttgtatagggcatgaaaaaccggttaggactaggtttgccatttgcataggatgcaaatttctggtcgcctccaccctaatcttttattatgctgtcacgtcctctatctgagctgtgccatgttgcccgtttctttactgtacatatggtaacaacaaaaaaagggaagatggagcctccatgtcggacatgcctgggccccaggtagcccttttctgttagcacagctgccagcattcccctgtgcaagcttccagcttgcttatttatgttttcagctcgatttttcaggctgctctttggtaggaaaaaaataatttcttgggatgcttttcattagaaagaaaattctgctgagaactcttttacccttactatctgcttaaataatttctttccacttcctgtgtcaaaattatccatatttagagtgagccttaaatccaatgactggtatctttatgagagaaaggactgggagatttgggcacagtgacccagaggaaaagatcacatggaaagagaggaaagattggagccagagtgccacagcctaggaatatcaggagccactagaagctcgaagaggcaaggaagtatgctcccctgaagacttcccatggagtctggccctgtccatatcttgatttcagatttttggcctccagaactgtgagatgatagattccggtgatttttaagccaccaagtttgtgataatttggcacagcagcccttagaaatgactaccaacaccagtgatactaatattcaactagacgtgagagccaccacttgaagctgtggcgccaaccttgccaggtgaactgttattgagctcaaggtagggcccaggtggaaatcactagcaatgagaacaccagctgcaataatcaccagaaaaccaccttcatcttcaaaacaaaatattaaaaacccactgtgttaaaaagtctttttttaagcaaggctgttgtgagacgcttcgaaatagttgaatataaaccaagacctatattatactgtagtcggatatcatctcaggattagcatactgtgagcaaatcctcaacacgttgggagttccccttccccttccagataaaagttgaaaagcctgagaaaatcaggggtgtcctcctaacttggatgttagctgccgtccatttctcttgaggttttcctttctttctttaacttttacaaccaaatatttatagttagtcctgctctaagaaagccttagaagccaggataagagcatataatactcagaacaaaactgtgtgaaacagccatattattctatctgtgacttgataattagatgtaactaaattgccggccaagatatcccatacccaagcaattatagacaccaactaacgaagacaggaaatcaaagaatgaaagctgaatgccatcagtggacatatcagaaaacatcaagaaaagctttctatgaagaaaaaaagtgtgcaactcttttaaagaaagcctagtcataaaatgaaattgaaatgtgtatttttttgttttattggctttatttcaaatggctattattaaatccctgatagtcaattaaaaaacattcaccaaactagaaatctgctgaagtatacatgtataagcatgcctaaatatattacaaactattgaattgaaacattaaaacattctccatagcaacactaaatcaaactgatatttcattttggttcccctgatgccaatacatatagtacattaaacccacagctttcagagcataaaaatgtctttgaaaacatacgtaatctagagatgatgttcaaatatagtataatatacaccttggtttatagttattatttctttcccaagattacatttctatgagaaagaagaggagcctaaatatgatatagggtcattaattttaatgatgaaaacagaaattttgactttgccagttctgaccattggggaatctgtgcccatagtaatagattactcatgtcttacttgcacttttcccaaaaatctcaagtcaaagaccacagaatttatacgctagaaaatataagaaaaaagggcacagaagctaaacaagaaaagaagaggaaaaatattccagttatggcttcaaagtcactaatttccatggaaggagattaagcgtatactttatcgaccttctctgccagcaaacaacgttttattcatgtcacttaatggggaaggaggtcaggtacagatctgaaggtcacctaactatatgctttcttccacagtattatagggcatagggaaagagcctaaaatatgcctgctggttggaattgaaaatgaaacggtcccttgtttaatgccataaaaagtatcctgagaaagtgtagctcttaggcttttcctctccgaggatttagggaaaatcaacagtgcccactggacaaaaccactttagataaagaggaatggcaaatttaagggctcacaaaatgtacttaaaagtttagaaattgggctttcaaattataccagtcaagttttacatgaattaagtcctattttgagctaggatgcatcattatgggaggtaaaccaaaatcttaaaaaatatattagtttagaatgagaactgtgcctcaggaggtgccatggaattcactaggaggtaaacctactgcaaattacattttaaaaagcaatctcagcaatatattcttctctaaaaccacaaattcattttgaatcaatatttgttatgagtccttttcaacatttttccaggagcaacacagcactgtgtcttcaggggtcgaagagggaatctacaggacttaaaaaagcatagggagtgaatatggggtcatagcttctgtcattgttgaaaagagatgccagtaagttctatgcattaaaacagaccacgcaaagcacatctgatggaataagataaataacataacagattcactcttgcatgtccaagcgtacttctgagatggtgaaatgcatttgatgcactgaaacatgaaaccatcaaaatctacagctggaagggacctcagagatgaatcatttgaaagccctccagaggaacccaggttccaggaaatatgaagaacgtgaccaaggtcacaagttagctggcagcagaacttgcaccagaatactgatctaattttattatatacacttttagtttctaaacaccaagaggcatgaatttacaaacaatgagtacagccacatgctgtgcctaaaataacaattacaaaagtaaacctacagcctcagttaaattacttacctgtgtttttcccccaccatacagaacattaccattcgcacaaaggtccctcatgttgcccctttctggccacattaatttgctcccgccctcactcctctaaccatccttaatcactgccaaccactcatctgttctccatttctatacttttgtcattttaaggatgttatataaatggaatcatacaacatataaccttttgaaattggctttttacgctcagtgaagttctctggagattaagctgtatgtatcaatagttcatctgaatgcagaatagcctccgtggtatggatgtaccacagttcatttaactattcacctgcagaaggacatctggattgcttctagtttttggccattatgaataaagctgctaggaacatttgtgtaacggtttttgtgtggatccaagtttttgtgtttcttggataaatgaccatgatcacaaatgctgggttgtctcagtccgcttgtgtcgctataaaggaatacatgagtagccaggtcagtggcacaggcctgtagtcccagctactcagaaggctgaggtgaaaagatctgttgagcccaggagtttgaggctacagtgggctatgattacacctgtgaatagccactgcactccaccctgggcaacacagaaaaagaaatctcttaaaaaatagatataaaggaagacctgaaactgggtaacttacaaagaaaaaaggtttatttggctcacggttctgcagggtttacaagcagcatgatgctaacatctgcttctgatgagaacctcaggaagctcccactcatagctgaaggagaaggggagccagcatgtagagatcacatacatggcgagacaggaagcaagagagagggtaaaggtgccaggtagtttttgagcaaccagctctcagggaaatgctccaggaactaagagtgagaagttgctcattgctacccggacagcactaagccattcatgagggatctgccaccatgacccaaacacctcccattaggccccatctctaacagtggggatcaaattttgacgtgaggattggaggctattcaaactgtagtaggttgtaaggcagttatatgtttagtttttaagaaactactaaactgtctatcaagcgtgactgtatcattttacattcttaccagcaaagatgcaaaagcagtttaatagagaaaggatagcttttccaacaaatggtgctaacgcagctgggcatacataggaaggagggtgatatggtttggctgtgtccccacccaaatctcatcttgaattgtagctcccatgattcccacgtgttgtgggagggaccaggtgggagataattaaatcacgggggtagtttccctcatactgttcttgtgatagtgaagaagtctcacaagatctgatggttttataaggagtttcccctttcgcttggctcattctttctcacctcctttcatgtaagatgtgcctttcaccttctgccatgattgtgtggcctccccagccacgtggaactgtgagtccattaaacctctttttctttataaattaccaatcttcggtatgttcttatcagcagtgtgaaatggactaatatagaggggaaggggggaaggaggaggggaaagaagaggaggaacagggaagcaagaagaactttcacataaacctcacaacttgaataaaaatcaacacgaaaggaatcattttccccgcatcttcaccagcatttagtgttgtcaccacttgtcactctcatagatgtgcagcgatatctcaacgtggttttatttagcattttccttagagttaatgatgtagaacatctttttgtgtgtttatcagttaaatggctgtccatgtcttttgcccattttccaaatggtttgtcttttttgttgttgttgagttttgcgagttcattataaatgttagataatagccctgttttggatatgtggttttcaaatatttactcccagtctgcagcttgtctttttagcctcttagcagagtctttcagagagaaattttttaaattttgaagttaaactaatcaatttttccttttatggctcatgcatttgatgccaagtccaagaaccctttgcctagacatagatcccaatgactttttcctctgctagtttctaaaagttttattttctaaaagtgttacattaatgttcatgagacattttgaatgaattttgtgcaaggtgtgaggtataggttaattttttttcctaactgtacaatttgttgaaaagtctattctttctctaactgaattgcttttttatttttgcaaaaaaaaaaaaaaaaagaccagtgggcatatttgtgtaggtctgtttctgggttctctattctgttgcatttatctatgtgtctatacttctgtcaatgacacatggtcatataaatattacaagtatgtaagtcttgaaactggatgatagactaattcctaccaccttattctttttcaaatctgttttagctattctagttcctgtgcctttacatatgaatttcaggataatcttgtctatatctactaaaaattgttgctgatattttcataagaattatattaaaactctgtatcaacttgggagaactgacatatttactatgatgaatcttctaacctgtgagaatatgtctctccatttattgagatcatctttgctttctctcatcagcattctgtagttttcaccatacaaattctatacattttttgatagattttcatgtatttatttttgtgtgtgtgtaaaaggtgctgtattttttatttggtatctatctgttgattgctaatataaataaacatagttggtttctatatgctggtctaatatcctggggcctttctgaactcatctattatttctaggattttttaaaaagattccttagacttttctaggtatgacttacaaggaagtcacctgcaaaaaaaaggctagttttactgcttcctttctaatctgtatgtcttttatttcctttccttggctcactgtgctggcaagatcaataatgaaagtattaaaagtatcagaacttgcgtagggggcataaaatactaaagtgttttcctactctcacacactactcaacacttctcacaccagattctccaacagacgctaactgggtatcctagaattcaattcagttcacacattatctacccagagatattgtcagatccaacaggttaggggttcagtcccacaagacagctcccactttggatgtcagttgtgtaccccaggctgtgaagtgtggttctgactggccagctataaatcaggattcctacaacctcctcttcatgttcaagaaatttggtagagtggctcacaggactcagggaaatgctttacttatgcagatatacaaccagatggaagagatggagaggacaaggtatgtgggaaggagtgtagaccttccctctctgggaaggtgccctctctacgagcaccaccctccaggcatcatcacacgttctgtaagctggaaggtctccaaatcctgtccttttcaggtgtttatgaagcttcatttcttatgcatgattgattacagcattggctactgatgatcatccagaccttcagaccctctcccctccctagagtcaggagataaggctcaaagttctgatgcttataccacatagttggttctcctagcaaccagtccccattctgaggctatctaggggccccagccaccagttatcatattagcattaaaaaacactcttatctccagagatttcacaagttttaggaattgtgcacccggaaccaggggcagaggccaaatatgtttattatatcaaaatatcacaaaagtattcgatcttccaacactgtgttgaatagtagcggtgagagtcaccatctttgactttttcccaaccgtaaagaaaagcattcagtctttcaatgttaagtatgttacttttttgcagatattctttatcaatttgaaaacattctcttccttttatagtgttctgtttttatcacaaagtggtattaaatttcaccacatgctttttctgtgggaattgatatgatcatgtcatttttctttcttagcctgctaatgtgtatgaaattagataatttaaacttaaaataagtcaacttaaagctgttagagctttaaatcattctgaaccttgagaggtggctctgcagcctgagtcaagtggcatgcagctgcaacttctggcttttttcttgtaaataattaagaagaccaagcagtgccagggacaggaccccctcagatcattaccctttctcacagagtaataaagtaatcttcctttgaatgtagcaatccataaccaatcaaattactgtggcatgtgcactggtcttgcatggaaaatgttgtaatcctgctggaacttctctgtccctgcctatgtaaatgaaacctcaacagcaccaaattgggctgctgatccatttgtgtagagtcagccgtgacgatcctcaagctctgcactaggataaactccacatttaatcgtattctttgaacctcattatttacggttgacatgcggtagattccattgctgattttcaaataaaccctacttgatcatgatgtatacttctctttatacattgctgaattcaatttgctaacattttgttaagaaattttgacatctctgtctatgaaggatgttggtctgcagggtttttcctactattttcatttggggcaatacaacttcaaaaattaaaaaataaatgaatattcttccttcatctgagagtgtcttgatttccctttcatatttgaaagacattttcactagacatagaattctaagttgacagttattttctttcagtatggaaaaaatatgatgccacttttgcctgcctgggaaacattggctttattactactgggcaggggagaaagtcctaattgtctataatgcctcttctggtatcacccctgagtggaggaaaaggtacttctctactgttggtagaggtgaaaatccaggctccccatgtggactcgttaccacccactggatatgagaattctggctctctacttggctttctgtaataccaacctgacaaggaggctggagtggctcattacatcccagtgacgatagtagttttggctcccacttggcctttgctgttggaggtaggagtaggtaggccacacgtttttcaatgtgtgtatgtgtggtgtttagctggagtagtacagatattatctaaaaattttctctatattgctagactgcccctttcccagtccttcacctacagtgagcaggctttcgctgtaacctttccttttgtctgtgccctctgtcagctaagggttactagcttctttagttccagggctgggatagctaaggcaaaaacaacgtctagggaattcactaccatattgtttcttgtgtctccaggtctctagctgatctgacttctctccacctctcagaatatttttagttttgtcttatatacaatattcaggattttttacttgtcctaaatgagaggaagaggaaaaagtacacctttttcctagaagtgaaagtccccttgttttactttttcaaaaaaactaaaatctttctcttgactgttatcacaacagatcctatcaaagaagagaaattaagaccaaaaaaagtgtaactgagggatagtaagagaatattcacagctttacttgagaagaaaaaaggaagggttacaaagtggggaggattagagtcaaaagactcaagttctaatggaaagatggtcagctactagccttgcatctctaaatatcacttaaatattcaggcagccccatattttgttttgttttgttttttcctgtaagatggggatgatatcaccgaggtgcccttccacagttgtggtcgtataagatgagataggaaatgggatggtgctttgtcaattttcagtcaagatataaataaagggcatgttattgcactccgatgataaactccctgcctacttcccacttgctccaacaaaacccagttgtttccagtttgtcctgtgtttcagcattgatccagcaactattgatccatgtgcacaaactagaaatatgggaggcattttggatacctctgactccccctattccccaccagtcaaaataagaatatcacagtcctgatgttctccttccagatagctctcagatccatctgcttcactccatcagccctagatccagcccccattctcttttacctgtactgtaatagtcatctcccaagtttccctgcttccaaactcatctctaaaaagcagctagatcatctttcaagcacccaaagcatctctcccgagtccattctagattcccccggatccctagagttcccatttgggcttcccgtttctcaggagacttatctgttcatttatttaaaaaactgaaacggttttctcttatttatcctaaaataaaattttgacctgaaagtatgattttaaaacactttaatacctttatagtcaacaagtaaataatatttcataataggaaaataattatgtgacatgtcatattggcattgcttcataaggtcaagggaaaagctggacatataaactagagatagtgtgtttcaccatagccttatgtacgtattactaaagaatgaaaacatcagccataacttgcaaatctgcattatgactcatgaaacaagtacactgtatctcgccaagctataattactgactaaacctaaacttctttatcacaaactcattcagcctcatgtgctcaacccatacacataaactctgttctagaaactgcctagttgatcaattctgacccagatctactaggaccatttcatggctagttctagctcccaaaaccttctcctacccttctccagttccttttgacataccccccagtttccctggtgttggttcacctttgcaacagcaagctcataacatgacttagaatctaaaaattgttctgatactctttaacgggttttagcaaaataagtgattaggataaacattgaaaattttacacctaattttaacagttactaatattacttctagttagaggagaaggactacagagtagggagcagggtgtagaagcacagattactcttatttttctgtaaggactgaagttcaaacaataaaaatgcactcatacatttcctcagaaattttaaaaacacacattaaatgctaaatatacatcctgtcaattaaaaactgtaagagtaaccttataaaaggaaaaaaaagtttgctctcgggagatgattaaatacccatattgactaaatatatttaaagtggttatgattcaatgtcagactaatatttttgcctctactttaattgctttttaaaaagaagtatcaggaggttccaattagaaatttaactgaaggccactttgaatcaatatgctgtgggaattaaatgatgctgtttttatgttttcctttttgaagatattggtcattctttttttaaatttttatctctaagagttcaaggaaagcttggtttttattggtaaggcaagaaatgcagcttctgactaaatgtttatatcttcagtgtgggatgcccttctccctttctctcctcctggcatatttaatcaacagaatattcacagatcttttacctcctacaacaggcctactccaaccctgcataatttctcctatcttagggcctctgacatttatcccgaaaaagacaactaaatacttgattctatgttttaccatatttcttttcttcctccacatctcactttttatttttagaaaatgcctctaatgcaatttagtgatcatcacagtgcctaggacattgcttggaactaaataactatttaaaagaaaaaacaaatatggttgattagtataagcaactactttgcagaactttgaaatgtgacttcccatttcaaaggttgtctttcgtattccccagtcttccaacaatcatatttcactgacgtctaacacatatacctgatttgagaatattctgaggctgagctcctttatcaaagttaattggtagaaagtgtcactcaccagaaaattccatctaattgaaaactggactgaaatggctaggctcaaatgggggctgatctaaatttctcatcaagcatcactttaaggtatcttagacaagactgccttgagctgtaaaaagctttgatgccatcagccttacaccaggatcaaaatcaattttcaacttttattgaaagctttgttaataagtttctcccctgttcgtcacagttatgaaaaacctttaatatttttgttgcatgggaataaagctaggaaggatgtaaatttcagacaaattggaggtacattttaaaaatattgtcatcgagactgacaactgccaaacctggaaaccactttctcccacatcaaacacaccctgaagtaatggtgaattcaaattgatatgcaagcctgtgacagaggctatcagaagaaactatttcttttcacctctaaaatacaattcactaagcatgacatccaaattcctattgtcataggcattttcactggtttagaagaagactgcaggacggctaatgtgttttcgttctcagataaggctaatgggtttcagctctcttgccagtttgattgccaaatgctgcctgtgacacagtaaagaattttgaagttgctcatggactttgtggaggagagtaacacagtctatcagcaacatttaccagtatggcaaagcagcattcactaatgaatctgagccctctcccgttgctggacccatggaagaccatttccagagccttcagtgcagctggacagggccacatgaccagttctgtcccacaggctgtgatcagtgttgatgtgtgccgcttcacagcccatatgtgattttctatgcttctcatccctgaagccttgagataaaggtgccataagacagcagtagacaatcgtgctgagccaccccttggaggtgagctgtcctggagcatcacctagaacctccgcaggctttgcaaggatgagaaatactcccagttggttaagccactgtgattttcatattgtttgttattgcattataacccaacccactctgacttctacacacagctctcagatgagggactggagacaggagtgcccagcacttagaggattacagattaatagtaaggaacactggttcctcttacatttaagacacccacaacatcatgatgcatttccctccaatgagatgggaattcttgtacccttgcacagcttgctttcattttgatgactactaattgtgacctgcaccttggctcttgcttgtctcctttattccttctctccttctttacgtagacacacagatgttctagagcatgcctgatatatcacactaatacatttattaagtatccctttgaaaagcaaaatgaaacattacaatttctgtggctcttttaaatgcctgtgaacacactagcacattacatttttaagtatttcagtcaaggggtcacttgggttagcctacattttggcaagtaaatcaacaattgctgccaattgcatcagaaagattcctttacttttagcagatctctaccaggagaaaaggagcaaatgtattggcttattggagcaaatgaccaccacacctcaggaacaaaagcttatactttcacattgcttactagatgccaggaaacactctatgagctttactggtatcaatgaatttaatcctcccaacaaccttagaggtcatggccacatttactcctattttacagatgagacaagtgtgtgagtttacatgcttacaaaaagcacttatcttttatcatcataaaatagagtttttagataaaacataggataagcagttaatctttagataaataataaaacagttttagtatatgtgccatatattgcatgggacatacttattctaaactgttttttacatttatctgaaattcaaattcagctgggtccctgtactcctatttgctaactctgggaactctaaattagaagctggatttaaaatttcatcaattctcagtatctaactttattaagcaaccaagctaagctgattgtacatctctatcaaacaaagttaaagacaagtttttattaaaatctctgaatctaatctactataaaaataaaatgccaagaagatttttactacaaaaatttgcttttgctttcctactacccagtctgtggcaattgagaaggatacagacattgaatgtagattctgtccgttgtcacattttatatctaaattggtgaaaatcctaccactcgtgtctgtaagccattcactttgtttggattgggggctggggtttgcaagaaaacacagaatattcctttttgttctttttttttaaacttttataacatgggacctgttaagacagaagcatgaatattctaggtcaggcagagatgaaaggacataataaataggaaacactgctctcccaatgtatcctgaagaagtccttgtcaatcatttccagtaaagtgaataaaaaatgcttaccatggcaagagcatacactgagtttgatgtagtggggacaaatcataaaataggtgtagggtgaggccaaattttaaaatctaaggtaccttggaataatatacttccagagattctcaataacagcattttaaattcttcttctctcttccaggttctgtttcatgcagggccatgagttactgccaacaagttaatatctactctcggctgttgattcaacccaaacactgtgcatctccaatctccatccatcaagggcttcaaaacaatgtgtttatctttctacttgttgtgaatattaataaattaagatctttaaactgtctaggaagaagtaagaaataactgccaagagcttgggtacagatgaggtatttacatacattagagaagtaccattaacagtaagtaatggtgcttttacattctcagaatgcagtgcaatagactgtcgatttgttttgaaggtgtctgcagtcataacacgtatctcatgctaaatggatacttagcaatttttaataattttaaactgatgtgctatttaatggtttggtgataacgcacagttttatgaagacggtttttgaatttggaatttttattgaacttgattaaatttaatgagactgcatcacttacattctaccttaattcttaatgtttataaaggtcacaacaactaattttaaaagttgtattttagaaaagcaaattctgtcagttaatgactatacaatttaaaccataattccaagattttctaaagctagcctacatgtagtactgtggtatgtcttcatgaggggtattaaagcgtaaaagtctaagacatatcactgttgtgaaggaaaacaaataggagaattttattaactccagattcttttgactttgtctgacttttgattagaactagagtacgcaaaactcagcagactatggtaaagaggatttacgtcaactcaacttcccaagaagttaaaattaaaaacatatctcccctaagtcaatacatcccgcattatttcactggtgactttagtcccaatttgtttgaggaaactaaaggtaaaagagaaaacaaatttgctttgaaggagtcaaggctatgtggaatagaaatctctgcaaaaatacttaacccagtctgtagcctttccatgaagcaaagaaaacgtaaaacagattttggggcattctgacacgaattactaagatatcacttatatgcctgtttttagactgagaggctcctcaattcctttttctttctgtctgcgtcatttccatcaggaacaactgttcaacccttacttgtagatcttcataatgattcttgacaatacacgtgcaaaattaaaatgggtctctttgcactgcttgcagtatggcaagagagtttacaaggcaataattctaaatataaaataaaaaacaaacacattacatgattttacaaatttaagggaatgtgtagaaggagtactaatcacacttggcatgtttaaaaatacacttggtgctcgtcagtgctcaaagagtacagtcatatcgtttgaattatcaataataataaaatcatggaggattgatcgtgagagtgttttccttcatcttagccacagtaataagacctctatgctgcacttcttttataattaggcaaaaatctgacagaaatcctgtgaaggcagaggtagttatttctgtgtattctttagacttccacattaagaaaaccatgcccccttttgacatgactatctctttcttccccacacaacaaaactgagaacataaaattatggacacaactgggcagctaaatgcagacacgctgactgcaataaggctctcatctcacagaggaggaggcagtacagcactctgtctccagtaaaacatctcctcaaaaacttcaaactttcttaacatctacagagaagtcttaacagaaaagtcagtaaattcgcctgccacacaccatcttgtcatttgacctttgatttctatagttcagcactccctaattccaatagacaagattcaaagaaatgtctgtaatacttcatctgcccgaaggaagacagtgagataatatccacacaagtcttgaacttttaaaatccattctcactgatacaggggaatatgaactggaagaaggattgaatgccatgcttgagtttttaccatcaaataaaatcttcagtgtgttgtttgacaatgatatttactttgagtgtgttttaaaaaatgacacctgctacaaatatcatggatctgtatatccttgatgtctcacaggtcataaaacagcaagggcaaatattttatgagctacattgcattgttgttttgttcccaggaaaagaggtattttctcaaatactaagagaccagtctattcctggggtcagctgaagccagtgttgaccctggacaaacactgggagagagctgtttccctactatgatgatccctggagctcagatgctgtctgtgcccagaccctcaaggcaaccatggccaaggtagagaaggtgaggacactgctctgagacacatgtggttcggcacacacgtgtactgtgataattgttgctaatgatgctgacagtagccaacatttaccaagggatcactatgcagtgagcactgtgcacagtgccttatgtgctgactcactgaatcctcataatgtcatttggaggtaagtactatcagcaacactacttcgcagataagaggaaaacaacggacagtaatcgtgctgcacagcagcaatcttgggagttgaacttgataaatccatgcatttattaagctcaagtcacccatataaggagtcagacttcagtcagtctcagctccacctttactataaccttggccaagttacttaacctcacaaagcctcagtttcttcatttgtcacatatggatgacagtattacttgccttacagaaaagtcatctcaaacttggaaagaggcgattgagcttactgcattccttcagtgtagagttcccactattgggcctgactttctgtttacagggttaactgacaactctcaggagagggaataattagtatgggctgttacagaccaggaggacatcatcctttctgtatctaacccaacactctaccaaattgcacgtataggtataggtataggtgtatgtgtatatatatatatatatatatatatatatatatgcctctcaaatgctctttggactgactttaacgttacattgggtccccccccaacaattagtgagctgaacaaaatcttgatgtgttcattttatatttgcatgagagcatgaatttgcctttctgccaactgtctgaacacaacattgttttaagaattgagataatgcatatgaaatgttcagcataggacctgggttaccgatgattcactaaatgtcatctatcacatcactcctataatcatctctataactgatcaccaaaagtatactatttaaaacttttaatgtgaggaatggttgtttctatttactcatattcaaatacaaacagagagtatttaatcactaactgtgagaatagctctgaaattatatactgttatccacagctggggccactttaaaatctggcctagagagtgattatctcacacatcacacacccagtacgaaaatggagtttttaagatatccactttctaggctgcttggagccttagtgccgtcacctctggtaaacaggattcattagagtgataattgacagttgtttccctttctaagtgattgctctgtagttccattatgttctgtcagggaagtgctagcaattaattaccaataaactaaacaccagctctgcttgcagcggaaggtttggaaccatttatcttgggggttgagggaggtgtttgggagaggggaaaatccacctcaccaaatacataaagtgctgtgtaaaaaccttattacaagggtgggtggggatggttagaggctctgggaggacaagagacccccatttccacttctgacactttggtatattaaaagaaaaaaacctcaaaccagtggtccaaaaagtatggtccattttaacataggctactttgaacactaaaaaaaatacactgcagaatgattatgacagtcccaagatgacgacaaaactttttgtttaagccaaaagcatagcaaggaaatactcaagtggtgtgacagaggactttttaccttctattaaagattttctgtgcattccttctactggaaataatatataaactccaaattgaggctttttgtgaaaccctgagatccaagggtttgagcttcctctcctcagtaagccaacagactctgaggtcagattcttctgcaaaccatctgagatcctataccatagttgcttgcttcctttcctgtttaactttttttttcaatatagaaccatgtggtggctttttatatagatcctggggatacatcctcgcagctctccaacttcctctatcagctcaagtcgctcccacagccacaatggtctctgggttccctagattctcactacatattacttactataatttttaaaatatacttaatcacacgtgctttcagtccacttcacattcgagtgtctcatttcataagactgtagctccttgaggacaaggacacgtcttcacagggtaattaacaattactgagcacctgcctgctgtctggaatcaggtcatgcaggcagagcaggcaggcaagaaagcaagtaaacaaaggcaacctttatttacttctcccacatttctctgccgtgggaaaggcaagtcaaagctgaaagaaaaaccaaaatggatttcatggatttcaggtctccacagagcccatgacctgttatttgaaggcttttgacccaccagtatgtccaaacatctgttgacatctgcctctctgttctgtggtgtttttcaagggatgctaggtgttcttcaaggtcaaaagggaatggtgctctcttaaagaaactggtgctgaaaagaataagggtttagttacctggggcaagaagtagaacaagaattgggtggaggtcaagaaaagcctaaggccaagtgagaaagaccaacagaagcaaaggagacagacaatcaatgataaatttcccccaccctaggcctaggggtcagtactgataaaagaggaacagaccaaaaaggcacaggtgcaggaggtgaccagtccaagcctctccagttggcttctgagagagctaacagctactggggaaaactggagcctccagtccaacctaacctggccttaaaaggcacaacccccaagacaaaagcactctacgtattcctgaaacacacaaggacacagattagaggaaagaaagaaaacaaagggctcatttacaaatgaaatttgtaattgaaattattttgaaatttatttcaaacttatctacatggtccaagaattagatgagtacaggggacaactgtgtatgccccagattcactggttattatatttttccccatctgcctatcatttgtgcactttcttgcttgctttctctctgtatacacactattttttcctgcttcctttgaaaataaattgcatttagcgcatacttcttaaaactaaaactaaagatattcttttccaccccagtacagttactaatttcagtaaatggagcattggtacaatattatatccagtccactgtcttctgtttctcaattttgtcaattaacccaacgtcatcccttttggcatcttcccctctttaatataaaatccagtataggatcttatttagtgttcctaactcttaagtctcctttaacctcaaacattactttgtctttctgttttcttttttaacagtacacctccatgccccaaacccctctaccccaacgtgtgtgtgtgtgtgtgtgtttcattttgtttaaatagaactattcctcatttgggggttctctgctgtgtccttgagtttagattcaggttgtatattctggacccaagtaccatattggttatgcttctcagggtactgcatcaggagacacacacatatctctttgctcatgaatggtgatgtgaattctgatcacaggtcaagatgttgtctggtttcttcactatatggctactgtgtttttccaaacacaagactgcttaatattctgagtgtatattaggcaggcaaagaatctagctcattatattttagttatacactaacaaagtacgcacatttataaaagcttacagttgtattttgtttgtctaaaataatgacacattaggaccaatgcataattgctcactctgtgttgtctaccattctgagctataagcttttattatgcaaaggctgtggtttgtgagctatcatttgtatgggctccttcaggccctctcaataaaatgacacatacaacaaccaataaacatgcccttttcttaaacatggtcggggtggactttcacatttcatagagcatctcagggctgttcaagctaacagatatttgaaatcaattagtccaacccacacatttttacagttgagaaaatcaagacctaaggaagaaaaaaacgacttgcctaaggtaatacagtataatagttctttataaactgaattataaaatcaatttagtgggccgtgaccagcatgttttaaactgaaatacaatttttaaaaaaatctgagtacttagcatacagcaagggtaaacactgtttggtgaaacctttaattatatatgtgtaggagtatagatgctctcctgtactaatgggataaaaaaatcttttttttaagatgggggtagcccaggctggagtgcagtggcatggtcatagctcactataacctcaaacacctgggctcaagcaatcctcctgccttagcctcctgagtaactagaattataggcatacaccatcatgcctggctgattttttttaaaaatttttttgtacagacaaggtctcactatgttgcctaggctggtctcgaactcctgagcacaagtgatcctccttgccttggccccccaaagtgccaggaccttagccatgagccacctcacccagccacaaaatgtatttcttactgaattctgtggttaaaatcctttaaagaactccattagaactaacccaaaaccagtggtcattctaccaggaaagtgtttttgcaaagtttagtgtgaaaacaaataaaggttgaaatgcagcttctgatttaacagttctggtatggacctgagattctgcatttccaataggttcctaggggagatctaagctgctcctgccagcctatcaactacctttgagaagtatgattaaaaaacactgcatctgagggaggacctactttatttttaacaacgcctccctgaagtaggtactatgtatatacatacgtatatacacacacacaatttttttgctaacaatttgaataggaacaactaattcttgaaaatgtttaaaaataacaaaacaaaaccttccacaaagaatcacctcaattcactacagagaaaatgtgctaattgtgatggtaataagagcgctggtatttactggtgttcacaatgacacgcatgagaccgagtgcatccataacccagttgattcaggttgatatgatttcccccagattacagatgaagaaacagacccaaattagtttattttctccaaggtcatcttgcttgagagtggagggacacagattagcatccagccaattaattcctaaggccatactcctatcatactcactgactcacagatgtatgttatccacacacctatgcacatgctctaaacattacatatgatataaatacatatttagatacgtgcattagcaccttggcatacacttttataaacactctacaatattcaggagtcagggatcacaagaggaaactaatatgtaaaaacccagttctctaaaattaggtgccttctcaagtaggtcaagcaaccgcatttatattgtctacattaaagggatctcttgaaaacagtcacattagcagaatacaggggctgagtgagcaggctggcaggggaggagtgtgagcaggctaacgactagagctacaaacaagattccatcacctataacttagatttcatgtggtatatttagttcaaaccctgtcactttatacaaataggttgtcacgtaaagtgcaaacaactctcttttgacaaagtgatactgctgtggtgctgggttgatggctttatattccacaaagctttttaagtgacaaatgatagctgagtcttgaaaatatggtgatatgaaatgactgcataaatcctttcaggcttcccggggggagcaaaagcatagcattttgcacattaattaaaaaagaaaatctgagaggatgaggttagatctttctaatcttgactctgtgcaaacggactttgaagttactggcacaaaattgagagatggccccagaaaagtcttcaaatgagatgtacaatgttgtttaaagatcaggctcaagtgctgctcttggcccaaatgaggccaggcaagggtgcaataattatctctgctagagactgttggtgcactggcgttgaaatcttttgatatgttggataatgcagattttgtgtgcacacattgctttcccaagctgtctacatcagtgtcatgttcaaatgaagccgaatagtttaaaaggctcgctttcacactggctttatttagcttgcataaacattttcccttcaatctcatataaagtcttgctgcgtaaatgcagctgtcctgctcttgtgtcttaatacagatctttacaaagaggcctgttgggcaacatatttctggtagatgattaataagagatataggatttcttttaaaaaaaatcatgctctgactacagagggcaaattcattacccataaatcaaaaggagtaagggatttcagtagtatcagaagccttatctggcttcaatctgacagttaactgtaggccgtgaatgattaaataaaagtctaagttcacccgagcctggataaaataaaactcaaagcccagaaacttcaaataaaataagaaaaaatcataatttttcacctcaaaaggaaactgagaagagaagtatgatgtgacagaaactatgatttcaaatggagggtttcttttgttgtttgtttttcagaactagactcacattttacaaaaggctccctacccataaggaagaaagttttgagagtaatgaggttgatctgaactgttaaaaactttctaactgagatatagcaacatatggtgtggcagaataaaaatggccacaaaatctttaacattccttccatccagaagtgaggggtctatgttccttctccctgagtaaggtggggccactgagtattttcactaagagaattcagcagaggctgggtgcggtggctcatgcctgtaatcccagcactttaggaggccaatgcagcaggatcactcgagtcccaagttcaagaatagcctgggcaacacagtgagagcctgtctctattttaaaatttaaaataataataataaaagaattcagcagaacttactatgcccaggcctcaagaaactggcatttctcttcaaacactagctttcaaatcctgaattgctctaagataagaagtctgccaccctgaggctaccatattatgaggaagcccaagacagcatgtggcgagagaaagggaaagatgcccacccaacctccagctatctgagtcatcccagctgaggctccagacattaatgaactgcagtaagctattcatcctaatgccctgtgggaatctctcacccacaaccttgggagacataataataataaattgtcttcagctattgtgttatggagtagtttgttacacagcaacagatagccagaacatacaataaaatgggctaatcttaagtgtatagctctgctcttttgcatatgtatacacacgagtaaccaccacctaggtcataagacatgtttccagaagcctctctctgaccctacccagacatttccctcaataaacatccccatcctacccccacacaaataagaaaccagtatcctagcttctattatgatagacaagttttgtcagttcttgaatttcatgtgtaggaaatcacatagaaggtacgctctagcatccagcttcttccgttcaacatactatctgtgaaattcatcactgctgctgcacagggcagtagatggtatgttttcattgctctgaagtgttgcattttgtaagtatactacaattatccattctgctgctgctgatggatatttggttgcttccagtttggggcttttatgaataaagctgttatgaacattctcatacatcttcctggtggacaaatgcactcatttctcttgggtatatacctagaagtaaagttgctggatcgcagggcagtgcactcatttggtaaagtattagttcatattccaactactcaaagaattgctcatctgggccacgttatcattgttttctcccctataactagcaaatattgaggcaaaatcatgctgcattaaattaagcaatttatgatttgtccttccatattgacctttcctgactaactacacaatagtattgttctcaatgatgtctactgtcatgaacatgacattgttcttggaaaaatcctatcaggcaaagtcaacctctaaaatagcattgtaataaatatgcagaaatgtcactttttgcattagcccaaaggttttgtatagcttaaggatacatgcagtaagctaactataaaaatagaaacttgacagtggggatgtatgtgtgtgtcaaaataatattactctttctgggtgtatggcagaaaaaatgacactacatccaccagcatgatttttatagatctgcctctttgccagatgtcaccttttataaactgctttataaaaacatgacagtataagtgcaatagtgtgtttattgcttgataaactttagtaataaacttaggataggttgaaaattaaagccttagagcctattcattaagcatttaggacaagtgagtaagcaaaaaatgcaaactattaaatcctaaatgtatgcagatcaagccactagcagcaagcactatttctcaatcagtatgtcttatggaaatatctgccagtttccttgtcattgagctaaatgcattacagccacatctaaagcatgccatttgcattgctacaaatttgaatgaaatccagaatgttacaactgccacaggctcactcaaaacagattaagtctttttcaaaactgttctgtaacttagcacagcatattttacatatggcaaaccatggttccaacaactacttttctgaaaagacttgaaaagactttaaggaatttcttaaaataatttcatagcacacactcaatattttgattactgatggattatacacagcaatgtagtgtggtctgaggactttggattacctgcagagcttgttaaatagagcgatcctgtagtcctttcctaatcgattgaaataaaatctctggaacaagggacccaagaactaggattttattaagtaattccaaatgatccttattcacaataaaatgtgttaaccatagctatacagtaatctaataaaaagaaactttacaggaaagtatattggcccagaagggtgtcattttaagtgaataatgtattcttacattcttaggttcaaactgttactcaacattatatttttaaaaattcaaatggcttatattagttcatattccttttttttcttgtagttatgtatgaacacccacaaaataaaatctacttaagaacttttgaaaatcaatccctataacaagtgcatatataactaaattttcctgatgattctattcatcctggactgacaattgttatctttgtaattgataaatgaaaaaagcagtaaaataaaacaatccctttaccaaatggtctattagaattcctctgatgctcatcacatttttccactgcttactattcacccccagatctcataaaatatttcagtagttaactacagcaaagctactaacatgcagtttgtgttgggtggatcctcacaaaagtgatgctaatatattggaaatatatatacatatatcattatatataattatatatatcattatataatcatataatatgtaattatatatgtgtgtgtgtgtgtgtgtatatatatatatatataatattttccccattaacaaatcagtgtgccaacatgacaacaagtaggagagactgtcaaagcttcacagttgctacagaactctagtactgggaagtactagttcaaaattccattctgggcaagtttttcttctttttttttttttttattttgagacagggtctcactctgttgctgaggctgtagtacagtggtgcagtctttgctcactgcaacctccacctcctaggttcaagtaattctcctgccttagcctccctagtagctgggactacaggtgcatgtcaccacacccagacaatttttatattttttggtagaaacggggttttgccatgttggccaggctggtctcaaacccctcacctcaagtgatccacctgcctcggcctcccaaagtgctgggattacaggcatgagccaccatgccccgccccattctgggcatcttaaacaaaagcaaaaacaaaaaaccctgaacacatcatggtataatgcagtgataaagcaatgtagggcttttctggacattaaaatgtttgaaaataagcaccaagaaaaaaatcacattaaggagcaaaaattacagtaactgcttgcctttttctttggacatcaaaagaaagaactaacaaaaggaaagtcttgctcgatttctgatcattttatttatcttattgtgaaagaaacaacactgaatcaagagtgaaatagaaatcaaccaaatgaaatgacagcaaaagttgcaaagaaaggcatctggggggtgaaaaaataaatgttccttcacagaaagaaaccagttgtttaaaaacaaaacagaacaaaacaaaaacttacaaaaacacagaaataggtcaagcaaattctacccaaatccctcttcctttgggccttgtcacaacaagtaaacctcatcagaggggtcaagaccacaatgactgacatcctgatcatgtgatgtgatggacagagaacttgactccgagtcagcagaatcgtatagtccagtttgacttcaatactcattaattcaccttttaaaagtttctgactctctgcattcatttttgattgctgctgtaacaagttatcacaaactgagtggttaaaaataatacaaatatattatcttacagttctggaagccagaagtacaaaatcagtttcactgagctaaagtcaagttgttggcaggctgattctttctagagattcggaaggaagaatggatttccatcttttccagcttctagtggctgcctatactccttggtttgtagttctttccctcatctccaaagtgcatcctccagtttccgcctctgttgtcacatggcctgctctctgattctgaccttcctcctgccttcctcttcttacaaagacactatgactaccctgcacccacccactttatccaggataacttccccatcttaagattcttaacctgatcacatctgcaaagtcccttttgccacataaggtaacattcacaggtaccaggaattaggacatggacatacttgggggccatcactcagcctaccataatctctttggattttcttcttaatactagttcattctttgttcatttactcatccacccacccactcacccatcaccctcactctacaggagttggccacagcttcccgactagtatggcagaacaaaacggtgtgttgtaaaccttcaaaggatctgctgacaagttctgatcaatatgtataattgatttttgctgcaacagagtacacattctgacagggtgatgtttttaagggaaaaaaaaaaaacaacgaacagagtagatgatggaacggtatatagattgggataactgactgccagtaaaagggcagagacattgattcacattaaggtgggaccaaagaaatgtatcaggttttctggaatgtgcagaactgtgtttacaggaagatacagaaatttgtctcatgagcacatagaagtccgtgaccagaacagcaaacagcccaactcaaacagcagcacagccacaatgaaaccgcacaaataaagtgatcaccgtggaagcttccagagacactgaggggggctgtttctccccagcagtggttgcactgtaattaccatagttcgtttggggttgccgacttttggtcttttcatgccaggatggactcctggttctgagggtagaatcatctttctttaatttcatgggaaggggtagggtaggtgcctacacaaaacagggttttatcaggaagaaaaacaggaaaacgacctaagaggatgcacaatagcagctctcacaaaaccgcagtcactgggggctctttcagtacctcaatttaaagcgctccgtaggatgacaacttatatcttaatttctcccacacaaaatccctctaaggtgagtttctttaggcaccatccagaccacattttaagttacaccatttaaaataaactttttaaattcagagaaaactatccaagtacgttgacactcttacgttgtttatgtataaaaacaattacaacgttaagcttcctcttcatttcaaatttgtttattcttacataagcttctagacaaaagcatactctctgaaggaaaactggggcagatgggggtggcgcaggatagcggcagcgttattgtgactaggtggtggttaagaaaatattttcaagacaacaacctgaaaatcaggcttaagtgccagaagtaaaccaaaaagaagcaatagcaagtgacaaaaatggctaactggagaggaaaaaaaataggatttcaattaaatcataaacgatggctaataaagtgcgttttaacagctgtaacgctaaacataatgcatcttactctgttttaattcaaatattaatccttgtccaatcactgtaatgggagaaaaatggtatgctctgaatgtcacattcgaattgggtagcaattatcttcctggtatcaatgtcagacattcacataaatctttaaaaaatgataaacttacccaaaaacatccaatcaaataaaatgaaaagatttctataaaacttgtgctataatttatttaaaattacaagtaacataagaaagatggataattacaattagggagatataaatttgaaatggaggaacatattaatattttaatctttctgataattctttaaaattacctaatatttttatatcagcaaatattgcctcaaggactcaattgaaacccaaatcgtaatgatcactatttaactaatttattaaataaaacatgttcaattgtacactaaatcaaatgacatggccatcataatggcagagctacaaattttaatgagactgaagaaaacagtaaaaggtctttgaacctgttatccatgtgatcacagataccgaaaacatgcttgtttctctcctttgtggaggctcagggactccccaactctaagcaacagttataataatatttactacgtgcttcccaccctgcgaagaatggacaggcagtatctcattacattctgacagcaggccaggtacagtggctcatgcctgcaattccagtactctgggaggctggggcaggcagatcacttgagctcaggagttcaagatcagcctgggcaacatggtgaatccccatctctaaaatacaaaaaatagccaggcgtggtggcatacacctgtagtctcagctactcagtaggctgagacaggagtattgtttgaactccggaggtcaagtctgcagagagccacaactgcaccactgtactccagcctggtgacagatcaagactaggtctcaaaaaaccaaaaaaaattcttatagccacctaaaaggttatcttcacttaagagatgcataatcaggcattgaggggttacaaaacttgcacaagatcccagaactaaggggcagaggaactccaaagcctgtaggagaactgctgaaatctgaggatctcctctctctgtatatatttaaaatatgatttctgtctcagtctattgaagctgctctatcaaaatgccttaaattgggtgatgtataaataatagaaatttatttttcacagttctggaggctgagaagcccaagatgaaggtgctggcagcttcagagcctggtgagggcttgctctctgctttaagatggcgccttcttgaagcatcttcagtggtagaaggggcaaggaagctccctccaacctcctttaagagggtgctaatcccattcatgagggcagagccctcgtgacttaatcacttcccagaaggtcctacctcttaatagaatcatgttgggtattaggttccaacatataacttttggaagaacacaaacattcagaccttagcaatattcatccatgcttctcaactctcattttacagcagaatttcccatggaattttcaagaaacacatttgtccaggtacagcccatagaaataccgtgggcccaacagcttattttcattatgcttttctgggcaattatgatgcctgctcaatgtgtggaactcctgctctgtgtatttcaggagatcctggagtatattagcactaaaatgtctctttttctaatagtagtacatcacattggttttataaatacttataatacatgacatactacaatgtgaaggtggttttgcatgtgtcatcacatgtgacatcccattaacttaccaagagtcacagggaaagacttgttattatacccaattacagtttgagtcaataggcacaaatgaattatcaactttttgaccttggaggccatctccaactttatattacataatccttttgctttattaacaagaagtctaaggtccagagagattcactgacttttacaggttcacccagttggtaaataagggcaccggacaagaaaaacaagaattcagctcccacaactgatatgatgtgttatttgtaacacctcacccagaatgtctccagccacctttctttgaaacctgcacttgcactgttaaactgggaaaagattaataagtacaatcgtatgatcacatgggtagtcacaacactgtaatctgagaaataatcattatagatgataaagaaagaggtagaggaggaagtactatttttgtgcccttgattatcacattacaaagacagaaactgcgacgactataaaagatgatcagaggaaatgatatcccaaatttgaaccgtctgaattatgaaaaaaatacaatgtttaactagaatgttccctaaacatgtcacactttgaataaaaggagcagaaggactgtatagaagactggcaacaaagacatacaggaaatgtaagattcactatttaggtatgagtttagatttttttgtatggaagtagagcattctccccaccctttctcctacttccaacttcctgcaaaaatcctacacagaggcaaaatatataaaatgtcttaaaaccaaattgttaaggccctgtctcctcctactggggcccaaagtacctcctccctcaaggggacgcagggctcccaggacaccaccgggaatcactgtttcacattcatgaaatacgtagtcagtgatgatatctacataacgtcaagcgtctaagtgcttgactaaattttcccattattttcactttgccaactacatggataataaagaaaaaaatgagaattttaaagctaaaagactcctactggccaattttgagtacttcctgaggatgagacactttccacataagccggttagagagatctcagtgagccagtgtcccaacagaacatggaaaatgaagcccagggaggtcatacaacctggtatatggtacaacatcgccctgcaggctggaaacaaggccaggtcacactgaggtttccagactccacagggagaggaggaaatcctagggagcagatccccatctgtgttgatcttcatgattttgctcacatccctgtgcctcctgtactatcattccggtctgtcttctttacatctgctcagttcctccttaaattactttgacttaaatggaaacattctatctgtaccataaatggaaaaccagtatcacttgccacagatagacagctaaccctgttaaccttgaaacaaaaggatattaaactgtagccggaagggatccctgcctgaggctctgagcctggggcctgcccacgctttgttataaggaagattagcaaatactagaaaggtgagaaagcttccccctggctaatgagaagggttgaaagaaatgaaagggaataacttcccaagcttgccagaaacaccaaggtagggcagttttttttaaccctgctttgaggtctagaatcctttgttgaaatgaaatcttattaacaatagaagcaataatgatgatgctgataagaaacagctggttgtattaggatacaccaggcattcaaatacaagtaaactcagtacttagaagtattaactcatttactcctcattaacaaacttgtgagacacagaaaggtcaagtaatgggccccaaatctctctgctagtaacagccaaaaccctggtcctataaccccagagtccctgtttttaatgaccacccagactgcccctcaagattccagttactaaggccgggcgcgatggctcacgcctgtaatcccagaactttggaggctgaggctggtgaatcatgaggtcaggagatggagaccatcctggctaacatggtgaaaccctgtctctactaaaaatacaaaaaaattagccgggcgtggtggcgggtgcctatagtcccagctgctcgggatgctgaggcagaagaatggcctgaacccaggaggcggagcttgcagtgagccaagatcgccaagcctgggtgacagagcgagactccatcagaaaaaaaaaaaaaagaattccagttactagcaactgacaatagagttgtggttgaaaagggattaaggagctaaagtgttatgctaagcatggttatgaacaaaaggcagaaaaagaacaaatgcgtccactatatggcttgatttgattacttgaaaattattcatttgttttactctttagctctttgcttcctttaaggtaatcacttttaaccctcttctcatattacttggctgatgatataccttggtgtactgttttctttatttgaacaaatatggttactgtgccagtaccttcaacagattcaaatctttttaagggtaaaaaggcttttctatttttcttagactacaaataatgactaaagtaattcaatgataatgagcattctagatatttctgaaggtttctgaaggtcacacaaaggtgactgtttctactgtgctaatatatccctggaattttcattcttaatattttccaaagagcaggtcaacacttcacagcaaaaaaacagagtgaaagagaaaacaatttttttcatattattcatatatgtttttaatagatgattaaagaagaaaaacataccctggaaatgtagaaatatgaagccatgctacatatttttataattatgttttattgcgttctgttaactggccagagggtttttaaaatgccaaaagattccaaattaaattaccattattaagccccttaagcctcatattgagtttagactgtcactaaaaacttttgataaattaaataatatgcagtatgagtattagagtttgaaatgtttaaaagtttctttacacatctgtcagcataacctaagacataaaatggcttacatacatttttttcaatgatagtgttttgttttcaatttgttttttagaaatgtaattaatgaaagctacagagcaataatctagcatctagaaatgccttcagagttgggtttttaaactcttctctaaatttattctgttgctaaaaatacattcattacatttttaatctaacaggttttagtgaataaaacaatgatgtagatataaagctaaatttctacagtacaagacatttcaaacatcataaaccaaggcaaaagaggatttacaatacagagtcaaactacaatggacacttcagaataaaattcagtcagtgtcctctgccctgccagcagggcatttactgtagtggagaggaccaggaaggagattcgctttataggataatcatgttatgttatgcttttattgaatgcacttacattttggactacacaattgttcttgaaatgtttccaaatgtgtgtaatcatgaccgacgtgatggcagggatctacttaatttccgcattcaaaggggaacatgatgcaaatactatcaagcgagggcacttcctgtcatataacacagaagagataagaacttgaccatgagctggcaataaattcatcaacatcctaaaccagcagtcagtccccaacctttctggtaccagaaactggtttcatggaagacaatttttccacagatgggggtggagtggggctggcaggggggtggtgatggtttcaggatgattcaagtgcattacatttattgtgcattttatttatattattattacattgtaatatataatgaaataattctacaactcaccataatgtagaatcaatgggagtcctgagcttgtattcttgtgactagctggtcccatctgggggtgatgggagacagtgacagatcatcaggcattaggttctcataaggagcgggcaacctagatccctcccatgtgcaattcacaatagggttcacattcctatgagaatctaatcctgccgctaatctcacaggaggcagagctcaggcagtaatgggagtgatgggggagcggctgtaaagacagatgaagctttgctcaattgcccactgctcacttgttgctgtgtggccaggttcctaacaggccatggactggtccatgacgcaggggctggggacccctgtcctaaaccatgtttgcttctgccccctcaccctttcccagagtgaatggtaattactgtgtacgatatttaaaaaatggacgatgtccccttaacagtattttctgcctgagtccagagctactagtagtagtgactgctgactaaaggatgaagctggagtaaaacctttcctgtgctgtgacccacatctccccattgctgaagaagagaaatgtaaaaatgctttctggaagaagaatttcacaaggttatgttttccctcagctttccatgatcacagtaatcgaaaaataacactcttagtttacagatttcaatttggcagtatctggcaatgttaattatataaatgagaagagagagataagaggtgggaaacaggaagtgaatgccaggaaaatgaggatccaggtctcctcctcatggaggtcgtccccaggcttcctgcaccagtgacagcacctgccaaccacaacatttcctaggcttcttccctgatttattttctccctagagcttacccctctataacacagtctatgtttcatattccatcttcttcatcagcttctttatcccccacaacaaaatgtgctccaccagggaaggggtttgaagttgttttgttcactgctgtgtccccaggactggatgacagaggatgcccaccttatttaccaatatattcccagcatctagtccaagggtctgtcacccttttcagtaaagtgtcagagattagctattttaggctttgcaagccatacaatctctgctgtgcagctacttagctctgacaccgtagagcaaaaacagccatagccaataaatatataaataaacgggcatggctatgttctaacaaaacattatttacaaaaacagccagaggaccagatgtggcccagagctatagttgccaactccattgtagaccatgtcttgcatatggtgtgtgctaaatatttaatattatgaatgaatgtgataactccaaaccagccaaccctcctatttatcattccagaacaaagaagactctcataaaagacaaccactaccagatgttttaaggtaacaggtattaaaagcagaatgggtaagtaaaacatagagtttgtcctcagtgactggagatggtctctgctgtcctgactaaatgacctatattagggtcccagtgggaacctaattcaattcagatggttcaaatgaagagactctaataaaaggcttattaatggaggggctggcaggcgaaggaaacaagaagggaggtggaggcactcagacaagagcaagagcaggaggtcatggcatccctcaaagggcaaggggaggccacagtgatcccagagccctgtgagagctaaaacatggaggaaggactatcaatgtcaaatgtaatgctcactcaatcagggaagaagcaagaaagagaaccccaacttccttctgctccagtcctctgattttcagcctagccaccatgcttgtcaatcccagatccaatccaactgtaagggagcacaggcaatgtagtctattggaaaagttggaaagggcaggcactgaacacagagtaaggcaggaatgagcagagacagggatctagatgagagtggcagactgagcaactaacacatggatcaattaagatcaaaacaaaatcattgtattagttcattttcatactgctatgaagaaacacctgagaatgggtactttataagaaaaagaggtttaatggactcacacttccacatggctggagaggccttacaatcatggaggaaggcgaaggaagagtaaaggcatgtctgacatgacagcaagcaagagagcgtgtgctcgggaactgccctttataaaaccattggatcttgtgagacttactaactaacaggagaacagcataggaaaaacctgcccccatgattcaattacctcccaccaggtccctctcactacacctggggattatgggaattacaggatagatttgggggggacacagccaaaccatatcaatcatcctactgagtacagaaatgaaaacttcagattccatacacttgacatagattacataaaagaccaccaataataagattgtgccccacctgtatacaatgagctgttccaagccaaaaatgtgtcttgattaatgctgtggtctttaccaggagcagttttcccacccaggtcacagtcttcacaaattggaagcagcattacctctagagtaagcaataaatgaaaatggtgcctttaatttcaaattataaggtaacacactgatggataaccatagcatgattagtcgattcaggacctcaatacacaatagaagaatccatccattatctgctcaaagtaattctttcatcccagcaactttaacaacaacccaggaaaattactgtcccttagcaaagccttttgaatttcatatggatttaattagttaactgccatctcaaggatgagaaccatgacaaatagttgttcttttcaaattagaagaatagactgttcaatgagcaatattgatgtttcccctcacctatttatacaagagattttctacttttttttttctaatttagctaaccattttaacatttatcgaagcttttgtgatcactgttctctagctgagtgttctagccattagccattagctttaaaaaacagctgaaagcagcctccctgtgtacagaaaataccgtgttcctcactagagacccctggcaatctgaaccactactagaggattctaacaagacattctttaccagtggacagaaaagcaaatagagaatattgttcaatgaacaatgcaactactaatcataacagtgctgtatcttaacctgtagtcatgaacctaacccagctgcttgaggcaagcagacccctctttctttttaactgtggaacaatctatagcatgggaaatgggttaagatttggaaaagaagttaggtgagtaactagcagcagaaagccaagcaccgtaagactctacctattccatctgcattcctgccttttctcaaaaagatctcaaagcagaaagaagcaatcagaacaaagccagtcagctctggtagcttgctcttacctctattctagctacatgtcacctcctgtgagaccctctgcccctccagacagtttaagaaacttctcagaagactagacacacactttgtggctactagtgaacaatttatatgtgtgtttatatttctacagaactttgaaaaagacttgcatctatatggtaagtaaatgctcctgatgtagaaaaaagacaaacaggaaagacaaaaccattttatttggtatcatcaaattaaaaattaattgccccatatgttcaaataataacttatagccgattgtggtaatccaacatattggatgttggctttcatgatctcaccaatacatttagcaaatggctgtggaatctggcaataaaatatttccagtctctaagtcttcttgataattcactctgtgttttacaaacaactgggctcccgggattctaagcacatcactcagactgacagagcaagtattccagacaattggttcctggagggtcaagacagcaatgctcgatcaggattcaaacgggtcataaacccttcatggatctctctcaagtgggtggtgatgtctccctagggctgctcatcatttgctgctacagtcaagcacttgtcattatagacaaacaccccatcagtcttaggtcctcatccagcagagtcttactgccaccggtggagacaaccaccggtataaagaaatccaaacaaaaattcggcatgtgtgcccatccaggcatgactgttcactgtgcatttcacttctacgtctgcactttcagcatggccacgaaactcagcacctgtttatctgccatgatttcaggcatccagattgttctggaaccatatatatcaaaagctctaaaacaccaaacccgtttctagaaatttatcctaaggaaataattggacaaatgcctaaaagatgtatgtacaaggtggttccctgctgtgttctttacagaagtgaaagactggaaatgcatcaatctcagtttggttgtctacagaacgggattgcaaaatctgatttacacgtgttacaattacatcttgtcacctaatgccaggagcagactatatatggctttaagctaaaggaacatcaaagtcatgagtgccttggaaaacagagacaggagtgtgcatattttaaagcagaagctcccaaccacagtcttgttcacatccctcagttctttgaaaggcagccagacctccatttctaagggacaaatgtgaccacaacctctcccttttcaagattcttccaaggcttcctcctgtcaccagaatcccctgcatatcttagcgtggagttgaaggtcttgtgcaatcttaagtccaactcacctactgccacttttctcctcacctacactatgctctagacactctggatttcatgaagtacccttacctccaggcctgtgtacatgatgttcatccattctgcctggaatgcctttctttactcatccatcagcttagctagcctcctagtttcttgcacctctcagtgccctttcctgatttttttttccattctttccatgggtggatataggttcccctctccccacatgtccctaagtgccaagtttcatgtttcctctatacattataactgcccttttcatatctctttcccatcagaccttagtcaccttggggtcaggaactttggcttattcatgttttagatgacaaagaacacaattttaggcaatctctaactctgccctcatgcctgccctaggttgggaagacttggtagcttctttgtcactccaattctttaacatagaaatatactcggtccgggtatggtggcttgcgcctgtaatcccagcactttgggaggctgaggtgggtggatcacctgaggtcaggaattcaagaccagcctgaccaacatggagaaacctcgtatctgctaaaaatacaaaattagctgggcgtggtggcgcatgcctgtaatcccagctacttgggaggctgaggtaggagaatcacttgaacccaggaggtggaagttgtggtgagccgagattgcgccgttgcactccagcctgggcaacaagagcaaaactctgtctcggaaaaaaaaaaaaagagagaaaagaaaagaaatatactctactgacactccaggaagcatgccctaagatctgtacctcatgattctcccacattattaaggtacaattgtcctgaatgcacttgtccttcctcaccatttctgtgtaccatgtacacaaaaatgaggggtgtatccaacaagggagctgcaaactagaacaagtgccactagattctttcattaatgctaattaaatatctattctatactaggtactgtccttagctctttacatatattaatttatttggtattcacagctaccccagaagcaatgtcctactattaacctcatttgagatatcagaaaatggtatgagagaggttaagaaaattttctactatctcaaaactcctaaatgataaagccagaagttgaacccaggtagcctggctgcagcatctgtggcactgctgcctttccaacctacccaagatgactgagcctcctggcctgatcaaggaggtatgcttggctatagagtatctgctcagacactagagtatctacgatggaggaaaattcgagcagacagtatcatcacagaaagaaactgattatgaatgaagaacgagctaggtgtcaaatggacatgcagcaacagaaatagacaaactagctggatcattcttttccccagagggctgtgggatctaggaatgggtgttaaccatcacactacttctgaatctcatatacacaggtggaacctgtgggaacctccaaaagactgattttccctcttaatgctattattctgtccctagatgtgaaaaggcaactattttggggagaatcgttttcaacaatatgaggctttatataaccagcttctactcttctgagccatcccttccttgatttcccccaccactccatccctatcacaaccaagaatttgttctccagaaacaaagatgacagaaatcaagttagggacatagagatgctatcacagccaactcagaggaagatttttgccctcccttatctcaaaacctgcattggccgacattgtgtctgctcctagacaccacttaacgaaagactttaaaaactttaggaacaatttatttaaagaaaactccatttccagtatactatgactgtattccaaggtaataaagtataaatgagaacaaggaacaagctaataaactgaaatgaaggctgcatttcaataacaaggtttgggagccatttaccagccacgtgtatctcactctcatgacttataacattggctgaattacttaacagaaatgaaagcgcatattgcttctgttatccaatgctgaacaatgtgacatttgcttcagagcacttgtatctaatcgatacataatgctaaatgtgatttaaaatcaatttaattgtgctcttgctctcccatgagtcaagggggaaacaaaggtatcatttgagatatgaaaccattaggctatttcccaaagaaatcatagatcccttgcttctaatggagcccaagaagtagatacagttagtttacactaaaaactccacatgtgaaaaacagtattgctgaaacagttaagatactgtgccctaaaaggcatatttgaactgtttttttttttgaattacaaaccaattgaacttttaaaaacttctttatttgttgtgacctttctacaaattatagcaaatttaaaaagaaaaaatataattaagaaaaaaacataatattgcatgtcatatatatacttactttcctagattacatacttttaaaatatctgtattcctacatattgaaaccaaccaaattgtcccatagagctaatgtgtatgatttattttaataaacatagaaattgattctcccagtcttaaaacatgagaaagttatgtttgtcttttctgagttcctttctcaagaaaccaaccgtcaggcctcccagataggatcaaggagctgaaactcaccagattactgtatttggacaatgagatgtcagatccctcacccatcatgattgcctaacagaccacctgcttcctgttgatcaacttctctcccttacccctccctaattcctgttttcctacacatggttacatttcttctctgcctacataaacccctcattttagtcagtgagagagatgggtttgacactgacttcccatctcctcagttacagcatgtgattaaagccttcttccttggcaatacttgttgtctcagtgactggctttctatgaaacaaatggaaggacctagactgaacccctggtgtttcagtaaccatgtaatattttctattatattgtttctctgaaaataattgtatagttatatgctgagccaatcctgagtgtgtacaaagatttggacttggagtcacttctagcatccatctgcctgaccaacagttactgagtccccagttggcacaaggttgtattacttatactcaaggaaatgaggctcagaccaattttaaaggagcaaattcaggactcaactaataatacaagagtctctagactttactttatatgaggatgtttaaacaatccaaaacagtcagtaagttccacctgaattgcagtacttgggttgagtgtctcacttttaaaaactgatgtattggccagcacagtgactcacacctgtaatccctgcactttgggaggccaaggcaggtggatcatcgaggtcaggagctcgagaccagcatggccaacacagtgaaatgccatctctaacaaaaatacaaaatattagccaggtggggttgtgtgtgcctgtaatcccagctacatgggaggctgagaaaggaaaattgcttaaacccaggaagcagaggttgcagtgagctgagaccacgccactgccctccagactgggcgacgcctgggcgacagagagagactccatctcaagaacaaaaccaacaaacaaaaaaactatatattgattaaacgaactatctgtgattaatgtacagcctgtgtgtattttttttctacctgcattcaagaaattgtatggctatagtatataagaaacagaatctttttaaattattttcctaacaacaactgaaaatagtcccatacaatgtacccaacaaaacttcctttttcaaaatttgctttaaatggacaaaattatgtaatagtgaagtaaacttttattaaaaagaccaaattactagttgaagttaattgggatagggttgttttataacactataacaaggacattcacacaagataatctctgatttgtaaaggaaaaaataaagtagttcacaggaaaatagtcaattttatggctcttgtgtttaaatagagggaagaatgtcaaaattcctataaacttaaaatttaaaatatcttcagaagttgccacaacttaaaaaaaacttgaattgcaccaaaaatatctagaaaaattttaagcagtaagtatattcttataaacatccccatattattgtaccttgtcttcccccttgaccaaggttttagactaaattcagttgacaacaggtaacatagctgataaactgaagatctctgcttggcatttgatagttcatcatttacatgggcaaacaacccacataaattcaaacactatgattcaaacatacagattcaaacactatgccaggaatgagcatctacagtgtatgcggttcaggagggtaaccaatcaccacacatcatcattgggtacttgatacagggttagcccaaatcgggtgctgtgttagatatgtcctggatttcaaagactcagcacacacacacacaaaaaagtaacacaaaaacctcttgtttttatattgaccacattttaaaatttattagatatattgggttggataaactatattaaattaattatgcctgtttctctttacttaaatgtaagaattactttggtgacctactttctattagacagtgctggtaaagaacttaaaaaaaatggtatgctccaagttaccactaagaaaaatttttaaaaatacattaaattaccaattacatttttttctcagatgaaacatgcatatgttaacacagaacatattctgacagatctgacagaaaacatgaaaaagtgtgctttctatcataatgattatttttcagataacaacagctgttggcctgtacaagcaagaagctgtttttccacatactaccaagtattagcattcaatcatgaaagaaaactaattctccatgggctctctccacatgctttacatcagcagcaagctgtgcactcctatgtaatctgaaaagccgaaccaagttggggctgcttcttggctcactgctttgccacttctctctaatatggcaaatacaaagcactcacattttgctgattcagaagtaaatgaaacattcaagacctgcacaaaaaccctgaccaaaaggaagtctcagacaggtgagcgccattttggctcttctttagttacaaaggagattaaaagtaatcagtctcttgaatgcctatgaaaagagtggttaaaagtcagctgttaaagaatggctttattctagaacacttgaacatagcccaaattttggaacttgaaaatagtttaaagttcccttataaatttcaagatctcatttatcacattttgtgctcaagaatcacctcagctgccaaaatctaaatagatctgtgctatccaatatggtagccaccagccacacatggctatttaaattaacaaaactttagttaataaaaattggaaattcaggtcctcattgtccatgaccacatgtggctactggcatagtagacagaacagtggagaacatttccagcactgcagaaagttccgttagacagcattgaattagataataacatacagtaagttagcaattcagaaaacttaaagagagaagcaaatagggcagaggaaggcatgtgactagaatgcagactaagactatttaaaaaaactcactgcagttgcattatgtcaaagtaagcaaaaaaaaaaaaaaaagttctttgtcagtttgatgagtgtatctgttatgcttgaagatgtagacagagagaaaataaaatcagtggacagaaatttcatttatatatactggttacgtacttgccacgaccacacacaaactacaacacagaccaaaattcattactgatgaattatggttttgcttttctacaagacggaggtaagcttggcaacatttattcttgggctaagttcacaattgagacaacaattctttccttaatgtgataaattatgctgctctacattagggaatgcatacttttttatcgaaaggtaggaaaaatcgcaaggtgtgccttctctattttttttttccgcccactaggaagacatgaagttctatcagggagttaaaacagttaaataatggttaaaagcctgcttctggaatctgaaaaactcggtttcgtggctttactactttctagctatgtaagcatgtgttctgactgtctcctcatctctaaaatttaaatgaagtaatgcctgaataattcttggtacacaccatttctaattaaagggatgcttaatgatgcaatcattcttcctttgctgctaattactaattttgaaatacatgttatgttttgtcatgacacatacaaataagcataacttaagtgacaaaaccataaacctatggcaaaaataccacagaccactcatatccctcagaggctttcatggtggacaagttagccgtgctgtctcgtacaccccactgcactgagttgctttgataaactgagttatgatcctgggagagagtactgaaataagacagacacactaaaggcttctgggaaaccacatgacatacaggtgtacctggggtttccataaagcccagagatggcagagaaagactcttgggggactggaatgtctgaaaatcccataaagaaaacagtttgcattcctggtcactgggtacaatcaaactcaggaagtactttgtatgggcaccgaagtgtatcctggaatacacagtcacacattactatcaagcctgggcatttttaccagttcgaaaaatcgaacacccaagtttccatttgtaaggtaatttttcaaataatgtttcttttcgaattttttttcccatttatgtagagaccttgagagaagtgtcatacctgagatgcagcaggggacaggatggaatgcgttttctagagaatcttccataaagggaagcatacatatattctgcatcactaagattaatcagaagaaattgctcaaattccaccacattccactttaagactatagctttcccattaatcgctactagcccgaagacctgtccaatgctataacagtgtatgataaagcatatatacctgatttttcacaatcatctataccacaaaaactctattcctgtaaatcatctaattatttagagatcctatttatttatttacttatttatttgagacagggtctcactgtggcgcccagactcgagtgcagcggcatgatctccaccaggccttggcttctcaaagttctgtgattataggcatgcgccaccatgtctatgtctggtcccagtattttatttacatccatagtatatatgtcagattgtttcttatacctagaattgatagaaatcctttatcacatgctgccttccaaaaaagagttcaaaaagcatggttaccacataaagacttgcagttactagaccacttagatgttgcctgagaaagatagagcacatgtggttttctgcatggtatgacatatctgaacagcaccagtgaatacagaagaccatggcacataatggtggtactgtgatggggaataaactgcctatttatttattagagcacataaattaccaactgatacgcaaaacaccaactgcaaattaagccttccctcagaattaaagagaaaagaggctggggaatggaaagaatcagatgggcctgcctcaaacctcagcgcactacttaatagctgcatgacctcagtttccttaaccctgaaatagacataacaaggcctcctttacagacttagtgtaaaggaggggacccacagaagataccatctggcatatagtttgtaaaactttacatttgctatttctgttatgtatttatgaatatacacatataattttatgatatctattgctataatatatgcaatatgtaagtatgtatgcacatatgcatatgtgtgtttatatataaaatgagtgatttttgctctttgatcttcaaatattttctttggatgtcaatttttctttccttttttttctttcttgatttggatctcaggatccaaaagtaaactaactttcctaaacctcttcagtattaaagagagattcattttgagccagcacactatatttctagtccatatctgaatccatatctgaaacaaagaccacgtctaaaagtaatactcttatttctaattctcacctaacacacccatggaagataagaaaattaacttaccaggcagcagtaacttcttggaattctatgctcacactttgctcagcacacataggcgttctgttgacagttggctctcaacacctcaagtacgtgtcagagggacgcgagccgatcagtttacccaagctccttacttattctcatttaccctctagaattttatttcctgcctcagaaagaagaatcccatctgccagaaggaaatatttgtagccaacatgacaaaagtggaatccctattttgtaacagctgtgaatcaaaacactagtgactgaaattaactacatcgtgcttcggaacagatgtgtgcacagaaaccaactcaagctctggtgttcctgggcaccatgtgtaaatcatccacagacaacacggtgggccatgttctcaccttgttgctatgcacgctcatttttaatgttctcctgaaccattgcagactttgagatttttttttaaaggcttagaatctttatttccaaaagaggagattctgaaagttgccaatcactcactggaagacctaactaaacagatgggttttgacacctctggtttgattttaaatgcaaacatgtcaaattatgctctggcacaggttcttctgcctcaaaattttatggaggggtgtttaattttttttaagttttcttctctgaactcagttgttccaccattagcaattaaggcaataaaggacttattacagaaacagtgatatgattgctgtattttaatgcagcagccttaagtaattgaaaatcattactaaaaactttaggaaataaatttcaagaacagacatctgcaaatgaagttgaaggtaaggtcacatttttatataaataggaagcgagaagaaaaacatatggctttctttggtgactcttcccataatcaacatacatgtattatctcctacaaccgaattagaagtaagtggtacattgcctctgatcactgttcttgggagcccatggcagacaatggtaatccactgcagcccttccaccatccatgcccttcagatgcaaaagacttgactagctgctctgaacagatacaaatcaagggaggacttgaacttcagacaagtaactatatggttagaaagattaaatatacacaaatgtaatcacttgagaacattttaagcaacatgtcagaatatgcaagacgatgggctgcaggataattaattattgagaatatacagttgacccttgaacaacacaggttttaactgtgagtgtccacttatatgaggaggacttttttctttttttgagacagagtctcactctgttgcccaggctgcagtgcagtggcgtcatcttggctcaccacaacctttgcctcccaggttcaagtgattctcttgcctcagcctaccaaatatctgggaccatgcctggctaatttttgtatttttagtagagatggggtttcactatgtaggccaggctggtctctaactcctgaccttgtgatgcgcccatctcagcctcccaaagtgctggattacaggtgtgagccactgcacccggcctatatgagaattttttttaaatgaaacatggattaatagtatagcattggggaatatgatacctccatatttggatggctgacttttggtatctgcagatccacagagccaaatgcgggacttgagtattcacggattttgttatacgatgagtatatccttgagtacacagaaggatgactgcgttctcattccaccgtgggggtgtgttgttttgagctggatatatccacacagcactttagtttgtaaggtatacctatattaagcctcatcgttgcatgtattattttgtaataatatgttgaatttataattttaaagggttaaataaccagtacagtttaaaaattgagtaaataaaaactgagaaattaaaatctgttcaaataagcactgcatttaaaacccatagatacacaaactctacagaagcctggagaaccaggcccacgtggagacaaaggcaggattgaatgagaaaaatgtgtttctatcacaaatcataattacttgtagaaaatctttttactgcgttctaagctctgttgggatccatgccttgaaggtaacacaccattggttgctttttcctgctctccctcttgattttttttttaatagactgaaggtaggaaatgctatatgcttatctctgagaagatgcctctatgtagtctctctgctttataattagcaacagtctttcccaaattctacacttagattgacttccaacttaacagatgttacagtgaatttcttttttctttttgtgtcttcatgggtattttagtgcgaggtaaccaaaggctgtgtgtaaggctaccagggaaatattcgcaccgcctgggtcagaaccctgtacgtggcatgggtcttagtaatcttgcagaattttgttccttagttcagccaaaacgaggttcttgtcacatgaccagcgaggattagaaacgtggacacattgaagggtaagggaattggaatttattgggtgaaaaagaaaaaagaaaaaaaactctcagcaaagcaagaggggatcctgctaacaggccatcacctcacacattgaattccaagccatacacaggacctgaagatgccaggctcctccccactgcacaggaggtgaacttcccctggcttcaccctgttctcccaataatgtgagggtgggtcagagattctccaggaccctccttttatctgcatcctgcatctatcagtaagtagttattgaatacacaattgcatgagcaatgtttaaggagcagagagagctctttgcatagcatatcaggcagctgatcactcaataggatttaaaagtcactgaatagactgctaggttccatagtgtggcagatataacacagggtctgagattctcatcctaggtttatgaatgttttgtgtttggacaccaaattctgattttaaaaagattactgtgataaaacctatttaacataaaatttaccattttaatgtttaaatatacagtttgtgtctttaaatacattcacattattgtgaagcttttaatagattgaatattcttctcttctgatcaacagcaagatgatttacataattctgtaaaactatgagttggcccattccctcaagtaaagcatgaagacttaaaagcaacatggaacacagaaagagaaaaaactttgagcccaacaagattttggctttgaaagagaagtaagatgtttaactaagactcaatggaaggaaaaatattgtctggagatactgaaagttgagaattataaagagtgattacaaatgcagaaggtaaaagtattggagcaaaaattggaaatctgctcacatttactggctttttaagcaagttctatcatagaggatctctcatccaaccttcccaaggaatttgtcatcactctaatccacagctaattttggcacagaaattatattagtaaactcagccatattgtcttctcacatgaagacaggactgatgtcctctaaataaaaaattagagtctatagcgatttgtttacaataacaactgatagttacaccccagggatcttctttttgcatatcctggtttttaataatgaattataccttctatacattctttcaaaatgtaaatcaatatactaaaaaaactacagaataagtcaacataaattgccctgtgtgagggtgcctagtagaccaatactaatattttggaggagatttctactttgtagaatctactgagattctgaaagctgcctgcaattctgcaagtgtagggaatgggggaagagacagggcagaggaatgaagcaatggacttatctaatcaaaagcctgattaaaacactccctagcagtctctaagatagaactatagggaggcagcaggcaatcaaaaggaagaggtccagctatttaagtatagctcatatctattcactccgttgtttgattagatttttacctgtaccaagtctatgtaggtatgatgaagaaaggtggtgtattaaagatgaggaaaggtggtgtattaaatattcctaacaccactttccccagatatgctactaataccaccccaaattttccactacgctttgccatcatgccctttgaaacctaattaataatgtttcatttttaagatgatagtctaggctgcaattttaaattggtaagactaatatcactatctatagtagaatacctctttcctccacccacattctgatgcactgtggatacatctgtccacaacaagagattaaaccatccctttctgtctttacttctcctttaaaagccctggactgtcttaatttttgacagaaactaacttctttcccaacagtggtggactactagaattccatgaagcatgcttttggtggctcatgttgtaaaaatcatgtatcactttctcttgtgacctgtcatcaaatgtgacataatttaatgcaacagctccaattttaaggatggcattttgcactttgctttcaaactctatgactacagttatccaacagaagctggccgacctcagtggaacagacggggatctgttaacaggttgccaactttaaattactgctgagtagcttagcatatctctagaataattcctttaaaaagtaattaatcattatttcaaaaaggtcttcagtgaagtgtattttctatattttactgatgggtagcatttgattggaaacagctaatacttctccattctctgtcttgcatttacatttttactgttttcaatattgctgtttttgtttgatgacaactagggacaactcagggagcagactgagatgcgtccaacaaagagaatatgaatagcaatctagaagagtgaacattaggcagctaatgcatagaaatacttgtattttgtatctattttctccatatttcaactgaagattcttgcctcatgttggaaacagattgagaaaagtcactcgtgtcagtactacagagaacacattccatgagcccatatcttcagcaatgtgtttgcatcctagaaattatttcagattatgctctctcttgaggccataaaaggcaaacactggaggaggaacagtgaggagaaactacataaatagctacaggctgtattttagagacgcctccaaacttgttagaagataacgtgttgacttttagggtttgtcaggaaagttaataaagctagatttataagtatctttcaagatttttttttctaattgaaaaataagccacacgaaaactgtattctaacactctttggaaactggtatcaaatcagtccatcacccacttcaaagaattttattagccaagatatcataaaagtctacattttaagattttttctttttatcataaaaaatttcaaagacatagaatgatataatgaatcatttatacctccactatcactcacaaaactatttaaaaacaaatcccagatgttacttaaggcaatgtcattagcaaatttccctttgtataaacactataaattgctttaaagtaaactttatgaaaatcatatgctttatttaagattaggaacatcctaatcccttttccccatacttcacaaattttaaatcatttgtgtcatactggtaatgaacaaattactaagtgtgtacaacagagatgatatatgttgtcctcctattagggacatccagtacgtgtccatgacaagtattcccctggatcttactacaggtccctgttgaagctgggcagggcctcacagtgagttccaacacagcacaccaggtaacactaactcatcaattagagacagcatgagaactactgaccttcctggtctacagcttactgtcaaggaatctcatagccaggaataagcttctttaccaattcctgctattgttaaatacctacaatcacactgttcaactaggaggagaactaagtattcatgatggcttggacctatgtggatactctccttgcttttcaagctcacagagaatggataaattattagatttcagaaaaccaattgtagactagaacgagaacctagaatgatctaccaaatccagtttgtgactaaaagatggcattgtttccattgtcaaaatcatgaaagtagactatcgtctcaagatagaaacaccatctttaccttccattatggaccttttaataggaacacagtgctaaattcctaaattacaacagtttattgaatcttgaatgacatcagtagtaagacctaccattattttatgcactttaagaaagaaaatgtctttttgaaaactatgacatgctatcaattataagaaacacctggtttcacagttactaacatatttgtatatacacacagatgcattctattaatttgtatttaagctaacatttcttacttgaagatgcattggtaatttattgataggaaaatcacttccacaactaaggatagtttttcacctttgttgctctgcaaagcttggtcttatctattcttccttttaagatttcatttccaccatcaatcccaagggcaactggtttaacgtaatagagaaagtcctggctagggaagcagagtgtgttccctgccaacatttgcccatgtctgcgcccaaatacacagtgactccttagagagtcctcacgcaatgtccatcaattaatatttttattattagagaggctagtgctctttacagcattggaaacctagaaattctaccagcttagccagcttttgctacctataagagtagtggaaaaataacaacatggtaaggatatctttctgttttcactgatctgaagtcacaagcctataaaaccattcaattataaatgtgaaaataaataatgctaataatgacagctcttgtcaactggacatgcccaaagcagactggagccagatatgtgcactgagggaagtgggtggagccacagggaatttgcaccttacccaggggaggagcctgtgctcttcagctcatctgtgtggcctggaatcgatctatgagatgaggacctgttagcaggaatcccccacgctttgctgagagtttgttttcttttttccttttcgccaaataaattccattcccctcatccttcaaactgtctccatgcctaacttttcctggtggtgtgacaagaacccagttttagctgaactaaggaacaaagctctgcaacagttgcaactaaattgcattaaaacaagatgtgcaagatgagttttgagacctacatccttttattaaggcagaaaaattcaagtccataatgaagtcaatatgaaaaggacctgaatttaggtttctgtagcaatccattttatggatgttgctttcttagaaattttatgttttaaaatagatttttaaaatttattaccttaaagattttttcctgtagatcatatggacacttaatttcttctatcaggcgtatcatctagaaatataatgcttacatgggaaatatattatcttatgatttgataaaaaatagatggagttgcaaatatacttttatgatattcttgaattttttttttccaatgcaaagattcccaatctgcctaccaactgaactgttttggtcgtgaaacattaccttctcggtatgtggtatgcctatcagcagaaaagtagtaaagaagaatagactaactttagttattacatttgcattgtctacaaagccatttacttaatggatgagtctcattagcagtccaaccacaatataaagaatacaatgatgtgtttcataggttcattaaaataatatttcaaaggagtcattagaataaaagaagctgaagtttcaacagacagtaagttgtctgcaaataaatgagatggaaccaacatgttttcaagtaagttaagagacatgtttacaaatacattacagccattaaaaaaggaagcatcaacttagcaagtgctggggggacgattactcatgcaatttactaaaacaaaactgtaacactctcacatcaatagttattgtagatgcaaacgcctgtaggtacaggaaaatgtgtcttaagaaggaaaattcattctacagccccgagatgattctccacttggaagcaaaattgaaaacattcaatcctgtcttcagatcaccactggtttggggggggggggggtttgttttttgttttgttttgttttgtacacacttttgtgttatttgccccaaaccccaagcatgcctatcttttcatttttttttgagacaaagtctcgctcttgttgcccaggctggagtgcaatagcacgatcttggctcactgcaacctccccctcctgggttcaagcgattctcctgcctcagcctcccaagtagctgggattacaggcgcccaccaccatgcccggctaatttttgcatttttactaaagacgaggtttcaccatgttggccaggctggtctcaaactcctcacctcagttgatccaccctccttagcctcccaaagttctgggattacaggtgtgagccaccacacctggcctaccctttcattttaaaaagaaattcatggtaaattagtaacatgaataatcctgtaagggcaaaaagtatactgaaaaaaaaattgtgtctatttgtaattatctaaccacacctaagaattgacaaatgtttgtttaacaaatcaatggatgaataaatgaatgaaaaaagcaattacttagcaaaggagagtttttagattaggttgttaattattgctgctttatcaatttttaaacccagtatttccacctgtaagcaaaataataaacagcttgtatatatgttcaataatgttgaaatcttttcacaaatagcagtgtcaaattttttttaaccaagatcatagagtttatattaaaactaaggattttatttttgggtttttttttcacaaagaaaattaacatgtagaacaaaataaaaaccactaaaggaatagagattgccatttatttattaactttccttttttgaaagagcttagatttataattctaagaaatacaaggtaagacacacacatgtgtaagtatacctgggacttggcaataagtcacaggcacctagaccacagctcttgtggcagagagcaaaaatggccccatgtaatttgcaatgtcttcccactctgcatcctgactcacctttggatgcttggcttagccatgtaacttgacttggccaatgtgatatcagcaaatggacttggaaagagacttgaaaaggctttgtgtatttctctttgtgctcttcctatttgccatcagcattagaacatgccagggatagcctgctggcggatacaaaatatttagagcggagctaagtcattcagccaagaacagcctagatcattgcccagccagctaaccctgacatgtgattgaacttagccaacctcagcacatttgcctaggtgaccccagctgattgtaggtataagagaaataaacatgtgtagtatggcactacttgacatccaacagattcacatataagctttgtactttgcagtaagattattctccaaatagaacatcaggttgcataaaatcaaagtagtactgggttttattaaagtaactaataaaaaattattcattttctattttttaaaagagaaaagacaaaattaaatttgtatgcacagtctgaattttgaagtgctggaagcttactcaacaatacatctactgctgaattcagctcacaagccaccaagtgtcaacctctgttctaggtactgagaagattccatgatttcaagctgtttacggattttgtgagaaggacagacacatagtgcattacataaaagaaattaaaactattatgtcttaatgcttaccacgtggacgaatataaacaatttggatttccagatgttttctggaatgcttgctattttgcctaaaaggtaataatcagaccaatccctacaattaaggagtttactctctattttttaaatatataattgataagcaaacatattccaaaagattcattgtaagtctaagtttttcagaaggtactaaactccaaaaatatacaagcctccaaagataaactgtttattaataaacgtatatataaggacttcagcaaacatagcttcctgagaaaaagcaattcaaagatcaatatttccttttaaattttacacaacttggacaaaattttctaaagaaatcacaattttaaaaatgttggaaagccagttccattgctgaattcataaggtaacttaccgtaaatcatatatgattatcatatttataactaacatcacatagccccttccagactgtcaactccatgagggtaaaacctagttatgttgacatctgttttctcaagcagttagaatttcctgattcattctcttgtctatctggctggaacagctaaaattaaggcagtggagatcattagtttgataaaacaatagaagacaattggtattggtgtaggagccactcaccagaaatgctgtaagtaatgactaggttctgcagaaataaaattaacagattattacagtacacactcccatacctacatcaggagtgaaaggatcaagcaccacagttaaaataataatgtcagttgcaactggggaactgagggtcctggagactcccaactcagatgcctgaagaagccagggcaggtatagtaagcaagcagggaaaacttggtaatagtgtacatgtgtacttggcttctgagtagtgggagatggcactgaactggcaagcccatatcccaactaaaagtgggtttcagctactaatctctaaccaatatttgccatgtagaagggtagagctccaaactcccatgattttatatatacatattaaatggaaccacaaatagcaatttctacatattatctccaaaattgtacgtaacgtcacaatttttaaaaccattatgtagaacaaataagacacatgtttaagcatttgtgctttcccaaagatgatgtcacctttgttcctggtccaggaagctaaaaacaagtaagaggtgacttcctcccatttcttctccctccttcctccctgtattccaccaacagtgctacttaaagtatggctatggaatattgccactccaaaacctatttttttcttttttggtctaagataagcgtgatgaacaggtaaactccatgatccagccccctgtattcatgctcttgtgtgtaatctcctctcttgagtgtgaacagtgtcagtgatttgcttccaaccaaaagaaatgcaaagatgatagaatgttactgctatgattatgttatgtaaaactccatcttgctagcaaactcactcgagagtctctctcccttgttggctttgaagaagcaaactgtcatgaatcctacagccacaaagaaacgaagtctgtcaacaacctgagggagcttggaagtagatcccttcccagtcaagcagctgatgagaccacagccccagccaaaagctatattgcagcctggtaggacactgaagcaaaaaaaagccattaacccatgtctgaacttctgactcacatgaactatgagataataaaggtgtgttatcttagcaccactaaatttggagtaatttgttatatagcgacagcaaactaatacaaggggcctaccccttaatgttaattaactgtatcactaggcacattgtttagtttgactgatatttattttttgtaatagtactttctcaatgaaggaagcaatacattgaattacactcagacgcaagccacctcatctcacagcagcccaataccttgagttctacagttgatgggcatagtggaaagagaggtctggtgtaactttatatgcagaaaatgagaaaggcacattttcttcctttgacttataattttgtctaatgatatatgcaacagaggtagtcaagagcagggtcagggaaatggagactatggtgaaggagttattacctgtaatacttctaagttgcatcataaaaatttgctatcactacagataaaagcaaaggatgagctaactgataatacctgtaaaatgctgcaaacaccaccatgatgtggtgaggaaagcaagataaacattcctatagaatcctcctattactacttgccctggggccttgtgaaaatctagagaatctaatagtctagtactcagctcgcaaggaaaccagtcagtcatctttgtcattctctgctcatatcttatttcctaacacaacaaaatcacttatagacccatgcagaaaccatgcccttccttctcagtcctagacctggctaacccctgtgccctctaaagatttaattagctagctcttaccctgaagaagccttctttgataagtttgttcctccttatagcttgctaacatcctgtgcaatctccatcatttcacttcttgccctgtatcgtaattagctcttccggtgactgtcttatccactggagtaattaattgctacttaagataagaaaccatggctctcatttttgtatttccagcactgaggagcatgccttgctcatagaaggccctcaataaatactaagtgcagagaaaataagtgagttattttactagaggctgcataagagccaagagaagcaacttaattatgaggcaacaataagcttggatgatgcagacaaaaatatgctaggagattttaagcactcagtctgtcagtggtgagcctaaaacaggttcctttaaaggtaaaagattcatacaaaacaatacgaaactaagaattgtacaactcaacacatgttaaaattgaaagaaatatcacaggtactcactatacccagatgtcaaattctttcatatcttgcttcaagcagcatgtgtatattaactcatatttaatacaaaaagctatgctttttctaaaagcatttcttttttaaaatttttttttaagagatggagtcttactctgtcattcaggctaaagtacagtggtgcaatgacagcttaccgcagccttcaactcctaggttcatgtgatcctccggcctcaggctactgagtagctgagattgcagttgtccaccaccacagtcaggtaattttttaaaatttttattcatacttttagaggaagggtcttgctatgttgcctaggctgatctcaaactcctagcttcaagtgatcctcccaacctcagcctcacaggtcactgggtttacaggctcaatgcaccatacctgacctaaaagcatttcttatcagagtcctacttacccagttttgtcaggtgccaggaaataggggagctcttacctaggagctccctctggtcagagtggcctcgcattctcagtgtgggggattcagtcctacatttatacctcccttggagatcaattccttaaagcaaaacaggtggctcactggatggcattcactttcagttgatcaattgatttgtttggagatcagttcttaacatttatttcaacagtttaacaagataaatttgaaatcatttttcctaaaaaaatttcaaggtgatcttaatattattttaccaacttcaactatgaccccttcttcagacttaacctaattccttctgaaagccaaaaattcagacccatttaccatgaagctgaatcctccactgcttctctaactacctcttccatcggccctaaaacattaaaaaaagtggggtgctgcttctctttttctgtaagatgcccaggcctggttggtaaaagtttaactgcttaggtgattattatgcactatacaaagtatactacatatcaagtgctctgcccagtagagggtctactaaaaaggcttaagagtgaaaactgccaaagggaatttcttaccttccctcagggcacacagaacctgaacctcagtaccaggtgttccctacatctccttctgctggtgagtctaaacctgaattactcttctttgtctaatcaatttagacaacaaattaagcatgaatactgcttggcatagtagccttaatcaaacaaaaaagtgagattttttatttttttaaacatctatgcaaacatagagcttttgttagaaaaagttacaaattaataacattaaataaagccaactctttagaaatgatacagaatagccaattcccagaagtatttgagtggctgaaaaacaaatctgtaaaaaagtcaatctcaagcaaaaatcaagttaaaatgagacagacacactttcaaaattgcagtaatttttaaaaatttataagaagtgtgtaaagaagttgacattcatacagtcctgttcagctgatagcttttttagagagaaatttggtaatatgaccccaaaaccttaacaaattttatatatttatcctatctattctacttcttagaactctaaggaaacaagaagagatggccagagacttatgtagtaggatttttctatcacgatgatgggctggagaatccaaatgtctcacgataaaaaagtggcaatataaaaaatggtatgtgatacaatagactcctatgctataattaatttttatgacatatgacatgcttgtaacatattaaatgaaaaatggcaccaaaattgtttaaaatacaattattttatttttaaagcatacataaactcatagtaaaaaagtatgcacattaatagtattagtcattacctgtgaaaggcagactgattagtgacttactttattattcctatccttattttaaacttttccaacccatatatgtggcccatcagatttgtaaaaatgaaaatccaaggcataggatttgaaggcatacattcctataccctgctaaaaacagactcagtttagtatctccttaggttctgatataagatgattctcgaaaaagccccaagccaacccagtctgaagaaacagatacagagtagttatcagaacaagaattcaatgccagttaagtcacctttcccaaatttaattctaataataagtccgtgttaaaaagcaaaggttcaaatattttagtgttattgagaggattagctcactgctgagagtgaatataaaaaacaattctatatcaaagccaactaattcaatcttatttttaaatgtcaccaaatatggcttctctcaaagtacgccggtccaattggtaatatctgatggctgattctgcttaactctactaaatataaaccattatcttagggaatcagtagtatactttattcttgttattctttagtattttgttagggatcataaaattggacttgactttgaggacaggactggctaagccagggcagttagtcctatggaccttttcactccgggagtctgtgactacttatccttaaacatttccagtaaatttatgttttagttatcaatcagttatctgtaaactagaactttaaagaatcctaaaacataaatctttttaatcctcaatgatttagactctctacatttttaaataattcagtcaaacaaaagaagggtaaattagtcattttgtgtgtcagataaaacacacatgcatacacagaataaatgttttttgttctcaaaggattttgttgtaacctccactcgtcatgtaacactggaacaaaatagttaggctaattacccaaaattaagttccacttctcgatttacaagctttccattttattctagcaattcttagctgtcatggactcagaaaattattactgccatcaattggaagattgttttagtggtacagatggctgtccttttataggccaacttaatgacttcttcttatctaatctgtcatctgttatttagttgtcattatgaactttttgggttgcatatcaatccattttccatgtttactaaacagatggctttatttgagaaaaaaaaaagcaaagcaagaaaatgacattgcatgattaaaaaatttcaaaaggctgcatacaatttttaatgttcctaaatgaaatgaaaaattgctattaaaaaaactaaatttgaagtcaaagtgaaatagattttaaaactcaatggacatgcaaagaaacaatcagcagcagctatctacaaatagaacaaattacttccaaaacagcaataggttattcttccagtttttgtcacaaatttttttttaaatttatcttgacaaatagatgacaaatgtcaacgaagtaactcttcaattcagaagctctttatgttgtaattcacaggtgtacctcctttgtctagtatttgtaaccttatttagagagtaggtaatgacataaatacttccatttagtgaaaattgttccttatctttgtctccttatgatgattttgtttaatcactgggtcattatcaaatcaacacccaaactcaagaagcgtaagggaaattgtaaagggcttgtatcaatgagttcagagatccaaaaataataactggcactgtgccatgaaagaacactgtagttcacactgtaccagagaaagaacttgacaattattagaaactaaaatacataatcatgaaataattttatgttacatttatgagtggtatttaaaattgtgtttgttcaggaaggatatttaccaagtcttgggatttgctgtatcagcctataacaacgctgcaaaagtaaccgagcagagccttctgaaacagtttcccatgccatactaagcacatcctccattgtagaacagattgagttcaactgtggtttttttacttgcccaagttcaaggctcctgagcacaacaaaaccaacaatgaggaagagcatgatcgcataattttttatgttcttcagacaatgtaggagaacttaaaatggacagccaatttttcaaaaaggacaaattatttgaaggatttcttttcttatatgataaccacagtaaaatgtaagactagtgtaggtaattgtcctgccactccattctaagctgtgagtgaaagtactccatcagcttaatgagaacaccgtgaaatataaaacatctatttcaatacaagttattgagaagctttaacaggctttcgggagaagctaccaaaagaaaaccgaataccagatacttgatttgagactgacaaaaatcttctattctttcctacggaaaattaaacaaaatgggctattatatagcaggaagacagagacaaaaaaaaaaaaaaaaaaaaaaaaaaacggaagaaagagtaaattgtatgaatcagaaacttggaataataattctacctcaaatacttctcttaggtcttctgctcacatctttcaggcagagaacatctatttgatgccaaatgtgtggctagaactgggccaggtgctttacatgtcatagatcaataccaaacaactagtgaaatcagcacaaattcaaccaatgaagctcttaaaacaataaggtgaaaaaccacattgttgaggagagccatacaatacagtcaggttctagttcaaattacgtttctttccttgagatcttctggtccatgatatgttttgatctgtctaaaatattatgtaggcattctcaagtgattaagaaactccggattgtttcaaataatcaggtcttccccaggcaaacactggagatcacttgttttttgtttgtttgtttgtttctgagatggagtttttctgtgtcgcgcaggctggtatgcagtggcataatcttggctcactgcaacctctgccttccaggttcaagctcaagcgattctcctgcctcggcctcttgagtagctgggattacaggcacccattcttgagtagctgggattacaggcacccatcaccacacctggctaattttttgtatttttagtagagacagggtttcgctatgttggtcagactggtctcaaactcccaacttcaggtgatccacctgcctcagcctcccaaagtgctggaattacaggcatgagccaccacgcccggcccaatatcactttcaatgggtcccaacacattaaatgatgatttcttgacaaagttttacacactacttaaggatcaattgacatcaaccctaactcaaagccaggaagcttaatccaacatgaaaatattctgtggatgttgtacttaggcatattattctctgtagtatatactttcatattgatacacatatttaacatattgcaaagcatattttaaaagcattgatctatgttctactggtaattttcacaacgcttaatcacatggccatcatagtctttgcataagactaccttgttgttcaagaatggttttagcattccatccttctccatcatactggctcagaggtgagaactgaccttctcccagtagataaaagactctcataattgtattatgtacagcagcatcagcatcacctgggaacatgttagaagttcgaactatagacctccaacccaaacctctggaatcaaaactcaggagataggccttagcaatttgtgttttattatatcctccagctgtctggagaaccacataagttttgagaaagaaggcaatgcaccttatcattcttcaaggcaaagttcacttcacttagcttggtattcttcactgcacctagcaccctcaacataacaagcacttaatacatatttgtgacataaaatagattaaaatattctaaagacagaactcattttagagaacaatcctttccagccactatttggagattttgatactagagatgtatttggctgagaagtttcctttccttaacctattgctaggttctgtgaacttgccatgaattgaaaccaaggatggactacagtcagaatgaaggaagatgaggaagaaaaaagcaaagaagaaaacaaaaccactctattccttctgaatttggcacaaagatctcaggtgttccttatattcttaagacgtaaatcacaatgaattatgatcattgagcaaatattactgtgagcctaggtcaaaaagctaaggtcatagtgttctgacataaacaaaatcagctttatttcagaaagagcatagtgaaaggctaataaacattgctaagtaaagaaggggctgataacacagatacaacatggtaggtctatactttctagtgcttatccatttctctgccagcccctgcatttatggcacatcaatcaaaagtcttggttttggagccaggtgaactgggttataatctggctcaggtcttcactagttgtaggtctttggggaaattattcttctcctttctgactgtcttcatctataaaatggagtaataatggtaactaactcatagaattgatggaagatttatattaaataatgtgtgttgtaaatgctcaataaatggtagattgtttttctttgtctataggaggtgttgagggcttgtagtctacttgttcaagcaacaggacataaaacaaaagctcattaagtcagatgtggtatcccatcagcacttgcccagcactgagaatacagcaggtattccagaagtgtgagccaaatcacatgcattataccacagtacaaagaaaccttccccaagagtcatggttgagaattacacagcagagattttccacatcacagaacagagtagactggcttgacttcatgatatttggatacaaaactgagaaaattagatttccaaaatatattattacttgaatatgaaaatatcttttttttttttttttttttttgagatggagcctcgctctatcgccaagctggagtacagtggtgtgatcttggctcaatgcaacctccgcctcctgggttcaagcgattctcctgcctcagcctcccaagtagctgagattacaggtgtgtgccaccatgtccagctaatttttgtattttcagtagagacagggtttcaccatgttggccaggatggtctcaatctcttgacctcgtgatccacccgccttggccgcccaaagtgctgggattacaggcgtgagccactgtgcccggcctgaatatcaaaatatctttttcgaattctgtgacagcccatgaccccttcaccagagcaagccaaacaccacttgttttcgccaaagagacaggagcaaaaggttctggtatttatcatctgggctttatctttttctggatagattatgaaattccagtgtattccagacaggtccattttcatggaaccaaccactgtcttccctaaaagcataacagcatcacaggcaaaggtcccaagataatagaattttatatatcaggctggctttctaagagaagtcaataaaatccaacaatgatgggaaatgcaggatgtagcagagatccttaaaagcaattagcagagagcagggatgaaaagcaattatgcaaacactagaacactaggacattcaagactttttttttttttttctttttttttttttcattctgtaaggaaaggacagatccctgctttggaaaaagaatacaaatgtgcaggtttgaaagttccccattaggtgcatctaccatttctattatattcaaatactaagctttttaggacttatattaaactccataatcttaatatttatgaccacaacttaacaattaatcaaactattaaacactaaaagagtcaaaggctgagtatgggtggggcaagaaaatttttttttttgagatggagtctcactctgaaacaatcttgaaaagcctccagaaggtacaaatttgctggcactataaaagacaaaggcaacttaaggaggttcaaggaaaaaggaaaataatgctaagaaagagaaaacatgagagaaggcactggggccaataatgcacagagttcagatactaaatagtgaagtgatccattcagcctagaagaatgttatggtagaatggaaaaatgcaagtctttgactctgagagccctgggttttaattctgtctttctgtgaccttgggtaaggcatataacttcactgagattcactctgagcacccacaaaatgagggcaacaatagctatcctatgaaataggtaactaataaatagcagcaatatttaataggcatgcaaattcttttctcttcccttcaccaagtcataataaacctgttctttaattcaaaatcaatatggccaaagccaaattcacaacatcttctcacaagcttcccttctcaaacagcctgtcttatcaatcgagccaccatgtctccactgacccaggcttggaatgtctgactgatagctgcctcaacttcaccttcaaaacaaatgtctgctcaagttatatccctccaacacgattcattttgacctctttatccctgttttgtcaaccacaacccaaatctaagtctgaattattgaaaaagccttccgtccgacccatgtgattcctacttttctccccacaaattcatatacctcccactgcttagcttatctatttcgaatactggtgtaatacatcctggtgatggctccctgtttcctactactcagtgatatattcatccgttcatccaataaacagttactggatatccaccaaataccaagtactgggctatgtattggaggtgcaaaaatgagcaagtcatgcctttgaaagtccagtggggagaagtaaacagatagattataatacaatgctataaagaagagatgaaactagaaattcgctttataggttgaacgagacaaaatctcagatcagagatggtgctgtattggaacagcatctcaagagaggagaggtgtttgtcaggcaaaaaaatggaaaagggcactattctttttcaaaggcacgtacacaaaaaaatcctgtgttttataagtaaaagacacccccaccaactgtagaggaggttgaatggatttcttgcagcagtgagtgtgtaaatgagtgactagctaggatgcaagactcccctcctttgaccaagcaagtaaacaaaggatggattcttcatagaagatgcaatggcaacaggtgacaagtttctttgggcaactactgagtcagttatgtaggtaaaggggtagagattcaagaatcaaacaaacaaaagacaacaaaagcaatacaatatttcagacacagaaccccactggccagagagagagacagattttacccctcaatgacagtgaacacagaacttagaccatttgaaataaaagttcttaccatatctctcctgactcgtacaaacaccaaagggcaatagtaaaggaggataaatctttttgagggaagtgagctgtactatctcatatctcacgggaatccattcatgagaaagtcaaatccagaagtctgttccacttcagctctcatttacaaaaaaagttttctccttcctttcttaaatcaagtgacacaagtcaactcaagatgtgcagcatcacatcgtcactcaaccaaactgtgcacacatcttctgccatgggtgtcaccaatcttaaatctcagtgtttaatactgagatttaaaaaaaaataattttattgtgtgcatttgaagtttatagcatgatgttatagaatatatatagatagtgaaatggttactaagtgaaccaaattaacatatcatctcacatggttatttcttgtgtatgacaagagcagctaaagtctacttccttaaaaaaatccctaatacaatacaattttattaactccagtcctcacattatacattttagatctttaaacttagtaatcctatatatctgctggttgatattgagatacaatacttagaagctaaaagcttatcaaacatgaaggcttttctgttcggatttttttttggagagggttaacaaaatgtgttgttttaatttcattttcagaacaaattaatttatctcaccacactttttgtttctagcaagcatgacaccactaggtatgagctgtgtgcttattgtggataaggacagtgtgttagttacctctttatcccatcacagtgtctgccacttaagcattcagcaaattaaatcatcaacatgagaaacatgagatacatttttatcatgtacatgagatacatgtcctgtatttttatcacctacgtgaacagagctgaacacctcacctattcaatagtaactccaattttattaactttcccttgactcattttcttcatcaataaaacgtggatcagattgccttccttatagagttatagtgagggataaacagggtacagtatacaaaaagtcaaatgagtcttcaataaacggcagacaaatcccaaacaaaaagaggggcaaaaaggcccgtgtcagagaaatcagaagttaaatcaccataacaatgaccataagcagcagagaacttcagaaggtatccccagccttttggaaatgtcctttaatttcttcatgttgggtaaatctagcaattgaaaaggaaagacgctgttaagttcaaatgtggatgttcattataggagctgaatgagagacaggtaaaagtttccagggaagaaaaaggcagtatgcaacaaagagttgggtatcaaaaaataaaaataaaaagaggtgcagaaaacaagctccttttcttctctaaattcgtggtgctcctatccaggtcggcaaccccacatcagtccttaccattgctctacccagtttgtgtccccactgaatcactccccagctccaagtgacgtgtgtgtgtgcctatgaagttttaaggaaaaattacctataattttgcttgatctttgtgaatctctgtagcaacacggaaaactgcttaacttttcaaaacaaatctaatcaccttatcattcttttatttcaagtaatggctacaatgtattgagcacataactaagcactgtatgccagacactgtattaattgctttatatggatctcatttattcccacaactctgacttgtatactgccgctatccctgttttacaggtgagtaaacctggagatgtggagtggttacatcatttttccaaggttatacagctagaaaataagtggtagctagaacttgagcccactgaattttaatggtgtcactgtaaagcctctgcgctgtgtatctcctgtccccatcactccccactctgctccactgtgctctgtaccccaggagtctggcctccgtgaactccaacaagcttccctggcccccctggcccccctggcttcagtgagtttgtgtgatagactccaggcaggagatgagaaggagggaagaacagttcaggatatttattcctcttggtccttcctggaaggtcacctcagtctagcttcctcaaaggacggtcaccatcctctaaaggcaggctcttctccacacttctgtcctttgaggttcccacaactgctacctccccttgtccctaggtcaaggggtggtcacagctctgccgttactcatcccagtaactcatgcagtcactataacatcatctgtggtttccctgcacccagcccacaactttgtaaacagtcccattgtaaatatactctttaatatatgctgatttgaatgtaccatctggtccctcttggaactctgatacagcctttctaataatgcctttggtctaggaataacaaaataattgttctccagtcattccatgcttttctacacctctgtgtgtgtgtactccatgctgctttcaagtgaaatgctcttcaccactttttctgctggaaaattctaactcctcctttataacttatgaaggcagttattttattcaaacctcctttgaccccctccttgccatgggcaaaataatgggctttttctatcatactctgtaagcacctacaacttagacaatacattatactgtatacatgtgagactggcaaaatctcagcatgcaccactgtacctggtatgcagtaggtaaaacaaatgatcactgaaggcttgaatgaatatattgctgttacatatattctttattctgttctacccaggaaattaatgtcacaggcattccattgagcaacacagaaggctatatgtgtacatgctggttcattctatgtgccaatttgactgagctaagagatgcccagataactgataaacattatttctgtgtgtatcagtgagggtgtttccagaagagaatagcatttgaattggtgaactgagtacaacagatatcctttcctaatatggatgggcatcatttaatcaactgaagggctgaaagaacaaaaaggtagaggaagggaaaattcactctctctgcttgagctgaaacattcaccttctcctgcttttggacactggcactcctggttcttggaccttgggcctaattagattaaatcataccataggctttcttggttatccagctttcagagaatagatcatgagacttctcggcctccttaagtacatgaaacaatttcatatatatgtttgtatgtatgtatctatctgaatatatatatatatattctattggttctgttctctctcatatattattacatataaacagaacattatatatataatactaagacctatatatacagtatatattatatatgtatttaatactatattatatataatactaagaccactaaaattgggatctttctggaaaatcaaaattcaacataaatttattatttctttgtaaaaatgcatatggaggagagggaaggcaagttaaccagatatactttgaatgtaaggttacatgttccctttaatcacttgatttactgaaaaaatacatgcttaaacctttgaaaaaggaaagttgtttttcagtagttcattatatactcactgagttttaaattctatcacaattcacgttttaaaatagatcttaacaccacacatatttacattaaaatagtaactgagtcatacttacctaaatagcctaatgactcattaaaacaactttcttttctgttaagtcatatttcttccttcataattcagttctcataactcattagttatttccaaagaaggatgtatcacagtcatagaccacttctgttcttagaacttaggaagccatctctttcagatcaaaatatctaaaatttctatgaaaattttcaatgatttaacatcagtgttacgtcttaagatttattattaagacatggtttctcagaaagtcaactcctggtctagtgtttttaaatgatttgactctgaatgttcagtaactttagttagctctcaattgatttcattatggaacatttttcttcctctcatgaaaatacgtaacaacaaaatatacctgattaacaaacagcttgatccatgcagcatgtaacattcatagatgctaatgcctctttgaagcatacttagtatttagaaatcattttgccttcattgaatgaccaaacaactggtgttcaaaataaaatatatgcctgactataataatatggcaagtacatatttgtcagtaatgggtattgctttgcatgatttatttttgttttcagaaaatgagtcctcgagaaatcctacaaatcactttccttgcatagaactgaattttggtaaaaggaaaaaggcgctatgttcagtccctccgcctttttgagatggagtctcactctgtcacccaggctggagtgcagtggtgcaatctcagctcaatgcaacctctgcctcctgggttcaagcgattctcctgcctcagcctcatgagtagtagagatagggtttcaccatgttggccaggctgctctcaaactcctgacctcaagggatccgcctgccttggcctcccaaagtgctgggattataggcatgaggcacagtgcccagcctgctaaccccttttcacatgccatctcatttgacccttgctatgttttgaatatcccctccaaaattcatactgaaatttaattacaggaggtgggacctctaacagtgattaggttatggtgctctaccctcatgaatggattaatgctgttaccacttatcatgggagtatgttagtgatgttgggaatggctatgttataaaagcaagctttctctcacattctcttgcccttctgccgtccgctcccctgccatgagattaacctcaccagatgctgacatcatggtcttggactttgcagcttccagaatcatgagctgtataaatctcttttctttataaattacccagactgtggtattgttttacaacagcagaaaatggactaagacaatcctatagacagcaaccctaccaaagtcagaaaggctaagggactagctgaggctctgattcctaatcccatgtccttcccattaaatcattttgtcaacttatataggttgaggctatacctatgctaagtgaaaatatccatctgatagattcaacttgagattctactttgccccattatatttgttctctgaggagagtgaagaagaagaaaaggagaggtttttgtgttaggccattatcaatgagactcatcaatactcaactaatctataaaatgagctcaaccttcccctaagaatactaaatactcatagataatgggctggccctttgattttaattctcagaggatcagtgtttttaatgttttatcattagttcctttcaattaagtcaggtaataatgctgcctggacattcaaacccaaatgaatggcttcaattatcccagggtctatttctcaatcaggagccaaggccctgggaccaaatagctaacactcctcaaagtacctctagattattttctgaaaagaattcaaagattattacattttagtgaattttctagagaatgcactgtttttattaaacgggagtttttgctaattttgctcctttctaaagatgttggaaagtctaagaaaactcttactcaaaaacgaggaagtgggaaaatctcaaactaaaccctctcagattatgttcttactcaaaatacatttgatgtatttgaaacacttgatgcctttatgaacaaatttgccttgatttattatgcaaagtcataattagctattttaattcattaactgcttgtttttaaaaaatatccaatttttaaaaacaacaaagcaaaagttacatggtatgacctatagaggttttacagtggatgaattttaacaaatgtatacacacatacaaagctctaatcaagttatcgaatatttctaccactctaggaagttctccagtgctcacctgcagtcaagctccaccactttcatggaaactgctgttctgatttctatcaccaaaaataagttctgcctgttctttaaatcaatataaagtatgtacactttggtgttgaacttctttcaactatttagagaagtccaccatgcacttacaggtattagaaatttttcttcttataggtgaagtatcttttattccatgaaatgaaaatccaacattttatctatgcttttgatggactatcggattatttccagtttagaatctttacaagtaaagtgactatgaacatttgtgtagcaaaacttctgtggatacatactttccttttgtaggggtaaataccaggaaatggaactgtaaaatcataaaacatatctttttaaaaaaaaaaaaaaaaagaaactgaggaactgttttccaaagtgattgtaccatttcatactcccactagctatgtttatgcatttctgttattccatcatcttattcactggatgttttaattttagctcttcaagtggatctacagtggtatctcattcctgttttgaatgtgcactttcatgataaataatgatattgaacaccttttaatggacttattggcatttgaaaaaacatatatataaatatatttatttctttgggcactctgttgaaatatttcaccttttatgttgccttaaattgggttattatgaagcattttagaaatatatatacatatatacacacacatatgttctgcatacatgtcttttgtcagatatatatatttcaagtattttcctccagtctgtagcttgcctttttattttctcaactgggtcttttgataatcagaaggtttttattttaatgaagttcaatttattaacttattttttcttttatagctagtgctttttgtgtgctctttaagaaatctctgcctgagactgtaagatattttttctctaatttgttatagaacttctacagtttttgcatttatatttaagtgtgtaatacatctcaaaatagttctttttcttagtcttttttttcctgtttagataatttctattgatatggctcaaagttcactgaccttttagcatgcagagactagttggctgttaactccattcagtatatttcaatcatggcacttttcttttctctttgtttttttttcctgagaccgctcactctgtcacccaggctggagggcagtggcatgttcagaactcactgcagtgtcagcctcccaggctcaagcaatcctcccacctcagcctcctgagtagctcaaatcacaggtgtgcaccaacacgccttgctaatttttttattttttgtagagggggtctctcaccatgttgcccaggctggtcttgaattctaggatcaaacaatcctcccacctcagcctcacacagtgctggaattagaggcatgagccaccacacccagccatggcactttttgatcctagaatttctatttgatttttatagcagtttttaggtaagattcttcatctgttcttgaacagcatccatgttttcctttaagttctttaacaatattattatagctatggtaactctaatatcttggtcatcttccatctgtttccagtgactgcttgttttcttcattagttgtcttcttcacttgtataataattatgaatgatatatcccaaggtgtctggattatcttttcttcccttaacatattgagtatttttgtggcagttaaattattggcagattctcttgatcctttcacgcttgcttttatactctgttagagtgggcctatttggttttattcttcattttagattgtgattctcctaaggtaggtctccttctatagccccaactgagcttctaggctgttaagcaagaccttctacactggctgcgacaggactccaatatctctcagcattgtgtgaccttcagtgcctctgttaagcattcagttctgcagaaggcaccctctactgtgtcttacagagtcccactctgtgaatatacagcctagccactggccaatggcacacaaggaaccctcattaaaccaatacaaagacaagttcaacagtattttacagaaaatcttttaagccaaagagaaaaacagtcatgattaactatgttggcaataattttaaggtacataaaaaaagatatttgtaacatatctgtattatcctaatagacaaaagtatccgctataggagtacatgattcgctgcctatgtccgagagctttgaatctcaattcctcacacctggtgccattttactcataatatgtaaaaggaagagctgctagaaaaacttacgtcacctgtgttaagtttatagatatacacttgaattaacaatatttttggccaagattcataaatacactttatgttttatgaagcccaattcagttagaacttgaggtcaagcaaagaaatcaagtgtaagagctgacataaaaacaggtttccttttcaatacactttcagctatcttagaaattaactgttcggagtgtttttctattcatactccagaacctctcgcccaataaaattatctcctcccagggctttcactagtgtcaattcactaaagatgcccgtgtcaacatttcaaggtcgcgcctcctcaagagtttaaatattcatctagatatccaccttgaattcaaaaaccccacaacagaattccttctcttgttcccgcaaaaatctgtacctcttcctgaatctgcattctggctgcactatgtacctagtcaccgagaggtggacttatacccctcttctctttcaccctttcatctgtctgatgcatcactaagccccaagagcttcctcctttaattatatctgaagtttgtccctctgtttccatctctgctctaatgcaattttttaaaaatcactcactctattcccacagccttcaaactggtctcttccctcctatccattcacaacacagcttctaagtgctcttcttaaaatactcatttgataacatagtttcctgttttaaaatgtactaagtattcccacacatctctagaaaaaagttcacattgcttttgtgcctctcactgccttttaattcgcttctctaataatttacatcctagttgcccagctacaccaaaccagttgaaattgcttggacgtgtcatatggtttcagaacctaagccgtttgcacaaggcaaaccatccacatgctcatccttgggtctcagatcaaacatgaacacctgagacagaagactctggtttttctgaccgctgtgttgttccaatctgtttattttactggactctatttgaaatgatccatttgtcctctattagactgtaaattccctatgtggagggagcataacaaatatatctttattctcctgtgtctagcacaatgcttcaccatatttgcaataaatcagtgtaaatgtaattgggatatccaccaccttaaatattcatcttttttatgctacaaccattttaattattaaatattttcttctagcttttttttttaagagatggggtctgggctggagtgcagtggctattcacaggcgacatcataactcacggcaaacttgaactcctgggttcaagtgatcctcctgcctctgcctcccaagtagctgagaatacaagctcatgccactgaacctggctctcaagtagtcggtttttaactaaaaatatttacaggttactacaaggctcttctttttatttttcaatcttactggaatgaaaagcaataacttctaacattagagttatcattctgctctatgatgtaacttagaaaatataataaaactgcaaatctatttccaaagcacatttaaaaaatacccccagatagctgagcattcataaattgattttatggtcatttgcaaaggtagcaggacattggggaagtaaagagagagagcaatgattgattatttgagaagttaacctcattttagcagatttttgtggggttttttttttttttttagctcaaaatgtttatctaacagataaatcaaatggagctttctgtacatacctcattacaattctaatttattttcccaacagaatcttcacaattatgtaaaaattggcacggtcctgctagtgacacttcctattctttcataccataaagcctgagcttataaacaagctgcagagagaggcattttcattacatacatcactgcattgtggcggtatctccagaatggcttaaatgcatcatgtacttttacccaaatggtctctgaacaagagtgttggaagagatgtcagttcttgggccctgacaatgttgtttcctagcctaaaaagtctgagaaatgtggaatattcctacctccttctgtgagaagtcagaaaatgaagagacgtattcatctttaagccaaccttccaaatttacctgagcatagagcaccaccccttcaccaccaccctcttttctttcctttggaaattcttattaacattctataggacatcattggaaggttaatctgattgtggcacatccataatttggctatttagaacattatgtttaaaaacagagttaatgtcatgagtctgtctgcttatctctatctcattgtattttccgcttatcttcctggtttctttttcttcctgaatctccaacacatgcccacacttggattttaaattattggtccaagacaaaaagagtcatgagtacaagttcgggccgatctacttcaatgaacaaacaatcgaaagctctttacttcctgatggcaaaaatatataaaattagtgacatctacttcagtatgcattaacctctttttaaaaagctgcctcctttatcttccattctcaatttgctttaggatgtcttttatttcttccttatctatggctcctactttctcacagactttttttttaaaatgtatttggaggctgatatgatcagtgtacttcctctgaaattaaagtttcttttgatattgagttcagtatattcagagtggaaatcaaatgacttaggctggttacaaagatttaagttaatagagatgaatttaatccactggtggtgtgttcataatcaaatgaaggactcatttctgttctagagcctaccaaataaaaatgtcaaaataattggattaaaatcatatgaaatttatttatttattcaacaaatattaaatgtttttatgtgccagacaatattgggtgatggacatactgatgttaacactgagaccctaccttgccttcaacagcctctagtttagcagagaaggcacacattaattctgtatttgtgtgtgccatgatctgattgtaattgtgataaatgtcatgggagagatgatagggctgatacagcccagtccttgggtggggaggctgggtaaggatagggtcagagaaggatgacctgagaaagtgacgttgaagctaagatataaagaatttgaaaatggcttggtaaagttctagataaatgaaacagcatcaaatgcgaaggttgccacatttgagatgagagcaggtcagtgtggttgcagtacagagagcaaggcacgatagtgtgagactaggcagagaataagcagagccaccatcataggagctcagaggccatcttaggacatcagaactttctgttaaaaacaatgggaagccaagaaaggtttttaaagcaggaaatggacatgatcaggttgagtgtataagccgtctccctagctcagtggagaaagcagactcatcttggtggtagtagggagaccagcaattgtccccaaaatgtccagtcactactggcaaaagcacccctaaaaaacatacaattgaggaatgcaaggtgcaacttcattagaagcccctcggcttacaacgtctatctaaccagaatgccattcttaaatcgctcctattcctatttcaaacttctggttcaaacagctctagtagccatggaagaaaagattaaaggcagaaagactggtagcagaaaagccaataaggaggttttagcctaggcacttggttctggtggttcaggaagtagagaaaagtcaattaaaacaagctacacagaaggcggaatctctagtatgtggtgaatctggttattgcaattactacatgtatctttttaaaaaagtaatggttttggttcctcttgaaatttacatgacactggaatatcctcatttctctgaattatttttcttacatataacacatatatgacatttgaccttgtcagatgcttaaaacagaagaattaagccaagaaatatttctatcaatctcaagtcttttaggaacctaactaaaggagaattaatagtttaattataaacaattctttcctgatcattttaaaagacccactgagaatgtgtgccaggcaaaatagtctagttttagttactttttgcaacctaaagtaagaagtctctatttttttaaacaatatttgatgacttagggtgatccagaattaatttcctccgctgctaatgcaattctgtaagtttttactcaattctactctgcatcattaaacaggactaaaagctttacatttagggaagcatatcacttggaaaaaaaacacgttaatgtgaattataacaacaaactttggagactaaaggcatgactagtaggatcttccaccccagattttttatatgctaagaaaatgaagaaagaagcacacacacatactagattacctacaacacggcctcttaggcaaagcattgacatttatgtagaaggacttcaagcgtggagctagagaatatgcatattcaagtaataatttgattttaaaacctgtgcagcccgaagtcaagatcaaattgcatactcaatttttccaccaacatttagaatattttctcaacgttgagacgtgataatagttgtgtggctgtgtgttttttaaaaagtctattaagtagaagagactgctaatcactgaaccagcccttgcagttttctttgctgctctacagtcagttaacaggatattacaaaataaattaagaataagaaacaggccaagttaatgcacatgataaagagttgagtcagggaaggtttctgcaatatttggagcctgaaaggagagactctaagggtagcagtggtgtatgataatgagaagagggagagaaaaatggtaaaatactttatgctcttcaagaatcattccttttgctccttttgaaaaaaaaaaaacaaaaacaaaaaacaaaaaaaacactttcacggtagcaatttttaaatgcttttcaataattgtgagtgccagattcatgattctgtataggaacatcttaatgtaacatccttaagtagaaacccagtagaacttggttttgtatcattacatcaatattgaaagtatagcctgggtgtggtggctcacacctgtaatcctagcactttggaaggctgaggtgggaggatcacctgagttcaggagttcgagactaccctgggcaacaaggaaaaaccccatctctactttaaaaaaaaaaaaaaaaattagccagatgtggtggtgtacaccagtaaccccagctattcaggaggctgaggcacaagaatctcttgaacccaagaggcagaggttgcagtgagcagagatcacgccactgcactccagcctgggtgacacggtgagtgagactctgtctcaaaaaatatatattgaaagtataaatactactataccattttaaagtacacatacatagaggagtagcaataccattctgtgaagacaactggttagttgtagttactttcatattctggagctgtcttctgcctggactattctcccctcaatcacaaattttcactgggtcagtgcctgctcagatatcatatctaggcttaatcaactgttctgtagaaagaccttcccagatcctatagatgcaatgctgtcaaacagagctctctacaacgataaaaatgttccagatgtgtgttgcccaatatggtagtcatgagccacatgtgaccactgagcacctgaaatatggtagtgtgcctgaggaagtgaacatttaattttattcctttttaattaattcaaatttaaattaaatttaaatagctacacgtggttagtggtttccatgcagaagcagaagaagacagctcctgttcttctatttcattcatattctgtgtgtccccttgtaggacttggcatatttgcagttacatagtgtttaaaattatttgtttaatgtccatctttcccactaaattattgagattttaagtagagtaactaggtctgtcttgatcccacaaaagcccatgcttgacaccacaagcccccatgcttgacacatagtgtctattcaaagagctgctgacttaccatttaaataaagcttttaattatcttaaacatataatatcagatattaataagttggttaagtgaataccaaaggttcatgttagaagactggaatactgtttacaaggtgtgaactttctggaaaagtccagaaaatgccaccagaaattataaaaatcagtggtaaaatgtggttgccacagatttttcataaacacaaacatacatacacacacacattctcaaaacacagctgccttcagcaaaagagtcttctattttgctctaaaatctgttgtggttgtgaaaatgatgacacttctctgcaaaagaaaaatttcaatgcaaaacaaactcacaatttagctcaggatgtatgaaaaagttgacacaaagaagctgtcctttcctggtttaaatgacacattttatctttagattttggtagctaatttttaaaaaaatcctttaaaacgtattaccttttccagggacaaatgctctataatgttattctctgccatctttgaaaatgaaataaacatttattaaaataataccatacacgacatagatatttttaatacccccattggaaatggtggcatagagaagtggacagtgtgtataaagctacgaattccagagaacactggttataattcagtgggaaatacagttagtttgtcattgtttggctgatttgttcatccatccatttatctctctctccatatgtaatgtttatcctttcttactttactaaaataatatctttcatcatgaaactcacagtatgctaggaaagttgaaaaaatacacaggtgactgaaatataagcccctaaagaaagctgtgttcaggagaggcatagagttcatccttggaggagccatttatatgaaaacagttctgtttacatgcaacagagaaagccattaagcttttttttttttttttaatggagttttgctctgtcccaggccggagtgcagtggtgcgatctcggcgatgcctcagcctcctgaatagctgggactacaggcacgcaccaacacgcccagctaatttttgttttagtagagacggggtttcaccatattggccaggatggtctcaatctcttgaccttgtgatcctcccgcctcagcctcccaaagtgctgggattacaggcctgatccaccatgcccagccaagaattcttttttttttttttttttttttttttttgagacggagtctcgctctgtcgcccaggccggactgcggactgcagtggcgcaatctcggctcactgcaagctccgcttcccgggttcacgccattctcctgcctcagcctcccgagtagctgggactacaggcgcccgccaccgcgcccggctaattttttgtatttttagtagagacggggtttcaccttgttagccaggatggtctcgatctcctgacctcgtgatccacccgcctcggcctcccaaagtgctgggattacaggcgtgagccaccgcgcccggcccagccaagaattcttaagaaaatatcctagtgagagcctttctttttaatcctgaaatgcatctgattgaggacacagggtttagggagggggcacaaaggaaaactgaacagtacatatgtgttgcataaattcatggactaatgattaggacaattaatgaatggtttaaatatgttagacgaaagctcattttgtaatgttctgaaacacatgaagcaatgtgagagactattattttgtttgtttgtttgtttgttttttgagacagagtctcaccctgtctcccaggctggagtgcagtggcgcgatcacggctcactgcgagctccacctcctgggttcacgccattttcccgcctcagcctcccgagtagctgggactacagacgcctgccactatgcccggctaattttttgtatttttagtagagacggggtttcaccattcacaggatgatctcgatctcctgacctcgtgatccgcccgcctcagcctcccgagactattcttaaaaacgcccatagtttccacacaaacaggctgattatgaagagtgacagaaaagccaacaattgtaacgtttgcctaaattttcttcaggtatgttcctggtttttcaggaggcactctgccttgcagatagagcttacaaaccaagaccatcagggtacatgtggcactttcatttttcttctcagagtagatctagagacatttaaattaatcatttggaggttgaaataccaattccttggtatttcaaagataatgtgccaagtcctattatcatttagcaataatttaaggaaaggaagtatctttcaaaagtacagaacaacctacacagatttaacatgtcaaactaatatgataaaattattttgctactatggtaatttcaagatgggtgtgacattttgcttttttgtcttctaaaaaatgaaaaatgtctttgaatcttgttagcaatgcctgaccttcagacacactggccatgccagggatgcagagttcacagtgattactcctacatgtacctgggcccaaaggccaagcctaggaggttcatttcattatcataaagtaaggtgaaaaaagatcaaacgtggattcaaaaaaaataaagcactaacaaggaggagaatatagcccgttgcaagcactacaatcaagtaggtggtacacatccccagtccttgaagaattgctcatgtgccctgtctaaaactggttttgtagactctgacttttgtctttggttgcacaatgatgaagaatcaattttatcccagaccagtgaaaatgagagcacattactactatgaggagaaccgctaaaggttaattgggttttagatacttagccctaattgttcaagattttatcataatatcaatttctgcattaatgcaaggcaccctgaggccatatgaaatagatttcattctaaatttaaatacatccttccatccaaaaagagaagcattcttcccagataattcccacaatcagaatccaacttcctagatgaaataggtcaaattaaccaaacctcccccaaaatattgctttcagtcagtgatgactgacataattatctagttaatcctaatacttagatacttaatgtagataatctgaaacattaattaaatatgaaaatacgttacatgatttttcctgggaactatattttagtaacactaacacttctgtttaagaagttagagatagttttctttccataactggaacattgagtactgttggttcaacaggaacaagtttggtatgccatttatttcggtattcagagcaggtcattaccaaaatgaaaattaccttaagtattgttaagccattagggcacagttttgtataatcagacaacatcttaatagatactcctatttattgtcacaataaaccatctgttaagttttagagatccatttttgaaaaaaggagatacctagttttcagaacacctggtataggaaactcttaatttacaaaataaatgaaattgagggagactgatgtgcgttgcaaaagaatacctaggttgaagaaaaaacaaaacacctacctaaatattctttgaccagtagtatctctagggcttctgtgtttcaatttacaattttgtttaacatataacctttaaggtattcaaaaacaacagcatcaataataatagctaaaatttagacaggaggttatgtgatccattcactattctagaaactttacatttattatctcacttaagcctcacagcaatcctaaaaggtaagtgctgatatagtttggatgtttgtccctttcaaatttcatattaaaatgtgatccccaaagttggaggtggggcctggtaggaggttttaggtcatgggggtagatctgtaatgaatagcttggagccctccccatggtaatgagtgggttctcactgttagttcacacaagaggctggctgtttaaagaagcttgtcccttgtcactctcactgcctcttgccatgggatctcccagctccccttttgccttctgccatgatactaagtttcctctggcctctgcagaagctgaacagatgttggtgccatgcttgtacaccctgcagaaccatgaaccaaacaaacctcttttcattataaattacctagtttcagatattcctttatagcaacataattggtctaacacagtcagtgtcgttattttcattttacagcgaggatactgagactcacagtaacttctgaaggttgtacaaccttatgggaaaaagagggtacagattttaaaagcaatggattaaaatgagtactgctgtgaatatctacatgtctccgtacacgtccaagtttagttgtctcactgcatgagtattttccatcttttcagacctatattaaaaatgcaagccaaatatcgattattatcattaccagtttctaacacccctgagcattttgacccggtaaggcaaagatgaatatttcttagaccattttatccatcataggttattctaccagtgaatagctgtctgatatcttggtctcaacatgactagaggctttacaagcatttataaatcccagtaatagtacatcttcttgagtggctgcctggttccactatgcgaacatcatggcaaccgcgtaacaaaaaagccacacagagtgttcctagtacttactgatatgaccaagaccttgtagcctttgaaactccatgatttttaacataaccaaaaagttcatgaataagagcttggtgcttcatgtcacatataaatgattttatattacccatatattgtattcccgcgattagccccaaagatgcctccccaatttagcagaagtatattgcttaggagggaacatacaaacaaaacaggctgggcacggtggctcacacctgtaatcccagcactttgggaggctgaggtgggcagatcacctgaggtcaggagtttgagaccagcctcgccagcatgttgaaaccctatctctactaaaaatacaaaagttagctgggcatggtggtgggcacctgtaatcccagctacatggggggctaaggcaggagaattgcttgaacctgggaagtggagattgcaatgagccgagaccgtgccattgcactccagcctgggcaacaagagcaaaactccatctcaaaaaaaaaaagaaaagaaaagaaaagaaaagatcattagacataaaacaacaaaaaaaagcacatataaagctgttctattgctcagataatatttcaaagaacaggaaagagaacatatttaaaagtatatatctgcattgactgccaatctctctttcgatagtagagatgactatgtttgatattaagcttctgtaaatcaggctttcctactttaactttctagtatcaactggtatatacaatcattactctttctttccttttttgttttttttctcctatcctctacatggatagactagaggcttaatagtgtgatgataatggctctgtaactctgtaactctgggtatggcgtgttcagaacacccacagtaaacaatcccaaatccaaacatgtgtctcagaaaatgtgtctcaaaggcctagtgctgtgctgtccaatatggtaggtggtaactacaagtaggtatttacattaaaattaaataaattaaaaattccattccttagccacatttcaagtgttcagtagccacatatggcttaatagctactatactagcacaaatatggttccattggacagtggctagcctagagtaacattttctaacttaccaccttgaccagggtttaaatcaagaccagccaatggattgtgcctcacatgtacacctacttaattttaattggcatcctggagtagaaaaaaagtacagtgtttggaatagacatctcttgcggacatagaattgcggagtggtgcccacatacaccaaacatggctcataagaacttgcattagcagcagtataaaactacaaaatactaaaaatgcaacaagagtgccacatctcataaattacacgtgtctttccacgtgccatttcaaaataagccatgagcgaagtgtttttcttcaggcatacagagttaaataaagtcctgaatacgatccgtaatcacaatctgggtctaatctgagacaattcatcttcttattcattaaaccagaaaacttgtatgaattggtaatacaagtaacaccgataatttttttaaatgtccattttacctacatgtgaacctgatactctgaaaatcactgttgattcttgtcaagtaaacaactatgccactgataaagctccattcttgagtccatattattccctgatagaacccaataatctaatcagaggtttttttacccccacttaggaattgttttttggatactgtgactccaatagggctttcattaactaaaaagaactgtatacaacatatcaaatgcagcatctggtctagtctgaatttctaaatgacaagcacagcatgcatttggaattacatagagaacgagaaatcagacctctatcattagcaatctttttccccaaacactgcttccacttcatgcttcaacacctttaccttccacagacctcttggtaatgtcacgactagcttgtcaaatcaaattcagcagcacacaagcatctgtattaatacttttgcattttcattcactaggaaaaaacaaactctacttagtaggcagattagccattatctactgtaactctaaaccatctgagttacattactaaaatgaattggcattgaaaacagagcgacagaaatgtttaccgatagaaaaatatgtagggaatgggagtttcttttgcgcttacttgccagtgacttcctaaagctgtaatgaggtcaaaataagctggtttatttcatctgtgaccactgggtgagatctcattttataatggccttaataatttgccacttatgattacgataataacaatattttttaaaatcactggaaactttaattaggtatttccaaatcgctaggggttattaaccaagggtcaattttgctcccccaacccccacccagaaatatttggcaatgtctactgatatttttggttctcataattggaggtgagagtgctactggcatctagtgggtacagaacagggattctgctaaatatacttcaatgcactggaaaacttcctgcaacaaagaattatcccacccaaaatgtcaacaacgccaaggtgaaaaaaccatgccctaaagctacatatgatcactatcatttaaatgattattccaggacttctatggacatgagctactgaaaaaaaaaaatcattttgtctttcacagatgtcaagcttaaccaagtccatgtgaccatttagagagttaggaggtacatctactataaaaatagcatttttcaacagaggctattttgttatttgtttcatccttattcatcctgtctctctaaacaacagcaaaatttttaacccatcatcaacctttaaatactgttgggtcaagttctcactgtcaaaaaagacatattaattgcaaaaaagcaaaaacatgaccatctttacagtgctaaatcacttctggaaaatgtttatgtcaaaaatcagcttaaatttttggagataggacaggcgcaggtggcccatgcctgtaatcccagcactttgggaggccgaggtgggtggatcacgaggtcaggagatcaagaccatcttggccatcatggtgaaaccccgtcgctactaaaatacaaaaaattagacgagtgtggtgctgcgtgcctataatcccagctacttgggaggctgaggcaggggaatcacttgaacccgggaggcaaaggttgtggtgagctgagatcacaccactgcactccagcctggtgacagaccaagactccgtcttaaaaaaaaaaaaaaaaattggagataatttttaatagagactattactaatctaataataacttccataatatcttaagtttcacaacagagatgatgatataaagtagaattaagtggcagcctaattattaatgatgttctttgcctttgagataatccagttatacactttaaaggtttggtatctttagccccatgcgaggagagagtcgtatgtttttctttctctcacacacactccaggaaaggaaaagcaagcacagtagttaacccctgatagtttattagtcattcttgctttgtcgctttattaccacgaaactggtcagtcatggacataaacaaaacgtgcaaggataaggcaggctttcactcacataaaaactgccaagggccaaccccattgtgaatcactacagaaaatcattacaaaatcttaaaacaacaacaacaacaacaaaaacccagcactttgaatcatagtatctcttcaacagatacactacaaaactttatcagaaacactatgtgagagatgaacagagctaggaggtattttcacattagtaaaaaaaaaaaaaaaaaaatctcagaaatcatttatataaaaacctattgtgagaagtctaaatttacgttcaatgccttccctttctttcgctctatacagttttaaaatatgttcattttgttctaactgcacagtaataggcatggccttctaagcagaaaaaatatattatggcaaggaaaaatgaagagatacgttgctaacacaacagacttttgttaaacaattaagaggaaaaaaatgcatacaatatagcatttgctatataaccataacctctcccattcctggtgtcccactctgaattctacttgattcaacaacttaagatgcaatggaaataataatgtctattccagcagattaaaaaatacaaggcagcagtaaatgttatgaccaccagctaatgggctatggtggagaagcatccactgtggattaagctctcaagtactcaataacttttaaaaatgccttaaatcacccacaaaatgcagtatacatggctttgtgtatacaactgttaagtgtacaaatatacatcaggtgcaggaaatcaaaagcagcctttgtgaaaacttagttttatagtacttattactacaaactagacataaaggtgctgaataaaataattaagaaaaaggaaatagcaactttgaacaatcttataaatcattttatataagttagttatccttagagtatgtatactataattctgagttaaatatttatataatacaatttttgtaactgaaacaggatctcactttgtcatccagtctagagtgcagttgcacgatcatggcctactgcagccttgatctcccaggctcaaaggatcctcctgcctcatctacctgagtagctgggaataaaggcatgcaccgccatacccagtgaatttttttttctggtagagatggtgtcttactacattgcctagactggtcttgaactcctgaactcaatggatcctcctgcctcagcctccccaaatgctggaatgacatatgtgagccactgtgcctggtccatataagattttagagtattactctaagagattaaccctaccctggggaatcgatgtcaaaagttgggaatatctttcctaggtgaaataatagaaataacgaactctttagagctgactatgtagcaggtgcttctgagtgccatacccagggtaactgatccatgggttacattagaggaaattgaagcataaggcaagtaagtaacttggccagagctgcagagcaaccatgtggcagaaccaagatttcaagatttgagccccggcagtgtggttccatagacgctactcactggtctcttctgcctctggaagactctctccttccctgccttcttgtcacccctcctcccacccactgactaccactgtacagcgagggtcttaagccagagatcctatgagccgcaaccaccatctgtgagctgcacattttttgaggaattacctttccggcagcacatttgagggattcaaggacttagaacaacatgaaacaattcaacaataatgacaaggcaatgactatcgaagtgcagcttcacctcacaatatctataaaaacatccatggttattgcaccatccacttgttcctcttcctgtactcttgtcattgtttcaatagaaaccgctgactaccctgactgctctcatatatacccagaggacaaggtttgagcatcttctggtaaacagcaatctttcttcatgctggcatgacctcacactccacttcttgcctcttctctaaacaatttcttctgttgtatacactactataatcatagcacacatgggtcaaaatcactagtctaatctcagtactctacctgcaaaagagcagtacctaacaaagaaaccaacctacactctcatttgtgaagggcctactgtgtgtgcgttccagacgatatgtggtaggtgctgaccactttacatgcatcaactgacctttaaacagaactatgtccactatagcgtaaacacaatgagggctcagagtggacaagcaactggtggtccacaattccatagcctgttagggttaaagctgggattctaatctggtctgctcttgaaagtccccacttggtaatatttctctttctctgcctttgcctaaggaaattctatttattcttttttttttttggagtgcaacagcgctatctcagctcactgcaacctctacttcccaggttcaagcgattctcctgcctcagcctcctgagtagctgggattacaggtgcctgccaccacacctagctaatttttttgtatttttagttagagacagggtttcacaatgtcagctaggctggtctggaactcccgacctcaagtgatccacccaccttggcctcccaaagtgctgggattacaggtgtgagccaccgtgcccagccaacttattctttaatgtctcccacactaatctgcattctccctgcaggcagggaccatgctttgttcacctctgtttctattatacttcctaaggaatggacacttaaaacttcccgaactgatcaaaataaatgtgagaggacagtgcctagcatctaacaggctccttggtggttgcggtctaagtggacatgtacaggtgggattactcgaattctaagaatggctggatttaacacaagtcaaaagcatttggaaacaataatcatcatcctgaattcccaattctctcccccctcacctttctgcctctgctctaccccttcttctccaaccctatgtctcagtctgtctgtttctccactctcttgacttctctctctgtccctctcacaccattattgtcaccacaggcctttgaagcgactataccctcaaacacaccatacttatcttccacaatcacatctgaaatattttggctatagtttgcttatggtttgtttggccttgctgagtctcatgttgaaatctgatccctaatgttggagttaaggctcgatgacaggtgtttgggtcccaggggcggatcccacagagatggtttggtgctattctcaaaggagtgagccctccctcttagttccttcagaactggtggttaaaaggagcctgacacctcccacccttctctgtcttgccatgtgatctgcacataccagttctccttcccctcctgccatgagcagaagcttcctgaggccctaccagaagcagatattgttgctatgcttcttgtacagcttgcagaacaatgagccgaataaacccctttcttataaattacctagtctcaggtattcttttacagcacacaaatggactaagacaatttctaaccacatctgagataaaattaaccccctaaataagcacacaaatggtattgatatgatgaataactcacctcaaatgtacttcagatagccttctgcacaaggcacgtctcttgagttaacaaaccctagccaggcatggtggctcatgcccataatcccagcactttgggaagctgaggcaggcagactgcttgagtccaggagtacgagacctgtctgggcaacatggaaaaaccccatctctacagaaaaaatacaacaattagcagggcctggtggtcacatgcctgtagacccagctactcaggagactgaggtgacaggatcataagcccaggaggtggaggttgcaatgagcagcgatcatgccactacactccagcctgggtgatagagacccaatctccaaacaaaacgaaaccaccacacaagacctaaacctgatatccagatctgagaagacagaaaatattttcaaatctctcacatatatatgcattcatacattgctacttactttcctctttgtgtgttactgatgtcttcaagtaatcacacagctctctgcacatgccagctcttgtgttccaagtttccatgcagcatctcatggaattgcctcaacaactccagggctagggactactgtcatctgtatctaacagacaaggaggctgtggtacagagggctcgtaaagttagcacagtggagaaggcaggttgctactcagacatccattcctagagcccacattcttagaacacacagcctgtctgtccctccagcaccaccctgcctacttttagtcatcctggtgtcgtctggctgtaagttcctgagaattaccctagttgctaatgtactggaatggcatcttccttattaaaggcactcaatttagcaatgcatttgcattccctgattggttttccatataagtggttcacaaaatatggtccctctgcaccacttgggagtgtcttagaaatgtgtattctcaggctttatcccagacttgttatgttagaaactctggagcaagggcctacctgcctgtgatttcataagccctccaggtaattctgatgcatgctgaagtgtgaggcttactaccctgcatgatatttatggcaagttttaggtaacggtgcctttgaacactaactttcagaaatagaagatagaaaatgtgcagtaaggcatcttgcttcagtaacacccaagggcacattctgtctacagttcctcactctgtcatctgtcctcacacgtaggctttctgcttatacactccaaattacaactacctaacagcttctaaaatgagtgtctggcttggaagatttttaaatgctatcagagaatgtctgtttcaggatttaacttgtccagtgcaaagaagtgaggctgggccacaagtgacccatcacttcacctgtaagagcaaattaattacccctcaacataagtgttatatttatgtgccaagtatggtcgataatgaggtctttaccgtgtagccatatttcaagccattgttcacttaagtaaacacattttaatcactgtcattttattatttattcttgagtctactatacacctgtcagaacattttgtgtttgactaactgtcatctccttgtatctttcctgcatcatatataaaccactgtccacctccacatttttccctcttactgaagtcaagcactacacaagttcatggggacttagaggcaagtgtgacggctgaccaccccaatagtttgcaaagcctttcatctgctcctctgaaaacgcttttcacacattccttccatatatctctctgctgcaatctctctgttgcaaaactgttgttgatgaagtgacatttatctaagcattgtcactttgaataataccaaagaaagaaaatgaaaatcaatgtaattgcaagctatcaacctcaaattttattcacttgttttaaatttgtcaaatgaaaataatttgtttatctgagtaacaatatatgggtatcagtatatggataacaatttttaaagcttgatttcaaatttggatttttaatattaaaaagatgaaaaatttttagtccaattttccctagagaactctaacaatagtcatgtactgtataacatttcaataatgacagattacatagatgacagtggtcccttaagattgtaatggagctaaaaaaaaaaaaaaaaaaaaaaaaaaaaaaaacccgtaccctctagtatttattacaaggtacttttaacgattattttagagtctacttcttctatttataaaagagaaataaaaatgtaaaacggcctcaggcaagtccttcaggagttgctccagaagaaggcgttgttatcacagaagatgacagttccatgcctgttactgtccctaaagaccttccagtgggacaagatgtggaggtggaagacagtgatattgatgatcctgacctggcgcacgcctaggctaatgtgtgtgtttgtgtcttagtctataacaaaaaactttaaaaagaaaaaaaacaaaatctaatatttaaaaataaaaaaatacactaaagatataaagatagaaaatatttgtacatagctgtacaatgtgttttaagctaaatgttattacaagagtgtcagaaagctaaaaaaaaaatttaagtttataaagtaaaaaagctacaataagctgggcacagtggctcatgcctgtaatcccagcaatttgggaggctgaatcgggaggatcacttgaggccaggagtttgagaccagcctggccaacatggtgaaaccttgtgtgtatgtgtgtactacaaatataaaaattagccaggtgtggtgggacatgcctgtggtcccagcttctcatgaggctgaaggacgagaattgcttgaacccaggaggaagaggttgcagtgagctgagatcacaccactgcactccagcctgggcgacagagtgagaccgtctgacaaaacaaaacaaaaaacaaacaaacaaacaaacaaaaacaaaaaagaacaagctataataagctgagattattgaagaaagaaaaatatgtttaaaatttatttttgtttatttattttcttttttagagacaaggtcttgccctgcaagcccaggctggtcttaagctcccagcctcaagcaatcctccttcttcatcaatgtttttaaacaaatttagcatagcctaagtgtatcatgtttataaagtctacagaggcatacagtaatatcttagcccttcacatgcactcatcacttatgtactgactcatcctgagcaacttccagtctaagctccatccatggtaagtgccctgtacaggtctaccattttttacttcttatactgtattttaactgtaccttttctacgtttagatacacaaatacttaccattgtgttacagctgcatataatattcagtacaataacatgctgtgcaggtatgtatagcctacatgtgcagtaggttacacccatctagatttgtgtaagtaactatgatgttcatacaatgatgaaatcacctaaggacacacttagcacaatatatccccttcatcaagcgatggatgactgtattcataaaaatctggatattgaggggctgcctgataatgcattattatatgtattaaaatgtgtcttgagccaaatgctaattaactcttggctggtgcctttccttaatgtttctttcttctttttttctttttttaattctgattactctttgggacaaaaaggtggtgctgaaacaagatatcatttatgatcaactcaatacagagattacttaatatttatcacattatgcagaggcttcaataagttcatcaaaatatatgttccaaaatcctatgcatagatttcaaacttttcttccatcaaaataaattcatactaacttgttgtaacatgtctgagtaggatctagtttgaggcactaagaagattaagacatcagtttgaaaagatcccgtatcagagcaacatgaataacatgaattctgctaatgttgaggcaagaacatgcatcaaatttatggcgaagcttggatggaagaatggtaaagtcgctgatgctttacaagaagcttatgggggcaatgcccaaaataaaccagcaatttacaaatggataattcattataagaataaatgacaccatgtcgaatatgaagcctacagtggcagaccatcaacatcaatttccaaggaaaaaattcaccttgttcatgctttaactgaagaggaagaaggactgatgattaacagcagaaacaggcaacatcgtagacatctcaactggttcatcttgcaccattctgactgaaaaactaaagctgaacatactttccactcagtgggtgccaaaactgttgcacacagatcagctgcagacaagagctttctactgaaattttaaccaagtgagattaatgtcctgaagcattcctcagaagaattataacaggagatggaacctggttttacccgcatgatcctgaagataaagcataattatagcagtggctaccaagaggtggaaatgggtggggcccagtaaaaccaaaggtggactggtcacaagtaaaagtcatggaaacagttttttggtatgctcaagacattttgcttgttgactttctggagggccaaagaatgataacatcttattatgagagtctttcgggaaaggtggctgaagctttagcggagaaacagctagggaagcttcatcagaaagcacctctccaccatgacaatgctcctgttcattcttctcattaaatgaggacaattttgtgagagttttgatggaaaatcattagatatccactttacagtcccgatttggccccttctgacttttttcatttcctaattttaaaaagtctgtaaagggcactcatttttcttcagttaataatgtaatcaagattgcattgacccccaattctttagggatggactaaatggctggtattattgcttacaaaagcatcttaaacttcatggagtttatgttgaggaaataaagattttttttgagaaaaaatttatctttcaattctattttccacaaactttttgaagtcctcttgtactatcctcaaactttgtgcactaattgaaaaaatatatatatttttgtaaaattatttataatgttacatatataatatataattttacatataacttatgtatataattatatataaatttgcatgtaatttttacatatatacacttctacaaaggaaataagtgaggaccaattttttctaagtggcttaggaaaagctgaccaaataaaagatccttcctcacacactgtggagtccttccattgaagaatgtggacaacacactccatagcagaagtcaaaactggtggctgctctccatcatattttatttcttcctacgttttttttatttaaataaattgtcaactttaaaaattcaagatcttacatctaaatatctggatttccattacctcatggaaaaaatgaggcctctggcaaccatgaactcttatccccacatggcaacgattgcatggtactaaataataatgccacctatgccaggcttggattctcttcactccagtaagttctctgtctggctcctgtgggcctctgcatttgccaccctgctctgcgttcagtaataactgcaagagagttcttttgttcccagcttggattgatccaggaagatgtctaaagaaagctggaccaagagcaaactctggagaatggacgggaaagaaaatgagtaggaggggaaaagaagagtctctcaggataggcttatggtgtaagcaaagcctcaggggtgagggtcagggtatgggggaaggatgtgtaagatagagtaaaacactgaatgtactggtttgactgggtcagaggtgtaggaatgggaatagcaggtgaaaaacttcagaaaattcattgaagagagactgaggagagccttgagggctaatccaaggagtttctgagacattctctaaattacagttcttaactttctattgagaaacagatcaacccactctctatgcaatttcaggtaagctaaatgcccacttaaagcttaggcagcatgccctgcctctccttactttccattctttaaatcaaaaaacagtacctacaaatgttatgttaatctgggagcaacatgcccaaaatcaaaaggactgaacatgcccaaaatcaagaggactgaaagcaggaagaatgctttggcacagaaggggaaaggatgaagcggcagtggagagccatggttaaggacacaggtacctgcctgggttcacatcctgaactgagtatatgcaccatggtcttctgaaggttacttattatctctgagcctcagttttttcatctccaatggaggaaatactagtacctacattaaaggtctgctgtgagaattaagtgagttgatacatattatatatgtttagaatagttcctggcacaaagtaaggtctccacgaacattaactgtgctgctgtcagcatcactaccactgttaccactatcatcatcacttaaaaaactgcattaagtccagaaggatagtggctgagagttcatctgcagccgtggccataaaaatagaagtaaatacatgacaaagaagttgtgaaggaagactatataggacttggtaactgcagaaatgtggggaaaagagctatacagaagtatttaaagatcactgcatgaatctgaagctagatgatacaataaaataacatggacaaaggtcaaaaagaatgtggcttttggagaagtcacatttaagatgaaagcagaggactgcagtgggactattcagaagtagttgaaacggcagaaatagaattgagtagaaaggtcaggctagatgcagatttgacagctggtggtgctttgtgaagctgataatttctgcaaggcaaggggatgaggaacacagataagccatatcatcatgatcattgtttttagataccactgcctggacactttctatgttctaggagctgtcctgagcattttatatggactgtctcattaagccatgattatctccccattttatagatgcagacactgaggattagaaagtttaaaatccttgttcaaaggcacccagcttttaggcggtatgaattaaaaagtggaatccatagccttcactcttaatcatttactatattcctttccacagtaaaagaaaagtgagatgtaaggaaagggaataatctaagaagtcgagagacaaaagcgaatgagtcatgcctctgaggaagaaggtaacgagtttatgagctagatagagagtcttccaaaggctaatttgtgcttcatgaatagagaaaggtttttaaaaggaagaaagaaaggggcctaaaagggaaggagttacatttgatcagtcaaatactagacaagaaagtaattcccaagatcaaattccaatttcagtttgaatgcaggacaagtggcagggtttcatttgcttggcatcaccaaagaaatggataccagaattctgatttgacattcatttacaatagaattttgcaattatcaattgccatttttccagcttggacagggttattaactttttcttggaaggtgattagtgcttagattccatccttaaaaagacacagactacagaggtacctgtccggtggtggtaaataatgtcaactccacaacaatggctacaaacaccacatcacagatcaccacaccaacagctaacacaccaagccttctacctaccaggcaccacactagctggggctgataccgcacttgctacccagaactacccccatgtgacaggtattgtcactcgccagttcagtctacctctggtgcctactgtctggccctcttgttgatatttgggtaagtctcctagaatttgaaacttccatttactccctcaaaaaataaagaacggattatgttttgatagctactgcagctttatatagttgatgcacactctgtgtatgttctccgtcactcacatatagggatctagagaaaacagctatataacgttaggggaaggagtaaatccccttgttttctgataagtttatgagcgagtgacaaaaaggaaaatctttcttgtgcttcagaatgagacagcgatgaaaaacaaaaccacttctgtgcagggtgaaacaaacattattgccaaggccatttttgattgggaaatgaacagaagattaaatcatagtggctaagtgaaagaaaccagacacaaaaagttaatatattgtacgattccatttatatgaaatacctaaaatagataaacccatggagatagaacacagattaatgcttatcatgggctggagtggatgggagaatgaggagaaactgcttaataggtaagaggttttactttgggaatgttttggaactatataaaggtggtagctgcacaacattatcagtgtactaaatctaacagaattgttcacttaaaatgattaattttctattatgtgaattacatctcaataacttatttcaaaatgaaaaaatagaaagtttaaattcaaggatacatataaagaatttttttttgctttttccccagaacatttaaagaatcactataaaaaggaaactttatcctcctcatatctaagtttaatttgggaggatgtgggaaggggctttattattactgttacttctttgcttttcattgtccacaaaatcacatataggaatgcaccaggcaatcaagcattttctctacctgggctgtagccactgatgtaaactacatagaaaatgtattatacagataagcaaattcttcactgtgaaggtagtattctctctactcaaaagttttcaaagaataaactgcaactgtagaaaagaagggtaacttttaaattaatttagaagcagagctcagcttgccctttgcattagctcaggttctttgaccaaaagacacaaagtcagcattagacacctaggagattactgggggaggaaagcagggtaggaaggaagaacttccagaccatgatgctaatgcttgtgaagcagaggaagagataggaggtttgggaagaaggagtcttaggctccagggtacttccaagagaggtctggcaggccaactaggagtccttgagcccatgttccagtgagaaagtctcacatgtaaaaggaaggagtctatgctaacagctcattcactgactataggaagtttggacttgccatgagacagcagtggatcaaggatagcagtagctgagttcttcagccagttatgctcccacaacaagagacctcagtggcccatttttatggtgccacatcagcctactgatagcgacaggaggcggccaaatgcctaggcatataaaggcaggtccccagtgcaaccccacttccaagctgaaaacagtttaaagcctgaaaaccaagctacaggttaaatgcttggactggattgagaacttgtcttcctgtttggcacactttcctctgattgatcctcacctttcacctattttacatatacctaccctttcctaattagttgtctacactgccacgcccacctttgagtagcgtctttgctttaaccttttttgcatactcacagaccaatcagcacacactccctttactgagcccataaaagccacagcctcagccatattagagaattttcccactttcgggtaggggaaccgctccccacatcccctctttgctgagagctttcttttcacttaatgaattctactctactaactctccagtgtccacgagcctaattcctcctggttgtgagacaagaactcggacctagctgaactaaggagcaaaaaaccctgcatcactatttttcaaagtctctactatagatctggcagtacattaactctctttctcctgtagctatgaggaatgggaagctgtggttatcggaaacctgaaaataatacctacttttattttaagcaagagtttctgcaacttctctcctgaaaatctttgaggtataatgctagaaagggagaggaaataaaagactcataaaggacaatgccagtgtccatgctctaagaaaaatttcagccagcaagaaactaactagatgagaaagtaataatcgtgtgtgtaacccaaaaagggcaaatctgatcctgcctatcaagtgtgacagtttattaacattgattggaaatttaacaaatacacagggtcagtcacataggtattaatgccacacccaccctccacaatcagttataagcctgttctgttaaagcagtatgaatactttataatctgtattcatcagttttgcagaattgtaatgtttgtctgaaatctagggtgatacttagtaaattacacacttaatatgttagaaaatattaatgttaccatattacccaataatccaaattttgtggaaggaataaggtacctggaaggaatctatttgatttcataggagttaagaaaataatatatataccacataggtggaaaaaaaatctatgttttgggaaaaactgacaaactctggatgtgttacaagaaaatgttttaaaaataataaaaaaaatttatgtatgcatatacacatgtaatcttaaaaataaggaataaaaggtggaaagtctatacataagaatgaaattttattatatattgaaaagcaagtactgtgattaatagacttttttgaaagatgctaacataacctatttttgggccagataatcagtctcttttagaataaaatgtgctttctatcagctttttggtcactgtaacaataatttgctggccaagaactaaataagtggcttaaagtacatctgaaggtatttataacctataaaaagtttcctcttatcatcatatctgctttattaacttcaagggtttttctgcagaagttctctcattttctttttgcactgggattttgtccttcatagttctaaaagaaatatcccattttctccctttcttaaccctcaggatagaagaagtagtatcttctcacagtgtgtgaagactcattctcccaaaagatgagcacaaaggaatagatgctgagaatatcaatgcctgtgacatttgctgtctcccataatgactgccatgggaggacttgggaagcggactgcaatctgatctcaagtcttctgactcacactctattttggactgcttttgtcttggatctggagtatagaaacacctatttcgtggtcggtaggcagtttaacaatcacatacacaatgaagcaatcagaaaggtgagcaggtgaatattctctttcagaggataaattactttttctaggaaaatgattattggctgacaatgaggtggtaatttacttccctctagactataataaacaaaaatacaaagtaggacaccattttcaacagctgtgtgggtgattataatcaccttttagccttgaaactagtccctatctcattagctatgatacataattttttaaaaaatcatgccttcaaaaagaaaaggttttctgtggctgagttaggctagctgtccatagtgccacctattaccaaactttacagaggatgagatttcttttaagtaaaccctgcttctgaattcagagtatcctcttgctcccagcctccaggaactagtctgaggcagtcagttctattacaggaagaggacacaagaggtgcattatgtaagttagcaatgactaagccgggtgctctatggggatggcagtactctggatagtgaaataagtgctcttttaggtaggattgctttagttggtctttgagttacttaagagccaagcctagagcagaagaggttgcaacagaatgtgacatgagttggaatctgtagaacaggaattcaggagttgtccctagatactatagcagggtaagaaatggaagcggagagcacatcatggagacatggagaacagaggaggtgaaagaagccctgtaatgtgaagcacgggatggaggaccctggcagcagcctggggcctgcagaggaaaaagctccaagaggagctccatataagagggtggccaagttcgtggcatcagactttccactggaaatggattcctgctttgtcctataattaccctcttatctctatacctccaggaaaagaatgttctaacaatgttggtgttagaaacaccaaccttgggttagtagagcactggggcttgtagggatatgtaagaaacatctgctggtcaccaaggggaagagctgagcagaggtgctggcatgcacacagaagcaggaatccagagcaagagatggcagaagagcacaacagaaactcacacgtgtctgaaagtgctggggtagacagttggtctccccatggtaagcaggatcacaccatttgcacttagatcattagagaagctgaaaagactgaggaacttagggagtacgaaatctctctaagtgaaatctcagtgcgaaatctcagtgagaggattttgttagtctaaattcaaagtctctaaaaaacaaaattgaattagctgccaacatttaaaagtgagatcattttatttttcttaatccaaattctttggttaaaaaaaaaaattagacaacctgaaaatgttaggcttaaattccttagtgctgcatagaaattggtgcctttacagagaacagttcaaaacagacctaccacctagatcaatttaatcattgatacggctggcctgcccctggagacacccaattctgcagcccctggtagcacctgatttaaaggatctatccatgactaaagacattatctatgcatttgtaaaggttatttttgctttgcttgtagtgattgctcagaagatttttagtgaattccttagttatgtactttgaagtgaaatccaagtttcacctccatatacatgtgatctccaaagtggtttcatgctcatgaaagacagctgtgctggttattcctcattttccaccagatgcattctctttccttcctgatctgcatcctgggaagttatttcctgtgtacctgccagactcactgatcctctgacttactgttaggttcggccagtgagaattatctgcaacagaatggaggccaggagagaagagaagatgggtattgactcactgtcatggttctataaccctccacccccacaactcccattgtgaccccttggataaggtcagctcttatgtggctctgataacacatgatcccttctaggtttagaggtgatgccagcttccctccactgttagtccccggtgcttccccaccccatgtagtttccttaaccctatctataccttataagtaatcccattactaaaatacctcccattaaatctgattatacaatctgtttcctcctggacccctgactataagtcaaatttgaacattccaaattctggtacaaaagcagttggacagaaaagataaaaggaaatagagtaaatttcaaatgagtcttgaaaacaatttggacaagcataatcttgcagattggtccttacaagccctacttgccttaatcagatacctcaacagttgagtgttctgggtcatttcttctctgaagcctttcatttcatgcgtaattagaaacatgccagtctgtaatgatggcagcctttaaaatggtcagtctgtcacttccatggccctaactccagacacaaaatgcatgcttgattactaagagtcttattaaggggctattgtttcccccatccctgccagctcctcctacctcctgatctttatcatcttgcattctacttaaagaaggatttaaagagaaaaaaagaaaatctcatagacactcacatcagattgtattaataagcaaggtaaactacatctgggcttgtcactcacagtttttcttttcctctctaaatctaagaataacatgcagtcagttgcaaaacagggagcaagttttccaaagagcacgtgggtgggagaagccaaccatgaagtaaattccaacatcaacagtctggttggattccactgtggcccccactaattttcccaactttttgggccatgaaatttattattatcaactccaggtatagttataatccttggtaaaactcctctcagacctggcagatagtgtcctttaaagagtacactaattctaaaaactgcttatttctatattgactgagataggaaaaaatagccttcattttcacaagtgattcactctaatcatttaatacctattactgcaacaacatgcaccagatttctgacagacacctgtttgcaaattatctaagtttcagagcagaaagcctggtttagaaatacaataccatctgtaataaagtagcactagcactcatctggactattttggactaaaaatagtccaaaaatgaaacacaatagaattttagtttcttgaggattgggaatatcagtcactgtatagtcattgcttcaagaacagtacccagtacatagtagatgctcaatccacatttactgaaataaaaagaatgccttaatagcccactgtcttggcagactttacctactctcattccagcacttggaacaattacctactttcaaggaccacctttgtacagtcatgctcatgcccagaacaaaattcttatttcacagagataccaatagtgcaaaacaaaggttttgactggttctctgctttagcatatgaataatacactctagtctacagagaagataatggaagccaatagtccaagcgttcaagtggtacttacttcatttaaaagtaaaagcccgggatagacaaagacagaaaaagcagcattgaaataacctgtgtgagaaagcagaattttaacaacagagctgggcaaaggaaaaagcaattagtaggtttgtcttcatgcagcttcaagagtactggttgttaaaattatcttaggagctggtggtgcttggatttcctttcaacagaccctgaactatgcagtgcttaacctccttttctgagaactatccagggacaccaaataggaatggatgtgcacatcgctgctgtcagggctcagaaagataatacccaaaatgaaggcctcagaaacaaaagactcttggaccttctccagccctcctctctctagcctctaattttctccccataggccagccacaaaacctaaaaatattattctaatccctaccaccttcctgcataataactggccatgaagaaactatctgacctaccttgcttaattataggtcattagacccccattccagaaagcgtcctgccccatacccagaagcaaggaatgctgctgagaggcaaagatgaatgcagacacaccttgctgggttttctcagtctaccaggattagatcacattttttgtccaatcatatttctatatggctctctgtactttgttgagcccaagtacaaaattggacaatttcccctgtatctttgggtcatcattctgaaggctcccatgtcatgtaaaattatgatcaaataaatttgtatgccttttcttctattcatctgcctcttgtcagtgttttcagcaatccttcatagagtgaagggatcgtgtattaggattctctaaaaggacagaactttgcaaacccccagcttttctgcgtggcagataggaaattgaaagtacatctgcttggttgctgtccacaaccaatcagactgattgtgggccaagtctgcctttgcacagaagtgcaactttgtaaattcactttagcttctgattggttgctttccacaaccaatgagaatactttcgttttcaaaaaatccctactttttttgcgtcattctttccttgctttgtgtgttttgtctaattctttgttcaaaatgccaagaacctggacacactccaccagtaacaagaacaatggagaaggttcaaaatgtcagattttaaacaaaaatttcgaggctatttattacctagaaaaacaaacaaaaatgtgcagtttaaacaaacccaaaaagagacagagaatctattatttcaggtcactgagtatgtactactcagttgtctcgggatgtgacagtagctaagaccctctttctgacctagagaaaaatccttcattcttcaaaataaggtttgaagtcacttcctctaggtaggcttccataaacctagtcagatgctcattcacaggacttttacagatagctctttgatcctctctccaccatagaacttgtattacactgctcttacatttgattctaatgagactataggcttcaaaagaactaggaccacacctgtcttttgaattcccagccctgcaacagggcttggtttataggaacactgaaagaatagcctttggatttgttgaatgtaagtttttaaagtcagggaccaggctttacacagcccataatacaagctcagtattggagatgtttccagtattatgggtcctaactcaccaagacagaaggaaagacctcacttttccaagttcccattcagcaagggcaaggaaggagtaggaagcaatacaggaattcagtttctgaacgatcattaaaagaaggatgtccaggttgcagcagcagcagaaatcctataatatatttttgtttttcttctcaaatgagctagaaaattggttctcaaactggtgattttgtcctccactcccatcccactgatggccacaggaggcagccaaatgcctaggaagatgggataggggtaggtaccaggtggaaccccacttccaagccaaagacagtttaaagcctgaaagcctagctacaagttaaatcctcggactggactgagaatttgtcttcccatttggcacactttcctctgactgaacccacccttcacctatttaacatatagctaccctttcctaattggttttctaaattgtcatgcccacctttgagtggtgtcttcactttaaccttttttgcttactcacacaccactcagcatgcactccccattctgagtccataaaaggtcccagacccagatacatgggggactttcccgccttctggtagggggaccacccgcatgacccctctccactgaaagctgtttcaatgctcaatgaaattcttctctgacctcctcacccttcaatgttcagtgcatcctcattcttcttgggaataggacaagaacttgggaaccagtgtgcaagccagacttggcccaggtgggctgactgggcagggcgccccctgtggcaggtagagtgccccaagagaagcctcctacatcgctagccagaggtccccaactggcaaagagaccaagaaaaatcctgcataccaccaaacatctagcaaagttgggagacattttgggctatcacaactaggagggtgctacaggcatctactgagtagagggcagggattgtgctaagcattctgcaatgtacacagcagcccccaacgacatcaactgtgctatgcttgagaaaccctcagctagacaactctttgttgtctgcagctaaaaatgaccaatctcctttctaagctccaattttcccattggaatcatggcaacaataatcaaccacttcttatatgttaagtggtgaggcttaagataacaaatgtaaaattcatagagtatagcctggcacataactgctcaattattattagatatttgtagtaatcattattataataaaagccgcatgtctgcacataatatggaggtatcaggtactatgctaaacatcttttaaaaagctgatattatatatgctccaccactcaaaacatgcttggtaaaagaataaatgttgacatatgcttgcttattaaatgattatgtgcataaggcaaatataaaggacataaaagtgtttatcagggcacaatactaaaaacaataaattaaattccttttattccattaagaatgcttttctctaagaagttcctgatcctgagaaccaggcaatcttacatgcaaactcaaagctgttttatccctctcttcagacaaaatacaatcaaacaaggcgtggctgaaacctattactgctagcctggcagaccactggagccaatgctgccactaattctgtcctgctatatgcaggaaagcgaaagagacacacggcacttcagagaaatcaatttcctttattagcttcctttctttatcgtttgctttcactgtatgttttgtggatcaagttaatcattttcatgtaaagatcaatcttaatatggactttcatttgaaagttgttgtcagattttgtggagaagccaaattctagagaaggatggtggggggtggtgtggggtggggtggggtatacacctgacttttgttgtttccagcagcccaaccattccatgaatttttggtaatagtatcccaaaaccttcttccctaatgttggcaactgtttagttcagatgtgtcgtagccaaaattgggcacatttcccaattcaggccaattagatatttctccctaaattctgaatcttgactaaaataaacagaagactgaaaagaactgaaaattatttctttaaatcgtggtgtccttataagactgttcagtagcacttgctatgcataaaccccaatctactctgctttctgtcaattctcaagtctcattctcctatatcctttagtctatatagtgaactactcaaagcctgccaataatttttttttttttttttttttttttttgcttaagctaaatagaatctacttttgtttgcttataatcaaggcaatgctaactgttactggtaaaaacactgtaacacactactgacaatcatggatctggagccaggatatgatatttctgtttctcttttatttagtcatttatttaatccaccttgtgcttcggttgctaagtctgtgaaggaaaaaatgtcggaaaagcctaccaattacagatgcctagtaggtccagagggttgctattacagtttcttattcatcaattcaccccaaaagataagtaattgaatcttttttaatcccctgagatttatctagctcacccacttgttaaggaggatgcatgtaacttctgagttaagaaatataggcaagtttagataatattcaatgggaataggatatgcaaatgtacatactatattttttaaattttatttatttttatttattgttgcccaagctggagtgcagtggcatgatctcagctcactgcaacccccgcctccacagttcaagcgatcctcctatctcggcctcccaaatagctgggattacaagtgtgtgccaccaggcctggctaaattttttgtatttttagtcgagacagggtttcaccatgttgaccaggctggcctcaaattcctgacctcaaatgatctgcccaccttgggctcccaaagtgttgggattacaaatgtgagccactgcacctgacccaaatgtacatatttatgtgtaaataaacacacataaatttttcaaataggagcccctacatttctcttccctttgatgaactgttgaaccctaataaaatgaagagtatcacacaaccattactggaacctgttaaagccactaacagagaaagtcatatttcaagtatcagttgcatactaaacgaaggctctaccaatgacagcacatgcctcattttaaagctatctgagaaaattttcctcaagtcttttcaaccagcactcaccatgtaacttttgaaaacataggtcagtttatatgtgtgtaacacacaggcacattaattctataaacattcttttcaaggaagctgcctggacaagtgctaggttgtaacggcccactggactaaccaccctgcacgtgctgcccagtttcaacacacttcctcagccgagacttgagatgcaaattgagggtaaactcagcttccaggcatagacttgaacatttaatgccaacaaagtcccattgtcagacccctcctgcaactcctaatccacatatgtctatccggcatccactaggacaactacctgcgtccacaacattaacatgatgtggacaccccagaagtccactaaaacccagtggggcaaggaatgactgtactagaaatgtgtgaaaacaatgagatttgagggtctttactgatcaatgatagaggatgaggaaaaagaagaaaggaaaaagatcagtgaatgtctcaagaagacaaaaataaaggagattaggagagacaatcagggagagaaaagaaatgttgacggttaagaggagaaataattgacaacagaaaatgaaggtcagtcatctgggccaagtgtatcatttacttatcaacttggtatttcctaagatctaatgtgataggagatactacagaaattagaatgaaatatgactttaatattgattaagttctatcctggcacttgccctcaaaggaaagatcaattaccataatcagggaatagacttttttaaaaacaaaaaacaaaagccataattccagtggctttcctgagagaatttatgagtattgccatagattaaagaatggatatcctccagcagatgacagcaaaaaattctgtagcacagagtttagggactcgagtctggagtcagactcgggggctcaaacgccaactttgcagcttaagagttgggtgactcctgcaagttccttactatttatttgatcctcagtctccttctcagcaaaacaggagagtacagatttcattggattcttgtaaatactgaatatgatagtgtatgttacaaaagtaaatcataagcccaaagttcttttacttggccttgattaaaattataattaaagcattggctattaggttcagagcatttaggggtaaacttctaagcaaagaaactgttaacccaagcactactgaaaacataaatcctggagtaatcataaccctttgtttagagagaagaaagaaaaggtctaaagactatttaaagtaaagtgaaatttgagaccaatctgtggagttcgtgttcttgtaaagctgaatataggcatcatttggtttaccagagctggcaatgatctatcgcacaaattgaaagatttactttaactgtgaatctgtaaccttggactctggatatttatagctgtaatgagaaattacatttgttagaatgtttgtattaacttttttccccacaggaacttggtttgccaactaaccttgtaataaccatagactaagatgtcagtgatctagttacagtttactcaagccatttgaaaagctgaacattttcttgctgaaagtaatacatctaaagtcatacttccctgagagaataagtcattttggagttaatcaagaaagggacagattatcatcaaaatacaatgcaaaaatctcaatttttcacaacaatgcaattcattcagcaaatctcaatactcccatgctacacgaaccttctttagattttctcctgggtgtatctttgaaggagcatgaggaatatttgctatggctcaaaaaccagatatgcattccatctgtttaaaagcttatagggtattatagatgaagcaagcttctaaattcaaccttaaataatgggaaaatcgaacaaaaacaacaccctaacagatttattttaataattctggcaagaagtacaaatctaaggaaacagaagcaaaatacaggataattcagaatactaagaacctgctattgtttaactgaaagcataggtaaaagttacaaaaagtgatgccacgttttgatgctgcttactggctgcatctagagagaggcaaggaggtatcaggcatttctgccaaagctaggtgaggtattaaccactgagaagataataggaatagatgagcaagttatccagatggtacaagatggcaggtaatgtatggataattgcaagcctctccggagttaagggtactaaagaaaagaaagtctatgtctaaagaggagaaaagaagacagacaagctggttacattggagatttttatttataagactgacacaggttaatttcattcccatcaagcaattattaataaattctcacaaggttttatcgtggataaaagaattgtaatacgtgattttaaatattttaattgccaaaaataaatttccaaagtattcacagcatttttttactttgaaaagtaattagcataagcaaataacacctcctgggtgactacttaacatatatactggctactattcatgaaattgtatttaaaatgcagagtcaaatttccatatgtaagataaacagtatattcttcatttcatttttaaaaatataagagattaattagctaaataatttccctggaaaactattaagtaggacagaggattcaagaccctaaaattaatttttcaaatgttaagaggtttatacatccaagctcacttccattctcatattgcttatttaatgacttcctgcaaacacagacaccacagcccaagatctttctctttcctatatggagtaataagacagagaacttaaagttttggtctttgcaaaatatgtgtactttcttcttgaccattaattcttgagccctgaggcagatagaaaaattggagtagtgtgccaaatgtcaatgtaaaggagacaaatttgacaggagatggagaagcattaaccccttatacctatatatctaaaatggtatgttatatatgttaaatacacataaaggatttctgtctgcaccatcatagaacgatctaagattcaagcacccaaaattacatgatactgatgccagtattctttacatattagaaaaatcttgaactagttcttaaatctgatgacttgggtctccccagtctgttcaataagacattttgactcctattaagaagaaacactcttcttatttcaacttggaaattaacaaagaaaacagcattcattgtagggaaaaatggcacattattttttataacctcctcttacttgagtagaaaaataatccacttaatgtgtctagaagggcagtaaccctacattaggggagaacagactcccagggaaaaagccatttacaaaacattgaggaactgccaaacgttgtagggttcatacagccacagctaattactatgtatattgtatttctggacctactggcaatatattggctgatctttctggattgtgtcttctcagctgaacgttgtttatttcccacatcatgcaaatgacagggaggatgttggtctattttgtgattggcagggtaaaaacttaaaattgtgttttagattaggtcacaaaaaagtgtgccagatggttgttaacaaaaaagaaaatgctttcaacaaacctcacatgttgtataatcttggacaaaatacaaaagatgtaaatgtcctgccacaaatatattggagctggatccacctgacaatgctgaaatatctagtagaaacaattcccaaagaggtatgaatctgacttttctctctagaaaaactgctggatgacttcttagaaaagttaagtcagaacccatgtttttttaaaaaatcatttttcagtggtacctttgtatttattgtctactctagtattttctcttgcctggggtggggggaaacattttttcacctgtattatcttcagagaagataatacacctgcagtgttttagcttggaaagttttaaaaagtaaacaggacatggtggcacatacctgtagtctcaactacttaggaagctgaagcatgaggatggcttgagcctaggagtttcagtctagcgtgggcaacatagtgagactcccatctctaaaggtaagtagatacataggtaaataaaacaaaggcagtatattttcatttccttaataaaaatcttgaggaaggtgggggaaaaggcatgtactagcttgcgttcctcatagtccattagcagataattttctcaatagtgtatgaggacaaaaataaataaataagaccagtttcacatttaggtccctagagattcacaatcatcatctcccttctgtctgccaggatttaaattttatttttaatgtggcctctcttacgcatttccctctctctgcagatttcctagtctctcccaagataactggaattgtactcagtattagtcaagtgagagtgccatttattgaccaccgaagaaaagccaggtactctgcagatctcacttcattcctcatagccataccaggaggtagcccatttgcagatgggcaaactgtaactcaaggtttctcacctaggaagggactgagcagagtctcaaactgatatggtttggctctgtgtccccacctaaatctcattttgaattgtaatttccccatgtggagggagagacctgtaatccccatgtgtcaaaggagggaagtaattggattatgggggtgggtttcccccatgctgctcttgtgatcataagtaagttatcaggagatctggtggttttataagtggtagtttttcctgtttgcacatgctttctctcacctgccaccatgtaagatgtgcctgcttccccttccaccatgattgtaagttccctgaggcctccccagccatgcagaactgtgagtcaattaagccctttttctttacagattacacagtctcgggcagttcttcatagcagtgtgaaaatggactaacacacaaacctagatctaactctcagacatgttgttgatgttgacagaaggtaaaagagtccataccaaatgaacattcttttagctacatacagcaattaattttcaccagcccttgagaaaagatttgaagcactagtcagaaggaaaatttattaaatagaagggaaagacatcaaagagttaataaattcagaaactgtacaactgagccaggtgttgaacagaggactagacatggagttagggtgagtaagagggagagagagagggagagaaacactaagaaaagaaaggcagagaaccatgcaacgacttccctgattttaacaatgaaagtagctcagaacataggagttacttggccaatagagttaaaggtcttacttaagaagtaccatgcaaattccatttctggttgccagaccctgatataccacatgttcatttctcaataagtgcatgttaggtaaattgaccactgtctcttctgaaatggaaatgtctatagtggtaaaggcattgccattggatttgaaagctgcaaagcaagttgactgcagggaactctgtgtgtgtgtgtgtgtgtgtgtatgtgtatgtggcttgtaaattattcttttaaactgcttacaaattagctgtgaaactggtagtatgtagttgtccatgtcaataacaaaaaagcaaacacacaaaaaatgcagatcagaagaaacataacctcagtcacttcatattaacagaccattcactcatccatttgtttaaatatttatttaataactaccacatgctacgcactgtgctacatgttaggggatatattggtgaataaaatagttatggttttagcaattacaaagcttacaatctagtcagaaaaacagacaaaattcaagtacaacagaaataactatgtaactacaaattgtgatagaatatgaaggaaataaatgaggcacaatgataaagactggaatgataggcgggtggatgacagagaaatgcatttacatacagtggttaggaaacgcctttatgaatccaaattctaggatctagatggagctctaacttaaacatatattggaatcacatggagggcttgttaaactagattgctgagccccacccaccaaagtgtctgattcagtagttctggagtcaggcagataacttgcatttctagtaagttcccaggtgatgctgatgtcaccgaactaggaagcacactttgcagaattaccggactagagcatagtgcaggagacagaaaggggcctgagctgaggttggaagagtaggcagggaagctctagataccctgacacatgctcagtgacaatatcagtgccaaattcagaacctgtctaggacttggagtgagtctaatgatcaagacaactatgaccactactgttatctttgccaaaggaaggacctctattactccctcttctaagctaagaacctgaaagcaaatttatcaaggaatacaaagaaccaactctaaaatcaaacaatattttttacaaagcattgctatattaacacagtatctaccatccaaagaacctgatgttatcagagcatatttaatagagaagataaaagagatcaaaaggtggcatctgccttcaaacatagagcgttctgaggattacggcaaggaaggcatttctgttaatagtagaagatgtgagcatgcaattattgtaagaatgatctaaattataagtaaagaagatacccttgacctcatctggtttgaaacatttaactggcttccaaaggaagataatctttattagtatttgaaaagttagatagaaagctaccagaattttgatagtttcgtagctctcaactttagtcttcccccaaatcatttgggagcttgttaatggtgtagattaccagagccatcctcagagtttctgatggaatcagatgaagtgaggcccgggaatgtgcactttaataggcatcctcaggcattctgatgctggtagattaaggaccacagtttgagaaatacctagttaaggcatggtaccctgtaaatggcaaaacccagatggataatctcttatggattttgatagagataattgaagttttactatgtgccaggtactgctgggcacttcttaaaagtactccctttagtttttaacaatttaaaaaaataatactcaagtgatgagaaaatgggattcagcaaagcaacttgtctgtagttgatcatgtaccaaataatttatagagccagaatgtaaactgagggtttctgactccaataatacatttatttcaatgatactgagctcatgattgctaacctttgtgaagctacgacaatcattaaacgatttcctggcaaccacagcttctcctaaaagcattatgtgatttggccttttaaaataaagagaaacagagtgtaatcatatcttgagactctgaaaaatccttagatgtctaaaaatattcacaggtgctggacaaccaagtatatgaatcaataagagaatccctaacttaaagtcttgtccactgatattacactggacatatctatccaacatcaagctcagagacagaatgtttagcagtgaagggtagaaactgaagacaaacgcctgagttaaaaaaaaaaaaaaaagtctctatcatggattagctatgtgaaagtgggtaaatgatttgatttctctgagcctcactttcctcatctataaaataataataattactttgggatttttatataagatattattatataatactattatatattattattacatacaatataattatatataacatattaattccattaattataattatagtgtaaaatatattatatataatagcttacatatttttgaatcatttggcatagtacctaccacacagttgttcaatacatgttatcttaattcttattaaattattacttttaagaggcatgtgatgcagttaataaaatagtggaaaaaacataaaggcccaataaacataacaagatggccaatctaatcagaattttgaaaaggcaaataattaaataaataaatcagcaaaatatcacaaaattccccataagatcataaaaaagtcaatattcataggataaaaatattggtgaagaagaggagaaataggtattctctctcataaaccataaattgatacaaccaataaaagggcatttgacagtttgttaaaaaaattgttttaaatgctgtgatacagaaatcctattttttcctattgattctacactcagtagaacagatttcggtaaccttttcctgtaaagggacaaagagtaaatattttagagtttgtgaaactttttacagtctgtcatgataactcaagtctaccacaattgtgtgaaagcagtcccagacaatgcatacatgaattagcttggctgtgttttaataaaattttatttatggacactgaaagttgaattttatctaattttctggtgtcaaatattcatatcgtgattttttttcaaccacttaaaaatgtaaaaacatttcttagcttgcaggctgtaacaaaacagcagcaggcatgatttggcttagcagctagctgtagttattaactgctaccttagagtgatacctactcatgtgcacaaggaggcatggacaaagacatttactgtagcgttaaaaatctgagaacaggccgggtgcggcagctgatgcctgtaatcccagcactttgggaggccgaggcgggaggatcacgaggtcaggagagcgagaccatcctggctaacatggtaaaaccccgtctctactaaaaaaatacaaaaaaattagccgggcgtggtggcaggcgcctgtagtcccagctactcgggaggctgaggcaggagaatggcatgaacctgggaggcggagcttgcagtgagccgagatcgcaccactgcactccagcctggtcgacagagggagactccatctcagaaagaaaaaaaaaaaaaaaaatttgagaacaactattagatcatcaatagagaaatggctaaaaaagtgtggctacatccataatctggaatattatgttattctatgctaatactatgttagcaaaaagaataatttatcacatacaattgtaagagatactcaagaaacttcatggtgaaaaagcaagttgcaactgttcagtaaaaatgcaagctatgctcggacttagaggttttagtacttgcaccattatggcagtgaaaaaattcgttagagaatgaggtcggtcacttttggttcatcattctgtgatcacagaacacagtgggtccatttgctgagacggagccatttgctgttcataaatgtttggatttgtctttcaacaactagctgacaaaggcataggcttaaatgagaaaagaggcaaagaaaatataatagaaaaactcaaagaacacataattaaaagcacttgggggactcctgaacagattcctactgtgtttttatactgaatgtcatcattctcaatgatcaggaggcagatgacagcatcaagacaatatggtgtcaagtcacatttcagaatgttcccggggctctgatcagcattagcctgactaaccagatcagagaagaaagtggtcacagcaaataccctgtctcagttcattactcaacacctgttaactgtgattaacggccctggctaattatgtgttaagagcatctcaggctgtaatggatcccagaggtctgcaaacttgacttcatttacatgtttgtctcctttcagaaggtctcagccaaacatggccgaaatctcccgagcattttatgaactcccatgtcatcaactcagagtttcaaatacaccagggtcttcctagaaaggacaacgaatgtctgagatgtacatttgtttcacagataaagcaggcaaggtttagattttatggcacataaatgggcctcttgttgcaattaatattataaaaggctgctaatctgtgtgcattaaactaattgttacattttgtgatctcggctaaaagactaaactgtatttagatggcagaatgcactaaaacctcgctttatgtctcaaactaaaactgcaaaagtcagaaatcaaaaaggcttcagagaagctttttgtctactcatttttagttttaaaaatatgtattaacattaattttacataattatgtcatgctatattcatacattaaatattaatacatatacaaacctatatatatgtatctgaatgtgtgtatatatatatatatatatatatatatatatatatatatatatatatatacgtgtatacacacacaccacagacgattagacagcccttaccaaggtatttttcttgcttttcttaaatggtattgaacctaactcttcctacagttaactgaaagtcaactaattaacatccctcccaacttttttttttttttttttttttagtagaggagcagagctggcagcagacattaaatccttcttcattcttatttgcttagtctagcaaagtaatgagaaaaaagtaaatccactaacaattgtgtgtgatggaatattatgcaacatctagtattcatgctactgcactccagcatggggaacaaagtgagactgtcaaaaaaaaatatattgaatgtctacatgtactgatatggaaagacatctatgacatatgaagtggaaaaaatcaagctgctgaacattagatagcatattatgatgcaaataaatgtgctataatagcccaactccacatatgtgcatctttagattcctgtatacacaagaaaggatctgaaaacatatagaattacaaggtcttacaagcaatctggttctgccttttttagcccgaatgggaagtacctatcccaaatgaccttcatcatcttcacaactagaaagagattttcatggtcccttctacccagtaacagcagagcacagtggtttggaacatgtgccgtgcagtcaggcaagtgtgcctcaaatcatatctaccacttactggccaagtcatcttagacaagttactacattttccagtacttctgctgttttctcatttgcacaacagtgcccgtctcataaagtttcgtgagggttgtgatttaatagccgtatagcacatgccttagcaagtgtcgtcaacactcacctctctatcattcttagctagtactttcttcatcttgcctcagttattatttgaaatgtgcttgtttccttagtcattacattttctaatttgccaaatgttaaacaagggcaagagttggcactttctgtgtctctctgcttcctcccaccaccactgtaagccccaaataaaataattgttttttacatttctgaaagcttttcactctgttacaaatcaaggggctccaacatgcccttgtttctaacaattctcaatgcagtttaatgctaggggtgaggtgggctcattgacttttgctcttggctgacatttccattagcacatgtgtggtgtgtattttcctccagtattctttttgctaagagttccgtctttctctaatttcttacttttaattgtcttttcttattgatctataagttgctgtcactttgatgaaacctaagggcttcaagcacatctctgctatttactagctggaatctttaaaaaggtatcaattaggttcagtttcttaatgggtaaaatgggcataatatcatctatactttttcttcgttttgaaataaatttggcttttaccacttagagaattcatgtcaattttagaaaaacaaagaccaaaaaatgaaataaacaaagataaaaccattcataatcccactacagatgtcaaaagtctattctacatccttctagtccttataaatgtacataactaaaggttctgggtcaaggggtctagacaattctgaatcttgctttatttcttattctctcttcccagaccactcaaaatgttaagtctgatgtgttttaattgaatacctttcattgtgcgtaaatatacacctaaaatcacaaatataaaggcttttttactgaaggccatcatgctttgcatatttcctgtaacttgctttgctaactttacaatatatcatgtgcaatcatccatagcagatatacattctaattcttaatgacctaataatcatccatagcatgtataacacagttcattcaactagtctcaagtgatcaaaattctttgttttcatttttttgccactgtgaacaatgctgcaataaataattttgtatatatatttttatctatacagaataattcacaaagagattactgtgttaaaggctatgtgtattttttttatttaaaatgatacagccaaactgctaagcaatatatatagctcctagcatttctccacattctaacagcattggatgtcatatattattaagttgtgcctacatcccaggggaaaaaaatctatcttattttacttagcaattctctgagattaacttttcctttttactggctatttctctctggcaaactgctcattcataatcattgcccagttttcatgtggttcactttcaaaaaacttgcatggagtgtcttggtatttaaatggtttaagtattggtttgtcatgtgtgttataaatgctgcttcacctagctcagtgtttgcatttgcttactgtccaacacacataatgaaagtctgtttaggaaaatacatgctttcatacatctttgtttctggcttgccttccatctctccaccccacatcgtattaccatcatttctcttcctggcctctcttgctttcaaattctaactttctcgtctttatctcctcctcaccagttatcacaattacctctgtaaagaactaagatttctcccactactttttttttttttttttctaaagagagaataaagctttggccgaagacagttttgatgagatggctagaaaaactgcttttcttcattggcattttggaaatattgctcagtggtttgggacccatttatttctactgcctctatccatctttgctttatggcttgacttctgctgctttaactccacattctgttttgctccacttcaactgtttagctgccaggtttggtctggtttcactgatttactgtatctaatctcattccctccctggattctgaaccccatcctagaaaaggcacttccagctcacagactcgcatgtttatcgattgaaatttagttcaatcgataaacattttagcatacttgggttcaattccaatagcacagatgttttcagatcatttcagatggtgagacccagaaattttaattatttttccaaacactgctaaaaactgacattaaatttcatccatgaactgaaaacatttttactaggagaaaatcatgatgctgatatatgcaattatgctataaagtattattttattttgttaggtattccatttaatactatagaagtattatgatatttattacataaagcattattataataaaatctcagtaccacccagaaaaattaaaggtttgaccttaactttctccaatttttccctattaatatcaatttgcttttcttgttaagaaaatattaaggtggaaaacttgaaacaggacattctgttctattatttttatgttgagaattgggaaaatacagcttttgttgtatagaatgtggtatgtatgtgatgagtatggaaaatgcatacttccaacggaagcagagagacttgttcaggggccattgcaaaactccactggcaaggcgctatcagcctgcagcaaggttgtagaggcaaaggtaaaagattagagattgatttttagagggtgagctaaaaggacatattggagagctcttaggcagtgtgagggcatattctgacatcttaaatgcctctgcattttaaaatttctgaccagctgtcaattttgtccatcaaaatctcagcctggttatccttgcttataagcagcagattttttgagtgcccccatatgactccaggtttcaaatgtttgctttatcgtatgtcccaaagtccaaatactggagagtcatatggaaatattccaaagatttgcacacagaagtgtgacacataaggtgagaacagccaataaagctgttaggtataagcagttgtgcaaaagaatcagttgtatagccagccctgcaatgcttggaatcaagcagcatggacacaaagtgtctatgtgtacccaaacagggcatagacttcaatgctttttcctttcatgactagtctaaggtttttgaagctcttctcataccttatcacattttacatacctaaaaagaatcaatattttcttgttctttacaacattcttttttgttgttgttattgctattgttgaaggacaatcaattctgatttacataaactcaagggtaacttaaaaagacagttgcagtaactaagattgaagctggcatgcctttcccgagtgaggtgttagacataaaaatggctttcatttcgtaatggagaaaaaagacttaagtctctgggacacaccactcttctcccctaatctcttccacaaatagcagcctgggtgatctttttgtaatgaaaattctatcacaaactccaaatattaaaactttctcatggctttccatcatcttaagaatgagatccaaattcttcaacctagtttaaatggttctatgccagggctctccaactctggtagacccaaccctccttaatacaaatattttgtattaccctcttcactctcctgagatgaaatctactcttaagatactctacctacacttgtatttttaaaaatgttataatatcttaactttaatactaaaaagaaatattagaatgggacagaatatggttatagaagttctcattcccctagacatacccaacggaacaggcagcctcaattgccaccagcagcctctcatggcaaagcgagggaccagcctcaagtgaattaagcactatagatggtagagtagagagacagaattcaggtccttgagtagagtagagtatagatggtagagtagagagacaaagagaattcagatttcactgcactggtgaatcaaccaaccctgaagcccacattacattcagactttttaatgatccaaaacaaattcctttcacagttgaactttctacaatgggttttctgagtatgacataaaacattataaccaacatacccagtcaaaaacagagcgtgagaaacagtgctttctcaacagcttgtctaaagcatgcttatataattatcaggagaatatgtgaaaattagtgaggtttttttctgattgatatgaatgagatatcttagacttcatagagatgatgtgtttaaagaacagcctaaactaaatgtttagtaatgtttcccctaataattcttaaagtttaagaatgacattttctaatttcttatgtattaaggtctaacatacttctcaggcatttaaggcaatggcgcaataatattcaaaaattgttaaagctactcaccccaactccttctaccagtcctggtgcagctaagtaatgcagctgaccattagcacacctgaaactaccacactaatgtggcttttcagggcaggatgaggaaatacagtgcccctagctaacttcttgcagcaaatatttgtttcaattttttaagtgtagttttcctaataccataacaaaatcatttcccccaccttttctcttcattctttcccaaaagtaatacagctactaaaacactgatagtataacaatttatgttgtacttctttctgcttttatcctagattataattgtactacagtaactatagtgataaaggtaaacacttacatggaaccatttgtgtagcaggtctttattccaagcactttgaaaacattaactcctttaaccctataatatccctacaatggtgattactacttttattttactgatgagaacactgattttactgatgagaacgctgaagttcagagaggttaaatcacttggcccaaagttacacagctgtaagccaaggtttgaacagaaggtcagtgctcttagccactagactaccctgcgtctcaatacagagagcagtctggggaaaatactggctaatatcggagaacatgttttgagattattagaaaatgaactcacatacatctcaaagctcttagatacagggagataaagactgcttttcaaagagaaacaaaagtaaacaaaatgtatttcttgaagagcttacaaagctaaagtcagaaatgcatctccactctgtcctgtctggtcatctttaaacttctacatcctaaagctttggtttccaatcagtcacaatctcttgtgctctgatgcactccacacactcactcacacatgcattgtgcatttcacacccacacacacacaaacatgcccaaaatacatggaagaaagataaaattagctgtcttctctttgttgttgatcaaatgtagctgaagagtcagcaggggataaatatcttgatgcttacctcaggtacaagtgctttgaagaagaacatagaagagcaacttttaatgtagcattgtgaaaagaaaaaaaaatgctataaaatccaacccccattgtggggtgtcatttctaacaatgaggtttgttttctttatctgtagtgcatatagatgatcaaacaaaaataactgatccacaggctctgaagtttttatcagtagtcaccttctgcatggattaataaatcaaaaagggattttaatcctatcttccctttaacattatggcacatacttttgcaataagcgtggggcaaattgggagcctttctgagacacaggtaggcaagtaaaaaccacattagctgaacgtgccttcctaggtggtagaaacacatggatcaagggaggatggttgcaacacatccctatcaggaacccactgcaactatctgaagcaccctcctacaggaggggatgggaaatgtcatcctgcagtggaagtgaatacagggctgactattcagatggaaatggccacttggctcaattatgaactgtggttggcactaatagagaagcaatgattttgtttaattctttacaaagacaaaaattaaaaaccagaaggagataaagccaagaccactgccaaagatgatctttctctccaatgttcagtaaattctactcaactccatgattctctcccaccctgggcctccatcattcaaatgtgaaatcattacctggatggtgaagtaatctgtacactaaacccttatgatacacaatttaactatatagccaacctgcacatgtacccctgaacctagcagttaaaaaaagaaaatgaagattttaacacaacccaaagggccaacagggaagcatcccttttttccttatagaaaatagttctcagaactatgatgtattcatccactttttaaaagtgaaaaattttataaagcaagaaactcctcaaaaaggtcacagatttatcatgatgttaaaagtcataaaaattatagttacaggctaagtagttaaatcagaattacacaccacccaattaattttataatcaatagagattaaaggaaatgaggaagtaaagtaaatgataggatcccagcttaaatcaaatcaatatatatttattgatagccatcccatataagatgccatgaagaaggaaaagtgttatggaaatatgtccttgtctctgagcagctcaccacctggctggggaattgatatgtaatatgcagagaatttatgtgcacagcaataacaatacaaggggtgtcacaaggcctcacacaagtcatgaccaacagaaccatgtagaaaagagcatttgtattaatgcaatggtcaagagcctgggctccagagccagacttcctggatttgaatctcaactctaccacttataagctcattgaccttggactagttatgagtctttcagcaggaataaaatagaacctgactcacatgatgattgtaaaaattaagtgagtgaatacttgccaagtgcttgcaaataaggcctggcatacaataattgccatggaagtattaaatgggcaaaatacaattgaaagaagagaaagatctccattgctctaaagtctcccaaagtcctaggacggtttaagcagtgacggatgatatcatgttcattttccccttcccacgaattccctccctactgctacaaacattcttaggtctagaccatactaaagattaaaaatgataaatagtctctactttgtaaactccctgtaaaaaatgttagactcttctacatatgcatctatttatcactgctcacattcattcattcccttatagctcaaaacctgactccaacccctaccattctacagaaagcactacaaaaaccctaaaatctaaatccaactcccatttctccttagtcaacaccctctctagaacattacaaattattcaccgtttgatcatcacaattttctacttcctaggctctgtcattgccatcagaattttggcttcgagaagtaaggactgctcttcctcatacctacatctcttggcatgcagtagcatgttcaattaaattgctttactagacagtgctctctacgacttttggtcagcagacttctgagatgtccctcaagattcttgcctctggtatatgtaacccatataattcctccctcttaagtatgggcaacacttgggtaagacggagtacacttctgtgactaggttatgttatacaacaaaggtaaggggatttctcggatgtaattaggatgccaaaatcaattgactttgagttaatcaaaagggaaattatcttgggtgggcctgacctattcaggtgagccattttaaggggctgaggcttttttttcttcctaaaggaagaaataattcaaagcctaaaagaaattctactgctggccatgaaggagaaagctctcaagttgtgagagggcttcaagagatagccatgtggcggagacctgagagcagcttctaggagctgagaatgaacgctgcgcagtagccgaaagataatgggtgccccagtcctacaatcacaaggaaacagattctgccaacaggagacagctcggaactgggtatttccctagtcaagcaagcctccagataagagcacagtcaactgacaccttgatttcagccttccaggacctttagctgaggaccccagctaaaatatgccatgttccagcctaaatattccagcccatgaaaatggtgagacaataaatttctgtggctttaagccactacatttgtggtaatgtattacacagcaatagcaatctcccgtaccctctgccttccctctgtcttttcctctggctgttttttcttgatccaacacctaaatgtgggttaatttttcctggaatttcttctttctcaacactctccaaagtgattatgcctaattgagttactttaataaccatctatatgtgattattgctagatttttagactgctcttctctcttaagtcatgtcctatttttcctactgcctgctggtcaattccatgtgggcactaccaaactcctcatttgatatctcccaaatctaccttattattgccccatctacctcttgctcaatatctctccctcctagctgggccagtcctgttaatgtcttctccatcctcccaatcatttagtttgtaaacatcactaggacattcttcctctcctgtttccattagaaccaataattggccaactcctgttttaacaagtttatattcaaggcttcttttctattcccaataggtactaggttggcctttttcttcctaatttattaaaaccttagttcaaaatctctaagtatttacaagtaggtcttccaaagttaatgaaattggcacaaccccaagagggctctcaaagtccaatacatgtaagtttccaatctcagctctgccacttaattgcaatgacctaatcatatttttaatatctttgggtctcagtttcctcattcaattattggagaaggtaacatctatctcacagggctattgtattacatgtaaaggaatccaatcaatgataactgttcgaattattacctggaatcgtggcaataggacccatttccctgtcaatcggacttgaaagcttaacaaggccttcaattcttcttcctatatccctttactgaaccatcagggtaaactgaatcaatgtcctacttggtagcttcatcagagcacgttttgagtctgcatccagattgttaactcttggaaaacattagcaatattgcttgtttatccttctttctgtgaacactgactaccacattcagcaataaacattgataaagaaactgaagagttgttaaaatggaaacttgacagcataaaggaaaaaggacaaagaagcaagtgacaggggtaaatgcaattggtaggctgcatcttagctaaactcaaagtgaagcaatgatgccccagcaggctaaggttactcttaatgagaaagtcccttgggacataaatgtcatcactgagatctgatcttcttctaggacagttagaattttcttacgggagagaggcagatactagtgttgttcacctcatcacatgcaacccaaagaaaatacccaatatgaatgggattcttttgaacaaagggaaagaataaaaataattggatatgcttgacaactttcagttactctgcttggccttaaggtgttaagagttgaaaatctagcttttacctagtgcagctgaaaatctctctatataatgcaaaacttcaaaccaccttaccaaagagaggacagcactgagacctagttatctcttaggaaacttcgcaggctattactttgagtacaaaacaatgacacaactttatttcctgccaaacactgagggtacgacattcataaaaattttggtctagtttatgaaaaataaaccaggaggcatcagttaaaactcttataaataccttctttaagtgattttaaaagatttcactgatttcttccacttatcaatagtaatgaaataaaaaaaagtcctagaaatggttacgctttggacaagatttgagtaagacattaaaaaattctattggaagactgtcccagaaaggagcaagagctaaatatggagacaaaattcaaagaaacccaagcaaaaagaaggaaggaagtcaggaggaatttcctgaacaggcacaacaacttcagacccatgagggatgggaaaacaaaagaagttctagatggccttaccagctagagaacaagcaaaccctggcaagagcctccccaggcagcaggtttaacatggcccggccctgtttaagggtatctatcacacagtgatagatgatgctctaataaggctctgcagggtgatggagggaacccataaacccaatgtggttgggatgaggatggaacaataaagaagagagaataaaaggttactagttgttgagaaccctacatgtaattttatgtataatagttgactttatccccacaacaactttctaaaatatcaatatactcactgtataggtgtggaagcataggtactaagaggctaagtgaggaggtggaagaagtcattggtgagcaagcatttccattctttcctaaacacctatggaagaagcatacctccctgccttcactgttggacttggtcatgtgactcgcatgaaaaggcaacagaagaccatgtaccagcttaagcccgtgccttaagaagtttctgcttgtacctctgggagatactgactgactggagaagaacatacactttccaggcaaacacaaagccatgatcatggcaccaaaatgagacatatggggcagagccgtcttctgacctgcagatttgcagtattaaaaagatgccctcagctgctctgtggagctgtgaggatacaatgagactgttgcattccactggagaatagagcgagtaaccagtttactcaagtgtctaaaagtgattttttcactaagtacctcttactagcacttaacactgtgtctaaaacacagtagccattttctgaacaaacattaccttttttcttccacagagaggaagaaccacagaagtataatacagaaacccacttctgacttccacctcaaaattctaaatatagtacctttatgaggtgtcttacttctgagccaacttgattcttacacagcctatcccattttgttctggttcattgtgggtctaagggcaatatttttttttctgccataaactgctttcttgcactgttacttttacaaatcacattagctaaaaatactgcattttattctcttatatcattctctctctaaggcaggatacttcactcttcactgtatttttataactctcatctggtatttttttatgtctgttttctgcacttatctccatcaagtttagataacagtcaccaacttcttgatgactctaagcttttactgaactttgggagattacatctatgtaaggttcgatgtactctactaattaaagatctctttctattgcttccagcagttttcattccttgagattaagccaatagttgcaagggtggtgagattcagggcagtgataattctcaactactctaaagcaagattgctcctttttctcagtcctggttttgggccaggtgcggtggctcacacctgcaaccccagcactttgggaggccaaagtgggcagattacttgaggtcaacagttcaagaccagcctggacaacatggtgaaaccctgtctctactaaaaatacaaaaattagccagccattgtggtgcgcacctatggtctaaactacttgggagctgagacagaagaatagcttgaactctggaggcagaggctgcagtgagctgagatcgcaccactgcactctagcctggatgacaaagcaagattccatctcaaaagaaaaaaaaaaaaaagaatgaccattaacttcattctatcccttacatgcaacattcttgctccatcatttctttttatgatgttggcctaatgatttagtatttaagttttctttacaaactggataacaattaacaattttatagcaaagcaggggctctcccaactcagaaccactgctcgctcactcttatccgtagaatcaattcaggatgcttagtgtagctgtcgctggctgtttcactgacctatctcttgccgacagctccctcaaaactatctccccacctcccacacatacttgaaagggaactaatgtttatgctttcaatattatttaagtatatattttaattatttcaaatcatttagtattttactggtgaaggacgaaggctcaagttctatcttgtcctcggctacacatgcagtaaatgacaaagccatcttaccaaagtcgggagtctgcatttcctaagcacctcactgacatcctgcaacttggcttacaaacttccctcagctcaaaacgcctctcaaacacccccttctggtgagcacttacagactctctcatgtccagctcagagtcttctcttagtagctttttatggccaccctgagacaaaattaactgttgccccatgtgtgtatccgtggtctcctgcatagttttattagaggaaacatgcaaatacactattcctctgctcaccccactgacctacagctccttggcagtagggcttttatttttgtttgcttgggtttttgttctgagacagggtcttactctgtcacccaggctagagtgcagtagcgcaatcttggctcactgcaacctccgcctcccagactcaagtaatcctcccacctcagcctcctgagtagctgggactacaggtacatgccaccatgcccagctaatttttgtattttttgtagagataaggtttcatcatgttgcccaggctggtcttgaactcctgagctcaagcgatgcacctgccttggcctcccaaagtactgggattagaggcatgagccaccatgcctagtctgggcctttatttttaattctcaggactgactatagtttttgacacattgtaggcactcaacattcaacatccaataaatgagtgttggacctaatctagatagctactacaattattaatgaaaaggaaagagctctgagggaacatgcttccatccatatgcgtcatctataatatactgatagtgataaaaactgagtgtatagtgaaaccgtggtaaatatatcactatatagcatttttatcttaacacagaggttcttttaaaagcttctgaggatggcttatcagtacttcataagcaagagactactagcatgcaggcaatttacaaataaacataattctaattttcacagctaaacaattgagaagggtcataggatccttaaaaactgtttatgaaaaatagctcctgcctcaaatagctcacatggatctactgggggaagcattggtgacaggagtaaaattaacatgttgccaacctaccaatgtgcttttcttggatgttgtcacctattaacatcaaatcacctatacttgtttatatttgattatggtttttgaaaacacatttttgtgtttgttttttacttataagattaaaacacatcaaaacatttgctagaagaattgtcttttttttttttactgtgataacacttaagatacatactcttaagaaaattttaagtgcactagataatattgttaactgtacacacattacacagatcatctctagaactaatagttcatcttccataacaaactttatatctgtcagacagaaactctctattcatccctgcccccatcactatcccctggtaatgaccattctacttttttgaatttgactgttttagatttctcatataagtggaatcatgcacttctgtgactggttaatatcatctgacatgatgaccttcaggttcatctacattatctcctatgacaaggtgaataatgttcatatatatatatgtggggggtgtactatacatgtatatcacattttctttatatatccatctgtggaaggacatttaggttgtttatgtattttaactattatgaataatgctgcaatgaacatgagagtgctaatatcctttgagatactgattttaattctttaaaatactcagaagtggtattgctagatcatggggtaaatctattttcaaaattttagaaatctccatacagttttctataatcattgcatcgttttattttcccaccaactgtttagaaggattccaatttcttcatacacttaccagcacttgggttttgggtttgcttttgtgacaacagcccatcctaacaggtgtgaggtgtcctctcactgcggttctgattcacagttccctgatgattagtaatggtgaacatcatttcatatacctgttggctattagcatgtttctttggagaaatttctatttaagtccttttgctcattttgtaaccaagttgagtggatttttttggctattgagttataggaattccttacatattttgcatattagatgcatcagatgtatggttcattttttctcctattccataggtggcttttccactctgttgactgtttcctttgctgtgcagaagcatttcagtgtgaggtagtttcaattgtctatttttggtgcctgtgatttcggtgtcctatccaagaaattattgcctagacaaatgttaaggagatttccccatttccttctacagacgttatagattcaggttttacttctaaatctttgtttcactttgagcttatttttatgtaccacagaatacattaaaattggacccttttattataccatattcaaccaattactttaatgacagtgggtggttactgtataccttgtctgtaccgtttctctcaaaatttgcatttccctttgggaatcttttgcagttacatcccactatctacctctcagcatttagaaaataaatattttctcttccaaatcactattgacagcaaaatctcaaagtaaatccatatgtgaatagtcacttttaaagaataggcaagttaaatactcagcaggaataaaaagtacaactctgtctttctctttctgacacattttcttccctgctttcctccttcatcctgtgagatgagggatggcagggttgcataggggatacatttgaggtttacatcaatctcacacagcagggtgagaatgatcacactatcctagtcccccaccaggacctctggagtaatgtcacatttccttgccactgaaaatgctacctgatgtacattaccttgtctctatttcaggttttaataacaaattcaaactgtcttttcaaaccattttcttaaatgtcttgacagactggtactagtgttaccgtagataaatgcctgctttataccaaagagatatcagaataatttctcttcaatttcctcctgcattttgcctaattattttgaaacattttacagtatattccttggtcccattaaattaaaatatctctttcattctttacccattgctgcccacccaccaaatcatagtttctactctttgggttgtcattttggaaataacatcttactaactacaacattcatagttaaaccaaagaaaacaggtatcatttgtaacagtgttttttctccactgtggcatgtatcaaagatcttcttttttggtttattttacattgtctccaaacaaataaatctaaagttaaaatacaaagtatccttatcagaccaccccttatcagccacttcacagcaaagatgactgtgtgctgggccagcagcaggccattagcatgcacagccttttctctttgatttgtgctgaaatgtaggctatccagttcatactagccttcagccaaagccctgtgggaagtaactgcaaaccataaacttccagtcctttacagacatttgtaatagaaaaagtatgcaaatagagccaccaacattactagggagtctaacttttaaatgacttagtgttattggacttgatttgtaaatgaaaaattcagatatgatggcaaggctgtttttaacaactctcctgatgtgattgaggagttgatgtactattggggaattatatactttataacgtaataaaaatgatttttttttttaccagcaacttgatttatgaagaatggtgcacacgtctgctgaaatatcaaagtaaactttggttacattggcgaggaagctaaaaggctaatacctccagggcacataaaagcttaggccttcttttggtttcttttcagggtgaagataaatgccagattgagttactttgttttttaatacttaaatctaagactttaataacttttatattgtaagttaaggggtacatgtgcaggtttcttacacaggtaaacatgtgtcatgggggtttgttgtacagattatttcatcacccaggtattaagcctagtactcattagttacttttcctgatcgtctccctcctctcacactccgtgttctgacaacaggccccagtgtgtgttgttcccctctatgtgtccatgtgttctcatcatttagctcccacttacaggtgaaaacgtatagtatttggttttctgttcctgcattcgtttgctaaggataatggcctccagctccatccttatccctgcaaaggacatgatcttgttctcttttatggctgcatagtattccatgtgtatatgtaccacattttttcttttttcttttctttttgagatggagtttcgctctgtcatccagactggaatgcagtagcacgatcttggctcagctcactgcaacctctgcctcctgggctcaagcaattcttctgcctcagcttcccaagtagctggaattacaggtatgcgccaccacatccagctaatttttgtaattttagtagagatgggagatttcaccatgttggccaggatggtctcagactcctgacctcaagtgatccacccacctcggcctcccaaagcactagaattacaggtgtgagccaccacacccagccagtaccacattttctttatccagtttatcaatgataggcattcagattgagtaacttttattcaacaatttttcacaagtatatgcagtgtgcccatcatgccagccactgtcctaggtgctgaggacacagcagtgaataaaacagaccaacagaagctctaggcttttatatgtcctagacatattagccttttagtttcttcaccaatgtaaaggaaatgtttactttgatatttcagcagatgtgtacaccattcttcataaatcaagttgttggtttaaaaaatcattttttattaaatcatgaatgtaatgtctgtggccatacagacaaaaaacgctgccttcatggagtctatattctaagcaacatacgctgctcatcttcacagatctgagccaaaagaggtttctttttatttctaaggcattaatattaactcaggtcaaattttattcattttttacaaagtatggatttttaaaatgaatcatcattagaaaatgtttacctaatgtctaggaaaaacattattggtctgaggttcttttaactacccatctacttcacaaaatgttttgctgtgaattaaactacacagcctacaggaaaagataaaatccaagtataaataaagtaaagaacagcacctaacaagcacctcgtattttgtactttcctatttgatttgattatgttttcaatctcttccccctgttcacaggagaggccaactaaaacctaaagtttagtacaactttctggaaattctgcaaagtggcaaacaaactgagaaaatcgtatgccttaaaaacccatcactgatgttcttgatcaatagttggcataaataaatcgtagacatgtgggcaagactgctggagccaggcaaggatttttcttaatgtggacagtgatgtcactgaggcagagagaaggaaggcatatttacaataaaagggagtgattatacaatacattaaaaccataaataaatactccattaagttataaaattctctctatatgttcttaggaggccttcctgtcaggcacttaacttagagaaaagcaagtaaagctccatttatcattcatttagccaaaacttgctgaatcctgctctatgcccgccatgacacatcatcatcactactgtgtattaagagtttactacatcctatgcactgtgctcagagattacatgcatcatctcattccagcaatgatcaaccctataagctgggtgttctttttaataatcattatatagattaggtaaacgatactcaggttgtgttatttatctgtggtcacatggcaattaaataatcagatgtcatatgagggtatgtagttctaagatataaattcatatttatgttactaaataaaggccttctcatgcaaaacaatcaacatctaaattcaggggaaatccagacctatattctaaaaatatggagttaataggtgtttggctgacatactttaagatattctctaccccatgcaccaaaatcatgactagtcacttgaattaatagatatctacacacttcaacaacagctacctagaataatgtatcatggtaatttacattttttaaaattaagatacagtatgattgtataaacatatgtaaactttcatatagtcatattatataaaaagattctatataattacatgaggcaggataagtagtcaaggaagtaatcatgtccttgggatatggcaactgtggcaaccgtacagtcaaaacaataagccccagcatttgcaccgtagtccagctcactcaagcaaagctatctccagtagggaacttcccctggagggagcatgcacatgtgatttcacctgtcctcagactgaccctgtgctgatgataatagtgaaaaacacaccgatgggtggagatttaagatgctaatgagacatgtggcacatggacaagcatgtacagctactgcacatgtgcgtccagacgaccacccagaacatgcttactagtaacactgctttccacctccttatgaataatcatgtaaaactccccaaaactccctattgccagtctttgctgtctcatccttacaagcagcccaccctgaattctctgtctctcagggtgtactgtctattccgcacttaactttcaaaatatgcttttcttttgcagtaaatgactctgtgctgcatatcctttgctgtgtcttgtttaatttcttttaaactaagaagaactgaggtctcacaacagccttcaaaaattacacactgttaacttaaataacaacttgacagttcaaatttaaagagaactattcctgtttaataatcaatcccctttttactaagacaatgggaaaataacattcatgctgatcaccaactaaccacattgttgggttaaatcaaacctctgcaattcctttgagaacataatgatgtccgtggtacccagaacaccaaaattgcctagactaccttctagaacactgtacaatctagttccatcacctcagttgtatgtttaccaggaaaatatcaattcccaaacccatcatacttttagtgtatttacatgatttaagaatataagagactgatgaaatatgcggaagaaaatagagccattgcttccattacttttttcgaaagatgagataaatcgaattggtgagagtgattggctttatattagatggagaaatctttacaaggtgagaaagatgattacaaaagcccagaagaactgtgccttagactgctttgcaggcatccaagtttttactccactttgaaggaatcatcactggtgcacagtgggtaacatttatttgagaaagtagaggtgagactccaaccagtcaattcatatttaaggaggtctagaaccaagaattaccaaacagatgcacattataatgtcctaaaaacatttaaatagcatttttatttcttggtaaagcaacatttgttgctctagccaagagtttcaatcaactgacaaactagaagtcctaactgatttgaataaagggcttctactgtgctctgtgcaaagccttgggtagctagaggcaagattctctagcaacacaagctctacccaccccggttacccacttcagaaccctgcttttagttttgggtacggcctcgaaggattacaggtgatcagatggatgacatcctgagtcatcagtcagtgattcctggtctcagtcagtgattcctccaggcacatctcccttctgatactcctaaataccagaacagcagcctgggaaaagagcaagtaacactcacttctctctgggcatcatgtgtctcccaacccttgagtgtcaagaatcactcttttctaaactcccaggctcctcaaagagcagaagtgcaggcatatatcattttagaacggaaggaatattccagacttgctgctcaagaaacaaaagatgcaagtgtctttgggcttgttcaaaagtacaccccttctttctttgtgctgtgggcaagagatgcacatgccagtctaaatgaaccactgctgtgtttatgttcatgctgcgttccatcatgtttccaatcctttactctttctcaccatttactgaggtactctcacccctacttcacatcgacagccccacagctggtcatcctcagtcacagtcttgccagttctaagccaacctagcccccagagtctcattttatatgcacaacagaggtaggcgcattgtccattagcaagtcaaagacttcttaaatcactgaatggttcctaggcttcttggaatgatttcaggaacaacttgctgcccttggtccacttctcttccctatccaaatttcaaacaagtaactggtatcttcccagtcatcagttcccaagactagacttttctcccaatcagggaaattgggcttgttacatttccatgacatgtcattctgagtgccctgttacccgtctctatctggaagatggtatataaatgaaatcatttacacagtgccattctaattttgaaaggaattgtaggcatgtcaaatagggctcataccaaataataacattctaaataataagagaggccaccaattgaggtataatatgtaccaggtcctacgcctgtaactttacctgcactatcatttaattcgctcagcaatcctataaagtactattgatatcttaccatgaggaacctcagcgttaaaaacttgcccaaagtcacaggtcatgtaaactcatttatgtcaaatttccaatccaaactatataacccaaagactccccaaaggtaaccaaacagataaaatttatataaatccaaagtttttttcttgcctgtctttctgcaatattcagtggggcaataaatctctggaatctgtcatttcagtatatttttaataaagtagactctttcacacactctcctggaacctctctccagttgctcagcttggaggaactcaaccaaagtacaaataacatagggcaataagtgatacttagaatttaagatgctttgggttttatgttggcatacgattctgatactctaccaaattacaacccagcaagagaaatgtattatgaacttgtgtgatataataacaagttaaaaagagtcatcctttcttggaaatcagcatgttcaccccttttgtttttgcttttgttcttagaacttgctgctgtacctcttgcaaagtcccataaggtagaaccaggtgatatcactatctttacctgatacaggagacagaaaagaatttaaaaaaaaggccattttacacagaagggacctaattctgaatgattcaccaatattcgatgaatcactgatgagctatacctttgccctcttcagattccttcttggctgtactaccagtaagtttgaccatgtcaatgcagggagtttactcacataactgtacaagtttctaaaaatgtctagcaataaatatattattcttggaagttatgttctcgggaaaaagaggtgtctccacttacttaacaatgaagtagctcactgaatcatttaaatagtgggctgaagaaaacaacaaaatctttaaaaaacaatttatcatctcaaacttctccttgaacaactgtttcttttttatttaccttagagaataggcaaaggaaaataaaatcacttaacacatagagaactcaagatagagacacacctttagaaagagtcacatacaaactggttagtaaattaggctattgtcttataaaagttgttgtaaatcttaggccaatacattcttgaagaattgatatttgatgcatctgtaggtatttatatatatatatatatatatttgtatttatatatatatatttatatatataaaaatatatatatatttatatgtataaaaatatatatatatatatatatatatatatatatcaggtcatttttcctcccgctcattctttttttagttgtgtttttttttttttaattttaagagacaaggactcgctctgtcacccaggctggagtacagtggcatgatcatggctcactgcagcctcaaactcctgggctcaagtaatcctcctgccttagtctttcatatacctgggactacaggtgcatgctaccatgcctgactaatttttttaacttattgtagaaatgggatctcactgtgttccctgtgatggtcttgaacttctgggctcaagcgatcctcctgcctcagcctcccaaagcactgggattgcaggcataagccaccatgcccagccctggtcactctgaaaggaatgtcattctcttttttgaaaagagatgtgatttcattataatgcctaattgttttgccacatacctaaggttcctgattcatcctcctaagtgacaaagactttttacatagaatcaaaagaacttctggtggtgggaagatggtctatagaaaagaaaaactccccccatgcctatgtcctgaatggtattgcctaggttttcttctagggtttttatggtttaagatctaacatttaagtctttaatccatcttgaattaatttttgtataaggtgtaaggaagggatccagtttcagctttctacatatggctagccagttttcccagcaccatttgttaaatagggaatcctttccccatttcttgtttatgtcaggtttgcctaagatcagatagttgtagatgtgtggtattatttctgagggctctgtcctgtcccattggtctatatctctgttttggtaacagtaccatgctgttttggttactgtagccttgtagtatagtttgaagtcaggtagtgtgatgcctctagctttgttcttttggctcaggattgacttggcaatgcgggctcttttttggtcccataagaactttaaagtaattttttccaattctgtgaagaaagtcattggtagcttgatggggatggcattgaatctgtaaattaccttgggcagtatggccattttcatgatattgattcttcctacccatgagcatggaatgttcttccatttgtttgtatcctcttttatttcattgagcagtggtgtgtagttctccttgaagaggtccttcacatcccttgtaagttggattcctaggtattttattctctttgaagcaattgtgaatgggagttcactcatgatttggctctctgtttatctgttactggtgtataagaatgcttgtgatttttgtacattgattttgtatcctgagactttgctgaagttgcctatcagcttaaggagattttgggctgagacgatggggttttctagatatacaatcatgtcatctgcaaacagtgacaatttgacttcctcttttcctaactgaataccctttacttctttctcctgctgattgccctggccagaacttccaacactatgttgaataggagtggtgagagaggacatctctgtcttgtgccagttttcaaagggaatgcttccagtttttgcccattcagtatgatattggctgtgggtttgtcataaacagcttttattattttgagatacatcccatcaatacctaatttattgagagtttttagcatgaagggctgttgaattttatcaaaggccttttctgcatgtattgagataattatgtggtttttgtctttggttctcttcatatgatggattacatttattgatttgcatatgttgaaccagccttgcatcccagggatgaagcccacttgatcatggtggataagctttttgatgtgctgctggattcagtttgccagtattttattgaggatttttgcatcgatgttcatcagggatactggtctaaaattctctttttttgttgtgtctctgccaggctttggtatcaggatgatgccggcctcatacttcatgtctaaaacaccaaaagcaatggcaacaaaagccaaaattgacaaatgggatccaattaaactaaagagcttctgcacagcaaaagaaactaccatcagagtgaacaggcaacctacagaatgggagaaaatttttgcaatctactcatctgacaaagggctaatatccagaatctacaatgaactcaaacaaatttacaagaaaaaaacaaagaatcccatcaaaaactgggtgaaggatatgaacagacacttctcaaaagaagacatttatgcagccaaaagacacatgaaaaaaatgcttatcatcacttgccatcagagaaatgcaaatcaaaaccacagtgagataccatctcacaccagttagaatggtgatcattaaaaagtcaggaaacaacaggtgctggagaggatgtggagaaataggaacacttttacattgttggtgggaatgtaaactacttcaaccactgtggaagtcagtgtggcggttcctcagggatctagaactagaaataccatttgacccagccatcccattactgggtatatatccaaaggattataaatcatgctgctataaagacacgtgcacacgtatgtttattgcggcactactcacaatagcaaagacttggaaccaacccaaatgtccatcaatgatagactggattaagaaaatgtggcatatatataccatggaatactatgcagccataaaaaaatgatgagttcatgtcctttgtagggatgtggatgaaactagaaaccatcattctcagcaaactatcacaaggacaaaaaaccaaacaccgcatgttctcactcatagctgggaattgaacaatgagaacacctggacacaggaaagggaacatcacacaccggggtctgttgttgggtggggggagtgggagagatagcattaggagatatacctaatgctgaatgacgagttaatgggtgcagcacaccaacatggcacatgtatacatatgtaacaaacccgcacattgtgcacatgtaccctagaacttaaagtataataaaaaaaaattttaaaaaaaaagaaagaaaagaaaaactctgactccattgtcttgaaactttgtttttgccatctaattccttaggcacaattttctggctgaggagaaactgcccaaagaccctagttccgttagattgaaaagcgatgaaaggaacagtgcaatgttttcttgatggggcactatggcctcaccacagatgtggcttagttacctgagccctacctggtaactccatgtggattaccataagtactctaaaatatggtaatcaaatactaatgcacgtaagtattgcttggaaaacagagtaagacagtttccccggccctatctccagagattctgattcactaggtctgggtggggctcatgaatttgcatttcaaataaactcacagatgatgccaaatgctagcctgaggaccacattttgagaatcactctagaggactgggattccaaagcactcagggtaacctgtatcacagactgtatctaaaatgttgttcttggattacagtggtctgtagctttaagaagcaattatgatacgtttcttaccaaaggtcatcaaagaaagcacactgctgtgatggcaagctatccacttttataaaaagaagaagaagaagaaaaaaaaaagaaacaaagtaatggctcttctcttggaactgagagaaagctgactctggtttacgaaggcctatctcattcctgatcgtttatcatttgagagaggtgtgaacagtctatgtcaaaaatgctcattcaacattcccaggaagccactcacagggctgaatgtaattttacttaagcctgtctgaacttgcttttcttatttttccccctgtagacacacgattttctttctttgtaagaaagaattcaaagacaaagacacagatgtgatttcaccaaactagcaaactttaaagcaaaaaaaaaaaaatcatccatttctgtttatagcaagactccctgttatccctctactcatcttcctatgcagagagaaaatgtgaaactgtaatagccactcttcaagactgattaaataaaaatcattcaaaagcctgtgttgataacatattcctatcttttgtgtgcaaatccatattgtgtttcttggaagacctaatatcctagaaaaaatagacctgcttcttactgaaaagcagcagttggaaactgaaatgcctacagtacaagtagtaacaaaattaatggaccaagccaggagtgaagcaagggagggtaggagggacaatggagttcttgagagtcctggcattactgggagaactgcaactaattagcttcagaaaaaaatccaattctgataatgccaattggggcatcattgagattctttccattttttgtttgtttctcttggtcctctttcttgatgtgtctgaggattttaagtagaattacagaagctgtgaatgcagaattatagagactctgcatgatggtatctcccaccaaagaaggttcatcctactctctggcagccagtctgaaatggggcgttactttcatccaatttggaattgagttgactcaaagctggttagtgttttgaaagatgtggtccacctctggtttacacacactccataggtgtggtttaaggcctgtggggtacactagtacacctgtcattcgtggatgtgcaactctacttattttaacctcagccctaggagactatcaaaaacacacacagtggctcacacctgtgatcccaacactttgcaccaaggtaggaaaatggcttgaagccaggagttcaagaccagtctggtcaacatagcaagaccctgtctccacaaaatacttaaaatattagccaggtatgctcatgcacacttatagtacaagctattcaggaggctgaggtgggaggactgcttgagcccaggagtttgaggttgcagtgagctatgatcattctactgcaatccagcctgggcagcagagcaagaccctatctcattaaaataataataataataataataataataataataataataataaaaagccttcaggtataaatctacccaaggcacccatcttctctcttaggtcttggttcctctgaatcctggctgctttggcagacccaaacttctatgcttgtctcttcagccttatgagatcaccaaaaattatgttgcccacaaggtatgattttctagctgcctgttttctcaactgctccttgagccaaaacccagcaaattccctgaagggaaaagcagcctgtggactcccggctcagcactctatagttccctgatttctgggtctcttggttgtcttggcagttctttgttatcttcaaattaggtttacatgtggcttttctattgttttcaaagaaacatcagtttgtcacaagccactctaatttagccaaaagcagaagtcctcaggttaatttaatagagtaataatataattacttccccaagaaataatgtttttattctgaatatgaggttaaattcaaatttaaacttaatccatatgttacataggaattattttgttaagaattagcttcaaatatgataatacacatattctattccaaacaacatgacaactcattcttagttcaatgatctcttttaagacagatatatcaagcaatttttgtaatctgtcagcaggcctcaaagaaacttcaaataaccataaatcagtgttatcatttggagtacttgagatgctctagataaatatttgatggtagatggacactaggcagaggaatagtttcatctaatacaataataaaaaaaatcacaagacacccactagtaagtttatcagggagcaagatggagaatgttgctgacagaataccactcctgcagctgccagtaataattcacccttgaagcaaagagatggagatttaaatggggacactatccaacttaagcctttctgtagaatatagtgtcctagatgaagacgtatgtagtaaagatgggggaaatgaccaaattattcgattaccatgtgttacctccaactgggacttccaatattcctgaaaattcacctgcagaagaaagtaaaagagaaacaacaaattctcaccatgaaatgattttgaatgctatttcagaatattaccctgttagatcatctcatcaatgaattcaggggccctctattatgtaggtagctcaagaacgtagcagaagccttggaagggactgtccatggtggatactgacctcaattgctctcggattataacggactatagcagtggatctcttgagagggctttagtctcttccttaacatgcttttatcccagggtgggattactaagatcaaatgcccaggcattcaaatgatggagatgtagaatggtatcaagtttggcacacatcctaaccaattaattggttttcataattatcaagtgttaagatggagtcaaaaaaaatcacacaaaaaaacttaggtctaaaagcaaacaaaaaataattttagctatgtgtgcagtatcaagtggtatcaactgatgtccaaaaaataaaaagaagagcattttctgtatgtggtaggcactgtgccaaggatattacataaaatctgctcatcttcacagtaactctgaattaaataccgtcataatcctcattcttacggataaggaaaatgaagcagagagtgggtaagtaatttagtcaaggtagtaagcagagagagacaacctgaactagctctctggatgcaacattgaaagctcttaaccgcattgctttactggcctcctggacagcattgatcattttccctgcactttaagaatgtaactacggattatggacacgtgcctttcctagctattcttaaattctgagcttaatataaaattaatgacatcctgggagccatgattcttccctactacatctcactaagaacatggtttatgaaatctttatagctagttgaaatgtgtttactaagtcttgccaggaagctcattttatagggatatcacacacaggcaatataaattcctatggggctaagaagccttcattccaaccagtgcttttcctccaagtaattcggtaggtttggaaaatgaagcatctggtctgctcttttccacaagtttctaagcttgaataaagatcactcacttgatacagaaagggttggaaaaattccagatctggcctctgaaggttacttcccagaatgcggctgttaactacctattactgtttagaccaagtatctttgagagggaaaaactcgctttgattgcctaggtacttcaagctgcaaatctgcatttcagtgaacaactactaagtaagcagacaggaaagagaaccagtgccccggtctgtatgcaacatcttgttctagccttttgtgccgaaaagctatgcaactgtgagaaagtcacactgtaagcctcagcttccttctcaataaactgaagatgatgatgatgttcttataaaggtagcgtaagtgaaagcacttagaagttattcaaatatgacatcatatgcgcatacacacacacacacacacacatatgcagtaatgtggcacttaataatggagctatgttctgggaaatgcattgttaggctattttattgtgccaacatcacaaactgtacttacacaaacctagatggtgcagcctactacatacccaggctatatggtatagcctattgctcctcctagatacaaacatgtatagcatgttattgtactgaatactgtaggtaattgtaacacactggcaagtatttgtgtatcaaaacataaaaaagatactataaaaatatggcacaaaaggtagctggcgtggtgactcaggcctgtaatcccagcactttgggaggccgaggtgggtgcatcacaaggtcaagagatcaagaccatcctggccaatatggtgaaaccccatctctactaaaaatacgaaaattagctaggtctggtggcacacgcctgtagtcccagctactcaggaggctgaggcaggagaatcacttgaaactgggaggcagaggttgcaataaaccgagatcggggcactgcactccagcctggcgacagagctagactctgtcaaaaaaaaaaaaaaaaaaaaaaaggcataaaaggtagaaaatgaaaatggtagacctatatagagcacttaacatgaatgaagcttacgggactagaaattgttctgggtgagccagtgagggagtggtgagtgaatgtgaagatctaggatattattgtaaactactgtagactttaataagcactgtacccttaaggttacactaaatttattaaaaaataaagtattaataattgcactatgacattacaatgtctacgtcaacactgggcaataggaatttttcaactccattataatcttatggggccactgtcatatatgtggttcactgttgactgaaatgttttatggtacataaatatatatatatgtgtatatatccccaagatataaatatgtatatatatctctaagagctgagctgtgcatattatccaggtcctgtatagaactgtatagaactatgcaagtgacaaagcagaaaagaataaacagaaaaagtccattaagccactccagaggaagtgagtttgagaggggatgctggattttcataatgagagaaagataatgcagagcaggaagagagattttaaaaaatgaggagctgcaggtcagctacagaagtgggttccagagagttccagtaatgccagcactgggttaagtggggaatttggggatgaaataacagcagacaatgcctcacttattaatggaaaatcatttgatatagaaaagttgtgtgcaaggagccataaaccaaaaacaccaacaaaaaccatgttttcaagaaggaacctgcttgtaacgagccagtgaaggtatataccaatttaagaattaggtactagtgacttcgaattatttaacagccaggtccatatagagaataaatagtagactatttttctcatatgggctatttaagtgagagatataagcagataaaacttcttaattaattgctttcaatagtttagagttagaataggtattttcaatttgtataatgaaaacttgtttttaggagttcttgggccaacgaagaaggcaatcgcaacattaacatagtttgaattaaacatcggtaaaacaacaactaatgaaaagcccaatatgtttttcttactacttgaaaaaatatttttactttattttttttaaccattttatcaaatggttatcaggggcccagtgctcctgaagtcaataaccaaggttcagaaatctttacccttttgctttttgggaaacgtcctaagccacgaaaaccaacttgccgttgcatatcataaggcccacctccagccttcctggttccctgtgttataaatcttcaccttttctccctcttctttcagaccttcttcatttctgaacatccccccacttcaataacccgaataaactcatctccttaatggactggtacatcttgtctttgacatatttaactgttacaagaattccagaaaactgatactagaaaaaaatgaaaccatatagtacatacacttttggtgctattttccagaagttgtatgaatgcaaaatctcaggtaaacaaaatttcataaaggatattaaatatcagttgattatactagtgccacaatcccaagaaagaatataagtatctacggaaaatctcattttgcacaaagataacttagtacaactaaaactagttcaacttttttagaaaaaacattaagcaagtaaacctgactctccaactatgagaagcattccaaactgagcatgaccccataggtagcactgggagattgcataaggaccagaaggtttctagcaatatgggaaaaaaagaaaatcacagctttagcaaaggaacaaagtcctaactatgaagatgacttaaagatacaatccttaggcccacatgggaccctgaggccacccacttccaaatttgagactcccttaatctcaaatccgagccacaattcagtgggcctaactccaattgatgtctcaagacttgtaattttctacaagtttattgctttccctctgagcaaataaacataccacactttatttctatacttctgtgagatttctcatataaataaatgcccaaatcttgggaggagaaatactgtaaccacatatcttcatttcaggccctgcataaatcaatttacagtgcaactctaaggtaaaaaaatgcagcaatagcagccacactcaataataaaatcacactaatttggactaataattagtaacctacttcctgagcactgcaccaagcgattcatatgctttatctcatttcagtatcaggaaaaccctatgaagtggtttaaagtggccccatttgacagatgtgaaaggttaggaccagagaggctttactgtgtacccaagatgactaaattattggaaagtaagtggtaacatagtaattattaagaaaggattcaacatgcatcaccgttatagtcaaaagacattggaatttacatgagaccaatagaatgtgaccaaataaagatatttaaatgaccagtttaatgaattcaaaacaatgattagtaattaacacatcaatctttgaatgtcaatggataattctaaagtgctgcagcttgcttgaaaagtgccttctctcaagctgattaaatattctctccaaaaatcttgtttacattattaatttgctcaataacccctgtcttcagagaagtgtaaacctctagctggtccctgaagagttagcacatatttttaattaaaatggtcttgaatcaattgagttattatttttccaggttatattactaacaatattaactccaaataagatagattaaaaaacaaggtacattgaaagtatgcaaatgtaagtgtcttcaacaatgaaatatctaaagttcatataaagacctgactccaaattatgaaaaatggaaaattagtcatttctgtagtgtacacgaatgatttgcaacagcaaagaatgtaaggatgtgtcaaaagtttacaagttcaaagtacaaaatgaacacttcctttaggaaatgctaaaacaaaattaaataccattagaaagattttgacactttgctcttttatgagccaaattacagtaacagagttgggaatataatgatgcaattatacgctgtcatgaacagtttaattattttatgcctgagcagattttttttttttttaactcaagtgccctatacaacttccacacctgaatgcttctaacttggctttgccattttctgactctatttaattttctggggacacagaaggatggtccttactttaaaaaatggttctatcaaaattcattctcttcacttttaagctcttaaaggcgaggtaacagtttttcagcatacactctccagagggctaaactcattcattcattctttccaatgctccaatgcctccgccaggccaggcaccaggctaggatgcaacatagatagatgtgggaagtcaagggagatgactgacaaacgaggaaaatgaaaatcaacaggaagttgtaaaacataaaggcagctatgggtcatgtctatgccttcaggtttcaccatcagtcctgttttaaatcctagccctgactctatgtaagtatttcagctctaagttaatctcttcaccacctggaaaatgggggccatgaagatctctccctcacaagttgtgaggttcaaatgagatgacgatgcaaatctggcacatagtatatgcccagtgaatatcagcagctaccgaatgataataattgtatttttattactttttgtattatcataagtgtcacaataagctatataaagcatgctaataagaacactgaggaaaagcaataaatcttcctggagtagctcattccgaacagacaaaagtttcaggggagagagggagataatgctgagtaatgggtcttcaatctctatgagaaaaaaaaataacctaagcattgttcaagagaagatgccatgttcatttaaatgactatttcatcttaagaaagcagtctgagctactaatcaaaccagaaccctagccatgctgatgatgatcattaatgtcatcatccataaattcatttgctgtgtcacatcttggtgtaggaatactcatttgttacagttatgtcttcagtttgatgtgaagagaaagcaaccataaagcaacttcaaggaagctcctccaaataattaaaattctgaagcattcctcaagccaaaagcagatcagaccctcactgagggcactttctattaaataagcaggctgctatttgttgttcttgcagcacaagtccttgagctcacaaatcccacagcaccaaaagtcattattttttaaccaaactttttttttttttttcttgagacagagcctcactctgtcacccaggctggagtgcactcgcatgatctcggctcactgcaacctccacctcctgggttcaagcaattctcctgcctcagcctctcgagtagctgggactacaggcacctgccaccacacccggctaatttttggtatttttagtagagatggggtttcaccgtgttagccaggatggtctcaatctcctgacctcgtgatccacttgccttagcctctcaaagtgctgggattataggtgtgagccaccacgctcagccttaacctaacttttaaagtcctaaatatatcttcttaataaaagggccaccatttcttgtgcacatctggagccctttctgggcactagtcactgtgcaaaagttgttacacacataacctcatttcccacaatccttcccaggagacactacttatccagggttgtaaagataaggaaactgaggcacagagatttttaagtcacttacgcaagttttaccataacaaacttgggtattacccaagtttaatattaccataataaacccaagtttactatcaaacagcagagctctgatatgaacccaactttgaactcaatgtctttagtgactatattatagtatgagtaccttgagaatatatatattttaaatttccttatttttaaaaaacaatactcaaattcaaaatacaaattaagatggggtgggtgaggtagggtgaggggagtgaatggatgaaagaagggaaaggaaggcaaattatccagccactacagtcagatgttaaagtagaattcagatatcaaccccaatcgggttgggttttcattatgatcagacaagactcttcttgaccaaagactgaactcaatttctagtcaatgtcttagataacaagggccctcatccattattagactttgaggtcttttccctccatcattgagcttcagctcagcaatcttacggccatttacaaggtgactgatgagccttcatcataaaacaagatgaaagcaacttgcctacatgcacgtcttcaaaaccaaccaaatgaaccaattacagaacaaaaccagtttagtgtgaggatcaaaatgtgataatgttttgttgagcacagagataggcacatagtgggttgcttgtttatttgctttagtatgaataataattattatggatattatcaggattcctaaaaagagtcatttaactattatgggaacaatataatatactagatgccctttcctcaaggttatgcaacctacatgggaaaataactaaaacaaatgagtagcttctgcaattaaggatcctgagaatgacttccctgcttgatttgtggtagtagctgcatgcccaaatggaggaaaattatttgaataaacattggtcagtggggagaagtgagttttaggactaggctgctttcagagaaattcatcaagaggaaaaaaatacataattttaagaagtcaaagcctattattagaaaaatatgttcaccaaatgcagctctaatacctttagcaatgagataaactgagtctagcaagtggttggactcataatgattcgatttctttaactagcccattaatccaaaagatggccaatccacgttcatgaagacactgccagtgagctagaatatctgaaagagttggcataaaaagctccaccacatgcaattaatccacatctgatcacatgcccctgaataatgtcagcccacagatgggtttgtacacacaagatacagtgttgcctttaaatattcacaaatatttttaaagtataactttttaaaaaacatatatgactcagaaagaacagaagggttgcacaactcccagatatctgaaatgatggttaccgacaaatcttcactgatgctaaagaacatttatttcacacctactctgccacattcactcccacacacttccccaaaccagaattgaattgttacttcactttcatgctgacttcagacataattgtcacttctgcaaggtcacactttggggaacactatgtaccttcttaaatacaacattaattatggaactaacctatttagtctcttgccctaaagacttcagcatttaactcgacttccccatagtttactgtatcatagcaattaagttaatggcagcagcagcagcagagaatcttttaacccctaatgggcttgttcctctgattagactagatcaaagaagctgcagctatttggaggcagattagagaggcttcttttttactgatatcagcactgaagagtggaagatcatgtgtgtgttgacatcttacccaaatccatccatgacagtttacactgaagttattcttaatgaagacttttaatacatcaagactatatggatcaggaggcatgaaagcacccttacattcaaagagaataaaatacctaggaatccaatttacaagagaggtgaaggacctcttcaaggagaactacaaaccactgctcaatgaaataaaagaggatacaaacaaatggaagaacattccatgctcatgggtaggaagaatcaatatcatgaaaatggccatactgcccaaggtaatttatagattcaatgccatccccatcaagatactaaggactttcttcacagaattggaaaaaactactttaaagttcatatggaaccaaaacagagcccgtattgccaagtcaatcctaagccaaaagaacaaagctggaggcatcacactacctgacttcaaacaatactacaaggctacagtaaccaaaacagcatggtactggtaccaaaacagagatatagaccaatggaacagaacagagccctcagaaataatgtcacatatctacaaccacctgatctttgacaaacctgacaaaaacaagaaatggggaaaggattccctatttaataaatggtgctgggaaaaccggctagccatgtgtagaaagctgaaactggatcccttccttacaccttatacaaaaatgaattcaagatggattaaagacttaaatgttagacctaaaaccataaaaaccctagaagaaaacctaggcaataccattcaggacataggcatgggcaaggacttcatgtctaaagcaccaaaagcaatggcaacaaaagccaaaattgacaaatgggatccaattaaactaaagagcttctgcacagcaaaagaatctaccatcagagtgaacaggcaacctacagaatgggagaaaatttttgcaatctactcatctgacaaagggctaatatccagaatctacaatgaactcaaacaaatttacaagaaaaaaaacaaagaatcccatcaaaaactgggcgaaggatatgaacagacacttctcaaaagaagacatttatgcagccaaaagacacgtgaaaaaacgctcatcatcactggccatcagagaaatgcaaatcaaaaccacaatgagataccatctcacaccagttagaatggtgatcattaaaaagtcaggaaacaacaggtgctggagaggatgtggagaaataggaacacttttacactgttggtaggaatgtaaactacttcaaccattgtggaagtcagtgtggcggttcctcagggatccagaactagaaataccatttgacccagccatcccattactgggtatatacccaaaggattataaatcatgctgctataaagacacatgcacacgtatgtttattgcggcactactcacactagcaaagacttggaaccaacccaaatgtccatcaatgatagactggattaagaaaatgtggcacatatacaccatggaatactatgcagccataaaaatgatgagttcatgtcctttgtagggacatggatgaaggtggaaacatcattctcagcaaactatggcaaggacaaaaaaccaaacaccgcatgttctcactcataggtgggaattgaactatgagaacacattgacacaggaaagggaacatcacacaccacacacaggggcttgttgtggggtggggggaggggggagggatagcattaggagatatacctaatgttaaatgatgagttaatgggtgcagcacaccaacatggcacatgtatacatatgtaactaacctgcatgttgtgcacatgtaccctaaaacttaaagtgtaataataataataataataaaagaaatcaccgttatatatttcaggcaaaggtacccagtagctttaggtttttatgcccatctgctttctcaacacaccttgaccgccaactctagatgtcaaaagctgatacaggagtcatacatcattcaattacgttcttcatgatatgggggctatgtgcattctactatatatatttttaaagacatggtctcactctgtcgcccaggctggagtgcagtggcacaaatcacggctcactgcagccttgaactcctaggctcaagggatcctcccaccttagcctcccaagcaagctgggactacaaatgtacaccaccacacctggctaatttgtcttatttttttttttttagaaacaaagtctcactatgctgctagggctggtttcgagctcctgggctcaagcgatcctcctaccttgttctcccaaagtgctgggattacaagcatgagccacagtgcccagcccatttttatcgttggtggaaagaaaagcattttttataatgtgtttagatgtcatactcaattctagcttcatcaaaatcacttggagcttttacattaatgtttaaaatacaagctacatcccagagctagtgaattagtatattttaagggttgagccagaaatttatagtttaccaaagtttccaaggtgattctaataatgacctagttccagaaatcactggtatatgccataatgcaaaggtataaagatagtatacaccaagtaaataaatgtcaaagatcaattaactaaaacaaagagtgggttgggaaaaatgagactgcctgagactaaaatctcattctccatcagctattaaggtagataaattacagcacctctttgagtttcaatgccctcactttcaaaatggggcagtaatagctaccacagatacataggtacaacgcgcttagcagtggtttgaaaccacaataagctgccaaaaagcatggctcattttgctttttaaccagattctagatcttctaaacaataaagctgattataaagacattttccacaaaatagcctttttcctctccttcaatgcttttcacttaatactgtacttcttgcaaagtcagtaggctgagcatgaacaaattaaaattaaaagctgaattacttaattaattttaaggcactctcagttcattaacagcattcctgcaagttaaaaaacaagaaaacacatggaatgattgtaaaccgcatcccaatttcagaaatgttcaaatatattggggttggggaggtgagcagggcaatctactgccatatcaaacccaaaagcttctcttaaaaaggctatgtacatgtatatgcccaccagacaagatgtccttctctcatgttgcaatcagcaacccaaaagtcctgtaaaatagccaaaggtcaaaatagttcagaaaacactacttcttatagtcctcctctccacaaccctcttttcagaagttcgtaactggcatattcacatatcaaaaaatctgaaattaagaaatgtcttcaacaaatatgtctatcaaacttgtcttgaactttcctcacttacctttcggggggcaaatctgatgaggacttattttgggaaacattaaaattagggaaagtcttttggttatacttattaggaaaatcattgtccaagtgtcctgtcttgccagaatgagaggtttataaggaaagaagttccacggctttggactaataaccaaccatgggaatcacagcttccttccaagggaaataacacctttttttaaaatttgcttttatattggttaaaaaaaaaagaaccatgaggaaacatcaagaaccaatattacttctttggaaaaactttttggggatattgctaaggatttatattgcataattcaactaaacgaattttttagttttaaaaaatcccaataatattataaacctagaaactgtttattcagatccaccttggtaaaataaatacattcaataaacacagaatacagacagctttaattttttacatgtgggtcaggaggatccatctctcccaaaacatgtatcaccccacatgtgctgtgatttacaatcctcaaagcattaaagtttaatttgtgaatctactgtttcagattcattggaattctgatccaatagtcactctaaaatagatgcaggctggaagacaattctctacattttaaagccagatggcccataacagctaaatattttttctttccttgttcagaatataattcatgttggaagtagtgaatcaacttaagtacgtacaaatttaagggaaccttagtcatcagtcccaaacttaggaatctatttaaaggaaatatattttaaggttaagtttaaaaaataacaaaagagaataccatatgtaacaaccctggcacagaacactttctttaagaaaactcccttaacgttaacggcaaaaaaatactcttcccatttcactatggtaactaataaaaattttttcttcacactgaaaaataaaatctttatttaatctaattctgtaagtgccaaaaactctgattattttatcaagttattaaatatgttattcagtagtgagccttattgattttccttttgattagaaaaattaccaaaaaaatccagctctacagttcataacctgagaatggtagaaacccaagacgtagagcacattatgcaacactcttaaacaaatctgcctcttgggatctctctccttttatagaaagagactctccagcagcccctagagacattcccatactaagtgagtcagctaaataaaattaagcaactaataaaacaatatgtcatcttgttctcattgtcataattaaaatcctttttctttaagatgaaaggtggcagctatagagtagccttcaaaatcataggctatgccgaagcaggatcttctctccaacgctgtacagacaacgcagctgtccctgacatcaccacttgaaattattccctatttgatatttttgacattaaaaggctgaagtcttttttcttctgcaagttacttccatgcttgcttattaagcattccaagttggtctctcacccaatagccttagaaagcagaccatcattatttagggcaaaggtttccagaggcagtcagaggcaggataaggatgggggatcccaaacaagccatgctctttcctaagcaaagcacctctattttgaatgtgtttgatacactgagcttccaaataagattgaaattgattttaaaaaaagggaacccccgcccccctttaagccaggtaaaaactataaccatccctgtcaagagcgttacatgaatctgtaaatcctatgacagactaccggttgaaaccgaggttgaagtcttcagttcgcctgactcagtgctggtacacagtaaaaactaacactgaatgggtgccccacagtgagtgaggcatttcagcaggaccggggggatgttatgcaacaaaaacagttatagcccttgtctgcctggagttcacaatctaatggaaggatgatcattacatcaaatattaaagagagctaccatgcagtaagcccattctagacatcagctgccgttctaatatcaactcatttactctccaccacacctttaagaatgaggtacagtgatcactccccttttacagaggagccactgaggcacagagttggcaaggttgctaagtggccaagtttggtttgaagccaacggtatggcttgagtgcccatggctcaaccactcaaccctacctcctctcccaaacactgtaagaacccaaatgtcaaatgcacctagggcaagtcctcgacagaaaggcatggggtgtgaaaagaatgtataattagaggatctgaccaaggcagggagaacaccactgaggaattaatgcaggagctgagagcggaaagcagggtagtgaagagaggagggaagagcatcgaggtaggagcaaaagcaagagatccgccaggataaagggcttggagagcaggaggactagaattcagcccatcaggacagagaacataggagggtggcaaacaggaggttatggccccaggcggacaaggaaagacaggaaggtgccaaccatgctggaccgggctaagacagctggggagccactgagggcatgctgcagggagatcactgggctaatacttgtgagtccaaaagacttttctggctgtatctacacagtcatggcacagtcctcccaataggcaggccgacacaaaaccaaccctgctctgtatcactccatgtattcctggtcatattgtcacagcctgatgtgcactgaccacctctgtgctgtgccacactgagggagcagctgctccagctaatttctacccaacattcaccacctggaggcaatgcattggctcctcaggctttagcatggcaagggaacttcacaaataagaaagtttaaaaatgatgttactctcttcaaaatcttttcttcatttgtaggtggcagaaggcaacagatatatcacatcattgagtaccatgggacatgtgttcacactttaaagtacttaggtgttatttcatgtaaatgttgagaaggaaaaaaaaatcctgtttttcttgtctcttgggaatcagctttggttttctgaagaaatagttcacaaatctaaggaaaatgatatatctatacttatttccctaaagagaacataatttttcttcttttggttgataaggatttaattgcatttagaaggatttaatcacataaggctaaccaatgaaacactaactgtgggcagaactctgtttcagttggccctattggccctaaaatgtcattgatagtgactaaatatacacattactcctctcccccgccatcctttctcctccttccatttctccttctcagaacagagaaataaaacgtctaggaaacccatcatttactggggaaaggaaggggacgtgtaacatttcaaactgtaataaggcatgaacttgccaagctgtccatgtgggaggttatagcatgcccagagaagttgcccagaaaatagacatggtttccaatcaaaaaaacttagaccagttgaaactctggctttgggcaatttacttaacttctctgggcatcagtgttaacttatgtaaaatggagacaatcacaatatgtaccttaccctgttgtggtaagattaaataattggcacagggcctgacacaataaaggttaatgatagcagctgttaattattatccacgaatcagtttaactttaagaaaataacaactactttggccattctagcaagtgtgtggcaaagagggataacagaagctccttttgtggaagaacatgtaatttgccctttatttgcacagtttggaatcatcatcataacatcctaatatgccttgaaatcctgtgaaaaaacagaagtaaacaagtaaaaccaccatagcaacactatggcagaactgagttcactaaaagatcttgtctcttgctcaaaaggcttgactcaaggaaaagaactaggtatttctaggttcccctgcattcatttttttaaaaaattgttgtgggtacatataagatatgttgtaggtacatttatggggtacaagggatattttgatgcaggaatacaatacataataatcacgtagggtaaatgggatatacatcatctcaagcatttatcctttgtgttacaaacaatcctatcatatttttaagctattttaaaatgtacaacaaattactgttgactgtagtcaccctgttatgctatcaaatactagatcttatacatcatatgtaacaacatctgtgtatgcattaaccatctccccctccccaactacccttcccagcttctggtaacaatccttctactctctctttccgtgagctcagttgttttaaatttttagttctcacaaagaagtgagaacatgtgatgtttgtctttctgtgcctggcttatttcacttaacacaatgacctccagttccatccaggttgttgcaaatgacaagatatcattcttttttatagctgaatagtactccattgtgtatatgtatcatattttctttatccattcctctgttagggacacttaggttgcttccaaatcttggctagtgtgaacaatgctgcaataaacacgggggtacagatagctcttcaatacactgatttcctttcttttgggtatatacctagcagcgagtttgctggatcatatggtagctctttagtcttttgagtaacctccaaactgtcctccacagtggttgtactaatttacattcccaccaacaatgtatgagagttcacttttctcaacgtcctctccagcacttgttattgcctgtcttttgcatatcttttcattattttgtgtcctcttcaataagccattttaactgggatattactgtagttttgatttgcatttctctgatgatcagttatgttgagaaccttttcatatatttgccatttgtatgtttcttttgagaaatgtctatccagatctctgctcattttttaatcagattattagattttttttcctatggaattgtttgagctccttatatattttggttattaaccccttgtcagatgaatagtttgcaaatattttctcccattctgtgagttgtctcttcaaattgctttcaaatttgctcttcaaatttgtttactttgctatgcagaagctttttaacttaagctatcccatttgtccatttttgctttggttaactgtgtttgtagggtattactcaagaaatctttgccaagaccaatgtcctggagagttcccccagtgtcttcttgtagaagtttcatagtttgaggtcttatatttaagtctttaatccattttgatttgatttttgtatatggcaagagataggggtctagttttattcttctgcatatagatattcagttttcccagcaccacttactgaagagattgtgttttcctcaatgcatattcttggcaactttgttgaaaatgagtttgctgtagatgtatggatttatttctgggtcctctatagtgttccattggtctatgtgtctgtttttatgccagtaccatgctgttttggttactatatctctgtagtataatttgaagtcagataatgtgattcctccagtactttttgctcaggatagctttagctattctgggtcttttgtggtattatgtaaatgctaagattatttttttctattttcatgaagaatgtcattggtatttttatatggattgcattgaatctgcagattgctttggatagaatgggcattttaacagtattgattcttccaaaccatgaacatggaatatctttccatttatcttgtgtcctcttcaattttttacatcaatgttttatagatttcactgtggacatctttcacttctctggttaagtttattcctaggtagttgatttgtagttattgtaaatggaattactttcttgaattatttttcagattgtccactgttggcatataaaaatgctactgatttttgtatgttgatttttatatcttgcaactgtactcaatttgtttatcagttctaatagttttttggtagagtctttagatttttccaaatataagatcgtatcatctgcaaacaaggataatttgacatccaacttggataccctttatatctttctcttgtctgatttctctagctatgacttccagtactatgttgaataacagtggtgaaagtgagcatgtttgtctcatttcagattgtagggagaaaaccttcaggtgtttccccttcactatattagctgtgggtctgtcatatatggcttttattgtgtcaaggtatgttccttctatacacagtttctgtgggtttttaatcatgaaaggatgttgaattttatgaaatgctttttcagcaaaaattgaaataatcatatcgtttttgtccttgtgttcatatgatgtatcattgattgatttgcatatgttgaaccatccttgcgtaactggaataaatcccgcttggtcatgataaatgctttttttaatgtgttgctgaattcagtttgttagtattttgttgaggatttttgcatctatattcatcagggttacttgcctgcagttttttttttttttttttaatgtgcctttgtctggtttttgtatcagggtgatactagcctcctagaatgaatctgcaagtattccttcctcatcagttttatgaaacagtttgagtagcattggtattagtggttctttacgcatttgctaaaattcagcagttaagccatcaaatctagcgcttttctttgctgagcgacttcattatggcattgatctcattacttcgtctgttcaggttttgcatttcttagtggttcaatcttggtaggttgtgtgtgtctagaaacatatccatttcttctaggttttccaatttattggtatatagtagctcacagtatcttctaatgatctttgaatttctatgatatcaattgtaatgtctcctttttcatctctaattttatttgggtcttctctttttttctgaagatttgtcaatttgatttcttttttcaaaaaaacaactttttgtttcatttaccttttgtattttttcatttcaatttcatttatttctgctctgatctttatttttccttctactaattttgggtctggttttcacttgcttttctagttgtttaaaatgtatcattagtttttctactttttgatgtaggcaattactactataaactttcctctgaatactgctttcaccatatctcataggttttgatacattgcgtttccattttcatttgtttcaatatatttttaaaattttcttaattttttcattgacccactggtcattcagaagcatattgtttaatttccatgtgtttgtataatttccaaaatttcagctgttattgatttctaattttattccatggtggtcagagaagatatttgacataatttttaaaaaaatgttttaagatttgttttgtggcctgaaatatggtctttcctcgagaatgatccatgagctgaagaatgtgtactctgcagccattggataaaatgttctgtaaatgtctattaggtccatttggtctgtactgcagattaagtaagatgtttgctgactttctgtctggatgatatttccaatgctgacagtgggtgaagtctccagctattattgtattggggtcttatctaataataactttacataacatatatgagtgctccagtgttgggtgcatatatatttacaattgttatatctcttgctgaattgacccctttgtcatataatgaccttctttgtctcttaccatagtttttgtcttgaaggctattttgtctgatataagcatagctcctcctgctctttttggtttctattttcatgcaacatcttcttccatatctctttatttttagtctatgtgtgtctttatattataggcgaagtgtgttcttgcaggcaacagatcattgcagctagttttatttatccattcagccactctacatctttcgattagagtttagtccatttacattcaatgttattattgatgaataggatttactcctgctattttgttatttgttttctggttgttttgtagtcttctctttcttctttcattccttcctgtcttccttttaatgaaggtgattttctcaagtgatatgtttttattgcttgcttttttattttttctagatctgttttaagtttttgctttgagtgtactgtgaggcttgcaaataacatcttgtaacccattatattaaacagatgacaacactgattgcataaacaattaaactaataaaaacactatacttttcatacccctgctttttaactttttgttgtttctgtttatatcatactatctatgtcttgaaaagttgtggttattatttttgatagattcattgtttagtctttccactcaagatatgagtagtttacatactacaatagtgttatgatattctttatttttctgtgtacttactattaccagtaagttttctactttcagatagttttttattactcattaacatccttttctttcagattgaagaaagaatcctttagcatttcttgcaggatagttctggtgttttgtttgtctgggaaagtctttatttctcctaaatatacatgtttgaaggatattttcactggatatactattgtaggttagaagattttttttccttgagtactttaaatatgtaatatcactctctcctggcttgtaagatttccactgaaacatctgctgccatacattttggagatctttgttatttcttttctcttgctgcttttaggatcctttctttatctttgacctttgggagttcattaaatgccatgagatagtcttatttgggttaaatctgcttagtgttctattaccttcctgtacttaaatattgatatctttctctaggttttggaagttttctgttatccctttgaattaacttttctctctctctctctgcctcctctttaaggccaataactcttagattgcccttttgaggctattttgtagattctgcaggcatgcttcattgttttgtattcttttctcttttgtctcctctgactgtgtattttcaaacagcttgtcttcaagctcactaattctttgttttgcttatttctgctattaacagactctgatgcattcttcagtaggccagctgcatttttcagctccagaatctctgcttgattctttatatctccctctcttcattagatttgtctaatacaactctgaactccttctctgtgttatcttggattccactgagcttcttcaaaacagctattttgaattccctttctgaaagctcacatatctctctctctctccaggattggctacaggtgacttagtttggtgaggtcatgtttttctggaaggtcttgatgctttgggtgtttgtcagtgtctgggttttgaagagttaggtattcactgtagtcttttcagtctgggcttgtttctgcctatccttgggaaggctttccaggtatttgaagggacatgggtgtagtcatctaagtttttggtcactttacccgtttctactttaggggtgccccaagcccaataacactgtggctattgcaggcttgtacagataccaccgtggtggtcttgggtaacttccagaagaattccctggattaccaggcagagactcttgttctcatcccttacttccctccaaacagatgaaatctgtctctgtctctctgtctctctcccctctcctctctctttctttctctctctctctctctctctccagagctgcctgaagctgtgggaggggtgacacaagcactcctgtggccaccgccactgggactatattgggtcagaaatgaagccagcctaacactgggtctcacccaaggcctacaacaattactgcctggctaccacctatgttaactcaagtcccaagggttctgcaataagtatatgggaaatcctgccaggcttgtgtccttcccttcagggcagtaagttctctctggctctggtcaggtccagagatgttttctgggagtcacggcctggagttgggaaatttagaaatctacttggtgctctattctaccgcagctaagctggcacccaaaccataagacaaagtcctttctgcccttccctctcctttcctcaagcagaggaatctctctgaccaccactgctccgggcacatggagagtattgcctggctaccaatgacattcactcgaggtccaagggctcttcagtgagcttgtggtgaatgctgccagtcctgagtctctctcctcagggaagttgtctttcctctggcccaggacaggtccaggaatgtcattcaggagccaaatcctgaaatcagagatcctaggagcccacttgatcctctgccatactgtggccaaactggtacccaagcggcaagataaagtcctctttacttttccctctcttttcctcaagcagaagggatctctccctgtagccaccacagctgggaatgtgctgttcacaactgaagccagcagggctctgagtctcactcaaggcctgcagcaagtactgcttggctatcactgctgattattcagggcccagtgctcttcggttagcaggtgatgcactctgcaagaactgagtccctcccttcattcaaggcagcaggttctcttccagctcagggtatgtttagaaacgctgtctggaagccaaggcctagaacagaggcctcaggactctgcctggtgccctatgctactatggctgaactagtatccaagttgcaaaacaatatcctctttactctctcctctcctcttctgaaacaaagggaagaaggagctgcctggagctgtgagctgtgttgcctagagttagtggggagcagctcaagcactcccttcaccagctgatatcttcttaggtcatgtgtaccccaggtccactggttctgagctcagtacaggaccaggactttccttgcagtccttgtggcctagactgcctttcaagtttatttagaacttcagagcactttagcctgtggtggtggagcttgccggaactcaggttctgaccattggcatggacaatttgcctctggctagggctggtctaaatgctccctccttgggaacctgctgagttcttcctggtgttgctttctactgtgacagggcaacactgagttacaatacaaagtcccacaatcactgcactctccttcccccaagcacaaagattctttctccacgtctcatggactgtgcaggagaatggcggaatggtgacatcaaccattcaagactgtcttttctaccctcttcagtgcctctttccttaatatactgttaaaaccagatactgcaatcacccacctggtcttttgttcttatgaaggtacttttttgtatgtacagttgttcaatttggtgtttctgccggggaacaaccactgcaggcttcaatttggccatcttgctctgtcttccccctgccaccccacccctctcacattcttgaaatgagtaaaaagccttcacgctaagcatggccatggaatcttcccatgttgaactgtaagatgaacagagtcatatttcaaataaagagattaggctgacatgaatgatcatatttttaataacttattaacctaattgcatgccacaattacatagtgagttttcatcttttaaatcaattttggggtgagggatgaaatactacctattgggtacaatgttcactattcaagtgatgggtacacttaaagcccagacatcaccactacacaatatatccacgtaacgtaactgcactagtagctctcagtctacttttttgttaaaaaaaaaaaagagcaaaaacaacagcaagaggaaagatatatatttaagaaaaaagcatttcaatgaggcaaaaacaactggttcatccttaggtccttaggcccatttattacttcgaactgtatgcccacttttttattttataaaggtttgcatgtcttcaaactacatgcccaccttcattttgcaaagtattgtacaatgctgtatttttttttttttttttgagacgaagtcttgctttgttgcccaggctggagtgcagtggcgtgatctcggctcactgcaagctccacttcccaggttcacgccattctcctgcctcagcctaccgagtagctgggactacaggcacctgccacctcgccgggctaatttttttgtgtttgtagtagagacagggtttcatcatgttagccaggatggtctcgatctcctgacctcatgatccgcccgtctcggcctcccaaagggctgggattacaggcatgagccatgtacaatgctgttttaaaagcagcgctcgtctttgctgcctttcaactttacatgctttggtttctcatagagaaaataaaaattgtttttaatccttaaagaacttctgacaggagagaaaaatgacttgtgtgtcccaaagcccccaatcccaaagacatctaagcaaaaccaagttgggggtgggggtggagaatttaaatagcagtaattatcgtatctcaatttgcaagaaaaacaaatgcctcaaataccattattcatttaagttttctgacaacctgacatttatctcctttagtgctatattatagaaatgtttcttattatattcattttccagagactgagaacttttaaaaccaatgaaatgcatgtcccagagttgatcctttgctttaaaaaaaagtttgaaaaaggaaaagctattatgttgattacaaaccgaagtgagttacagtaaatgatgcaaagaaattttgacaaataggtatatgcacttgaaagtggtactactctgctctcaaggtgttgctgttaagatatgaaccaacgctgaaaactccatatccacagatagctggcttcttcgataaaattcaattcaaatcaaagagtaattaaagcacttaatttgcatgagcactgttccaagattaactaaagggctgaggggagctggaggtggggagctcaattaagaacctattcaacatatttcaagagagagggacaatctgaatttaggatatggatgtggaaatagaaaggggaatgtgagagacattatcaagagagaataaatacaatgtgaagagacaacctgggagaagggagaaaaatattgccaggcttaaaatacatgacaatgaaaaggccattaaccaatagggctaactacaaaggtggtgctttggtggcaaaaaattttctttggaaatactgatttgaggtacttgcacatgaaaacttaacctcagctgggcgcagtggctcacgcctgtaatcctagcactttgggaggcaaaggttggtagattgcctcagctcaggagttcgagaccagcctgggcaacacagtgaaaccccgtctctactaaaatacaataaaaattagccaggcgtggcagcatgcacctgtatagtcccagctactcaggaggccgaggcaggagaattacttgaacccgggaggaggaggttgcagtgagctgagatcacgccattgcactctggcctgggtgacagagcgagactccatttccaaaaaaaaaagaaaaaaagaaaacctaacctcacagagaattgtacctggagatgtatgggggaaagacacattattttggaaacatttaaagaacctcatactcagaactagaaaaaaagacatcttcataaattctgatgcatttttcatcctaataccagcagtgacacaatcaggacagggaatgtgtctgcttacccagcaatcaaggaagatgaaggagatgaagcagacagagggcagggagggtcaaccctgactgcaccagcaccaaaggctagagtttcttctggtatagcaaagcctaaataattttcttcattaagcttattttttcatccatgggaaaaggaacatgtgttcatattacattaacttgaaaaattcagaattaatgaaaaaataagcctcagaatcttaaatcaactgaatatagcaacagagaatagatgaagccccaaagggcttctgtcacactcatatataataaaaacaccagtcatgtttacagttcaattttatagagctaaattgatgagtagttttggagtgttctagaaattctacaatattcattttttattgcagtttttgaatttattaataattaggcaagaaatcattaactacattttcaaaacagtagaagtaaagcttaggaggctcattttcacaaatgtattattttcaacacaatacaattttttttttttttgagatggagtttcgctcttatcacccaggctggagtgcagtggcacaatctcggctcaccacaacctctgcctcccgggttcaagagattctcctgcctcagcctcccgagtagctgggattacaggcgcctgccaccacacccagctacttttgtatttttagtagagacgaggtttctccatgttgctcaggctgttctcaaactcctgacctaacctgatctgcccacctcagcctctcagagtgctgggattacaggcgtgagccaccgcacctggccaacacaatacaattccaatttttaaatagtactacttaaatcacaaatacaactgactgttattaatacaatgaaccaggttgagttatctgccattacttactttagaacttagctcatgtcagaaatatacaaaatactcctttgatataaacagatagcttgggggaaaacgaaaaactcttattagaattactactagttgctgtagcaactgtcgaagtgttttactatgtgccaggcactgggccagagactctttgttcatctctttaatcttcactacatttctataaagtaggtatcttgagatgtccattgtactgaaaaggagacaaagcaaaggttaggggagttaagtaactcagtaacttaaatgtttttctcccttagctgaaatgatgcatgccacaggtttgaaaaacattctttccctattcaatcatttatttaagtgataaacattaatctcaacataaacagaaaatagattgaatactgtgattattactttgaaaccaaagctccatctttagagaaactcatactggcaaagcaaacaaggactgatgaattggaggtgcacttgtgcgcttaaaactgcagcagctgatgtaggcactggaggggctacaacccagggacccaggtagtttgcagaaattcacaaggtgcagggtatcagttttgtcatcactttgatacctgtcaacttcatgggcctgggccaatcagccaacttgctcaaacctcacgtttctttcatgtaaatacaggttaagcacccctacaccaaatacccaatatctgaaatgctcccaaatctgacacttcttgagtgctgagctgacgccacaagtggaaaattccacccctgacctcatgtgatgggtcataatcaaaatgcagttgcataacacagtttattaagagtctccaaggggaaaaaggcccttccagtccccttcagcgtatcttttccactcatgcccagatttccctacacaagcatgccacaaagtattgtgtattatgtgggaaataacacacagggaacttggcacaagaactggcatacaattcccgaaatagtagagctgtcatcatcattactggtttttatagtaactgtgaccccaaagagttaatagaagtgagatagtagaaaaactgatggctgtgcagtcacagaaatcttccaagtctacatctctcattgaggagatatgcaccatttgcaaagttatttaacgtacctgagcctcagtgtccctgagtgtaaaatataaataaaaatatttccctggtatgagacagaaaaatagagctaatgtgtcaaaagtaccacatggagagactggaacacaggaagttcctattactgttagtatgaaggcgctttaagaactcaaactaggcaacaggtacaggccacagggggaataaacgcaaacgtccagttaaaaccaaatccagacataagagaaactttatttgaaaaagtaactgctataaggggagtgagactactgcaatagggagagctctggtcatgagatgtgcaagtagctcaacgattgggcagaaaggaattttcttttatagggaggggtaagcaaggctagaaagatcagctgggagcactgactagggaaagcttctcctgaaggtcagctggttctcaggaggggtattcaaggagaggctgctctgcatcccaatgctgaaggcatggtcaaagttcaagggcctagggagcgagacacacctgactgaagtttggttgattatttgggcactgggtataaacaaatcagctgaccatttataaggcgcagaacgggaatgtgaaaactcagcttctggccttgtcggaggtacttaagtgagcatcatttggtctcgtcctggacacccggggaaggattttttttttttttaagaagccttttccagaagacaaagggtgggggatttcttcacctagtgctattttccaaaatacttggctcaggtaaagctcaacattaccataaacagaacaaactatatatatatatatgtatggtttgtatatgtttaagtacgtatatacagtttcgtttacatgcatatgctgaatatagttcagtacttttaagcaaagtattataatatcatattcaaacaatcaccacctttttttcctacaaaaataagcaatgaattaaaagcaagtctgtcattaacccacggtgaggaaggaggaacaattttaactacctgaggtcttcaaaatggatttttttttttcagttcttattctaatgcaatttcctggtcagaatctttttatacataaccttgaatataacaaaaaccaggaaaatggcttgtacacaaaatgaaggctactaagagcatgagaaaatatttcattcttttcctttgatcatctacttttcttttgagagagatgcagagagaggatttgagtgtttatgcctgcctttggatttcttttgctgggttttctattaagtcttctctgacatcattactagcttatgcatactgaatgtgtactctcttgccaggcatcacactaaccacactatgtaataatttctatagatctccacacagctcagtgagaacagtgctactgttaaaaagtttcatattaatgtctgcattttagatctactgcaaataatcacatattatttttctggtagatgaatttcatgccaaaagattaacttaaccttttatatacatatgtaaacaatcggtataggcatgtagatataaacatgtatagaacacaaacttgcatttgtctcaggaatcaggtagagaccatagtaaacatttttatcttggaaggagggcagagagctcatcatcatcaattcagaacctataatgattttacccaaacttctctaatatgatagggagcaacactttttcaccctgttcatagtacgaatgaaaggtgaattatcttggtctagtttgagttctgcttgctcacccctggaaggagaaagtgcataccatagagaagcgtggagattctttgctgggtaataggaaattggtcttcacagcagaaaataataattgcaacaaaagtactaacaaaaataataacaacaattagagcaacaataaaaactacagcattgacatactgattgctcataatatgccaggcactggataagcgccctatttcactaccaaacataattcttccaataatcagcagtaaccttatgcatcccacttacagatgaagaaatgagacaaaggaagttcacacagctaccaaaattgggaaccaggaattaacctcaggcagtgtgactgcacagccagggcccttccaaacaattggttaactaacctgggtcttttgctggccaatgtatcggggaataatcctagccaacaaattcaagggaaacggaatcaagcaaatatgaatgaacttcatttactgaaaacaaagtaggctttgataggactgtgttaccatctctagacctaactatgattatgtcatttcttagtgcctcttgcggcaaagaaagtgcactttacataaaaaaacaatagaatgcatctggcagaagtatgagaagagtaacgatcatggtgatggtggtgatgatgatgatgatgacagcttcaagagcagcagggtaaggatgccactaaaatcaccaccatttatgtgccaggcattatgatacagtcattacatataacctttttctcccactatattgcatgctgcttcacttaccttgtaaaacattttagacataaaaggtgctccatttttttgcacaaatgaacaaatacatgaaataaaagtatgttgaaggcacagaaaaagtattcataaaagacaaactcaaaattcccaatgacacagagagtataatcacaccacatatcaaatccaagccacatagcacagagtgtgctattgaaatgaaacgcaatataactattgctctgggaattacagatgggatccagtaaaagacactgtattaattatattgttttccatggaacttttctaaggttgcccaggacagcaacactgtagaacattcatgatgaaactgtcaaagaggactagacttgaggggccttagggagaaaagagatttgaaaataatgtactgcttgcccatggttcagacgtgcctttctctgcaagtatgatcacattattgattctcaaaggaagaaagaaaatatgactttgtcccttaactgacatcaaagttacagtgttatgcagtgatgcccaaaagcatttgcaaatattcagaaacaaagttttgagtgtcctaggagatgactatcataccaattgatccaaaacacaatggtcaagaggcatggaaaacctatggttggggagggagaggaagggtcataaatatatacagtcatgcaccacgtaatgacattttagtcaatttactggatatatgatggtggtcctataagattataatgtatctggaaaattcctattgcttagtgacatcctagctgtcttaatgacatagcacaagacattacttatgtgtttgcagtgatgctggtataaatgaacctgtgctgccagtcatataaaagtattgcatattaggtacagcaggggtccccaaccccctggctgcagatcagtgcccatctgtggcctgttagtacagtgggaggtgagcagtgggtgagtgagcattactgcctgagctctacctcctgtcagatcagagtcggtattagattctgatagaagcatgaaccctattgtgaattgcacatgcgagggatctaggttgcatgctccttatgagaatctaactaatgcctgaatatctgaggtaaaacagtttcattccaaaactgtccatcccccatgacccctgtctgttgaataattgtcttccatgaaaccagtccctggtgccaaaaaggttgggggctactgacgtaaagtacataatacttgataatgataatacgtggctatactggttgatgttgtattagtccattttcacaatgcaataaagatattaccagagactgggtactttatgaagagaagaggcttaattgactcacagttccacatggttggggaggcctcaggaaacttacaatcacggcagaaggcaaagagaaagcaaggtatgtctcccacagtggcaggagagaaagagagagaaaaccagcaggggagagtccggagacttatcaaataaccacatctcatgagaactccctcactatcatgagaacagcatgggggaaactgatccaatcacctctctccaggtctctccctcaacatctggggattacaattcaagaggagatttgaatggcaagacagccaaaccaaatcattccagtgctggtccctctcaaatctcatgtcctttgcacatttcaaaaggcaatcatgccttcccaacagttccccaaagtcttaactcattctagcattaacacaaaagttcacatccaaaatctcatctaagacaaggcaagtcccttccacttaggaacctgtaaactcaaaaacaagttagttacttacaagatacaatggggatatacaggcattgggtaaatgttcccattacaaatgagagaaattggccaaaactaaggggacacaggtcccatgcaaatccgaaacccagtgaggcagtcattaaatcttaaagctccaaaatgatctcctctgactccatggatcaaatccagggcatgctcatgcaggaagagggatcccagggccttgggcagctctacctctctgactctgcagggtacacccctctcccccaactccccaacggctgctttcacagctgtcgttgagtgtctttggcttttccaggtgcacagtgcaagctgttggtggatctaccattctggggtctagaggatggtggccctcttctcacagctccactaggcagtgccccagtggggactctgtgtggggactctgtttgggggtgccaaccccacatttcccctttgtactgccctagcagaggttttccatgagggctctgcccctgcagtagaattccgcctggacatccaggcatttccatacatccttttatatctaggtggaaattcccaaagagttccacaagactagagaaaaaagaatgaagaggagtgaacaaaacctccaagaaatatgggacttcataaaaagactgaatctacaactgattggagtacctgaaggggatgggaagaacggaaacaagctggaaaacacacttcaggatattatccaggagagcttccccaacctagcaagacagaccaacatgcaaattcagaaaattcagagaacaccactaagatactccagaagaagagcaaccccaagacacataatcatcagattctccaaggttgaaatgaaggaaagaatgttaagggcagccagagagaaaggccaggtcaccaacaaagggaatcccatgagactaacagtggacctctcagcagaaactctacatgccagaagagactgggggccaatattcagcattcttaaagagaagaattttcaacccagaatttcatatccagccaaactaaacttcataagcataagagaaataaaatcctttccagacaagcaaatgctgagggatttcatcaccaccaggcctgccttgcatgagattctgaaagaagcactaaataaggaaaggagaaacaagtaccagctgctgcaaaaacacaccaaaatataaagaacaatggcactatgaagaaattgcatcaaatagtatgcaaaataactagatagcatcatcatgacaggatcaaattcacacataacaatacgaaccttaaatgtaaatgggttaaatgcgccaattaaaagacacagactggcaaattggataaagagtcaagacccatcagtgtgctgtgttcaggagacccatctcacacacaaagacacaaatagactcaaaataaaggaatggaggaaaatttaccaagcaaatagaaagcaaaagaaagcagagcttgcagtcctagtctctgacaaaacaaactttaaaccaacaaagatcaaaaaagacaaagaaggttattacataatggtaaagggaacaattgaacaaggagagctaagtattctaaatatgtatgcaaccaatacagaagcactgagattcataaaacaagttcttacagacctacaaagagacttagactcccacacaataatagtgggagactttaacaccatactgttaatattagatcaacaagacagaaaattaatgaggatattcaggacataaactcagctctggagggctctggatcaagcggacctaatagacagctacagaactccctaccccaacgcaacagaatacacattcttctcagttccacgtggcattattctaaaatcgaccacataatttgaagtaaaacactcctcagcaaatgcaaaagaactgaaatcataacagtctctaggaccacagtgcaatcaaattagaactcatgattaagaaactcactcaaaaccacacaattacatggaaattgaacaacatgatcctgagtgaatcctgggtaaataatggaattaaggcggaaatcaagaagttctttgaaaccaatgagaacaaagagacaacatatcagaatctccgggacacagagtgtcccagtgttaagaggaaaatttgtagcactaaatgctcacatcagaaagctagaaagatctcaaatcaacaccctaacatcacaattaaaagagctagagaggcaagagaaaaaaatccaaaagccagcagaagacaagaaataactaagatcagagcagaactgaaggagatagagacacaaaaaaccctccaaaaataaaataaatgaagacaagagctggttttcttgaaaaaaataaaaaatagacagcaagctagattaataaagaagaaaagagagaagaatcaaatacacacaataaaaaaatgataatagggatatcaccactgacaccacagaaatacaaactaccataagtgaatactataaacacctctatgcaaacaaactagaaaatctagaagaaatggataaattctgggacacataccccctcccaagactaaaccaggaaggagttgaatccttgaacagaccaataataagttctgaaattgaggcagtaattaacagtctactgaccaaaaaaagcccaaggccacatggattcacagccaaattctaccagaggtacaaagaggaactggtgtcattccttctgaaactattccaaacagttgaaaagcagggactcctccctaagtcattttatgaagccagcatcaccctgatgccaaaaccaggaggagacacagtgaaaaaagaaactgtaggccaatatccctgatgagcatcaatgcgaaaatcctctgtaaaatactggcaaaccaaatctagcagcacatcaaaaaacttatccaccacgatcaagtcagcttcattcctgggattcaatggtggttcaacatacgcaactcaataaacgtaatctatcacataaacagaaccaaagacaaaaaccacatgattatctcaatagatgcagaaaaagcctttgataatattcaacatcccttcgtgttaaaaactgtcaataaagtaggttttgatgggacatatctcaaaataataagagctacttatgaaaaacccatagctaatatcatattgaatgggtaaaacctggaagcattctctttaaaaactgatacaaacaaggacaccctctctcaccactcctattcaacatagtattgaaagttctggccagggcaatcaggcaagagaaagaaataaagagtattcgcataggaagagaggaagttaaattgtctctgtttagagattacatgattttatttttagaaaaccccatcatctcagcccccaaactccttaaactgataagcaatttcagtaaagtctcaggatacaaaatcaatgtgcaaaaatcacaagcattcctttacaccaacaatagacaagcagagagccaaatcatgaatgaactcccattcacaattgctacaaagagaataaatacctaggaaaacagctaacaggggatgtgaaggacctcttcaaggagaactacaaaccactgctcaaggaaataagagaaaacaaattggacaaccttccatcctcatggatagaaggaatcagtatcatgaaaatggccatactgcccaaagtaatttacagattcaatgttattctcaaactactattgacatccctcacaaaattagaaaacactactttaaatttcatatggaatctatgaagacctctgtatagccaagacaatcctaagcaaaaagaataaagctggaggtatcaggctacctggcttcaaactatactacaaggctacagtaaccaaaacagcatggtactggtatcaaaacagagatatagaccaatggaacagaacagaggcctcagaaataaaaccactcatctataaccatctgatcttcaacaaacctgacaaaaacaagcaatggggaaaggatttcttattcaataaatggttctgggaaaactggctagccatatgcagaaaactgaaactggaccccttccttacaccttatacaaaaattaactcaagatggattaaagacttaaatgtaaaacccaaaactataaaaaccgtagaacaaaacctaggcaataccattgggcaaagacttcatgacgaaaatgccaaaagcaattgcaacaaaggtcaaaattgacaaatgggatctaactaaactaaagagcttctgtacagctaaagaaactatcatcagagtgaacaggcaatctacagaatgggagaaaatttttgcaatctacgcatctgacaaatgtctaatatccagaacttacaaggaacttaaacaaatttacaagaaaaaaacaaccccatcaaaaagtgggcaaaggatatgaacagacatttcttaaaaggagacatttacataaccaacaaacatatgaaaaaaagctcaacatcactgatcatcagagaaatgcaaatcaaaaccataatgagataccatctgaagtcagtcagaatggtgagtactgaaaaaccaagaaacaacagatgctggtgaggctgtggagaaattagaatgcttttacactgttggtgggaatgtaaattaattcaacctctgtgggaagacagtatagtgattcctcaaggatctagaacagaaataccacttgacccagcaatcccattaccaggtatatgcccaaaagaatataaatcattctactataaagacacatgcacacttatgtttagtgcagcgtcatttacaatagcaaagactcagaaccaactcaaatgcccatcaatgatagactggataaagaaaacgtggtgcatatacaccatggaatactatgcagacatataaaggaatgagatcatgtcctttgcagggacatggaagaagctggaagccatcatcctcagcaaactaacaaagaacagaaaaccaaacaccacatgttctcactcataagtgggagctgaacaatgagaatacatggacacagggaggggaacaacacacaccaaggcctgttgggggtggggggcaaggggagggaacttagacaacaggtcaataggtgcagcaaaccaccatggcacacgtatacctatgtaacaaacctgcatgttctgcacgtgtatcctggaatctaaagtaaaattttttttaaataaagaaatggacaactctctagaatcaaacaccttgaaattccttgaataattaaggacccacggattgttcatcttttcatatacagaccccaacctataattactaattactaattgcagtgagatcagagaaaaaataaatgaaaagtctactttggagtcaaagatatggttatttcaaagaacagtttccctatcaatagtcatttgtctaagactatattgatcagcatgaagtggcacattatagaagacacttctgcacacctgttacagaaaagcctcctcacaatgcctatttctactaactaatctatgctgtccactctaataggaactgaaaaagacaccatttcctcaatttgatagaggatacagtaaatatttacacaacacttaaaatgagagagtatataaacaataatagaaaacaggtaattcagggctagaatttccaataaaaaattttattttgtttttgttttttaattagaggaagagaaagatcaagccatatgtcagatgtacttcattcttttttcacaaaagcattatctagtcataaaatagaggatcacaaaaagagctgaactgatcataaaaagtctgtatttcctgtgcactacaaacaaccataatcccttgaacaattccccaaagctcctaacatcaaacattaatcagtcagtttaggatccatcagcaaatttaggatacctccaaaggggcctgacaggttaggcaaagaaagcattgcataccatcagttctttcactgatagctaaagatctataggtcagagaagggcaggctctgatgtctcctccattaattattgaaggtaatattccagatgctagtaaatcttaataacttcaaatatcagcttcaaagatgtacttttgatgaacaaagccaaaacacttctccttatcaaaaagacatgttataatgcatattttatctttcaacggatatcctctcaccaataaacgtgatctttgatccaaaaattcttagtaatgccactaaaatttctcaaaacaaagtcagtttaaacgtgcttcagttaaaaccactgccctattgctctaaaagaaacattacaaaatgcaactacagactgtcaatttttcaacaactttgggagtgactgtttagacactgtcaaatgatttctaagcaaccctgccacaagcagactggcttgctataaacacaaggtgtaggatacataagaactaatatttgttaaggaatttctgtgtgccagactcttggctgatctctttgggtttgattgaatcgaatagtcatcacaatctgcagaaaggtttggtgacttgatcgcaagaacctggctagtaagggactgagtaagagacttcactaggcaagttaaagtgctgctctacactcccattgctgtctctgtacccagcacgtgggcacaaatgtaagagcctcgtgaaggaaagcataagcaagaacacactgagcagctctaggaagctccttaaggtagaatgagaaacttactcaggcaggctcctgcagttgcacaattatcattcttcttaagtgtgattactgctcaaagtcagaaacatcaaatgtggaaatattatccaagtaggggatccatccatgaaagcaacaattgagagacttctacattctgctctacgacacctggaaggctcatctccgaagtcacattctttcaagatggtttgaacaaaatgcagatctttggtgcagcaattaataggtacagttatgtatacttcaacaggctgaatgtaatctatcttgaacttgcctttcaattactccgtgcttggagcttcctgcagtgcctgactatctcaaagttgctaacgcagggaaataagcctatcagaaattcaaaacacttcatcatcacattttaatcatacaaaatagtaagtcctgagtttagctcattccttgacaagtcagagatgatgaagtctttaatgctcacctatttatacagcaatctttcctcctaattccgtctatcctattctgttatctcaaagatataaccaggtgacagagttcaagttcattaccaagagaatgtatttctccagccaaagcaaatagaatttcgatgaaacttctaagtacctgttataaatgccaagtattaaaggttctttattcagctatttacaagaccatctgtgaagccaacattctgtgatccaaatgcagatgttctatgaaggaaggcaaggctaaaaaagaaaatcctgacaaggcccgtgcagctacttaaagcataaagggaagtgcaatggtcttacgatttaaatataaacctttgttaaatgatgaggaaaccacagcagcagggacctgctaaacaatcactcgactcctgtgattgagctaaaagattatatttgagatgctcggtccatcgacatatttactgagcccctgttatgttcctagtgtgttccaggcaccatagcattattgtaggcctggctcatgtatgctgtgatttggtgtttaccttcgattctgaagtttagaaaacctcttaacagggcttcaagatacttttctcttgtatctgattccaagtaaccctgtatttactcaaccaacagtcactgtaggactattcagaagtcatgttaagtaaaaggtgggttacctagaagctgacagtgtcactggagcggggtcttgaggatctagacattggttctgtggttgcttagaaaggtctgggggccatgagggagggcctatgacagcagggtaggggatattctcagagcaatagctatgtacaatagaaatatttcaatcttttaattaccagtgtgactaaacagaacctcagcagtcctatgttgcctagtatacataaatatttaagtccaagccctatattcaggcagctctccagctaaataatatgctatagaattatctaactttctctatcaagttcaatagattgagagaaagaccagttatctaacagccagaaggaaaatcaagataaaaacttggtgttaagtttttatgtaaaacatgaaactataatattttgctgaataatttcaatgactgcaaatgaacaaaatctattccaccttttggaatcccttttcagttttaattcatatattccacactttctgctacagagatttccatcatgggtcaaggattgaaccagatgatgtccaatgagttgggatttccaagagagaccatgagcagtgctaaaaagtagacattttgtcacaatatttaataaatagcattcattagaaaaatattatccccctttaagcaaatactattattatttctctctataatagaaacagagttctaacataatagtacctattcgttttactcagaggcatcaatcctaattggaaatttttaaaaatccagctcaagttgcaattcacagaggtggcaaatctcctttagagggcacagaaatgtacatatgatctcattttaaaatgtgtgtgtatactttttatttctgagaaagcaacaaaatcctggcttccaataatgtccaacttaatggagcataacttaaactccttttaacaaagtttaaatttttaaaagcccactgaattaaagacatcatgactaagaccaagctggagtgctctagaatctagcttacaactgtttggcctaaggagcctatagcattgaccctgcatacattaaagccacctgtgctcaagtccacttatcactcacacctgcttacaccatgctactgctcactacaataccaataagaacatctgcctgctttagataaagattctctgcacatctaaattagaataacaagtttttgaactattattgcaaaagaaacagcagtcaatgtggtaatttttggggatctctgcctaggtttcattaggctcaccctaatgtctttttcagttttggcaggagggcctgtgcctgttttcatagccaaaagactgccatactcacaaatggccaaaaagtatgaagaaatccttcaagtttcccaggcactgaacaggaggctccaaaccaagtcatctgcttggagtttttattactccaagttctgttataaactgtacctcagtgctcttcatgtacgacatgacaggcaggaaatcatccttacagctttcacatttaacaaggctacttttgaccaaaatgagcaatgaatttcaaaatacagggacatggcaaagtgctgtaactcggaattaaacaaatcaacaccaagaaacaatattctactagcaattcggtaatcacaggcaaagatgataaatatccataatgtttttataagccacaaacatggtttaatctaatcttacactgtttgtgtttataaagccaagacaagggtgatcatctaatattttcataacatctagtagaaggtagttaaaaagatgttacattagacatcgttactgcttcaaaataaactctcaccttagttaacaaaatgtgttatgggttctgtgcacatctgttataggtaccacagagacactatagctactgaactcgtatgtgtgctagacattccattttgctttttaaaaaatatataacaacctattatttatttaccataattatctccattttacaaaagtgagaaggcttaaatttattttccccaatccaaaactgtaactactccagcccaggtgtctcttttaaacctcttgctccgtctccacagacttcaacatggaggaaattcaggggataaactatatccaaagcagcctcaaagattcaggcagtaatttcattatcatgtcttacttgatttgtaccaaaaaaaaaaaaaaaagattagatttcagtttcacgtcttctgtctcttactaattcaggtactaaaaacagttggtatttactgagtgcttattttgctctaagcccttcacatgatttaacaaattcccaaaacaaccctacagggtagatagtagcatcatgctactttgcaggtgaggatacaggtataaagatgttaagtaacttgcacaggtagccaatttgggcccctaactaaggcagtctggtcgatgctttgacctttgtgctacctttcctctacctctgaagacaaaaggtaattgcaaaataaaagtatgatatgctgagaagcaaataaactagatctggtaacccaaaaagtatatgttgcactcaagccctccttgcagtaccaaacccacaaaaccaaatggtgctgagttgtgcattagaaacaggttaaaagacctattaaataagctcagatctgaaaggtaaacaataagctactgaaatatgatttttattaagcaatagcaaacaagtctatttacatttcaagaaagaaatggcaataattcattagcaagacaaaatagagtcaaccaaaccgatgtagtttctctctccacacacccactcccttacacacatactagcagccctatgaaaaacagggttataatagaaatgctgacacaaccaaccttataatgtttcatacgaaaagctacaattatattttctaattgtaaactgggtgaaaaaaaaaaggccaaccagaacaaaaacataataactacctagaaacagtccatcagaattcttggattatgaaaaatgcatataaaacactattatcttcagccacagccagaagatgtcagacaatcaattcatataacatgccagcttaataaaatctgcatacaaaatttatgaatgcagtaatattcctttatatcacaagttattaatggtcaatttaatgaacatctacagctggagtgctttcgttctgtatgatattttaatcatttttagccatggatttaaacgcatttcattttataaccatcagctagtgaagataagaaaacctttacacaaataactgaaatatttggggtaggccaccaattttgtctttatgttgttatttatttccttaaatttttttttacaacagaaacacaatgaaatgttccattataacaatatttgatttaatatttgtatttagaatatgaaaagtttgcttaaagtagcattacatgtttggctagcataaaatcttccatttcatttcaaataaagaactttctaacctcgtttatgtgaaacaatctcgctcagagctattatcctccaaaaactatcctggtggaatgttgacatctcggacataaatattcttgaaaattaatgtgttgtatttcttaagtatcctatttccactcacttgttcacataatctttaaaaatcctattgtgttcaagtctacttttcccacagattctttactaaaactaaattttactatatgatgcttatgtggaaggaacaggcaacataactgcaagacaacagtagctatctgaaaatacaaacattcagcatttaaaatattgatgtctttctgtggtcacaaagtcaaataattgtttctcacatttgagcattagaatttggtatttaaaattacactcatccttcagagttaattgaaagatttggatatataggaaaaaggttaagaaatctaggtcataaatacttcttaaggtgcaagaattggcttcataaactagtaaatgtgcaataatcactattaaagaatgaaagatggcattttttttttttttttgagatggagtctcactctgttgcccaggctggagtgcaatggtgtgatctcggctcactgcaaccgccacctcccaggttcaagcgattcgcctgcctcagtctcccaagtaattgagattacaggcgcccaccatcatgcctggctaatttttgtatttttagtagagacggggtttctccatgttggtcaggctggtcttgaactcctgacctcaggtgatccacccgcctctctcccaatgacagcaattttttagtttgactgtctatagccttataggacattacaggtgaaaatcagtaaaagccatgtgcacaaaagatttagtgcattcatgtgtctttattcattcactctatcttctgttgcttcactggttccttttgggcttcctactatgtgccagttaatctttatttgctctgggcgagtaactcccattcttaaagacctaataaaacaggacacagtacatgtatacccactaattataaaacagcgtagaattgatggataagtgccaaggagaaatacaaatcaagaattcagagaaaatggttcttacttgtcgagaaaagggcaagggaagactttataaaggtcaactggaatttagaggagtaaaagaaataagggtatttttgggtaaagggcacaacatgaaattgacttaaggacaatacacacaaggacaaaaagtgcctatgacgtgagttttaagtttaaaatacagactttcaacaatgcttaaatctgtagatggtaggcattttccaaattcctctaataagtagaatcagcctatatccaaggaagatcataactcattaaatttcattttaaccttcctgaatctgcctaaattttctcatcttatcaggcaagccaatatatgcttacactgtgaggttaaagaaatgaacctgtgaagagaacctgtcaaatcaaattatcaacaagcaatagtcccactattggggaatatataagctgcaatgtcaattttaaagaagtgtgcttacatttgcattttaattaggtcacaccttcaacatcatgatattaatttcagtttaatgctctattttattgccatttccaaaatgacatttttagacatggacataaagaaaaaaatctctacttttgttttgacaacccataaatattgcaaattgaaacaatgttgaacaaagttcaatatttggaatattcaaacgagagatacgactgtgtctaaaattctaaatacttagaattggatttcaaaaatattccaagggaaaattattagattctcatttaagagcataatggagtgttgaatggaacataaaattcaggttcctgtgagtcaccagaagctaaatatgaatagctcagaaaaaatcattttggttaagactttgcattagaattgagacatgctttgtagttttttcagatcaagagggaggtagacaaattacagaatgtatctttgtccattaataaatgacatatactcaaatacataaagttgtaataacattcacataacaaaattcatcaatcattttaaagtgtaaaattcagtggcattttgtacattcacaatgtcatgcaactttcaccatatctgtttccagaatgttttcatcatcccaaaagaaaactctgtggccattacagccattctacattccccactacccactcctaacccctggtaccactaatctgctacctctatgactttgccaattctggatatttcacataaattgtatcacataatatgcgacttttagtgtatagttttaatttttatttttgtaggtacatagttgtatatatttatggggtacatgacatgttttgatacagacatgcaatgtgtaataatcacatcatgtaaaatggggtatccatcccctcaagcatttatcctttgtgttacaaacaatcaaattatactcttagttatttcaaaatgtacaattaaatcattattgactacagtcactccgttgcgctatcaaatactaggtcttattcatgttttctatttttttgtactcattaaccatacccacacctccctgcccaccacctgtcaactatccttcccagcttctggtaatactccttctacttactacctctattagttgaattgtttcgatttttagatcctacaaataagtgagaacatacagtatttgtctttctaggcctgacttatttcacttcgcagaatgacctccagttccattcatgttgttgcaaatgacatgatctcattcttttttgtggataaatagtactccattgtgattaagtaccacattttttaaatccattcctctgccgatggacacttaggttgcttccaaatcttgactattgtgaacagtgctgcaacaaacacgggagcgcagatcgctctgtgatatactgacttcctttgggtatatatccaacagtgggatgtctggactgtgtgttagctctacttttagttttctgagtaacctccaaactgttctccttagtggctgtactaatttacattcccaccaacagggtacaagggttcccttttctctacatccccgccagcatttgttactgtctgtcttttggatataagccattttaactggagtgagatgatatctcgttgtagttctgatttgcatttctttgatgatgaaggatgttgagcaccttttcatatgcctgttagctatttttagtgtatggtttctttcataagcaaatgcttcaagtacattctaacaaatacattctctaattcttctttaagggaatactcttaaagaagaaatggtcaagtacttcatttcccaactgttttctatttttcttttcccaaaactattccaaaaagtttatggggctttgtgtttattgtttatgaggtaaacaaatatgagtttttactcccagatttttccaaattaaaaaggcagtgacaaatatccatttaaattaaaaatccaagccattattgacattggaacttgattctacatatgcattaaaaaaaagacctaacagggggaaacctacattgtgttcataactggggatatccaacagcatcagtatgtcaaatttccataaatgaatccatgtattcaatgccattcctttaaaaaatttcacggccttttcccacagaatttgacaagacggaaaaaaatcatttgaaagagtcaaggtaaagaacagccaaaatgtgattaaaagaaaggaatgcttgtctttctagacataaagatactctttaatcatagtaatcaaaggactgtatcattaaagctcaaagagaccaactgaactcagtggacaggcaagaaacagattcacacatttatgtcaagaccatggggaaagaatagaatggaacactgtttttccataggaagaaaagtagattcataatttatatcacatataaaagatatccagatgatatcaaggcacatatggaaaagaaaacattaatacattagaaaaatatgaaagtactgttatgatattaacactgggaatatattcttaaggtacagccaaaatgcatagaccaaaaggaaattattaaatttcattatactaaacattttagtatcaaaggcactatcccctgtcccgaccccatcacacatatggaaacccactaagattccaagcgagaaataaaaaaaagtcctgtgatggatatgatcacaaaggatttaaatctagaatatataaaaatactaattattgcaaaagaaaacaatgacccaatggaaaaaattggcaaagaatacacacaagcaattgacaaaaagggacacctgtttgcatccaggagcaaacgttttactccactggataattggagaaatgagaattaatccaataatgtggtaccatcttttacccaccagagtggcaaacacttaaaaagtgtgccaatgcaaacatcatgggaaacagatgttttcacccaatgctatggagtatcaactgacacaagcacttaattaggactatagaactgctctccaatgttggagaaatgtgtaccttacaacatggtgattccactgctaggtaaatattctacagagagactcaccagtacactaggaaacacatacaaagatattggttttacatcgtcttaactgagaaaaattagaaacaacctttaaaaaggaataggaaattaatttgtcttccactcagggactagaatacaatacaggaggtaaaaatgaaagaatgagggcttcatttattcatgtagctgtatctcaaaaacaatgccgagtaaaagaaactgattatgtacagcaggacacagtcaagaaaatattaaatacatcaaacaacatgatttcctttttagggatacagatgcacattaaaaacaaataaaaacaaaaaacaaaaaaaaacatgcaaacctaagcaggtagaaaacctaccaacttcaggtcagtaaacgcctctaaagcagttctcaaaagggggtaactttgcctcccacatgtggcaatatgtggagatattctttgttattcacaactaggagggggcatggtattgtatctggtcggtacaggtagagttgctgctaaacacttacagtgcacaggacagcccccacaagaaagtagttatctggtccaaaatggcaatggttacaaggttgagaaaggcagccctaaaaacagaggaaggagaataagatgacaggtggggaagatgaagtgtatctataacttttcattctaagaaaagatctgaagcatgtatgaaaatatgttaaattttttaagaaggactgccacattattctttgtacattcttatatttgaaatatctctttaatcagttcaaaaatataaaaatcattctgcaaacaaacacagttaatttctaaatttgatgaaaattacataattcttttattagcctatttctataaatatatctttggaaaaacaatattctcacactcacgatcaaacgtatttgcactttttttcagtgtttgttctacacagagctataaaaggaagactgtggaagaacccaggattcatccaggatcacaggatcatttcattattacagtttcaggcaagaacattctaaaaccagctcagagaaagctaattccgtcctttcctggttatatagcagatcataataattccaggcaattctctgaagaagctgatgatctagaacagtgggcttgcatcacacaccccatcatgcttccttaagtacatggcttaggatgctgatttctcccaacctcatgggtttcagtagttcctacaaacaactttgagatcaaccagtgcataattttattttttcctttagttccttagtgcagaggatggcaaactttttctgtaaagggcaagatagtaaatattttgggctttgcaggccatatggtctctgtcacagctactcatctgtgtcactgtaacacaaaaacagccatagaggatacataaaggaacaaatgtggctgtgttccaataaacctttagttacagaaacaggcagggagctagacttggctccaagccatagtttcgccaacaccaagatggacagcaaaaatgcaaccagtttaaatactattttaaatttaaggcatttcctccaatctttgaaagtaaagttttatgtatgttttaatcagtgtaaaaattttgtactaccaaaaatgaatttatataaatgaaacaattcaataaatgatgaaaatgttcatttgttacatttatagcatactaacttctttctggaagtatgttataccccctgatttactaaattattaattataattttactagtttaaattatgctattaatgattccttataagaaaataaacacacatattgtatcttcaactaagggttgggaacgacaaggacagtgaaattatactcccaacacaaataatagctttctattaggtttgctatttcacctgaataattccttataatcatgaataatgatgttattcgacaacctaatgatatcatggtgtgtagcttcaatccatctgtctttgtcaagaaggtcaaatatttgtactccactgcactaggcaaagttgaacaaacagttaaacaacatcacacaccttaattactccttcaaatgaaaccagcaactaccattttacctgattctaggacctgtgaaataaaaacctacttcaaagatatttaatctgtatacacttttacaccaaatttaagctcaacttaaaaaaaaaataaaagtggttaaactcaagaaaaagccccaagattttctaagggtattgttaattggttgttgctgtaaaatgttttgtgaataacaaaatattccaggaacttttaacaaagatctggaatacttcatgtgttatcttgacattggcttaaaggtaagaataaagcaatagcgtgatagatgtgaactatagttcctataaatgcttcatagtgtttgctttgcttcgagattccatgagtgaccaaggagttgaaggggataaaaactccccattcactgtttctacagagcctctacaagacctggacccttggggctgggggatggtgaatatagcaaggtatgatgtgggcatacttaaatgatttgcagcaaaataatgtttatattaaaaatcctgttttccttccttccacccttctgctttttcttaaatctcaccaaagctttattgctgcacaaaaatgaagtccttagaaggccttattaatctggttccagactcctagcatcttcccacttcctcaccatgcttcacccccacaggtcttcgtgtttttgaaacggagtctcgctctgtcgcccaggctggagggcagtggcgagatctcggctcactttaagctcctcctcccgggttcacgcgactctcctgcctcagcctcccgagtagctgggactataagtgcccgccaccgcacccggctaatattttgtatctttagtagagacggggtttcaccgtggccttgatctcctgacctcgtgatccgcccgcctcggcctcccaaagtcctgggattacaggcatgagccaccgcgcccggcctctctgtgtttttttaaacattattgagcatgcaaacttgtttctgcccctgagcctttgttcttgtttccttctacctggacttggctgcccattgtcccacaatgggctggtccctcctcgttagttcttacagcacgtgtcaccggcaaagagaagacttccctaccactctgtctcaagcagtccctcactctcaatcatactcttctttttattttattcagaatagaaaatcatgttgtttgtgatttatgggtttacatttatgggtttcatcttttatggtaaacctctgcacacaagaataaaagtaggatcgttatctgactattcattattgtatacctggggtctggcacatagcagaaactaattaaatgataaatttacatattcattcatttacaatagacaactctgtgtctaatttgaggtcagcaaatgacggccctagagccaaacctgcctgatacctatttttgtaaataaagttttattggaacacagccctgtttgcccgtttaccaattgatgatgttgctttcacactagaatggcctagtggtgtagttacaacagagaccacatggcccagaaaagatttacagaaaaagtttgctagctcctggtctactacacagtatatgttctcaaataaataaaataaagtacagtcattgcttttaaaggagttctggtccattgtgtgtttttattcaaacacttttagattaaaattctatggcccaaaagaaagctcctttaaaactgtaagcatcacctagcaagagttgtattggtgctgtggctgggcacggtggctcacgcctgtaatcccagcactttaggaggccaaggtgggtggatcatttgaggtcaggagtttgagaccagcctggtcaacatggtaaaaccccatctctactaaaaatacaaaaaaaattagtagggtgtggtggtgcacccctgtaatcctagctactagggaggctgaggcaggagaattgcttgaacccgggaggcagaggttgcagtgagccaagatcaccccactgcactccagcctgggtgacagagtgagcatccatctaaaaaaaaaaaaaaaaaaaaaaaaaattgtattggtgctctattcattaggtcagctggctgaaatcataaagaactaacacagtgcctggcccctggtaagtactatacaagccttgattggcttctttttggaagaaaacattatatccggtggctaacacagggcttggcacatattcggttggtgcaaaagtaactgcagttttcacaataaaagtaatggcaaaaacctcaattgcttttccatcccaacctaatagcaagtaacagtcaagatctgttgaactgaattgaagtgaacttgactctttcagccagagggactaacaggctaatctgtgaaattagtgggcaaaaaactgattcactcacctgagaacaagccattctgtaaaataggctgagaaaccatttctcaccaacatttttcagggatgacttgaagtaatatgatccaaggagccagatttcaatatacgtttaatgttttttgataactcgttgtaggtagccactatttatcttatttgagttacaaagatacataaacacaaaatttaaacagtaatttgagtcacagactcccagagttgcaatactatcccctgtaatactcagttctatagatattttttcttttaaaagatccaaactaacccacatttacgccagctcttccaattatgactaaccgatgcatattatttctccaaatcttgacggtctaagctaatgcctctcacagttgactcacagatggaagtcacaattatttgggagtggctggctttttgttttgagttccacttcctggctcctacgctcaacttttgaattcagaatccttagagtgagaaatcatggcagagtccggaatctccattttaacaaacaccctaggtgatgctcggtcctttagaaatctgttattttagatcaagagatcatatatccacattaagaaataccaagtagctatcaacttttggaaccactactttcctctattggaaatgtaacgaagtgatactgtgtgttttacttggagttattcatattactgtatattacgtgcatacacatgcatattacgcactcagtacttgtaggagtgaagtactcaaagaaaagctaaaatgtggcatctttgccatccaggcggttctttgataagcagcatacgcataaatgatgtaaacaaatgatacaatgacccatgactgagagaccgacgagtagacatgcaacaagatttcagagaaagaagcaatcaagggggtctaggttgtcagtgatgtgaaaaattgccttctttggatccagtagaggaggcaggaagtacaaaaagtgatagtagttatcacactctagaggtgtcccaggaccttgttcttctctcagttaagacctaagatcttagaacacaggaagagtaaagcaagaactatggccttctaagttattaatcccagcagcctgggaaagattactaaggctttgaaagctggccaaaagtcattgcatctcagtggtcatagaggaagacctgggccaccatgaactgaaccagtaagaagcccctgtctccaaggagctgtcctgaatgaccttgcacggcacagcattctctttatcttcctgtggcatcagtaataaaaatcattggctggtctcctcatttgacatctaatcaaacacttcactcggaagttacttttcttgcgggtttaggtcttaaccctccaaggatcctgcaaagttctagaggacagagtgtcagcaactcccccagtgcttagcacaataatgtcaggcatcataaaaagatcttgtttaatcatttgataattttttatttattgcctaccatgtaccagacattgtgttaagcactcaatagaacagacagctagatcctaaacccaatggcagtgacaaaaccgtctgtagtcatgagggctgacgacaacactatgactatagtaaaagccattaaaatcactttaaattggtgaattgcacggtgtgtgaagtatatatcaaaaatgctattataaaaaaatcaaaatggcagaaaggaagatggtcaagccttagaaattcacttggtgaaaggttagaaaaaacacatccagaacttagttactcctatttagatggtgactgtgacacattagtaatacttgatggtactgtagctgaatactgaatattaagaaaattggaatgcttctcagaagcaacaaaacaacgaaactacatttatgctgtattggttaagaacataggtgtcagaatcagaaaaacatgtgatcagttctaggttctcttccttagttgtgtgactttggtcaaactgcttacctatctgagcctcaatttcttcatcagtaaaataactttaaaatatagtaatgctcaataattcttagctagtaatcaaataatgcaaattagcataatacattctcacttataaaattagcatatattaggaaaattattactattcaatgagtagtagcaaaatgtttttccactttgcttttgggtacatgtgaaattttattgtatgtccactcattgagatctcaaacatttattatcataacatttacataatttatgtgtatgtaccttatccaagaaggcctatgatagcaaagatgctatgtctcagttttctttgaatacttcactcctacaattactgagtgtgtatgcatgtaatatacagtaatataaataactgataaatgtatgggcacatacattttatattggttgtggcatgacttctaatagtgaaagttatgaaacaaactaaatattcaaaaccaggtgaaataattatagttaatcatattgatgaaatattatgaaaccactgaaaatgaagttaatgaataagaaacattaactttaaacaataagaaaaaacttacggtattaggatcaaaagaaagggatatcatactatatgtagagtagtgttgtgttctagttttatctaaaactgttttggagaagatggaagaaaacaaaacattttaaaagattaacagggattatctctgggcagtaggattatgagtctttttacttcatacttttgtgcatgaaaaaaattaacagtattaaattcttgctcattttatttataataaatacatgcagtattgattttaagaaagagcaaataagccttattttacgtatcaccagattatatcacaaagtgacgttaattttactacacagataaatgaccacatagctcaaatgaccagaaaaaaagaattgtgaagtatattctctaaatataagcatccaaccatattgatagccaccaatgtcagtcacacttaaaaagattttttggccgggcagcgtgcctcacgcctgtaatcccagcactttgggcggccgaggcgggcagatcatgaggtcaggagatcgagaccatcctggccaacatggtgaaaccccgtctctactaaaaatacaaaaattagctgggcatggtggcacgcgcctgtaatcccagctactcgggaggctgaggcaggagaatcacttgaacctgggagttggaggttgcagtgagccaagatctccactgcactccagcctggcgacagaacgagaccccgtctcaaaaaaaaaaaaattttttttttggttcaacaaagctgcttagtaagtagtttaaagttatttattattctaacccaaatgtttcacatcacagtaatttgttaaatataattgtataacatagtaaaacgtgaactgccaaatacaatatattgattgaaggagtctcatgaagctttgagagcttcagcgatagtggacaggctgtattcaaccgcagctccaaaggagaaagtgattaacaaaataagaaaataattaattcaaaagaaaatatgctttagaaatatgtgattttttaattgtgagaaggataaaatgtttccttaaggtcatgtaactgttagctacacaggtagcctttctgcccggtagtaagcccaatgtggaaatgaaatttagtagtgatttaatttataattatttttcaaagtttgaggaataggaacaactacattatgttcaatagtctgaaagcacaaattctgacctttaagttcaaagtggaagtcaaactgctatacgtcagcatgacaacatcaagaaaaaccaacaggtcccaggggacaaggggaatacctgcttccctgcccactatcaccccaaaagttttgtcagaactattttggacatttgtcaaagatgtattttttttcctatttagatcatgagctgtaaaaacagaaaaaaacaaaataatgggcagaaatctatctgaaacccactactttttttccttcctttattttaatagataaaaggctaaaccaggtcatctacctaaacaagactggttccaggcctctgctatggctaagtagttaaggaaatgatttttgcaattaggatggtctcatttatattgggacttcactacttactaggtgggtgagtgtggacagcttacttccatacccctaggcttctttcagcatctgtgtaaagggccattaagtcagaattaaataagtggtagctgttattactaaatataaaagcctcatagaaaagatatgttagttattagaaagaaaattttccctaaaacttcttttaaaacatcttatgacaaagttacagaaatatttttaagccgtttgtaactaatacagacgcacattctctctcatatttacacttttcacctttgcttcccatctggaggagatcatcctccaaggtttcttccagcatattttatgataatcagactatgaattgggaatacatattatttgggctctgtttttgattgctatttttcatgtggtaaatcccagaaagctgcccaaatcccctgctgattatcttggccaagatgttgacaaactcttagatttctgctatcccattggcatccattggtattgcaatggcattctttcatccaacggacaaaacctctttccaaattctgacaacttctatattatcatcattcttctaatgttaataagcttgaatttggtaacattaaccccacagttaccaaatatggcctcctcatgccaacccacctctgctttttgtagaagaaactattaggccatttgtaaaagtctggtttgatgactcctcattttgtggcaatttcataaatatgaccaactttatcattagtcttattttctttcaattaatcaacaaagccatgagtaaaatgtgaaaatttaatagtcttttcccatgatttctcacagacaatataattgagctttccatgttattttacagttctttttatatggtaggcactaatgaaggagtccacaaacactggttacatagcacacatggttgatgtctatttttcacatggtactttgagggtggagggtaggtgggaagggatggatgtattccataggatctgtagcaacaagtataaagctaattttgtaaactgcaactcctgaacactggtgcctttggagaaattatttatcatatattatctatattacagagattgtgtttggcaaatccacggttttagagtcagtacacaaggcagataatcatttgtctgaaaatctcggacaagtgtgtttactatctatagtagatggcaccattttcttcacaaatatttattctcctcttctcctacatcgtgggaggagtatactactttgctttactgatttcaagatggtcatgtgatgtgctttggccaatggatcacaagtggatataacacacggccctcccaaaggaagctttaaacgtatgtgtgtggtctgggttggccttctaacctcctgccctctaccataggagcaaaatgttccagataggggctgcttcttcagcctgcgtaaatggaatgagaagacaatggagcagacccaaagccagctgagcccagccaagaccagcagagccacagctgacctgcagatttgtgaacaagaatgaatgatgttgttgtaaactaccaagattccaggttgttgccccataaaaactgacggatatactatccctaagtcttaattacttcatttaataaattgtgatttagtgtgtgtaaaacatagtgctgaagttactatagtgaaaaaaaagcatatactgcccctgctctcatagtctagaggaagaaaatggaaattgcaccatcattctagcacatgtgaattacaaacaagtaaatgctatcaaggaaagaaatgtggttccattagaacatataataaaggaaagtggccaagactgaggtttcaaaagagcccttctagaagaagggatacgtgagttggcattggtagaatgaacaggagttagcaaggtaaaaagacaatgcaaaaacattccagtcaagagagaaacaacatgcaaaggcctatggctaaaggaaacacgatttggtggaggaatgaaagaggctagtatggctgggcatgaaagaaagagggaggcctggcatgtggtgagattagagagaaagactgaagcaagaccagaggcctttaaaggccatgttttaaaagctagggtctttatcctatgtacgaaaggaagctagcaaaggttttttgttttgttttgtttcattttgtttttttacaacaacaacagcagcaacaacaaaacttgtattttaagctcaggggtacgagggtaggttagttacataggtaaactcgtgtcatggcggtttgttgtacagattatttcatcacccaggtattaagtctagtacccgttagttatttttcctgatcctctccctccttccatcttccaccctctgataagccccagtatacattgtttcctcggcccatatgtccttgtgttctcatcatttaactcccacttataagtgagaacatgtggtatttgctttcctgttcctgcattagtttgctaaagacaatggcctccagctccatccatgtccttgtaaaggacatgatttcattctttttatggctgcatagtattccatggtgtatatgtacaacattttctttatccagtctaccactgatgagcatttaggttgattctatatctttgctattgtgaatagtgcttcggtgaacatatgcatgcatgtgtctttatagcagaatgacaaaggtttttcaatggggataaagtaaggagttcttcatcagtttgtgtttgataaagctctgactgctagctacatggagaatgtattgcagggaatgtagagtgaagacaataaataagctgagtgaggaatgctggtggcttggattagggcactggcattagaaattagagaaatagatagatttgtgaaatttaggaagtaaaaccagcaagatcagcactgtgaatacagtattgcatgttagaaaaagaaggatgttctatagtactactatccatgaagcgatagatcttacaataaagaaggaatctaagaaataatgtctctggattatgaatttgacttaatttatcaattaggtttgactacttgaaaataacccataatggtaggtaatttcaactccctgccaccacagttacaggtggaaactgttattactgaataatggtgtgagcataaatgatgtttgtcaaacttgtgaatcttaggaaaactctttggacaagtgagtgaatattaatttagacttcattggagagttcaagttttttctctttccatataatctatgtcatctttttggaaaaggtgaaaacaaaaaaatagataatacaaagtacttcaaaatgccaaagactaccctctgagctagcttgaattctattccttctatttatttggatcaattcttatccaaatctgtgagatttgtatattatgagggtgttttctttgacatcttaaagttcaaagatgtgtttcaacaatctttagagtaggtacttatggcatcacagcttagcttctcaaaaagccaattataagacacagctgttaccatgccaaattcctatatatttggttttaaaaaaaactaattctacacctggctgatgaagtaaagacgaacgtgatagtataaatgtacagacacaaatcactgctttaagattccctctctagacccacatagtacatatctgtggtgtctaccagctaagcttctcttcctatattcccacccaaattcttttggggtacctgcaactcccccattgcaagcagtcctggtaggctatcaaataaaacaccttatctaccaagcaagagatccaggacaggccaaacagatggcgtgctccaggaatgtgactcttggcgattccaaatgataccaggacatgtatggttggagctacatcacttcaatggcagcatcctgaggagactgtcattaccgcaaccaggatacccagagctgccccaacttctattatttctgaggcctgtttgtgcttagctttcaaatttcagtctatgacctgcttcccatagctttccaatcttgtgtactattacataagtagaagctgattctcagataagacaagttgtccaaaatcacacagataataaatagatgaattaggattcacatctctgttagactgaatccacattcataatcttaataaattcattatactgttcctatgatcacatctcaaatggaatttgtaaaaagcccagtaacatttgtttattgccttagcctaccacttagaaattacaatgaaatgttaactatatctgctattttgctattcgcaagtgacagatgacttggaaagcatgtccactttagtcctctaagcacatttacattttcatattgccttcacatgacatttctgtggctacacttgcaatccagactagtctttcatcctctgttgacaatgatctgtttcattttcagagaaaactacccaataagtctctttaacgttatggatatagtctttctaaggaataggaagaaaatattttttcattgtcttacagtttttttgtttcaatgaatacatcacgtacctggtaaagaaaccttgctaccgtctcaacctttgccaacattatcattcacagagattccaatgagtgatacaaaccctagcagcttcagcctacagcttggtgaggttgactacaaagagcgcccatcccagagttactagtactcttattttgccatctttatttttgtctctggaaaatgaataaaatgtcagcttcagtagcaacatactgtggaattcataaaacaaaggtcaggtatgaagaacacaggaaaccaatggtagcaaaaggaaacccaatgcctgagctggccatcttggcgagtggggaaaactagaacagcactgaaaaccaagcatagttaagccaggattgatgggtaacagctgcactttgcaattcacctgcaattcagatccaatttcacatattctgcaagcccaaaaaaggccaattattgttaagtttctataagagtttaaacggccatgattcatttttgttttcctttaggaattttaggaccccctaagaagtattctctcttctacatatcatttctaggccttgaatttgaatggagcatctgctgagtataatggacctatttggccttttatctcattttttgtgaagctagtcaaatatgtatccttccactagggtcagcatcgactagatggactaggaagaatttcattagaaaatgagatctcatgggagacgataaagaccaggcttccaagacagagatgtgagttcaagtctctggtatttactagctgaagggctgtgggcaatcatgttaccttcttgaacctgctcccccacctccccccacacacacaatatagaaatacctaatttgtacaattacgaatccaaaatattaaatttaaatttaaggttttagcacaatggcacataggaatgactatagtgccattattaaaaatccagtaagtgcatttatgcaccatataatgtagtatatgttgtaaattcaatagtacataatagaatcatagtctctaacctcggaggtcttacatctaatgttaatgacaaaccaagaataaattccagtaagggggtgaaaagtgttctgatgatgggggaaatgcaggtaataatgagtagctattttattattaaaaacgtaaaacacatgtacagcagagtggtcaagaatctaaactctatcatcagaatgcctaggtgtgagtctcatgtctgcccattactttcagtgagactttgcataaggttatccatcagtgaaattaaaatgataatattaactatcttaaagggttttcacaaggattaacagagaaaatatgtatcgtactgagaatggtgctggagatatactaatccttcaataaatattacctataattaccaccattatgccaattccatcagtactgagctatacagaaatggtcgacacccttcagaatgtctccttctacacagacaaacatcgctttatgtgttttaagacaatcaagctataactagagaaaaatctaaggtatctctaaagacactttcaactcagaccatttatctttaatcaaaaatttggaaattttgatgttaaaattctgaaattattttgagggtactatagggtcttagaataaatagaagagaaaaataaacataaaatgagaggaagcacccccatagtgctggattttaatggaggtatcagcatcaatccatgatttaaaatatatgtatacatattttccagtcctttctaacagaagggcctagaaacaatgtcacctgagtagccatgagcacacttaatgcccagatcttggtttctaattatcttctatttaaatgaaccatatagctaattccagatctgaagcagggaaagtatgttatgccaggaaatgaggacagcttatagataaatagggttatctcaaaagggcagagacatctgaataaagggacttctgctgtcaaattgggcaaatttaatcaaaatgatataataaatggattctaacaccttgaattaaaagtgatctcagtttactagatgagagagaaacagcaacagacaaaaaggggctaaaaaaattgaggagaggtaaagttcttccttacagaataatgtctgtaaatatatgttgaaagaacgacaaaaatagaaagctaacatcttatatatcccatattataaatgactcaagccagaatcaccaacaaatgctaaaacaaacaattaggggaaatcttattgtggaacaagacatgtctattaattcaagtcacagcaaacctaggaaaagattgactgatatgtagccatggtaataagtagcatcctgaatcagattaaagtctatttaattggcactttctagtcaaccaatcagtaacagccctttattgctaaaagacagccagtcagcaacagactcatacatctctaagtgccaattaagcaacctgccccactcctcacctgaatcaacatgtttccacatatgtcagcttacttacttctgaaaatctacttaactccatactttccactttggtctactcagactgaactcgaccagcatagttctcctttacaataaattcagctttgtctttgaatttcagatgaatggtgaactgcattatcaccccactatataataattaaaaagaaaaaaactgtgtcttttacagtggggtaatctggcagtcatcaactaaccaaatggtgaaacttggcattgtcattagtgatgccaatagcctgacaggatgtactgatgcagaggcaaggggacaacataacctatttggtgtccttgccaaaaatggtttaaatgaaccgaatcaggagaaaacaatgagatggatcaagatagtaggctgttgcatgggccatatggcttggaatcttcaaataatttaatgtcatgaatatccaagggagttagacaattgatatatattttaaaatatttaataaccaaatgcaatttattaatttatgaataaccaaaagcaatttaggaaccttgactggatctgtgtcatggaggaaaaaaagccaactgagaaagcaaattgagaaaatctgaatatggaaaatatgatattactgaactaatgtgaattttcttgggtgcagtaaatggggttagttgtgtaggaatgtttccttattcttggaaaatgcaagctgaattatttaggagtaaagcatcctaacatctgcagcagactactgtttgttagagggtttggcacaaaggaagtgtctacagagacacggcacagatatatcaagatgtcaaagttaatgaatctcaatgagagataaacaggtgatcactgaactgttctttcaactttactgaggttgaaatttttacattctatttacttttattctgaatcttatatacacagaccacccatggaatttcccaggtatttttcttcagcctcaatttctcacttacagtaaaaataaatgtgttgtactctgtttttgtaagtcagctcaaaactttattggcagaaacagtggtccaaataagcaaagttcaaaacatttaataataattttcccctacataaaaaaggcaaatatttttcagttaaggataacaaagataagattccctttggagtttaaaatcctccaatctttcagctttgtccatgtcattatcctcagcaaacacacacaggaacagaaaaccaaacaccacatgttctcacttacaagagggagctgaacaatgagaacacatggacacagggaacaatacacactggtgatatggacaggaagcaggagggaagggtccctggtgagggttctactctcaagcctggacccatggccttaaatgagaataggcatgcttgtttttgtgcccagatgttgccttttccaaaaccactctgacctgccctgcaccctatcctgtgcccataagaaccccaaaccccacgctccatgagcagaagagcagcagagcggcagagcagagaacaggagagaagaggagagaagtgtctgaacgtggagaggacaagaggcagctggacatcggagactaggttggggagaagtttggccagggacagccttactccaagggaagattatcttcccactccattccctttccagctccccatcctgctgagatccactttcatcacccaataaaatcctctgcacacactacccttcaatccatttgtgtgacctgattcttcctggatgccagacaagaattcaggaggcactgggtgtggaaacccaaaaaggctgtcacactgactcttcactgagctggctaacacttaagctgtctgtggatggcaaggctaaaagagcattgtaacacacttggacgctgccatggggcatgcacagggcctgcttctgctggagagaagcagccagcagttccagtgttccttcactccggttcccacacccgtttccttgcacgctccctcccgtggggagtggccagcagtgggctgagtaaaactagcagcttcagttcctgccagcgaagtggtcaagggagctcccgtttcactggggcctgtcgaggaggtggggagaaggagagcatcaggttaaatagctaatgcatgcagggcttaacaccaggtgacgggttggtagatgcagcaaccaccatggcacatgttgacctatgtaacaaacccacacatgctgcacatgtatcccagaacttaaagttttaaaagataataaaaacaagagttataagtggtggaacaacaacaacgacaaaaatcctccagtgtttatcataagccattttgcctccaatgtcagtaagacaacctagaagtctctgagaggagagaaatctttccagatccatcaggagacacagaagtcacatgaaagcgttcctacagacacatgaaaatgctaagggtatctttggacactgaggactctcccaccaacagccacactgacaacagcctttggtgtctcactcagaggagtccctggtgggaagccaggctgtaatctgtcacaagagcatgtgagcagaggccaccttactagataaaatgcagctggttaccgcattccctggagggacagtgacctccgacagacaaggtgaggcaggcagacaaaacagtgggcaccgcaaatgaacaggcaggcgcggagtggtgcctggaggaaagcctctgacctggagccgagggagagctgctagataaacaagccattataagagggtaatattccatcctagtgtgagcggaagctgggaagaaaaccaactgtaggcctgatgtggactgcagctggcaggaaggctgcagagctcggttcaaggcaggagatcctgcccctgtccctggcacagaacacaaacagcaccactggatgtggtgggaggaggaggaaggaaaatctatacatttacgggacgtgaaatgcaagaaattgagggaattcgtccaggaaggaggaatgacaccattaatatcagtatttatgggcttacaagaagataaatgcatttcaagagtagcctcaccccaaagagaactaaccacacaattaagatcaaggctactgtcatagacctggctctgctttgaaaaacaagctacaaagggaagtttgggctttaatttaaaaaaaaaaaaaaaatgttcacggaaataagagaaactttaagaaaacttgtagaacacaaaaatcacattagactcttctataattctcataacaatagaaacttaacaataatggagcttatatttgaatgcttcatatggacgagagagagtttaagcattttgcatatattaactcacatgatcctcacaacaattccgctgggtagatactattaccgcccatttgaagcataaggtaactgaaggaaatctaggttaagtaattcccagggcttgctcttgtaagacaactgagcttggattcacatccaggccctcagctgcaaagcttatattcctcagcccatgaatactgcctctgggtatgcaaaaatcacctttgccttcaggaaataaggctcacatttttaagtgaacactcaagttgatatagtggggaaggcggggaaggcagggaaatctggagctgagacaaaggagtggggaaacatactatgggttcagaggacctatccacaaacctgttggtctctgtacctcttcacgctgttgaaaaattgactacaccgaagagcttgaatttatgtgactatatttgctgatatttaattccaagttagaactaagaaaattctaaaatatttattcatttacttaaaataataaacccatatgttaatgtaatattttaataatattttctaaaacaaaaaaactagtgtgaagagtgacaaatctctaatgaatggcttgatagaagataattgcatccttatttctgcttctgtatgcaatctatcatgagatgtcttcgctaaagcataggaagaagttggcctcatatagacatatagttggaaaaggaactacttcacaaattctgcaaaggtcttggggaccttccggggccccaggaccactggtctagagaaaggactctagagttagaccacctggatttgaaacctggctctgccacttaatagctgtttggtctagatcgatttagctcatattatctcattctctcatctataaaatggagataccaacagtacccacctgataggtttgctcatgagtgctaaattaatatttatcaaatgcctagaacaatctcagagcataaatattatatgttagatgaataaataaaatgacctggctttgcaagaagcatctccgccagagtaacgtctctgtactgaattgtacattctgacagctgagacaatgacagggatcacttgagcgaaagtgatcaattacacccatgttataatagggataattataataggagcttcagtaaattgagaaatcaattgagatacaaacttcgacttcatgggagctaagaaaacataatcatttgaatctctactcctctgaggatggatagcaacatcctttcaaaaccctttcatgttcaaagtcacatcagacaggggaaattctttaatgtaatttctgttgcattttggctataaaaacatgtcgagaagttgttaagctgacaaattccaaggtatctcttaatgacaaaaagtgggtgaatagttataaaggctcaagagttaatgttattttagggttaagttaaatatatttttacctgtgcaaatttttatctatttcatttttaaaaattgataaaggtcattcaggaggtgatttgagaacacacaacttgttgtagatatctttcttatttatattattgccatatatgatgcaatacatgtaaaattcttccatcccatcctactatacctttcacatattctttgacattttattccctccatcaaatatgagttgtcttttagatagcatcggaatcataggatactaagtagctacttcctctgtctctctacacccacctccctaaaactacaggcggctgacccactgatattactatgaattttttgctcttcatcaacggtcaaagggtggtcttcagtccaatggcctggttaactgggaattgccatatatggcttatcatttttaagaaattacaatattgcagaaagcattttatatgaaaattatattaaacataatctagaatgtaaaacagcaccataacgtcatattgaatatagtacatttcatgactcagaagacacattatagttgtgccacaatccccaagatctgtcttttcaatattacccctatgcaggaaacatgtgaaactagcaattaatagtataaagaccaacttaggagttctgtaaagaagttagttagaatgtgaaaacaccgctgtgcttctagaaccatactgcccggttcatcatgacactcctggtctctccatttataaacttggaaataccattctttaccttcttcaagggtggccaggaagatacagtgaatttttaaagcatgcctatgaagttccatgaacttgttggtgatagtggactagcaaaataaaaattagaagaaagaaaactcattcaaaaaaaatcacaagaaaatacgcacaaatatttaatctcaggatagattttgcataaaagaacaggaaaaactcataaatgaccaagttgacaaaactatgacaaaatttctacatgttaataacatcttaaagaaactgaagaggctagggccaaaaaaggaacaatatttgcaacaaatgtgacaggtagagggttaattcgtaaaagatctctaacatattgggtttttaaaaatatcccaatagaaaaagaagcaaagcaccttcataggtaacttattgataaaggtaatgtatatatatgtttaaaagttaactccactagcaattagataataaaatgtaaacagtgagatatgtaaaatctatcaacttggaaaaggttaggccaaaacaaaaaacctaattcttgaagtttatgagatgtgtacccccatgcagtgctagtatacaataacttccgaatgttcatccatttaaacaccacataatattatagcaagtagtgattccagtttaagaaatttagcagaaacattaccaaagatcctgtaccaaaatatttgttacacatatgtcgaaaagtcagtaataactaataaattatagtagatccatatggcacaatattataccatcgttaaaaatttcatttatatgcaggctgggtgcgctggctcatgcctgtaatccaagcactatgggaggcagaggcaggcagattgcttgaggccaggagtttgagaccagcctggccaacatggggaaacttcgtctctactaaaaatacaaaaattagctgggcatggtggcctgtaatcccagctactcaagaggctgaggcaggagaattgcttgaacccaggaggtggaggttgcagtgagcaccgaggtggcaccaatgcactctagcctggacaacagagtgagactgtctaaaaaacaattattttttacatacatattaaaacgtcagaaaaatgtcaacaatgaagtaggttaaaatcatgttataaagtgtttctctttttcaagagaaacatgtaagaacaaagaaaaaagtagaaaggaataaactgcagttttggcaaaggttatttctggaaaataagattatagatggtttttattttgtacagtgggcagatattcttatgattagaaaaaataaatgaaaggtttaaaaatgggttacacttgatataaactagactgcagcttcatagatataatttaaacaaaacgtttatttagtcaagcaattcattagctggttactggtagactgcattaaaaacaccaaatagtttgaatatatttacagttggcccttgaacaattaaggggcaagtgatcctgtaccactccccatctgcatagttgaaaattcacatgtaacttaacttcccaaaacttaactactagtagactattgttgactggaagccttaccaataaacacttgattaacaaatattttgtttatgtattatgtattgtattcttaaagtaaactagagaaaatattaatattaagaaaaccataaggaagagaaaagacatttacagtattatactatatgtattgataccatagcttgacatcatctatttacaagatgaatcatctgtctaaaactgtaggtacatatcaaggaatttaaccttttcttgtaacatcatggcttttctctgcttcttgggagcacgtccagcatcactagtgacccttcatgttagtcccatggtactattccaggtttatggtatgcatcacacacaaagaaaaatgagaaccatgagagatcactttttactgtgaaacaatttactggagtgaccatcagctcagagatgattagtgtcctgaggagttttaaacagatactcccaacacttgagctcaccccaatagcaatacaaggtggctacaaatttcttatagtacagtatgtactatagttaattttatgcatttatgatttcatacaccatctttatatttctttatattcctctcaactgcaagtggcaccatgtccagactgtgtttgtgtgcctacgtttcgataaattttaggcttgtttgtgtttatggtactaaatgatagaacagactagtatctacatatattaatgacatacatttattctttttttagatatttctagctagttttttttcaaattgtcacaaatgtccaaaaaatttttctaatatacttattgaaaaaaatccacagaagtggacccacacatttcaaacctgtgctctccaaggatcaactgtaattccttttctccataacatttcagtagtatcagaactacattaatgctccgtacctcctgtgtacggattatatcaggaggctgagctgtggatgaaagagattttaaaaagaaacagtagtgtgatttgaaactaaataaaagagaaacatctcgtctagagagcatgtcagtcctagtccaaacctttccagcatgtacaggctgaacactccaaaatgaaggtctactgcttattgctgaattgttggtagtctcaatgaccccaggattgcagagatgcttcactttcaaaaaaaaaatccattaaaattagttcaaagaggacactaacatggtgttagagggtcatttttcaatgttgtgggtggaggagcgagacacttagagtaactcccattatggttaatgagagttgagcatctagactcatctaaaccccctgagggtttaatttaaaaccactatggcaaagcaactctaagccatgaatgaacagcagcatttttcacacacctacctcttcccaagtaccaaaaacagtagaaataataaaggtgagtttgtttggttgggtttgatttttactaccatgcctcatagaagagaaaaaaaaaggaaaaaggctcatatcaaatgcctataaattttttggtttattttaaatccagggtgttattttaatgccatttttaaatgactaatttaaacttgagtctgggtttttccagttgctatgtgatgttcacatagaaatgcagtatttttttaaattccatttaagcttcagttttacaaatttagggctaccattatataatgtccattccaagacccatgctcttgatcaaccttaaggcatcaggataatggacaataaaaaaaaaataagtattattattattttttgaggcggaggcttgctctgtctcccaggctggagtgcaatggcatgatctcggctcactgcaagctccgcctcccagattcacgccattctcctgcctcaacctcccgagtagctgggactacaggcgcccgccaccacacccagctaattttttgtatttttagtagagacggggtttcaccgtgttagccaggatggtctcgatctgctgacttcgtgatccgcccacctcggcctcccaaagtgctgggattacaggcatgagccactgtgcccggccaaaagttataattattataccatgcttccaatatgccaaatttattcattcttctgacttccatatcaccttgttttaattctctcacaagagcccaggaggcaggcaaatacctgttttcatagcagaaaatacctttatcttcacatgagcaaatcaaacaaaaaagaataaatgacctaagtttccccatatgggactaaaatacatttctccaattccctgtccaaagctcatttgcagttttgacaagtacaaatgttttgtacccaaagacagtaaatgaggcagtagagccattggcaggcagagctctttcttctcccatgtacattcaacaataccagaaacaggactgagagagccttgtaaccatcatttccatggtttgagttttgtggtagggtcagggaaggcctctgtgtgtaagtgatgacaagggaacaggaattgaaaggaggaaaaccagggaccctgtgtaggtcagagggtggcaggtgaaggtcagaggaatgtcagattttactttaagtgaaagaaacagcaacagcaaccagaagttttttttttttttttttctgacacagagtcttgctctgttgcctaggctggttgtgcagtggcacgatctgagctcactgcaacttctgcccccctgagttcaagcaattatcgtgtctcagcctcctgagaagctgggattaaaagtgcccaccagcacacctggctaagttttgcatttttagtagatacagggtttcaccatgttggccaggctggtttcgaactcctgacctcaagtgatcacctgcctcagcctcccaaagtgttgggattacaggcatgagtcactatgcccagccagaaacaaccataatttcttaatgcaaaggaacaacctgttcttgtttctgtatttttaaaaatctatgtcagctacatagtggtagactggaggatggatagtggtagactggagttgcgggagtgataaacaaggaaacctgagagctcactgcacccagttcagacaagatttggcaggagtagtagagatgttgagtaccagactcagaacatatttttgagaaacagcctccatgtgcattggaaggatgttttgagaatgctgtcaattacatattctggcatcatctccttgaggaagaattcacagaaaatcgcctgatctctggtgttgtgcacatttctgcatttttctgaacaatcagcctatttttacctcaagaattgatgctctttccttatttaggttggtgatagaaagttcagggccaactttgtgacccatctgtttttgttggttttcaggctgctaaagacacacccaagactgggtaatttataaagaaaaagaggtttaatagactcatagttccacgtggctggggaggcctcacaatcatggcagaagtcaaaaggcacatcttacacggcagcaggcaaaaggaaaaatgagagccaagtgaaaggggaaactccttataaaaacagcaaatctcgtgagacttattcattaccacaagaacagtatgggggaaaccatccctgtgattcaattatctcccacgggctccctcccataacacgtgggaattatgggagctataattcaatatgagatttgggtgggcacacagccaaaccatatcactatctctagcaagtatataaatattttatatctatttgatgcactaatctcacttttggtccatcttactttccttttactacttcttgaattttgtagtttgcttttttttaaagcacttaaatcttactctactttttcatagtcaccttaaatcatgttttaaaaattctaggaaataaatgaataaacaaactaaaattgtctaatggaaatttccttgattattatagaaataataaatcagaagaaggtttcatcaaagggatcatcagaaagaaatagagatctacaaaagggcatgttatgtaaggcaacctgtatgcatgggaagccaagatgataaagccataaaaacttgactaaactgaagaaattgcttacagagctgctccagacttcctgaggaaggcaagacagtggcatatacaatcttgggaaatcaaatctcatgagccgacgagttatcaaacccttctgttagatttctctcagctgaggaaataactgatttcatcagcctggctggaatccacatggaaatctatgaaacctgtgctgggcatgggaggggttgagtatttttcatgctcaaaccacctgttacttctctctctttcaaagcaggccactttggaatgatgaatattagttatgtctccaagcatgtgttcatgtgtgttaggtacatagaaatcctggttgacactatgttaaccattgcagtatactgcctggtgtgagaacttaccacattattctacttgttaaatgaggaccgttgtcctcttttatctttagagctaaaaagccaacatggtcaaccagggtcactcatctagcaaatattcatttaacaaatatttactgaacacctcctatgagcctggccctgcccaggcagaggagatgcattcatgaataaacctgagaatcatccctgccctcagagagctcacattctagtcagcctgagacacacacacacacacacacacacacacacacacacacacacacacacacaaataaattatataataatttagtgtataaacactacaaaggaacgtcatgtggtaggggtgcaattttaagataatgggaaagactattctgtgacatttgagcacaatctaaatagaggtctgaaggagttgagtgaacatagcatatgtacatctggggaattggcattccacgaagaataaacagctgctggttcaagggctatgaggcagcagtgtgcttagaatgttaaacaaacaacaaggaatctagtgtggttggatctgagcgaatgtggggagctttgaaagttgtatgtagctgctgtaacaaattaccataaattggtggctgaaaacaatagccattgatgctgtcatggttttggaggccagcgtggcatccaggtgtcagcagggccacgctccctctttgctgctccagcttctgatggctgtcagcattccttgacttgtgaccacatcactccagtctgccttcacgatcatgttgtgtcctccttttctccatgtaatctccctgtctcactcttataaggacactgccattggatgtaggatttgcctggctgatccaggataatctccccacctcaaggtgagatacttaactcacacatccacaaagacccctttcctaataaggtaccattcacaggtttcaaggattgagatatggacatctcttttgagggatccccattcaactcactacaggaaaaatggtaatagatgaaatcagaggggcaatggttgatggcagggggtggatggaggagtacaagtaggaaccttgtcaatcactgtgataactttggctttagttagaagaaggtaggaagccactgtggggataatgagagaagtgacatagattcaacaagtcttaacaggatcactccggctgctgccatgcaaaaaagttccaatagcatttaatccttacattgatactttgttggcttaagagcatgccaaatttagattagaaatgaaaatgagaagaacctgatatacagatcttcagaaaatatttaataattaaaagaatattcctctacctaaccatcctgttttgaaccaaaattaaatttatcccataaatatttatcaaccatctaatatacacaagattctgactctaagaattgaagggatcacaccctacctaatgtggtattgactgacaaccccttttttttaagatttatgtcatctctttgtgtaaacaataattgaagaatctcaacttagtgggagaaagacgtgctaccattatattctttgccattacttttccagccaccctatgttgaatccctttctggctctttaataatatcttgggcagaacgtataactatgtagtcactttccataattgtaaatctctccattttaaaattctagtcttggttcttttaaaattttatatcctatcaagcacagacttgagatgcaacttttattacttagagctctctacaagtgttcccccatagtgaggctaagctatgctagcgttaaaggcagagtggtcttaggtatcaggttgcctgtcaacaggtgacaggtggccaggtgtggtggcacatgcctgtaattccagcactttgggaggctgaggtagattgcttgagctcaggagtttgagatcagcctgagcaacatggtgaaaccttgtctctacaaaaaatgcaaaaattagctgggcgtggtggcccacacctgtagtcccagctgttcaggaggctgaggtgagaagatcacttgagtcctggagctcaaggctgcagtgagtcaaggttgtaccactgcactatagcttggatgacagagtgagaccctgtctcaaaaacaaaaacacaaaatgaaacacacaacacatacacacacacacacacacacacacacaaacaggtgacaggtaagtgtccctggtctagctccagttccatctgctgggagcctctgcaaatacggtagtctgcactggtgaattaacagacatgttttttccaggaaggtagtaaagtctcgcccccgtttgtttctgaggatccatttacaaaaggacagccatgtctcccttttaggtctgccggtgttccatgacccaatcccctctctggagaggccagcacctcagttggcccagcatctacctgagcaacctagtggtgcctgcctcctactcggacattcatggtcatttacaggaaccgggggacctgctgaggttggtgcttctgggcttcttcaaagggctaccgaaaaggtgaaatagtgtagaaaagttgttctcatcttttttcccaggaacactactcctcttcagtgacttcttgctctgctactacaggcctctccaacaagcctcccctgccccaccctacattcaagaatgcaaagatgagaagcaagcactcttgtgtgctcatgtacaattccaaactccacagagcacatgggaagctctccaaaagcaattgtacctccctgcactcccagatcatgacagtacctgtgtcagcctgcaggtcctacagcttcgtagcatcaagccaaagaacaagatgccagtgtcattttgtggaaagcatcccccaagagatgtgacttttgaggcagtgggagtaattattccagaagagggaagaagaaagcatccctacactcctcatttcaactgtcgatctttgtcctcacgtatcctctccctttgcggtttgggggcgtggaggtatgtttcagtgaggtaggaatggttctgctgctgcctctcagtaatgtggatgtggggagcatctgtccccacatgtcagcattcctgcttaggccttagctgtttattccgcggaaatatgaaaagtttcactcaacatctgctgcactcctgaacttcaattacattactgcagatatgactccctgagagatggcttctagagtcatttggtccctaaacagaatagaaaatactaactggtattctaggcctctgcatgtgaaacactctagattttcatgtaattcctgttgatttatttttatcttgacacatcttatttaacaactattaaagcaatcatctttggtgaatggaagggtatcatggctaacttttaaagtattagcacgtaaatctcttgaactgaaaattaatcttaaagataaaaagaagttcttgataacttcaggcatttcaaaacctatcagaaaggagaaaaattggagagccagatgaatttagctcctcctggacccattttatctcagagcaaattatgcggctaaccaagctaaactgcctggccccatatagatggcagtggagagtaaggcttaaaccttctagactttcagaagtcactaaggttggtcttattcttaaatgataatgaagcttacaataaaataataaagccactaacagcaaaatgcccataaaaatataaatggcagagtaaagatttaggaaaatacaacactagaaagtggggctaatgggaaaggtttaaactctagggagaagaacttctcaggacacccaccccaccgtacatagaagtttgcagcacatgtgaaatgtaactggagaaggtgaaatgaacaatggaatgagaatcaaaagtcctgggtaaagcccagactcccatgaactagagccaccattggtctgtgcctcagcttttccattcaaaccactcataggccaatgaggatagaacaatttttgtttcagaaaggttcttgctctgcagcccaggctagagtgcagaggtgcaatcacagcttactataaccttgaactcctgggctaaagcaatcctcctacctcagcctccctagtagttaggactacagatgcatgccatcacacctagccaataaacttttcttgtagaaaagggtctagctatgctgcctaggctggtctgaaactcctggtctcaagtgatccccctgcttcagcctcccaaaactctgggattacaggtgtgcaccactgtgcctgtgtgaaacaaaatattgactccaataatgcattgttagtcataaaatataattttaattatttaaaattatcttaatgtaagatattagttatatgtatataaatatactctccactgccacagttaccccaaacacatatacaaaaggaaaagaaaggaaggaaggaaaaaaggaaggaaggaaggaaggaaattgcctcagtatcccccatgctacaagtaagctttcccttaaaccactattaggaggctaagttcagtgtgaggaagatgaccatttgatacgaagaaagagttctgttggtcttaattaatcagctaacctacaactatgcttgacttaattggtcttgaagaacaaagaacatgcttggtcttaggaatataaaggagcttcttccatctgtttttctccctctaaaatctccctctaaaatctactgagaccatgtgcattggcatgtctattcctgttattacaatattgaaatacacaagtattacttattacccttgcgtgctgctcaccacctcttttcttcctcccctgggactctccagacctccccacaatgcacaaattaataggctgatgtctggcacagtagagagctttcaggaaccacctttgacattggtcagtaccacctgtcatactaattgttacacataaacataactccactgcctaagacatatccacccatatcctgacccccaaatgcaggcagatacaagctaaaccaaggctcctgaaatatatttaaagcctgtagtagaaatctcacaaagatagtttagattgcaaactacttcagatatctggtattgtagaggtttttaaggataagtccaatgtaggatttgtgcccagaagctatttgcaaatttatggttattttttcagttaattagtttgagaaaggaaatggcagctaagtaaataaattagatcattaatttgcaataaatataaattaattatgctaattctaagagttgaacacatatacgtattttgtatatataataaaaataaggaacatacataagactattaggagaggaaagctaccttgactgttgtaaaaaaatccacgtatatgtactcagtagattttaacagttttgatatgtgcatgaaatataaaagaataagtaactacctactgatgttcaaacaaacctattttcattccaaatggaaattagaatatattctgcattatttgagttaattacatgacacttcttataaataatgatgtattattattccattcattacttctaattatattccttagcaagtgcgatgcctgcaacaccatgaccagtcttttcctgttccttaaaatctgatgacttgcatggaaagcaggtcaaaaatatgcccagaatataacgaacagagttcagtgattgttaaccatgacagtttaaaactacttgaaaaagttactgtggaaataaatagaaatggtgaacagctttccaaattacaggatacccatgatagcaacataagaaatatttgaagtgttgtctagatacatataattatcattctaccattcactagaattggagaaagaacacccctaatatccctctcccccagcatacatacacattaacagaattacattctgtgtagatccgcagatcgtaaagatacacatttctggttgcaaaagtgactctacagcctttatgcaattctgagaaatgtacctgctaaaagtcctaatcaaaatgacagttgaatttttctcctgtaatgcataatcaggtcaggccagcccaccccatcccatgcacagcacggtctggggctagaaggtaaaacatagtatggaagacaggtcaagatcaaggaaagacagttaaaactatcattaagcaacagggacctagtaacccacaaggctactttgtacatacatatcctcaccagagagcaggcagcaaggagccagaagagtcaaggaagagaaggcagatagcaggaagtagtctagatgaggtctagagaccaacatgtacatgcctcaggaacagtgtttcgtgggtatgtcaccttcattttgaaggggccagggcaaagtgcacaaagtccacacatttttcttcatccaatttcaaaccttccttgcacacatacaaagtacctacttaattccttcagcatcagcttccaacaatccattgttctgtctatgataaaaaataaagatgtcagtctcggctccagaaacaaaaaataaacttgggagaggaagagactagcaaggagggcttccccttcccctctagtgcccatcacagttactgccttctgaccccacgtgcagcctgagtcctcaaccttggcagctcactaccaactgatcagctggtatgtgagataaaatgaatttgttttctgcattgtaattctttagatggcaagtcaagatggatgatggtcacagcaagtttgtcttacaatgggagttggcaggattctctgtggtggattttagacactgaaaaaagatgttggtcaactttgaatgatgacagcatccaataacttcctttgttcccattgtccagtgctatcagaagctgcttgtagctggtggccatgtactctaataacccaagggtaggtgcacattcatatggaaacctttcccacagaagtaggaaaaagaaaggtccaacttaacagtcactgctaaatgcatgtctttgaacacaataatctgccaaatgaagtcaagaaagaaatgtgaccacaagaaaaccaacttgccccactacaatggacagcaatattgtctttgaacatttctcctccaaaagctcttaagctggctaatatacaacaagcatgcacagagcaaagacaagacatgtgcttagggaaattttaagagcaaaaacctatctttagctataaagatattaaaatagtgcttgtgctcattttacttgtacaggaaggtttgaaaagaactcttttttttttttttttttttttgagacggagtctcgctctgtcgcccaggctggagtgcagtggtgcgatctaggctcactgcaagctccgcctcccgggttcacgccattctcctgcctcagcctcccgagtagctgggactacaggcgcccgctaccacgcccggctaattttttgtatttttagtagagacggggtttcaccgtgttagccaggatggtctcgatctcctgacctcgtgatccgcccgcctcggcctcccaaagtgctgggattacaggcgtgagccaccgcgcccggccgaaaagaaactctttagagaaatgaaagatcactaataactgcagtttcctgaacaattaaaggaattcacaagattacaacctactgaggaaatgacaaatatttctgatttttatggaaggactaaaagggcgcttttatgtatagcatctattctgtaagaatcactgttaagtaatgaagctatttttattatttttccacttatttcaggaacactcaacatggtaacggtctgaaaacgggggaaacttaacattgctctttggaaagttaatattccgtattaaaagatatttgtcagagttttcttttttaccttttgaatttggatcttggagcactgtttgcatggtagccaactttttatttctaatgtgtcagcagaaatgttcttaaagttacctagtctaattctctcacaaatatactttgtaaggctgtccctacatgcatcatcctaatgttgtatggccctggtaacattctgcgtgagatggtcttgattggaaaaatctgctctttttaataactgattcaataaactgttgacgtatgatttgtagaatacagtatgatcagtgagcaaggtttctgtcattacacaccctattcaattcatccacaaatgttgctgtgtctccctcatgttgcagctccttatgccattcagaatagcaatgcagagatcaatacactctctgctgaagacgacagaacaaatgaataattttatttacaatgaaagccccagtcttcaaatggataccactaatgtttaaattcattttcatgctcaactcaagaagagagatagacacagcacaaagcaaagggagtgggggtaaggagaagtattagccataatggttcaaatttatttaagccatgaacaatagctgggctgcactgagacacaggaataaaatgtttgctgcagaattctgaatgtgtactcttcaaaatgattctgtcaccaagaaactctgaaaagcattttccagtaacaagaaattaatggattaaagacattctgacatattcttctaagcgttgcaccacagaagccaaagcctgttcaataggctttaaacagtgttggcaaggaacagaagcgtttgcttcaggtgggaacaaggagggactgaagtggctgttttgagaatgaagcaaacgatcctgcttcaaaagcgtatctttggcctctgatttgacagttctttttctttctctgaaagctatgaaaaagtcagtgagcaaagtcataagaaataagtgttggtgaggggcagcaaaatgttataagagagacaagttcaaagatgacatttacaagcctctcatgaatggcacactccccaaagggcacctgaatgccatttttaagaagaagtcatcaaacatacaaaataaaatgttccattttacataaagatgccaatatactgcccttaaaacacagattggtccattcacaaattaacatgtaaagaaatggcaaagaaccttctcccatctgccatcaattcattcactgcttttagatttaactccctacactcacacgcttgtaaacagaattgtaatggacaaaggatgaaggggaagctgggaaaacctagcttggacatgatactgaaacatctggaaaaaagtggtgacaagacttggccttggggatgggaaacgggaaaaggtgggatttcggcacatcctgtctctctattctgttaactggaacaatgcatatactcctgatgtttccagcttcactttagattcagtgaacacagtacatttggatgctaagaaaaaagagatgtgcaagagcaggtctcgtccataggaagcaaagactcagtgcagacagaaatagggatgcacgtactttggatatgaggcagactgggctgtgtgtttggtcttggtacctggaacagagtatgagctcagtaataaagtactgaatgaatcaacatgagaataaggaagtgagtgtcacaaacagaggacagagttttgttttgttttcttccctaggagcaggggacagttatcaaagcacttcagatgaaatgaaaagcatggggaggaatctccagttgaggtgaggggcaggagaaagtatagtaaagggatagtacaacacatattcagggaacagccggaaagaagggagactgagccagtacaatgaaggtccttaaaaactattctaaggaatttggactttatcctcaaaaaacagacattccttattggtttattaacaagggaagagaagaatgatatggtcagggctgtggttcagataaagttataggctacattggaaaagcccagaggcagggagacagcataaatctagatgaaccacacctaagggctagactagggcaggcaggagagaacactggaggaagataaaagcccactccagacatctcaccatttatttatgaaatgttagtggacagagctatccacatcttccattctcaagtctcaggacaaaagactagagctttctgcaagcaaaggagtaccttattaagatgcgtctcccaggccgggcgcggtggctcacgcctgtaatcccagcactttgggaggccgaggcgggtggatcatgaggtcaggagatcgagaccatcctggctaacaaggtgaaaccccgtctctactaaaaatacaaaaaaaaaaaattagccgggcgcggtggcgggcgcctgtagtcccagctactcgggaggctgaggcaggagaatggcgtgaacccgggaagcggagcttgcagtgagccgagattgcgccactgcagtccgcagtccggcctgggcgacagagcgagactccgtctcaaaaaaaaaaaaaaaaaaaaaaaagatgcgtctcccagttgtaacatggcagagtttataaaggtaaagtaaaataaaaagttacaaaatcatcacataaaaagcattgtctgaatacactgtctactggccctgagactgttttaaatactgcagctgttaattagacttatagagtataatgattttaaaaaagctctggttctcattgttcttataatcagagagggttggatccttcttgctaccttccaaacaaactgaagtgtgttaattttaataaaatattctccgagcccttggtatttactcaaatataaagtaactgagcagggttcatttcccaaatggtgacaccagtgccatctacaaagaaacgagttgtcattcactacttgctcactattcactacagatattttcctagacatagacatttctacttttcttgagttcaaactcaggtatgccctggttttagacatcactttttctgagtttgttaaaaagtctgaaatatcaaattactctcaagatatgagtaaaaaaactacaaagcagagttcattccattattaaccattttaaaaagtggccaacatggcaaaaccccgtctctactaaaaatacaaaaattagctcagtgtggtagtgcctgcctgtggtcccagctacttgggaggctgtggcacaagaatcggttgaacccgggaggcagagattgtactgagccaagattgtgccactgcaacttagcctgggctacagagtgagactctgcctcaaaaggaacaacaacaaaaaaaagtggtacatctctgtgacctctaattttcataggaatgagagtgaatttagacaaatggatcttgtctaaattcatattttcatcccaggtccctttatttcttttctaaaagtcagttaaagctggcacctagagagagatggcatttaaaccatattcttttaacacctgaatttacagacattttgctttaaaaaaccccaaaggaaaaagcccactacaaacttatagcaaaataaaatgttacttcaagaaattcaggtcttttaaaagatttcaatacacaattggtattaaaattaaaagtgctgttttctagggcttttctaaatcattctagtgtttttttttaataaacagaagaaaatagttttctaatattatttagactcatttaaaagaagagttttaaatattaagaaaagcttacatatttactagagtattgcttattagttttctaaattaatacaatttatttgactagaatttggattccagaaatttgggagtctataatacaatcacaattatcttttggtacatgtttttcttatttgtattttttttttttttagcatacaatagttacgtggctagaaaagaagcttgttcataaagttctcaggcactttccacattttcactggaaaaaaaatgtagcttactctgaaaaacctcttggcatatttgtacattcagaattactaagaaattcatttcaaagcaaaatcatgtctcagcgtggaaaatacttattatctgaaaatatcaaattttattctgttgccttctgcatggcaaactaagtgaaggaggaaagagaaaaacatcctgaagagtccgtacaaaattcatatgcacacaatcaggagtgaaacttttaacaacataaagataacttcccaagcatttcaccaatacttgttattcccactgcaaaagaataaagctcctattgaagtctataggaggaaagactacaactcagtggtcagagggaaataaaacaactccaccaatgacactggtcaatgatctgcaagctggtatttttcccaagagaaaatgctatttcaggtcctaatattttttaaaaaaaatttgtaagtatatctataatataaatttaattaaaacgcacaacttgaatgatctccaagaggtaaagcaacaaagtcagtctcaaatcctcacatatcttacttccacatcacaaaggcaccactcaatctactattaaaattcacaacagataagctgaaaaccaagtgcccgtgatattcactgggctcattttagaagcacctatttatttactcagctatggtagtgaaaaggtcaagcaaaaattcacctccaaagccacggttgctaagcaactctcctcagaagttctgcaacattgatcaagcatattactggtgccaccaactggattcagaataaatatgagtaacatcttacctggtgtctccgaagtgggagggagatggattctttatttacctttttggacagactggaggccaatcttgtatttatattcatttggctggttaggctcagaagacttttattttccctctccaaaaaaaaaaagaaaggatacgtcctggtaccacaggtttcctattcacaagagcgaaggacagttctgttttgagaaacactacagagggcttgatgagatgttggccaaatctgaacgacatgtcctcacagttgaagtctaaaagaaaagacaatggatagttataaaattcaattaagaaactcagttcatataccaccttaaagaaagcaaattccattactacagattcttagttgcagagaggatgccattgaaattgttcctcattgaatgttcaccaagatgcattctgggaaagtctttctaaaatactccactctccctaccagtgtttccttgattagagttagcaattttcaagcagaagcttccacgtggacaataaaacagcttttccccttcactccctctgcacttcacggtgccaccttaactcaaatccacaaggccctatttgtcagctacttatttttacccatctattttgtcatgtctgctaagctgaaaattttcattaagtattaactataaaccttctaattcttaaatgcttctctcaaatggttttgtgttcatataatagcaatttagaacaagtacgaacactgtctgaccttgcctacaattacaaaaacatgagcacttccagagaactattctagtaaaatctccaaaataaaggagaaaaaaaacatttaaaaagaaggaaggagcaaaacggagttcaaaactagaacaattcctggttgtaacagggccacaaagcagcaaggtacctgaaatgttctgcgtcttccttttgagggaaagccatggggggccgggggcaggaaagggaggctgaagggaatttggcaaatggcacagctgagacaagccaaatccatctagcaccaaggaatgacttttcaatcaggtggatgccaatacatgacaaagttactttgtgaatgactaagacacactttgtgaatgactaagaaacaccatccctagaaaactacttcatttttctaattcgggaacagcctagtatgaaactgaggaacatggatcaatctacagaaaaacagagaaaggattacaaaaaggatgaaattagaaaatagttggctatttgtgatatgcatttggttttcaaccccatttcctggcacgcaactcctaaaatccttagaaactccaaagtgatgtctttttgtatgctaatgattgactggtgtctagcagcctctaagagtctaggtagcttcaggatggggttgatcacaagaaggaccaagcacacttatacaccaataacagacaacagagagcaaactcatgagtgaactcccattcacaattgcttcaaagagaataaaatacctaggaatctaacttataagggatgtgaaggacctcttcaaggagaactacaaaccactgctcaacgaaataaaagaggacacaaacaaatggaagaacattctatgctcatggataggaagaaccagtattgagaaaatggccatactgtccaaggtaatttatagattcaatgccatccccatcaagataccaattactttcttcacagaattggaaaaaaactactctaaagttcatatggaaccaaaaaagaacctgcattgccaagtcaatcctaagccaaaagaacaaagctggaggcatcatgctacctgacttcaaactatactacaaggctacagtaaccaaaacagcatggtactggtaccaaaacagagatatagaccaatggaacagaacagagccctcagaaataatgccacacatctacaactatctgatctttgacaaacctgacaaaaacaagaaatggggaaaggattccttatttaacaaatggtactgggaaaactggctagccctatgtagaaagcagaaattggatcccttccttacaccttatacaaaaagtaattcaagatggattaaagacttaaatgttagaccaaaaaccataaaaaccctagaagaaaacctaggcaataccattcaggacataggcatgggcaaggacttcatgtctaaaacaccaaaagcaatggcaacaaaagccaaaattgacaaatgggttctaattaaactaaagagcttctgcacagcaaaagaatctaccatcagagtgaacaggcaacctacagaatgggagaaaatttttgcaatctactcatctgacaaagggctaatatccagaatctacaaagaactcaaacaaatttacaagaaaaaaacaaacaaccccatcaacaagtgggcgaaagatatgaacagacagttctcaaaagaagacatttatgcagccaacagacacatgaaaaaatgctcatcatcaatggccatcagagaaaatgcaaatcaaaaccacaatgagatacaatctcacaccagctagaatggcgatcagtaaaaagtcaggaaacaacaggtgctggagaggatgtggagaaacaggaacacttttacactgttgctgggactgtaaactagttcaaccattgtggaagacagtgtggtgattcctcagggatctagaactagaaataccatttgacccagccatcccattactgggtatatacccaaaggattataaatcatgctgctataaagacacatgcacacatatgtttattgcggcactattcacaatagcaaagacttggaaccaacccaaatgtccaacagtgatagactagattaaggaaaatgtagcacatatacgtggaatactatgcagccataaaaaaggatgagttcatgtcctttgtagggacatggatgaagctggaaaccatcattctcagcaaactatcacaaggacaaaaaaccaaacactgcatgttctcacttataggtgggaattgaacaatgagaacacttggacacaggaaggggaacatcacacactggggcctgttgtggggtggggcgagggtggagggatagcattaggagatatacctaacgtgaatgacaagttaatgggtgcagcacaccaacatggtacatgtatacatatgtaacaaacctgcatgttgtgcacatgtaccctagaacttaaagtataataaaaatatatatatataaataaaataaaataaattaaattaaaataaaaaagaagaaccaaagcaggattatagggccagaacattcagccccactcctcaatctcccaggaagagagaggggctgaaggtgaagttgatcaccaatggtcaacagtttaatcggtcatgtttacataatgaagcctctgtaaaaacccagaagaacaggtttagggagcttctggatagctgaacacgcagaagttcctgaaggatggctcgccctgggagagcatggaagttccatgctctttcccccatacctcaccttatgcatcttttcatcagtatcctttgtaatatttgctgtgataaactggtaaacttaagtatttccctgaattctttgagttgttcaagcaaattgattgaactcaaagaagggaccatggggtccctgatttatagtcagttggaagttccagaggcccagacttgcaactggtgtctgaaagtcaggtgacagtctcatggcattgagccctcaacctgtggaatctgaggctatctccaggtacgtaacatccaaattcttctgaaatgaatcaaaggacatccagctggtgtccgctgctttgtgtgttggggggaaagaaaccccacacatttggtcacagtagtagtctttgctgattgttgttgctggtgtgaaagcagaagaaaaacatgttgagtgtatttttttccttattttatatagcacatgaataatgcatgattgtttaatgattctaatattctcaatgacacagaagacagagagctgtgcaaatgtcacttactatggacacacccacatagccagaactgtacacatttcaggtactaaagaaataagataggaaggtttgccccagtggtacaagataatggtttttagaacatttacaaccagctcattaaaaacccaacagttctcaaggtgacgtccctccacaatagcatcagcatcacttgggaacttattagaaatgcaaattttgaggccccaccccagacctactgaaccagaaactctgggacaagggcccagcaatcaaggcttccatagctgtccaggtgtttcagaaccactgaccaaacccaactatcctcccaatccctgggccttttcctacagaattcctgccaaatggctgcctagcatatgcttgaatatgtccagtgatgggaagttcatcacacattcctcctaagacagtcaactctacaaataacatagttgctctttataccaagtccatctgtttttcatgactttattccttgggatcatataaaacaagtatcatgcaagtggcagtgcttcagatatttggagttagctatttttcattttttcttgtttttcaagaataaagatggcaaatcacatccaccattctacaaacagcattgattcaagtgacctgtgattatttccctccccagaatctacttccttagagtcttagctgtaccactttgattttttgcttttagtaacaccccaccatattctacatgtggggctattcgtactacctggttctagggatgggcaagtgacccaggcacccatagtcctttgacatatgattggttcgggagtggacacaggacacaaaatgagccaatcaaaggcaaggacatccttcagagtaatactgctattagtaacaatgccactttctttcaactgagttgccaaactggtagactatgaacctgaaacagctacgagttttcctaaaaaagagctggcttgatgtgagagccaatactgaggcaaagacagtgaagacacagagacccatacctgatgacactgtctgagcacatggatctaacattgccagaagaagtcatgtaccagaagtttctttcaggataatggaatagaattgacttagcacaggctctacttgatgagctactattatcatgagcccatgaaaggctcttctttttcttttcacttttccaatcattttcctttttgtcctctgtgttcagtcccattccctcccttcccaccacagaaattcactttttcataattaatgtattattcagaatcctctttacatgtttgtgtacatacattttttgtcaaaaatacacagggcccttatacataatttttaaatttgtatataaattgtaggttttaaatcccattcttctgtattctctcaacattgttttagaaatttatccatgttgccataaacaattccttcactgcattccactgtagtattccttgcccattcctctagtgctgtagagctagcttgattacaaccttttaccacaagttacactgtgactaccattcttacacgtttccctggattcctatcttagcatcccattgttgggattcaggtcagatacttacttagattttctaaaatatatgcaccagcttgcacgcccagcagcaatacattaggatttctattttcctacatccttaccagcacttgatagtacttcctgctttccaagtttttaattattgaatggtaaaatggcgtctcttccttttacttcatttgtctctaatagtgtgatgtgtgtgtatatgcatgtttctcttcttatgaattgccaattcatatactttgtcctctttcatattgctttcctcccttcaattttctaattttgtagagtcccttgtatattctaaatattgatcatggtctattaaacacaataattatattttcaccatctattaatttctctatcgttccctccattgaacagaaatcattcattttgatgtattccaagtccatcaattttctttttatagtttgtgctctgcaaatctctccgaacaaatccctctctaccataagtttgcaaatatatatattcctatattttcttctatcgactttatattttcatccttaacatttaggtatttattccacttggaactttgtttatagtatgaaatacagaaacggcttcatttttctttttgtgagccaattttcctagtaccaattcctgggaatgattacagtaagttcccatatatacacaggaataagtctagactcctttctattctgcttcagagccagacgctgtagaacaaaggtcgcacatttttgcacattttttttttctgtaaaggaccagacacagcaggccacacaatgtctgttgcaattactcaactttgtcatggcagcatgaaagcagtatgagtaggcgtggctgtgccccagtaaaactttatttgaataaacaggcagcagcccagatttggtttatagggggagtttgccagctcctgctgtatcttgttaatgtctaaagaaaaacagagatcctctttctgtatttattatcccatataaattttagcctccactctgcccctttcaaaaaaaaattcttagatgttgattagactgaatttaaattgtaagatgggtgaggggaatgtgacatcttcaaaatattcaacgaagccatttatgaatgctgcatttatgctctttaataccataataaaactcttgtaatagagttttaaatttcccttatatgttttatgcattctatcttagatttattcctagatagcttttagtttatgtcactattataaatggtatcttattattgtcatagtttataattagttactcccaatacagcagaaagctattgatttttctacgttcttatagctggcaatctagctgaactcttgcattgcttctaatggtttctgctgattctcttttttgttgttgttttgttttgttttcagacagagtttcgctctgtcacccaggctggagtgcagcggcgcaatctcggctcactgtaagctccgcttcccaggttcaagggattctcctgcctcagcctccagagtagctgggactacaagcgcccgcaccacgcccggcttttttttttttttttttttttttgtatttttagtagagacagggtttcactgtgttagccaggatagtcttgatctcctgacctcatgatccacccatcttggcttctcaaagtgctgggattacaggcatgagccaccgcgcccggacttctctttgtttttatatatatgatttcacttagaaataatgataatcatatctttcatggcaattttcctactttcatgtttctttgtcatactgcattggtcagctatgtggtaatgtattgagaagcagaagtaacacagggatccttttcttgttcctgaccttaagagggctgagtttaaacttctttttttttgtattatgaatgatgtctactctaggtttttaatatgaagcctttaatcaagctaaaaatatcccttctatttcaagttttctaagggttgatacctttttttaaaaaaaattggttttatgaaatgcttttcctatatcactgatgacacaattgcttgttccgtgccattaatgtggcaaactacattagcaaatttaaaaataataattcactattctttccctattatgattaattcaactccgtcacaaggtattattttttaatatactgctagatttgaattcttagccttttgaatgtcataagtgaagttggccaataatttctcaacctatttttttttttttttttttgagacagagtctcactctgttttccaggctggacacagtggcacgatctgggctcactgcaaactccgcctccccggttcaagcgattctcctgcctcagcctcccaagtagctgggattgcaggcacccaccaccacactcagctaagttttgtatttttagtagagacagtgttttaccacattggccaggctggtctcgaactcctaacctcaagtaatccacctgcctcagcctcccaaagtgctgggattacaagcatgagccactgtgctcagccaacttatctagtttttgttatcaagattaaacataatagtttggtttttcttttttgttccaaagagagtttattaaacgagcattttctgtttcatgagcgttaaacaaaactcttttgtcaaactgtgtctttttctcctgtgccagaaaggactaagttttgacaatcattacaatttattgttttctgatttactaaagattttttttttcttgtatcaatttcttagccatatatccttttcacataatactggtaaaaacttatattctttttactggatttaaaaatataatctgtaattatctcttttacctatttcgtattgtgtttatcatggtacatggagatgttttttcttcatctgttattcaaaagtaagatctatcctatgaagttttttaaataatgaacttctggttctttggcttttatgaattatttttactttattaccacatttgtatttatttcctctgatttgttttcctttattgtttctttggatttactatgttgcagtttttctagttacttgagtcaaaccttgggcttataggattccagacttagtgtttttctcttgggtaacaaaagctatatattgccgtgaaagtattccattagctctatctctcacctactgtgcttttattatcactccgctctaaaactttgctattcttgttattatttcctatttaacctgagggttatttcatagtatgtcttttcatatccagatatataggatgtttttgctatctttttgttaacagtgtctgattttatagcactgttgttaagagaacctctaagctgttgattttttagaatttgaggcttcctgactcattgaaagttgaagcttgtgtctaatccacatgccctctgaaataaagtatgctctgcttttgttgaataagttctatatacatgagacatcaaattgttatccaaatctctctttgtctcattgcttcattggtttctgagaggactgttttaaatttctaactatatttgctaaatcaatgtctaacgccataaattattgttttctgtacctcaaagctacattactacatgtggatatgttcctattcatttcactcccttggtcttcttattcctttttcttctttgtatttgacaagtataaatttttccatcaccttacattagcgtgtgttctcttgaatttttttttaataaaatactatagcatcttgttttctatccattaaagaatctgctggataagtttaatcactacacatttacactaattattctttgagcttatttcagatattttatcttttcgtttgtttcacttcactttttctcctgtctaccttccacgggttaagtctggtttttctctccccatgagtatgaaaattacacattctatttttatttcagtagtggttattcgtgttcttatcctatccatactaatgcttagtgtttaaaagcagatcaggatctttatccttagtatattcctacctcctttcatctcttccagatatcatatcccatcttcgtcatgtcctaacttttatgctgaattgatattgttataatttcaaataatgctttatatgcttttttacccaccatccctctctccccacttactctactgattgtattttcatttgtcttgtttacaaagatgtaaggacattcccttctcacaggcagctgtgggctccagcaccacctgcttcttttgaatcttactttccctttctggcctttagtcctcccttttcctcaaaactaggctacacttttgagtggataaagagtctcagctctgccactctcttcctgatcttccagaattcactgaaccttctaatcctcagacatctcatttgaaaatagtagataatgaagtatacaaagcatgtctcgttgtctgccacatgatgtaggtacccttaaatactaatagttttctctctttccctacccaaatctaagtctacctcttttttaattgtggtaaaaatcctccccatatatgctgctagtacacctatttcttcaagttttaatttcaatgaagaagaaaaatattctaggaactctaaaagggacaaaagcattaaaaagattaagagtcaatagagtttgatgggaaaatttgtgcatctccaggatctgaaactgtctccaagactgagataaatattaaatactttcctttcacataaaaatggcagaaagcaattttattttcagataagtaaaattgctgaatctttctaccaaatataaagactagatgtaccaatattctgtggaattttccagggaaaatcatcttcagggaactgcttcttagcaaatatggagatggtggtttctgtaagccagagaagcaaatactggattaggaacctcagtccaaggtttagacccttagacttgtagtgagcattagccaagaaggaaatacaaggaacttggtttactctagaaatggtaattgaaccctactctctctttataaacaaacagaagtagatacataaatgaaaaaaaaggtctcacatttctagccgattactttcttctttatttttttggtgaaaacttcttttatttgggactaaaaatatatgatttcaacattcttaaatgagtctccatttcccacttttcagccataaaaggtagcctcttgctacctctctcttatgacatatttgtaccctctctacctcctataaactacctttacatctgcatctcctacaattctcgccagctggtagcataacacttttagagctttatctttaaaatttaataaacataaaagaaacaatgaaaagatctctactatccttttgtgtgtgactcagtggatgtgttcagtcatttttttgacagggctagataggcaacctaacttgtagtagagtaaggttcagtgacacaaaagcaaatgcaggccccaaactgggaaatctccaagctgtgaacaggaactgacaatagctcacttcagggtagggcagattctttttccggatttgctttcaaatgttatgttaacatccaactaaagtaacgaaatctcttttggtattgccaaaagagattcacatttgagtcagtgggctggggaaggaagatccacccttaatctggtgggcacaatctaatcagctggcagtggatataaagcaggcagaaaaaaaggagcacgagagagagagagcgagagagagagagagagagagacactcttcatagagaatattattcaaggatttcttaaacttgggaatataagacttcagggccctgatttgggaaatactgaattaataacaactctgtcactttaggcaatccctttgcactaaagccacatagcagtactctgttatcagacaacaagcagctgatttaaaatataagcctatatctgtcattttcatattatttcatcaaatagagaacaataaatacaaactttttgagagcatgagggccttcaaaacccactggccgaagtttaagaaactcaggccttcagcaaatgcacctaagaaaccaagctcatgaagatgtgaaattctaatcaacagattacctgaaaacatttccatcccatttcatgatttctctctcttttctgtagcaaatgatgtttttggaagaaaaagagcgcatatttcccttgcctggctactcaaaatgtggtcctctaagtagcaacaacagcatcacttgagagttgtaagaaatgtagattcccaggccccagcctagatgtaatgcataaacctgtattttaacaagatccccagctaggctgtttgtacattaacgtttgaaaagcacatctcagagcactagttttaaaactaggtctattaagatcaacttgagaactttctcaaaaaacaaattcctatacttcatcatactcttgactccaacaatctctgcaacaatgtagctaacccatcacggggatttgacaaacatggcttccgattgtatcttctttccaattcattttatgaactcaggcaagttccttagcttctttaaatttgagaaatgagtatgacaacagtaccttcttctcaaggacacacataaagcacttaaatatttgataagtgctagtcacaatattggtgtattttgccttgacaaaagtaatgcctaattttattcaataaacaattgttaattgtcaactcatacataagctaatattgttaagttgcttcgtataatgcttatcacaaaaatggtatgtaatggttacataaatacaaataaaatcatgtatttgacaccatactgccattaggtgactactatctctccatattagaggtagagcagtgtcaaaaactaccatctgattaaataatagaaataacagctaagtacttactcggtactttcatctttctaagcaatttatatgatatgttacttaatcctgacaaccctatgaggaaggtccttcatacaccaacatatcaacatttatgcatctctttgattacttctcatgcattaattcctagatttgagaatcactgtgttcaaagtatattgaactattaaggctacgggtatgaactactaaatagctctcaagaaatgtagccaatagttgatatccaacggttgtatagaaaaaagtcccatttccccaaaactttgttaatgccaggcattctctaattctccaaattgctaataaaaatttgtcatgacttaggaatacaacataaagggaaataacttcttctaaatgtcctagataaaacaatctaccatgaaaattaatgtctcctaggcaaccaggaagtcagacacaatgaaaaagaaacactgttctcttcgttaaaagaataaaactgtgtttccttttaactagaaaaataaagttgttatttcattatggccaggaatattaaggttcactgtaaaaaataatctgctatttttataccctggcattactcagtgaatggcaaaaatctagaccaatcctagaaggcacgaatgtctttgggggatgtcagaaaaagccttaactccagacacttctaccaactggagagtaggtttctatttcaattaacttaaacactaggggctcaattgttaaccaagaatgtaaatgagcttattaaaagctgctggctaatggatcccaagatgaaccttgagaggaacaatgccctgtcatctaactgaggaacaacacaatctgatctggccccgctctgaaacatactttattgatgacttggaaaacaaggcacataaatgaatggttggagacatatattgaagtttatatgatttgtaaaacattctaatctacaggcgtatgtcaaaattccacaggagacagtagaagaggatcctagaagaagataacaaagtgaacaaagagaaagagaagacaacttgaagtgtcccagaatttaagcaaacaagaatacctgtaacatttttatacaaagagaattttttagtgaagtatattaagtcatcaacttatgtcactaaaaaaattttcaattgttaacaagtcaaagaaaatccaaaacctcagctatttataaacagaaaacacctaggtatttcaaaatgccaactgccttttcaagatctcacttcatcagttacctcttctctgttctgtcattttttttttttttgtaaacctacttgttttacatatttaacctcattctcaccagtttcttccctgtctcctaaaaagatgttcagggattacatatacttaataacctttcctcatcaaactctaatcacctattcatttaataaatatgtattatatacttgccatattccaaatactattctagtggtaaatatgacagaccagccctctgctctcatgtagtattctaggcacagggtgcatattgcaagcagtagagactacaagccagtcaacaaggaaaaatattctgattgtgacttgaaggaaatgatcaaaatccaagaacaggaagggacttggaggaggcagaagtggctgcctaagtgtcaaaggaaaggggaatctcacgtttgatctgcgagttgaatgataagaagtccactgtatgtgactatatggggataaaatgttccagatggaggaaacagcaattgccaaggcaagaatgatctcaagatcttagaggaatggaaagaagagtgtggggtggagcctaacagcaggcagcaaggcagaggtgaggagatgggtttgaaagatgagcagggatcagatcatacaaggtcttgtgtggcgtttcacttaatgagaaactcgtgataacaaagattcaagctccagagtgttcagggtctaaatttgactttcaaaaaaagattttactattgtacattaaaaatcatctcaggacgcctggtgtggtggctaatacctctcatttgggagaccaaagcagaaggatcccttaagaacaggacttcaagaccagcctgggaaatatagtgagaaagaaagaaagaaagaaagagagaaacagagagagggtaggggagaggggaggggagacgggagggggagggggaagaggtgagacgggagggggggaggggaggggagacgggaggggggaggaggggggaggaggggaggagagaggagaggagaggaagaaattagctgggtgtggtggcatgcacctatagtcccagctactccagagaccatggcacgaaatgcctgagcctgggaagttgatgctgcagtgagctgtgatcatgcccctgcactctagcctgggtgacatagtgagatcctgtctataaaaataaacctcaggagcttaaaaaaaagcatatgccccattcccagattatttttctgttaagacttttgaaaagtgacatacaattcatataccataaaattcacccttctagtgtacagtttgatggttttcagtatgtgtgcaaaattgtacaattatcataactacctaattcagaacatttttacccccaaaagagaaaccatttcctttagcagtcatttcacattttcctctagcccacagcccctggcaactactattctactttctgtctctgtggatttgccttttctggacattctatagaaatggagtcatacgatatatagccttttatgtgtagcttatttcacttagcatgtgttcaagattcatccacattttaccatgtattcatcctttattccttttaaaggctgaataataccccattgtatgtatacaccacatgtttttctccattcatcagttgatggacatttgttactacatttttggacgtttgtgaatagtgctgtgaatattcaggtgcaagttttgtgtggacttatgttttcaattattgaacgtacacctaagagtgaaactgctggatcatgtgggaactctgtatttaacattttaaggaactgccaagctgttttccttagtggctgtaccattttacattaccaccaccaatgaaagagggttccaagtcctccacattcctcaccaacaccccactcccagatattttaaattaattggtctggctgagacctagatatcaggcttttttttggtttttattttgaaagttcctatggtgattctattcctaacgtatagtgaaggccaagaagcccttactccagcctgttcattgccaacttggtaagtatttatacctactccctcttcctgataagtattcatacctactccctcttctgctccagagctctttagacatgttacttggtgcccccagcactctcaatgacatctgctttgtagctgactcatccagtgagagaaggaaagataattaaggaagatacagtcttatacttttaacagtctcatttatttctgagtggggccagtgtctgtgtgaaatcttcatggttatctgcatgtctggatgggttttctccaggcactctggtttcctccctcattccaaaggtgcatgtgagattaagaggcatgtctacatggtcccggtctgagtgagaaggtatgtagagtgagtcctgagagggaatggcgccctgtccagggtgggctcctcccttgggccctgagctgccaagacaggctctggccacctgagaccctgaactgcaatgaatgggtaaataattatcttgcttttattaatctttcttataatatgtagacatcatctttatttctgtatttaatattaacaatattttggtttttatttagaagtttggtgatgtttttgtgaggagaaatatgccacaggaattttttttttaatcagttagcctatggtcaaattggtttcattatacattgttttggttaaagttgtagtttctaagaaacctacctatgactcaagtgaggacttgtgtttttacgtaatgtgaatcagcaacccccttcttccactgattgatccgacggagaccttttatgcaaaaagaggtcactgctttaaaatatatatatatatatattttatatttattttatatataaaaattatatatatttaaaaaaatatatatatatatatatagagagagagagagggagagagagagagagagagagagaggctcctgaagttcttctcatctagtcaagaaagatatagggtgtaaatggatacttctatgttttatgcttcaacctgaccttgagtattaaacatggtatcatatttacaaaaatgtataacatttagaactacttttgtcactttataaaatgattcttccaaaccaaacacaggtgatgaatatctaaaacaccagcatcaaggcctagagctttgtgtttgtacaaaatatcagggaaaagccaagcacagtggctcacacctgtaatcccagcactttaggaggcctaggagggcagatcacttgaggtcaggagtttgagaccagcctggccaacactgcaaaaccctgtctctactaaaaatacagaaaattagctgggcatggtggtgggcacctgtaatcccagctacttgggaggctgaggcaggagaatcgcttgaacccagtgggcagaggttgcagtgagccaagattgtgctgcgccactgcactccagcctgggtaacaaagcaagacttcatctcaaaaaaagaaaaaaaacgtatcagggaaagacagaaacctgaataaaaaggaaacagatttctacactgaaggacaaagtatggcatgacttctcagtctgatggaggccgagattcgtttttttcattctgagattcatcttaacggttaaaaaaaaaaaaagaacaaacaaaacgaaacccaaatcatgtttttcatgtggactgtaatagcagagacgaacttacatgtttaaatacaaaaacaatccttaaagaggagaatcagaagttgaaaatcaccttactgttatgtatctttctggagtaatcaaaatttctactatattatagtctctataccatcaaaaaatccacagatatcacagatattcatctccatggactgtatgaagacattgtggacatattgggacatcaactcagaaataatgtcaaaagcttgtatggtaaatctgaatcaactgtgatctttcagaagcaggagcttccaaaggggttcctgtagcatccctttatcagagcaaggccagtcagaggttaagaaacattgggtcttttactttaacacttctcacatattattttaaaaataaataccaaaagaaataccaaaggaaaaaccacataaattatattttgaacatttacattgaacaaattaaagttcccaacataagtgaatacaacataataattactattctgcatatgagagaaattattccaccattttttgactcctgaattgttggcaatattcatggcaaagcaatgctgctcataggtttttgctaaaacggagtataaggctaattacagtgtcaattatagctatgtatcatttgtactctatagacttactcctattttaagtggtctaccatattcttctaatatctaacggtgttattcacaagataactacatgactgatacattttttacgtaacagtgtactacaggtggtacaaccttgtaagagaacaagtttagaagtatataatgcacatcttccttcaatcctgtttattagcatatggaaaacacatttgaagataaccagatataaattcaaggccttgaatccaaagccgtcccaaactactgattccctgtgttcttccaggccctcagaagatgtcggttaaaggaaatcataaaaagtcaaactatagcctctgtgttatgtccccactaaagccagtatggccagactttactgtagctgagaggttcttgctcatggagtcttgaaatagagcttcccaacttcagcagagatgcctattatacaacattaaataaaagacgaatttaaatgaatcaagtcttgactcttcttccaccatcatgggttttacagaacagcattatccagggctccattcaaggtaattttgctttttcattgcttgacaaatgctttcccatttccctgcaccctagacaaattggtatttctcagcagctcttagaatgacaatggcagttttctcttcatcgttttttcatttcttcatcctctcgccatgagaggcactcatcaggggatctctaatcctacccatctcattacctcttcactctatttgtcaccatttggaatttcagaactcttaattattagcttactgttaccaacagtaatgaggctctggctgcctactggggagcatcatccaacactaacaagctagcagactgagaccggcacctgaattccatcacgtggttccattgttcaggccaggtgggacatttctgtctgcaggcaagctttctgcaggagagctggagtttgcagggtggctattatccattcactttggtcttatgattcacactgactcaaaacagctttcctgtgtggtcatgctcatttacatactggctattgccttccttataataacacttaatgtttatttctgccttgtcctccttttcacttgtataaggacttcctggagctaagagttctcaaagggaacactaattggtcattttcttatagctacttttgatctcctcctgacctggaatgaacagtgagtctctcacagccatctgggtgatccgtctatatacagaccttccttgacactcccgcagtagtcagcatactgcctcaacacaaaagaggctagacaaatgttaagtgacatctataaagttttctgagcaccaaagacagacccagatgcagaggagacagaaaggtaaaggattaagaaggagctggtccctctgaaactatgacaaacatgtctttatatagttaacgagggaagatgcaactgatccaaaatccatctcttccttggcttcatatcctttcacagcaacaagagccttgcaccaatgaggacaaatgagcattggttgaatacttctaaatgcccagcctacattaggcacttgacctgcatttgctcatttaaaccccaatagcctgtacagtagacctggaggaaaacaaaacccacagaagtcaagcaacttgatcaaggtcacccattagtgaaaaccccaaagctcttctcagtacaagtggtcacccaacaccgctcagaaaacggttaggcaaaatgagggcctggggtgggttttggaatagcaacaccctgaaggtaatagaggctggtggtagagaagaggagcagtggcatcacctaggtgtgtaacgctgcctttgtcccctgtagctgctgccttctatccaaggtgaccaccgtgttgaacactgtctaggaaatactgtgctcagggcaaaggatgctctctttttttcacatttttatacagctaagagaagtcatttctgaaaacaggacttggaggtcaacgtttacatatgatgccaccaaggacatctcctgatgatacccatgaaggagagaccattccgttagaaaacttgtgcagtaacatttaaaattggcatttgttaaccatactaataagagctaatattcctgtagcccttgctatataccagacattatgctataaatgctttatgtaaatatctcacttactcctctccaaagcctctgaggtatttttatcaccctaattttacaaaagaaaacactaagagtttaagtcccttgcccaagtacacacggaagcaagtgatggagccgagatttgtacccaggtatgtgacactggtctcctccccacctccaacagtgctaagaaagatcttctgcccacattgcattatgtgctgtacttttttcatgtaaatgatcattccaaatgtctacatcctggtgggtgagcggaggaggtgacaggaagaacaaaaaaaaaaatagacatgatgtcaagaaaggaattaattttcaagtgcacaatcactgctacccacagagtctgtctgtttggttttccataggtataaagagattactcagagtccataaggtggccatgccaggtctctcggggtcaagcagacaggccaagggtgtacccaggctctccttagctctctacatggctctgcctcatctgcttgcttggttcacccatgacatcagagaaacaaagttgggagcaatgctacttcaagcatatgccagttactaagggtaatttatggcaactctcattgccacgtgggctgagaagcacaacataataattaaaagactgataagcaatcactaatgaaatgcataggtattgttgaaaaatgcattttgagtccaagtaaaacaatgatgtgtgttctcccagtgcagaatctctgagctctgtaatcttaaaggcttttgcttttaaaatactatttcaaatgccagctattagtaacccatacatttgcaccctggtttcattgcaaaaatgaggaaggaccattgctttccaaaagaggcaacaaatagaattttttaaaaaacgcttctcttggaaaattttgatccgtttcaagtgatcttgtttagaagacccctacgccaagagtcctgccgggacagagttgtgttggcatcacttgactgctacctgtgtcgtctttgcctttgtgtatcgcaaagcctgttagaaacagctcatggaagcggggctcagaagacagaggtgtgtgctagaccctgccctacctttgttctctaacagggaagcataatgtcaaccaatctctagtcatctccctgacccatgtccctgactggcatacacacagggccacatgaaaccattccatggctcaggccagggtttcaagcatcaattacccttagtaacagcacatgcctgaagtagggttgctcccaacttaaatatttctctgatgtcatgggtgaaccaagccaagcagatgaggcagagtcatatagggagctcaggagagtttgagtatgccattggcctgtccacttgacccctgagtctaatgactcagcatggtctttggagttctaggatggcattatttacttctcctcttgcacagtccagaaagaacatttttccccactaaatgcacattcccaggagctccgacctccagtcaaaaaagtaaaagttgcttggtaagctcactgcctggggtcttctataccaggaagggcccaggcctagcactcatgttgtggcatcttcctcctgcactgtaggcagatgtcgctaattaactatgacatgttctcctgcagggcattaacagaatcttttagataccattaccaatcaatcagagttgctgcataacatggaaaacctattgctcatttcacttttcggctttagactaatgacccagggaaacttttcatggcagccctgagatggttcgatccatttcaagctaaggatgtgataatacgtgtatcttccagaatcttgactctttcaattaggagcatgaataacaaacttctagcattgaaataacatattctacggtaatcctctgactgatcaccttgttaataaatatctaaagaccgcatttttctctgagcttccaacttccatgggaacattctgattgtgatataatttttaaattagcgggtttattcatagatttgtgttagtaaatggcaagcttcttactaattagcaaattgtgtaaatccacagcagtattaattttcaactgtatggggaattaatataagacaaaataaataaggagacaattaaaatttccctagaggcatgcatttctataaaattcagcacaaaacaagaaaacattaacccattttgagggtgcatttagaaaagatcacaaaagatgtgtcagtgtcacagagaacaagtgaagcatgcatttgctgtggcacgcactctcagttacagctaaattccctaaagatattttctcaagttactgctgctgagatgtcccctcttgccttgatgcacttttccagcactttctcatttaataaggtttttattatttctttattgatgtttccactcaaattgctggtgtgctctctctcactttagaggacaatgcacagtataatgttctgatcctcaaaaactgccccacaagaggtctctcactaaccaagcgcttgctaatatccatttcacttttcccactaacccactgagaagatggaaagcatatgtatctctgggctcctgtttaacctcccagctctagaagatgagaaaaagcatgtccctcttacgggcacttacaccatttcttatgaagccatcccacacactgttaaacaaatctgattgtttctcaaactcccctttaactgcttcagcttattgctaagatgttggagtcttcctgtgttggtggccatggaaaccacctgtctatttaatggcatgaggtcttttctttacttttcctggcatgccaggctgttggggaaaggccagagccctaagtttaaacaagtcaagtacagatgtttaagaatgacagctcccaacagcttcagatcatagctaataccaaaattaaactgtaacatggtatgctctgatggggaaactgtgcacagtttctaagtacacaaacaagacagtacacagacaattgtaggttccatttgggggcaattttcttcccttatcatggctatcagtgatacaatctgctgcagaagaatgtggtgttaactaattagtataccatatagaagtgcctgtcttgtattatttacagtgcctgggacacactcctagtacagggcttctcataggcacagtaattatgcatttgcctctctgtcttacatattagataatgatctccttaagggctgggaatacggtcagagattgggattgcctatcagccccctcccaagcagacctaagcagccaggtggtaggcaagaacagcttcatgaatggctactaggcagttcccagtagtgcctggaaattctgtaagtaaattttaaacggcttggttcaggccaaaaccaaaatggatcttcctgttccctcaccccaggtctgcagtgacatactatcctgatctcctctttctgtttgaggttgaaaatggaaatgggaagaaccaggcaggccttatctggcctgcttgccatatggagactgatgggcagactgttcacaaccacaagcaggtaccacagaaagaggacagaatagagccggtcctttacttttaggtgagttttcctccactggcatgttgtcaccaggcaaggcagttgccatttctactgatgtaaggagacacacacacacacacacacacacacacacacacacacacacagagagagagagagtgtgtgtgtgtgtgtcaaggagaggtggggaggaagtgagtaggaagggacacagagccagggactaaagagaaaagtcccttcctgtgaaaagaataagataatattttcatttaccatccccatatacacagcagtgagcaaagtgccaggcaaataattgatacccaacaaacatcagctgaatgaacaaatggattcattcattgcacttttccatgtctctatctctagtatttaagatttttttaatgtatcttagaagagcctactgttgtacaccaaaccaaaccaaaacagcagaatgtcctaaagtactgacatatgtgtagaaattacacatcaaattaccaatcagatagacgctaaggtaggactgaaatgtgggccaaacccattttggaaacaaagaacaaagtcaatactcaaggtcaagctcttagacagctattcttccaaagcacctggaccccaagacacactcaacaaatttcaggtcatttcttctctcattaagccagttacaaccaagttatagaagtggagtccttacaagtcgctattgatagaataagagctagtcaaagaatgtttgagccatttttttcccagcctcagatgatggggagaaaaaaaaaacacctcaatcaaggatgtcaaaatgaaccaatctgcaatagtcatctgggcaggggacaggtgaatagcccaattcttctcacagaaatgaagaaaaagttcaggccattatccaggatgacttgaaaaggcaactcagtgactgagctttgtagttctgacaccattcaaatagaaatgggagccagagatagaaggactgacggctcattctcaggaatgtctgtgactatgcttagatgtgtcagtagacaacagcttcctaccaaatggtacaggctttggcagcctcttttttaaaaggccttttagtaactagtcaggcaccattcttaatatcaaaacattctctcttttttattgcccagactctgggaatctggaaaatgaaagaaaagaaaaaaaaagaaaagagagagaaagagagaaagaaaaagagaaagagagaaacagagagagagagagagaaagataattctgactcttcctaggtaaagttatgctttccagttaacttgatccactagttattacccgaaaacatgctttccctatgtttgagttctcattcatttattcaacatctactatgtgccagaccctgtgttagatgctagggatacaacggttaatgagaaaaagaaaatgtcttatcatggagctcattatttatctgtcttataattaatctatattactttatttaacaactacatacattaaacactgcccttttatggttacggaaagacagcagtgaacaaaacagacagtctctattctctgatccagggggaaaagactaaatgagttagtaacattttcagatagttaggagagctggaaaaacatacattgggataatgccattgagagtgagtgatggagtggcagcaggactgttgtttgagataaattggccaggtggcgtctccaagaagaaaagtctcacttgagactggtaaatgaagccagcaatccaggaagggtgtttgtcagggtggccagcttttccccactcctaggttttaagaggagtctgacactgactattattaggaaaataagttagttggcctacttggagggtataataccagccagcaccttaatattcaatgtgtggtctggggaataccagcatcagcatcacccaagagcttgttaggaatgcaaattctcagctccactccagatgtaattgatcaaaatctgcacttgacctgacccctaggtaattcatatgtgtattaagactttgagaagccctggagctagccaccttgagtaagacctaaagtcatgtccaccaagcctggcctctatcagtcattcctttgtttattttggaattcatttgagaaatttgaggacccaggcatagacaagggctgctatttattggaggtcctcaagatcctctaaataaagggaagaacaagtacaaagccctgatatgggccaggctgaattatgagtgaaatcaacagaaataaacgcaagccatttaaattttatccctataaaatggctagcctttggaagtttttaggcaagggagaagtaatatgttctacgtgaaactttggagcagtgactctgggtgctgcagagagagtggacaatagccaagcaagcatggagaaaccacacagttaagaagctacaaaggcgagcccgatgggaagcggtagggacttgagttggtgaggcagcagtgcacttattctggatatgtcttgggagaagagctaataatacttactgatgaatagaaatgtggggcagcagttaggaaagaggatggtcaaagaaccagtcagtgcaggcatacttcatttcactgcattttgctttactgtgcttctcagatattgcatttttagaccaactaataaccctacaatcgccttttaagtgttcaagtgaaaggaagtgtcacacatctctcactttaaatcaaaaagtagaaacgataaagcttagtaaagaaggcatgccagaagccaaagacaggccaaaagctaggcctcttgggccaaacagccacgctgtgaatgcaaaggacaagttattgaaggaaattaaaagtgctactccagtgaacacacaaacagtaagaaagtaaaacacttattgctgatagggagagtttgagtggtctggatagaagatcaaacaagccacaacattcccttaagccaaagcctaatccagagcaaggtcctaactctctccaattgtatgaagtctgagagaggtgaggaagctacagaaaacaagtctgaagctagcagagattggtcatgaggttcaaggaaagaagccatttccataatataaaatgtcgaggtgaagcagcaagtgctaatacagaagctgcagcaagttttccagaagagctggcaaagataatcaatgaagttgaccatattaaacaatagattttcgatagtgacaaaacagccttctattggaaggcgatgccatcaaggactgtcctagctagagaggagaagttagtgcctggcttcaaagcttcaatgaacaaactgaatctcttgttaggggctactgcagatggtgactttaagttgaagtcagtggtccttgagcattctgaaaatcctggatcccttaagaatgatactacatcaactctgcctgtgctctgtaaatggaacaacaaagccgggatgacagcacatctgtctgttgcatgatttactgaattttttaagccccctcttgagacctactgctcaggaaaaaacattcttttccaaatattactgcttactgatgatgtacctggtcacccaagggctctgatagagatgtacaaggagatgaatgttgttttcacacttgctaatacaatatctattctgcagcccacagatcaaggaggaattctgactttcaagtcttattaattaaatacattttgtaaggctataactgtcatggacagtgactcctctgatggatctgggcaaagtaaattgaaaacctggaaaggattcaccattctagaagccattaagaacattcataatgcatgggaggtcaacatgaacatagtttagaagaagttgattccagccctcatggatgactttgaggggttcaagacatcagtggtgaaaaaagcaggaaaactagaattagaagtaaagcctgaagacgtgactgtattgctgtaatctcatgatcaaacttgaacagatgagaaattgctttttatgggtgagcaaagaaagtgatttcttgagatgaaatcaactcctagtgaagatgatgtgaacattgtcgaaatgacaacaaagaatttggaccattataccaacttggttgataaaacaacagcactgtcaaagacgattaactctaattttaaaataagttctactatgagtaaaatgctattaaatagcattacattctacagagaaacctttcattaaaggaagaatcaatcagtatggcaaacttcatttttattgtaagaaatcgccacaaccacccaactttcagcaaccaccaccatgatcagtcagcagccatcaacattgaggcaagaccttcccatttttattgttcacattttttagcaataaagtatttttaattaaggtatgtacactttttaggaataatgatattgcatacttaatagactacagctaagtgtaaatatagcttgtatatgcattgggaaactaaaattcacatgactgatttattgcgatagtcactttttcacagtggtgtgtatctgaacccataatatctttgaggtatggctgtacccctacgaggcatggaggtgggcatactacccatgctgcccccaagcactatggctgaccccttgctgggctgatcccaaatacaaaatacaagaattcataaacaatacaacactttccgttaatggagaatgctataacacctagttcccacttctattcttcaccgttggattctaatagatgcctgttattcctttaaaaatatgagagcaatggatttcatttacaaaaaagggaaattagttacacaacaaaatgaatactcagaaaaatatttcaagcaaatagataaaagaccacttttaaaaatctgaatatccaagataacttgctctcgtaaaagtttgtgattggcaataagagacagattgaaaactgctagacttttcaaaaaaccagctcctggattcactgattttttgaagggttttttgtgtctctatttccttcagttccgctctgatcttagttatttcttgccttctgctagcttttgaatgtgtttgctcttgcttctctagttcttttaattgtgatgttagggtgtcaattttagatctttcctgctttctcttatgggcatttagtgctataaatttccctctacacactgctttgaatgtgtcccagagattctggtatgttgtgtctttgttctcattggtttcaaagaacatctttatttctgccttcatttttttatgtacccagtagtcattcaggagcacgttgttcagtttccatgtagttgagtggttttgagtgagtttcttaatcctgaattctagtttgattgccctgtggtctgagagtttgttttaatttctgttcttttacatttgctgaggagtgctttacttccaactaagtggtcaattttggaatcagtgcggtgcggtgctgagaagaatgtatattctgttgatttggggttgagagttctgtagatgatcaagtgggtttcatccctgggatgcaaggctggttcaacatacgcaaatcaataaacgtaatccagcatataaacagaaccaacgacaaaaaccacatgattatctcaatagatgcagaaaaggcctttgacaaaattcaacaacgcttcatgctaaaaactctcaataaatgaggtattgatgagacgtatctcaaaataataagagctatctatgaccaaccaacagccaatattatactgaatgggcaaaaactggaagcattccctttgaaaactggcacaagacagggatgccctctctcaccactcctattcaacatagtgttggaagctctggccagggcaatcaggcaggagaaggaaataaagggcattcagttaagaaaagaggaagtcaaattgtccctgtttgcagatgacatgattgtatatctagaaaaccccattgtctcagcccaaaatctccttaagctgataggcaacttcagcaaagtctcaagatacaaaatcaatgtgcaaaaatcacaagcattcttatacaccaacaacagacaaacagagagccaaatcatgagtgaactcccattcacaattgcttcaaagagaagaaaatacctaggaatccaacttacaagggatgtgaaggacctcttcaaggagaactacaaaccactgctcaaagaaataaaagaggatacaaacaaatggaagaacattccatgctcatgggtaggaagaatcaatatcgtgaaaatggccatactgcccaaggtaatttatagattcaatgtcatccccatcaagctaccaatgactttcttcacagaattggaaaaaactactttaaagttcttatggaaccaaaaaagagcccacactgccaagtcaatcctaagccaaaagaacaaagctggaggcatcacgctacctgacttcgaactatactacaaggctacagtaaccaaaacagcatggtactggtaccaaaacagagatatagatcaatggaacagaacagagccctcagaaataatgccacatatctacaaccatctgatctttgacaaacctgacaaaagaaacggggaaaggattctctatttaataaatggtgctgggaaaactggttagccatatatagaaagctgaaactggatcccttccttacaccttatacaaaaattaattcaagatggattaaagacttaaatgttagacctaaaaccataaaaaccctagaagaaaacctaggcaataccattcaggacataagtatgggcaaggacttcatgtccaaaacactaaaagcaatggcaacaaaagccaaaattgacaaatgggatctaattaaactaaagagcttctgcacagcaaaagaaactaccatcagagtgaacaggccacctacagaatgggagaaaatttttgcagtctacccatctgacaaagggctaatatccagaatctacaatgaactcaaacaaatctacaagaaaaaaacaaacagtcccagcaaaaagtgggtgaaggatatgaacagacacttctcaaaagaagacatttatgcagccaaaagacacgtgaaaaaaacgctcatcatcactggccatcagagaaatgcaaaacaaatccgcaatgagataccatctctcaccagttagaatggcaatcattaaaaagtcaggaaacaacaggtgctggagaggatgtggagaaataggaacactttacagtgttggtgggactgtaaactagttcaaccattgtggaagtcagtgtggcaattcctcagggatcttgaactagaaatgccatttggcccagcaatcccattactgagtatatacccaaaggattataaatcatgctgctataaagacacatgcacacacatgtttattgcggcactactcacaatagcaaagacttggaactgacccacatgtccaacaatgatagactggattaacaaaatgtggcacacatacaccatggaatactatgcagccataaaaaatgatgagttcatatcctttatagggacatggatgaagctggaaaccatcattctcagcaaactatcacaaggacaaaaaaccaaataccgcgtgttctcactcataggtgggaattgaacaatgagaacacatggacacaggaaggggaacatcacacaccagggcctgttgtggggtggagggaggggggagggatagcattaggagatatacctaatgttaaatcacgagttgatgggtgcagcacaccaacatggcacatgtatacatatgtaactaacctgtacattctgcacatgtaccctgaaacttaaagtataataaaaattaaaaaaaaagaaaagaaaacttctagacttcccaacactttgagaaacagttgccacctaactactaaagcaaaatgaactaaacctaccactggaactcaacctttaggcattttaaaaggccatttttaatgaattccctttcagctcttagtcaagctcatctttttgaattcgatctttatttttaacaggagcacatacttaaagaggtagaaggtatgaagaggtcagcagtgatcatctttacttataagagacaaagcattcctcttggaaaagtcaccataccattttggggacttaaactttgaatattttttcaagaaaacacatttatgacaattcattatgctagagattctttttttttttttcctttcaaaaatattttccattttatgtcttctaaggctgatgaaaacaggccttccaactctgggcttgccttattgcctgtctgtggctgaaacccaaacattttcctattacagtttaagtgtttttatgtatgttttatacccaaattcagtaaaggtttgacatagaccaaggtaacatttcaggcagtatctttaaaatagaaatctattttcagattccaggatgtagaacagttggttttgaatttataactttgataccagcattttcctctttaattgtacttctaaggatacctcctggccaccaaaggacactggcgtggtttatttcagtactgtgataaagtgattgagaactgagattttattcccaaagaggctaactcctttatcttattctaaagccaattattttgcaaattagatccactgcttacatagtatgacatgtgaatagatgtaaggaaatccatcactactactccaagcatatgcctactgagtaatgagttagcaggatcaccttcatgtttgaagacaccaggacgatatagtagaggagaacgtaagctctagtgtcagaacgcctgggttcttattccatctggctagctaggagactttgggcaagtccctcccctacatctcagtttccccatttatactcaatggcagtacttcccaaattagtcacctcatatttagagatatttatttattaatactatatatatatatatatatatatatatatattttttttttttttagacagagttttgctattgtcacccaggctggagtgcaacggcacaatctcggctcactgcaaccttcgcctcacaggttcaagtgattctcctgcctcatatatagctgctttattgagatgtaattcacatatcatacaattcacccattgatgtaattcacccaaatgatacaattcaatggtttttaatctatttacccagtggtacaatcattactacaatcaattctagaatgttttcatcactgcctagggatctttaaaaattccaaagcccagactatgccacaaatcaattatatcacagtctatggcggtgggacacagacatcagtagtttgcgaagctccccaggtaattccattgcacagatatgtttgggaagccatgctgcactggaatcactgtcagagtttcagggaaaataaacacagaaataaagaaagaggagatgttcagcagagagactgtcctatgataacataagcacagaagtggtggtgagaataatcatactgaggacgaatttaatgggaaagactatttaaagaattacactgcaacttttataatcgggactaaaatagcaatttttttactcgttggtaatacatctccaggcacagcatcctctgagagtatgtataagttgggaataagagtgttgaggtaggaaagggatcaggaggagataagaacctgtaacttatctaacacatttcaagacattaccaagcttcttggccttctaaaaagctcctggttagccttacaggatgccactgaagtgccacccctttgtgaaatcttttcccactgaagtcacagtttgatgcttcttaaagctctgcgtttggcataatacagcaattatcacccagagtcatatacttcagaagttggtcaccttcaccagggcaagagttctttgaaggcagaaacaatacttagtacattaaaaaattaaaaaaaaaaaaaaaaaactatctcaagagcctagcgcatgttatggcacagtgttgacaaatatttgttggactgaaccaaagcaaattcacatccactactgtcaacacaaaaatgaaaaaaaaatagtgcactagttccaaagttcccagaacacttaggggccattgtagctctcagaagactggcaagcaagacctgcaattttactctataagggacattgtaagagcaaagcttggggtacttaataactccactaaataaatggcacaaccacaagctgttattaggaacactgaatagaggctgggcacagtggctctcacctgtaatcccagcactttgggaggccgaggcaggtagatcacatgaggtcaggtgttcgagaccagcctggccaacacggtgacatcccatctccccgtctctactaaaaatacaaaaattagccaggcttggtgatgtgcgcctgtaatcccagctactcgggagactgaggcaggagaatcacttgaacctggtaagcagaggtggcagtgagctgagattgcatcactgcactccagcctgggcaacagggcaagactccatcgcaaaaaaaaaaaaaaaaaaaaaaaaaaaagaacaatgaatgacgtattaccaacactgagatcaagaaaaaaaattgccatccaggggaaaaagattaattaatatcaattaattttcttttacaggagtagattatacagaagtctttaggcttctgaggagaatttgagaaaattttacagtaaacaggaatttgcatacgctctgggagcaaaaagtgtgtccccagacaggtcacctggggtatgttcaagatgaagaacaaaagtcgggcatttctctaagtgtagagtcaggagggtgcaaataaaggcaggctttagagggaatagagaaacttttggattcaaaagaaatacaattatcattacaatagagctacatggttacacaataagcaatactattaagcaccctctctggaaagagtgttctttgaaaaacaaaatgcagaacagatccaaaagcaaggtaacaaaagctattaggtgaagtccatcagaggaagaattctctttccatagcatcttccttcaagtacaagataattatgttttatttatggcacaggaatagaatatgagattcaccattcaataaactcaggaaaatcatttctttggtcattgctttttatttataaaatgacggcttggatcaaggtagtgtttcccaaggttttctttctttcttttttttgggggggaagatttaacaggcattacttgaagaaacttagagtcaatagattctaaattatggtcacttgaaaccagcaccacaagattacccatcaagacctaatcaaccaaattaacaattagtatttgggcagaaagttgatgcaatatctccaatatcaaggcagtacagactgctttgaaactgatattcttctctgtgcatgcatatacacacacagacacacacacactcatacacacatatatttataattccttctaaatatttgaatgttcatatatataattctttctttttaattactccaagctgagcatgtgtaggttagattcactctgttttataatatttattgtgtttatagaatatgtccatcacatcctagcccctaggcatgtttacaaataagataggaaaaaaagagactgttgataacataatggctaaaaatccacagccaatattttcagaaagatcacacaaatgcacatacatgcatacacacacagacacacacacactctatctacagatcatcctggtatccaatgtgaattccatcagtattctcagtgcaaaccacaccctgtggtttcttttcctactccctacacaacttctgccatcttgagtcttaaaatataaaacaaaaaaatatatggtccattgatggaaaggatagaaggctttagatgggagacagggtcagattcatcacatcatttcttttgacagcctagcacaggggttaatgttggctggggagatggaaaaaggaaagaggtaatgggagcagacctgggaccagttggtcagcaactcgcagagttctttaatcaccaacaacctccctgtactgaggcaacatgctgctaaatgctcaacatacagcatttcgtttcatcctcttgatgtccctacaaggtagttcctattatttccatatttcacttgataaaactgaggcccaagttacaaaatatcccaagttacaaagctactaagtggcaggctcaggacctgcacccaggtcttcccaaggccaaagtttagactcttcaccagaactgcttggctttttgctagaaagcctggggtcaggaaggttaaccattcacaaagagctcagaagtggcaaggcctggatggaatgcaatcatgaggacaacatggggcactgtccataactgtgtgatattgcactttccctgatcaaacgtcccctctgagggtgtcctagggacatttgagaccatttccctctgacacatcccttcttctgcagaagcacccatctcctttagaatttgaatttctgctaaaaagtagatgctttcctcacaaatgtcccctcctcctgtattctttctcctcttggatctccaaactaaaaactgtagtgggtatagaaaggagagtctcaagtgctgtgaaaatctttctagaggactttcatcccttcccaacagcctgcaatgtggacttctgtcccctcagtaacaaaccgtacatgtccttcctgaactgagaacgaacctgcagcatccagagcagctctaagaagcaggagaagacaaaaaaggcatgcagctccctgctgctctcaggaaaggggagagaagcgcagctgcctccgttcaaggctgggtgagagtgatgagtcaaatgactgtcatcatttggattctgacatttcttcctctacagagaaaacgaaagagtctgctattggtgatcattcattctgcgttcatttatgtcttgtgtactttttttttttatttttcgagatggagtcttgctctgtcacccaggctggggcgcagtgacgtgatctcagctcactataacctctgcctcccaggttcaagtgattatcctgcctcagcctcctgagtagctggaattacaggcaagcaccaccacacctggataatttttgtacttttagtagagacagcatttcaccatgttggccaggctggtcttgaactcctgacctcaagcgatccacccgcctcagcctcccaaagtgctggcattacagacgggagccaccacgtctggttagtattatgtacttctgactattgtgttctactttccgatttaaacaatgatcccagcagctatgggagctacaaagagccaggagtttggaagcttttcaagacactgtgagccctctccttttatcctgacttctttctcactttctgccttttcttgaagaacaagaaaagcaactccagtggaaaccacttaagcctgcaatttagctcacaaattgtccccagcatccttgtatctccttctccaactccttttttttttttttaaccttagctcttcctgatgattgtgagcatagctcagagtaatgccaactgttgctgtatcagcttaaatcagtgtggtacctggtgatggggcacagttgaggcaggcactacgagcttagacgagccttcagccccaactgaaagggatatattgtggagcactcacgcattctatagccccctcctaatccctcaagaatcccaggctgggaatggctgcaacttcaggattgtaaagttgtgtaaacacatctttacattgactacatcatggtccaacgtaacactttgaaacaaagggcttgagtgtgtccctgtaccccttcattcctgagttaaaaacaaagctccatcagtcgactcatatttatagagtgctccctgctcatctcctttcagtccttccgcttgccagggtaagaaaatttagtgcagacgatcccagccttcccagacttccctcctccttcctgacagaattagttgttgccccccaccccccatgttttatcatagccctttgcacactgtgttccccttatttatatgcttgtctctccagttgactctgagcttcttgaggttgggaacatcgtttgtgcctgtcacatctttatgggcccaagaatagagatgataggcaaaagtggagtaaagaataaaggaagaataaacatttttaaaatcagtctccaaagagttttccttctggcaggtaagacaaggcatacagtgagacatgaggcaaggcagtaagtaataagggtcagaataaaaaggaaaaagaaagcgactgttggacttggctgagtaggttgatagcaagctagtaagaaacatgagtaggtatcaaatagacacaggtgcaaaaacagggctgagaaaggtatgtcggaagggatgtctagttccaaagtgtgctgagattaaggaattagaaatgtaagctgagctccagatactggaagacttttagtatcaaacaaacaattccatttttttcttttgtctaaacattagagatgggtacacaaagaatatttacctggttggaatgtccagaaggactgtagtggactggaactcatggaagggagacccaatggaaactgtagaaacaggcttacacaatagcagaggaaacccttaatagttattttaatcaaataagattttcatttaaaagaatgaaagaattaagaagaccacagtataaaatgtaaggaataaagtttatagagagcaactggcatcggagacagaattcacaggtcagaagagaacttacaaacataagttccagttcttggagagatgcaagaacatactgctcctataagttaagaacaggttgtttgttcatcagaaaatagaattttatgccttacggttcacatgaagagttgtgaatgaaagtatgagcagtgcaaaggaacaatgagggatgccgggacaccaaagactagcaacgggaggaagccatgactaccacaactgctgaaaggacaagggcaaaacagcattactcaaagccactggcagccacagtcacggaggccaagatgactggtgggagatgtagttgcagaaggacacagttactatcgtctggcaaataaaggagggaatgagtatactcacctccttctcttcacaccctgtaaacttacactaatgcctcccattgagcaaacaccagggaggaagtccaggagacgcaagacagagacgggtagaagttgaacctcaggcaaaacaaagattacccaacacaaggctgtataaaaaaggaaaaaatcagtttaagaggcaagagcgtcattggaaattaagaatatgattggtaaaatttttttaaaaaatacaagaaatggaaggcaaggcaccaaacatttcctaggacaaaaagataaggaggtggaaaatatgagagaaacgtcaggaagcacagaagaggggtcccagagagagctctgagtttaataaacaccaagggtatggtgtctgcaaatgctccagggaaaaacacaagcaaaaggaaagaaatgcaacctgaaaattctttaggattcaataacacgtaatgataaaacagtttctttgccccgagtccttggagcataaaaaaatctgggacaatccgttcccttaccacatcagaaaagcaactttttgtttcgaaaggtctgtggtgaaacacaattccatgacgttaatcaatttatttcaattgggagtgaagcataaatgaaaagttcctatttcagaacagaccgtgaaaatgtgaagatgttattatttccaagctaaaaggagatgtgagattctctgcctggcacatttcagaaaggtacaatcagccggggcaggggaatagatttaaaatagaaaagtaatgggaaaagtgctttccatgtaacagacagggtggtggatgaaaacctatccccctaaagcccactttattaatatacattttactaggcactttggaaagtttgaaaatccacatgcttctcatttcccatagcttctgggtctaattacatatttgcatccatttgcatacacacacacacacacacacacacacacacaggtctcatccagtgatatagataattcaatattcaacttgtcgatcatcaccttaaaatagagatctaattatggaaaaaaattgtatgctgtttttcaaataaataaaaaggaggacactgattaaaaatataacacccctcattgatcaacaggtacctttttggttttaacctatcataaacatgaggtttggtactacatggttctggccctcccaaattaacactgagctagttcagggaacaagctctcacataccaaattctgaagctgcctttcagcagcaatttgagggaccaagaacataggctttccaaatgtctagaagctaaccagattcctctctccttaatttagccccttacattaggtgccccatgctctcttttgggtcaaaaataacagggacaatttaataccctatgactgtccattaaatatctgaattatgaggattcagatgtaaagtgcaatagtattttaataaaagtacactaaataaggaagctggtaatagacctcttaacgaaaacgtagtcaatggttcatttaatttgatggcagagtccactttcaaataatcccaaaagtgtatattttgtaagaaaaaggttgcagagttcacctcagggtattcttaaaaaattgtttgcacactgagaagacatcagtgctaagaggctttcctgattactgaaatttggttggaagtcttttttatttctattaaatgaatatatacaaccgttcggctgcctcaggacatttatgaaaatgagatgctctgtcttaaggaagttagctttaagagcgacatttgaatcattagatgcctcattggctgttacaaaaacaaacttcaatcttctgcttccccttttctaatattagctaacaataattaagttgcttagacaattccaggtgactcaaatttcatagcacgctcttcaaaaggctaagggatcactttaagttcctaaagccctaagactaagtgtgtttcactcactttgtgtagctccagcccagcatcatgtaccaaagggataacatgattaaaaatcatcaacttgtcttccgaaatctgtttctaaaccacagcacaaggaacagacatttaaatacagaaagggatggagaactacaatcttttaaaagtgcacactttagtgcccagtgtggtggctcacacctgtaatcccagcactttgggaggccgaggtgggtggatcacaaggtcaagatattgagaccatcctggccaacatggtgaatccctgtctctactaaaaatacaaaaattagctgagtatggtggtgtgcacttgtagtcccagctactcaggaggctgacgcaggagaatcacttgaacctgggaggcagaggttgcagtgagccgagatctcaccactgcactctggcctgggcgaaagagcatgactccatctacaaaacacacacacacacacacacacacacacacacacacgataaatattcacatcatctgcctttggttattcaacctatagtttatcatgggaaacaagatcttattcttataaagtacctgcatattttcatttgctagaaattaaccaattcagcttatatcatatgtggcacaaggttttgtcatgaggaggacatttaaagaataatttaaaagaaaacaagttcaaacgttcacataaaacaaaatagccatctctaaggagaaaatgggtattgctgatcctaatgttaatattctaaaataaatgaaacatttttgaagggagtattcaccaccacagctaaagaaagccacaaaaattagtgtatatgtgcctatatttatataggtacatttcccaattttattcttttactattacagatagctaattcctaggaaacattttctagatgtcttcttttatataccatgtctttggacattaattacaggcaaagaaagtaaacactcacaagaaaaagggaattttacaatctgatcttcaatgttatctcaagaaatgctgttatagctccttggttctggtttccatgcacctgcaaattgtcctttcacccatcacttgtaagtagtagaggagcaagcatacctgtacagtcatgcattgcttaacaatgagaagttctgagaaatgcatcattaggcaattttgtcatagcacaaacatcataagagtgcacttacacaaacctagataggtatagcccactatacacataggctatacgctatatgctatatgctgtaacctattgcttttaggcaacaattctttactgcatgttaacatactgaatactgtagataactgtaacacaagtatatttgtgtatctaaatatagaaaaggtacagtaaaaatatattataatcttatgaaacctcagttgtatgtgtactctaccactgatcaaaatgtcattatgtggtgcatgactgtatgtgaacatttcttgatcataaaaataaagtgtatgttgacttagttagtgccctggcaagttaatatgtatgttgacaaactataatgcttaacatgagtatggttaaaataacactatgtgaatatataaacacatgtctatacatatacacatatatacctatatatacacacacatataaatatatacatgcttataaattacagtctgtcttacattagctaaactattactacagtttgagataaatttgagatgttacaattggaaatctcctgtttcaatttgagaagggaaaatgttggcatattctcctgagtggagaaagaggctttctatgtcagcagatacttcagaggaacgttaatgtctcgaggtttctagcaaattaacagcccaggtaacaaaatgcagggaactctggccagttgcttacttactcagttggatctggccacttctccatgtattcccaccacactaaatggagcatgagtcatttgagtaatgagtcagaaaatgtctagcagcctccgtgcaatagcagacgtgatgcttaagataaatttcagagatactaggatggtgtttttcatgtctgcacatctctcattggtgatgaataaaattccttctcccttcccaagagacaaaaactgtatcatatgctatcctgaggctcgttccaactctaaaatttaaaatttcaagcaaaacctatagaaagaggcaaatacagtgtataaatgtctacaatttgtgtcctattcaaaattagtttttgtggaatgttgtctaatggattcagtggtcacgttaatgacaacttcactcccaagtactacatgccctgttaaagaaaaaatgcttaagtgaacaaaaaatttaaacaaattttggagttcagtgaaattaatgaataatctctttttcaatcatccctgattttttaaaatcacaatacctaaattatgatgataggaattactactagactttgagttttaatcccagtaacatctttagctgatttaaacctatttcaacttccattttaatatttcatctcattttatctgtatggttaatattaatttcctttttgcaccttctggttgtagcacaaagccagctatacaatagttgtgtgctgctgaatggaatttgaaggcaatataaaataatgtacagcatcactgaactggggattaaaaatcccaagtttgagtactgtcttggcaatgcactgcctttgtcactcaggtaagtcacttcttccttacaaaagtttcttccattacaggtttcacctctcatgacaattcctatcaattagttgaggctgtctggagtaattaggcaggacgctggtgggatggagtgccatgattgatgagtgatgcctgccaagggtgtatgacagcgaagtggtagcaattttgtcctgtacttggcaattgtagattagaacagggctgctcaaatgtgcatctatcaccaggaagcttttaaaatgcagattctgattaagtctggggcggtggctgagattgcatagttctaataggattccaggtggtgctgatgctgcggagttagagagtacacaagaagcaaggcaaagtcccttgcagctctgaatgaatatggaatctcaacctctcattctctcttgctcactcgcacacacattatttctactttatgtatgtgaaaaggtgcttacatatgccaagaatactgacaagcacattaaatacgtaattctcatcctcccccacaaaaggtagttagaagttttcaggtaagaaaatggagatttaaagagggtaagtaatttgtctaacatcacagagctgacaagtagtctagatgagagatgaacctagagaacttaattctagtaccttgctcttgacctctatcatatgctgtcttgatactgtaacaacattagactgcttacttagtgccagccactaggctgttttgtacatattatctcctctacttttcttaagaactctaggaggtaggtaatatttttgttttacagataacaaaattaattatccttccactgtctcaatctcggtaaaaccatagtgattcctattaagtaaaacattagattcatatctataatgaactaaacacaaagaacagtaggctaataaaagcaacatgtatatgcataaggctaagagtaaatatataaaaatattcttttataaattcatcctatgtaaatgcatttttgacaggtaaactcaaatgtttctgcagagtttagtgatgaggttatcaaagtccaagtgattattggtcccaaacagaatccatcagtgggatttacagtgggagaagtatcaaagattcttttttcatcatactcttttactacctaaaagttctttattagcaagcaaatgaaataagattggatcagtaaatttccctggagatgagatttcaatataagcaggtgacagtggatgctgcaccgatgcacacttaagaagagcaaacaccattgcaatgtgagggcaggatttttgctttactttgtttaaaaaaacaaaagtgtgcttcaaaacctaagggtctgaagcagtgattctcaaccttggctggaggctgcactttggaatcaagtgtgtagaggggacttaaaaaatactgatgcctagatcccctagagattctgatttatttggactggggtgcaaccgagacatcaggatatttttaagcttcttagtttttaaatgtataaccaaggttgagaatcatttgaatataggcatacctgtcccatgtggggggcgactagtcattaaaggcatgaatgtctaattgatgaatgccctcgtcagagcagactggtggcattcagagagcagcaaagactttctcccttgaagttaagcttaaatttcataagtaagtctattttaacagaaaattttataaaacatttgtagatagtctgaactacgaaaatcattttctccccttaccagaattatttccactggagggcagtctcctcttgggaagaaatgaatgcggatacaaccttcttaacagaccaaagtttaaaatattgactaagactgtggcattcacatgggtttcatttcaagacaatttctgggagatggagtatttgggataaaaaaaaatgtgtattctatgtgaagatactgccaaattaaaggtttatttctgtctgctaaaactaaaaggataaaagcttaacccaaaagataaacacatccacatatggaagaccctggggtgtacaaacataacaacaacaaatagaaagtagcatttattataggtttactgtgtgtcagatcctgtactaagcaatttaaatatcctacttgattctcagaacaaatctatattttataggtaagaaaactaaagctgagaagtgttcaaagaaatgtgtccaataccacatatcaaaaaagtagctgagctaggacttgaaccctatctgcctgacttcaaaaccagcccttgcaatcaccaatgataccgctttactgcttgagtgagaagcaacatggtccctatgcgtaagacaagcgtctaaatcagaacatgtcaacacaagaaaacaggaggaaaaaactctctttacacagcattaggtaatgaaagaaactgaaaggaggtgattcgggcagaatgagaaattccttattctccttactggttttatattttaacagttttcacaaactgtttttggttcctcttcatttcttatgcaaaccctttccaatccattaaaaataaatttggcattcccattgctatgtcttcagccgctgtacagaaccttggactagctggtcatattcctcagagacttatttcctagatcaggggttgtcaaacgttttctgtaaagagctggatagtaaatatttcaggttcttcaggccccacggtcttggctgcaactactcaattctgccagtgtagcatgaaagcagccagagatgatgtgaggatatagatgacagacgatatgaacaaaaagggcaagactggattccaataaaactttatttatggtcactaaaacttgagtttcacatcattttcatgtgtcaccaattattattcttctttctattctttttcaaccattcaaaaatgtaaaagttatctttagcttatgagccacataaaaacatgctgtggcctggattcagtgggcaggtggtaatttgccaatccccgtcctgaataaggtgtcctgtattcatttgccataacgcaaaggtcttgtcacaaagatatctagcaatggctccatgctcaaagagcaaatgtatccccagataccatcagctagtatttcagaatcagctgccttcccccaaaccactttttgctattgtatacaaattctctcagtagtaaaagtatcccagttaaatcacatcagcactctgggaaatattcttcttggggaaatattacagaatctggaatctgaaaatgatccagaaggtcacagagggctgtcatttcccaaaggcattctccagagcctccaagctcctcacagctgcagatacaggtataggtacagttccttagagaaaatagctccacagaatgaccaggacctaagaaagctcttagcaggggtgtgctagagccatctcctatcagctcatagaagaactcattatatttttcagcattttgtgagccagttgacatgagttgataacctgaaattggccatggtgggagcatcagcaccacagaaattcagaaatgtgtattcacaagtgttacaaattaggctttttttcccctctgagagcaattgttaaacattggccagcatacctctatccattacccctttccaacagacaaactcctcttagatctgttttacacatacacacatacaacccttgtgagctgcggtggcggtggcagtaactgtgggttcagggaaaggaaagaatttccccaagtaataaacaaatgtatttaggattaatcaccattttagatcatccttgagttactactccctttggaatcccaaatgcattccccttttatattaaatatggtcaactggagactaaggagttcaatcatttttgcataggatcagaaatttatcagaatcttttatcttcaattatcttctgtaattttatgtgttcatctaacatggacaaaaggaaagaagttacaaagtcctgcactgcattgtacaactgtgatccaagaggtgccattttcacttctgcatcatgctaattatccatgagcctattcccttttttatttttgctactactgaatgaagatccttacaatgtaatatctagcaatgttctaatgttcctgaactatatattatttgtttttaagcaagaggctctctgattatttctggttcctggtctcactccactaaactacatgagcccataaacctaatctaaacaaatcattttgaatttattttttctgcatttgctgccttcatcttagttttgcatcacttcaggcatcaacaaaactattttaatacaatcctttccctctacttctgcaagattagaaaataaaagagaacatttatagctactaggtgagctggaatatctaaaaagggattatatccctccctatttgtcaataaatatgacaatagttcatgtgagagtaagctgaagctgagtggcctataactaattctgaaaatttctaagctttagaaaaggatatccaggacttgaatgctcctgaaacgatacaacacattcatgcgtaatcagagatacgtagattcaaataaatctacctctacaatcttcagaaagcaatttttggagtcagacacaggtgcattttgttagagtttactgaaactctttacattgtaaagctgtagtggtagtcacccttaagttattcatagacaatttcaattatttattcatagactcacatgatgttatttttcattcagatccaaagcttgttacacattctgcaacaaaatatttaatgaaattccaagacttaaaaaatcttgcagtgaaagcaagaaagacctatcaatactgagtcaacagagtggacctaccaattcaaccaggcttggtacccaaaggcacaactcaacataaagttaacatttcactatgtaaattctaactccagtttctttttgaaacacaccttccggtcatctatttttccttcttgatctgttcataagtcataggacagaatcaattacctaggaccctttcattgtcaatgaaaatatatttcccaaagtgggttctgtgaaacactattataggcattattacagttgttttactattttttttaattccagatttggataaatttgggagatgtgggttttcactccttggggacttctcagagcccttagtatattaatgtacatcagaactctccaagtagggcattagaacatacagtattatccatacattttaaaacaaaagaattttcttctcatggagaatctcattggactagtatcccacgaagcacactttcaagaatgctggtttataagacacagctgagatttgcatataggcaccaaaagtggaaccacagagaaagggggaaatcatctgagatccctctcacatgagcacactggctgcagtaaaatgagcaatagaaactgctgagttcttttacatctatttccagatcctgtcaaaatgaataaataaaggtaagcagggtaggaggacagcaatcctgtgaaataacctccccccagtctatttgatagtttccatgacttgatcattgactcatcaaaatagacagatgtgctcttatccagcaaagtttaaagttagagataaaaacaacaacaaaaacctgagcttcaccttcagcaaagaagtgtcagctggagactttagaaattcaaagaggtaaaaacagaactatcattcaacccagaaatccccttactggatataaacccagagaaatataaatcattctaccataaagacacatgcacaagtatgttcactgcagcactattcacaaaagcaaagacatggaatcaacctaaatgcccagcaatgatagactgaataaagaaaatgttgtatatatacaccatggaatactatgcagccataaaaaaagaacaagatcacgtcttttgcagaaatgtggatagagctggaggccattatacttagaaaaccaaagcaagaacagaaaaccaaatactgcatgagcttactcataactaggtgctaaatgatgaaaactcatggatacaaagaggcgaacaatagacaatgggacctgcttgagggcagagggttggaggagaaagaggagcaaaaaaaataactattaggtactatgcctagtacctgggtgatgaaataaactgtacaataaacccacatgacatgagtttacctatgtaacaaacctgcacctgtacccctgaacctaaaataaaaattttaaaaaattcaaacatcctgcctaggattacaaatttattaaaaaattatttccttccatctaagctctctatcagaaaagtaatcatggaaccaacccaaatgcccatcaataacagactagataaagaaaaagtagtatatatacaccacggaatactatgcagccaaaaaaggaatgagataatgtcatttgcagggacgtggatgaagctggaaaccatcatcttcagcaaactaacacaggaacagaaaaccagacacgacatgttctcactcataagtgggagctgaacaatgagaacacatgaacactgggaggggaacatcacacactggggccagttggcgggtggggagcaagggaagagagagcattaggacaaatagctaatatatgcagggcttaaaacctagatgatgggttggtaggttcagtaaaccaccatggcacacatatgtaacatgtaacaaacctgcttgttctttacttgtatgctggaacttaaaataaaatttaaaaaaaactcaaaaagagaaaaaagtaatcacctgatattcaccgggataaagaaaggaatttagagaaatgtcttttgtccctacagttgaggcgtaaaacctgacagtgaggatgaaggcccttagaagccacgcagttccactaacaagcccatgtagttatttctacctccattacctgctgctttattaatataattaaccactatttattgagcttctgctaatgccaggcactatgctaggctgtatgcctatatttttattttatcctctgaccatggtaacatcggttgtcttattatcctgatttcacagacttggcacagagaagttccgtctcatgtcaaagatcacacagcctggctggggtagaatctgtatcaggaggcaagtctgcctgactccaaagatcatgcaatgccccttctccttttttttttcccttccaccactcttctgtcatgccttttccctagctattaccatttaaaagcagttgtgattaaaaacaaaggtcagctgtccataacttaactcaaatgttctttcttccttgctcttagagacaaattaccatcttccatcattcacgtggaccaagaaggatttaggctgagatgattatgcataataatctgggtctcattacaagctgagcacttggaagggccattctctcagcccttaaggcagctgaacttgatcatattttcattttcttttctccctatatccactaaagatcaactgacacagaacaaatgaagttactaacaatttactgatttctttaaaatatatatcttcaataaaggaagaacaaacagtcaaatgactgaaatctaagtacggaatgtgaaaaatgccactctctaaaattctcaaaggaagagaagaaaataaagaggggaaggagaaagagaggggaaggagaaagggagaaaaagaatcgaaggagggagagaggaatggaaggagggaaggaagggtatagagatcatctgcattagaatcttctcaggctgggggtccctgagcccactccagaccaactgattcagaacctctggggtgggatccaagactgcatttgcacacactcctctcgtgactataatttttttaattcatttatttttgagacagggtcttgctctgttgcctaggctggagtgcggtagcatgatcatggctcactacagcctcaacctctcaagctcaagtgatcctcttggcctcagcttcccaaagtgttgggattacaggtgtgagccatcatgcctgtcctggtgattgtaatttacaccagattcaccttaccctaagaagtgacttgtatatgtgttgcttatggaagtcagaagtttcccaagtttaagaattcagcatttagctccaggaaaaattggtcataaatatgatgatgacacatatgtgagacaatgactgcatgagtccaggaaagaataaagacattctcctgagaaagactcctcgttggagcctatgggttctaccgggcaggtgactcacccgttggagtcacaggtgactcagcaacagggttatgtaacaagaccaccttccttggtgctaattttagatttaaatagagaaactatttgaatgtcaaattaacctttttatatagagagagaaaaagtataacccaatgtaagcacaaggtaataagcacagggcaacacattcaaacagatgcaaagcacgtggagtgaaaagtgagttttccttccaggcccaaccacttctttctggcacttcagaaacacactttgtagaaccaatcacttgtatttgtgtgaactcctccctgttaatacaaagggaggaagcccattatacacacagttctctccttcacttttcccagaataacatatcctggaggccattctccacagtacatacacatttacatcgttcttttgaacatcatcacagtccatgtatttgaccagttcactttaataaacatttagactttttctaatcctttgctaatagaaatgatgctataaggaacactcttcttcatatggctttgtccacgtcgggggatatatttttaagataactctgtggaagcaaaatggcaagggcaaaggatacaggcacttttgagatattgccaaattttccctcccaggaagttgtagcaatttaaacttctattaatagtatatgatactacttgtttcccccacaccttcaccaaagcagtatatttttgattgtgatttaatttgccacttcgacttcttactggagaaagtgctgaccagcaaacatgaatgtaacttggcagctatatttctcctggagaatgaatacattggcattctaatttatcatcttcttatgcattaggtaagtatgaatctgtggccttgaccctcttcaactctgggtaaatttacaaactttagtttctgggcctgctaacacaggtgaacagtgatgcctccaagagaggacacatctacaagactgctggaaggagtcctcttttaattttactcttccaagttttaaaaataaattgcaaaataatttttctctaataagttaacgatttaaaattgtaattcaattagaaatttttttaaatattatgaaccaaatttttcttgctcaagtctgcaagaagggaggaactctgtggaacgcttcagatcagaccaccttggcggacatcaaagatctaattcaaatgacatctactcacagactcagtggtctgcttcatggattcaaaagttaatcaaaattcatactacaaatgctgttactaatcgccacagcagcaaactagaacccctccttgcccaccacttttacactccacccccagagaataacagacaacatgctgtttcttccagtaattcttaggatgttattgatgtattgtttatttttcatagagtccatgcacttaggaggaaacagggcataatatatatgcactttcagaaaactgttttaatgttataaataatatccaaaaccattaatgagttttagaggtggctgccttgcagcggggaattacttaagcactggaaagccaatcaacaaatatttattttgcaacttctgtgtgcatgcctaaaaaatcttattccattagtaaaataagtccatctagaaaaatacattaattcaacgcatatttactccacactcacatgttgcaccacagctccaagtgtgaatgaggcagagaccctgcactcgagttaggaagacacagccaactgaactgatgacttaaacgcaaagggacagagcacaggctatggcaggattacagaaaaagggctcctcatcaagccttgagggaatcagggaaggcttccaggaggaagcaaactgatatgatttccaagaaggattcatccaggggggaaaaatggacagaattagggaaatactattgcttaatcatagaagttcacctaaaccccatgaaagtcagcaatagtaccgtttctacctgaaatacagtcagcccaggattagaatatgttcagctctcatgtcataaaatccctaaagaactttctgaaaagctaagcccactgataagaataaaggaaaagcatagcaccccacaaactaaaacatattttccattacaaatacattttcaccaactctgaaaaaccaagtggacatttaacagatcctagaagactttgctccctaattgcctcccaataaccctcactctcattaaactacagcatgaccctctagtttggaggcccaccttctctttactcaaaaatttccaaacctaatgagagatagtcttagagaaagatgatggacttaacagactgagacgtattttccttccttggtgtttacattatttgacagcaaggagccccagagcaggagctagttccaagcaaagtccccaaagaatatcaacaaggaaaaacagccactaggctgtataaatccacttgctataaaattccaacacacacataataaccagcatatgaagctgaatccttataggaaaacaattcaaaatccaggtacattcatcaggccctccccatgtcgtggaagactaaagttagtagctcttccatatgttacactatgaaacaagatgaaaatggcagagaggaaaatgaaatgagccttctgagattcattctttagtttgttcgttcaaatacacggcagaagagggtgctttccatacagaaattattccgttttgacacactctaacttaggctatttggaggagaattgtctggctctaccttacagtacacacttcccaaagtcccacaaatcatgtggctttgggagaagagagagttcggggagcatttaccccgaccataccaaaatgaattaacagggattaatttgggttacatggtctatgtgccagtcagaacagcttccagtgtgtttcagaatttaaggtggggaaaaaagaaacagaaaatcggatttcaaaactaccctttaatgaaaagctgttaaagtgatttatcttaacaaaataatcatcaaattagaagctatatgtattcttaagacattttgaactccacattgtatcaaaattaggtagaatatatatattattatatatatattatctctctatatattctctatatgtaacctctatatatatatatactatatatattccatatatatactatatatactctctctctatatatatatatatataaaatcatagatacaccatgataatttactgagaatactaaaggagatgcgaataaaaaatatgtatctagtctatttgttagaaatcaggtatacctatctgcaacagacaaaaataacaatggcttaagcagacatggtctaatttgctcatgtaagtctgaggaccagcagaccagaacttgtctggccactggcaccgtggtcatctaaaacccaggctgctttcagattctcttctaccacctctgtgatggttcttattctcctagcccaagatggcattccagccatgccattcactgcctgggcagcaggatggaggcagggcaggcttccaatctttaatgacatgttccagaagttgcgcccatcacttctcattgtcacttgtcagaatttgattatacaaccccacctagaaacaaggaaggttagaaatgtaatccttcctctaggcagttgtgcaggctcccagaagaaacagagctggattattcaagaaaggtaagcgtcagaggtagtaggaaagtagcctgagtctggagagagtgagtagagcctccgtgagatcttgtcctctcttctagcccctcatctagcaagatttacagtgggttcctgtgcctgggatatagcactgtcttgatggttatagcaaaggtcccagtggctgtgcctggcttgaaagaagtcaacagcagcaatagcaaagcttgacctcaaattgatggcacagacaggcataaagagaagcctgcccatcgctgggtatcctgaagacctttctccaacatctagggggaaaatgtgggctttcattcagtgggcagagcccacactttcattttgactagaacatacattctgagtatgtaatcttctattggttaaacttagttatactctctcactttgtacccttaacaccacatacaagactgcttttgataaggaataaggacaggagatccttttttgtcctccaactagcctgcaaaaaagtattactgtagattgatattgtataatattacaaagaatagcactagcccaggtgacctgacacttctctataataattttctctggcacattaatttacacttgcatgcatatcactgaagaaaggtatttggggtttctatcaggacaataacaggcttgaaattagtgttgaaaaacattcacagccaggatttcaccccctgcccctgggttctctattttagctttctacattggcaactttcaacttttgctgctcaatgcaaataataactagcttaatgatttagaagaaaatattcttggagtatgttatagtcgtatgttaactgcaaatggctgccacctccaaataattgtctgacactatgtctgactatctgttcctccattctattgatctctcctatgaacaaagcagacagatatgcaggtacagctcttttaggaacaaattgccctttctccaagctgacatctttagaattaagaactcagagacagccaatgtggaaaaacatttctcccctgccacatgcttggtgggtcagaaagtcaatcaaattctatttcacaaaaaaaactaattcctatgagatgggaggctgcattaatatttctaagaccaaatattctccctcaagtaatataaatttataggtataacttttcccaatgctctatcgacttctcatggtatatgaaagtaattaggcttctctgaaagccagagctgcgttgagaactatatttgagtaaacacaaaagaaaagcattttgagtgttacttttaatgtttccagaaaagttaacacctataaaaatattgtttccagttttctgtatagaagtcactgaaggaggatgtgtgaaagtctgtggaaacagtacactggcaaactgccagctggaatcgcacggagctctgttgtaactcaaatctggccaggccgcaagtcaaagcatgtcctaagaaatatagtacacacatacagcgaacacaaccattgtaactctagcccatgggaagctgaacattcaatggacagtgtccagactatatagaaaaatagaacactgacccaccacctgcagaaaccagtcgaggaaaccacaacttttgcagccatcggccccaaatggttggtacttaatcaacaactgccaacttccccaagtgttgccccctgcatccaacacaggaccaaccagtgaaagctgactctgatcacataggacatctggcttctaggttagccacctccagcttcctgtgccaacagcctcaagtcaggtcacacctgaatcctcctcctcccttccctctcctctccccttccaacactataaagggttttctattcccctacttccttttgagtcttcaccagccacatgtgatgatggctgccacccttgttctagaaagcccagaatagcctctgcttcttctcatttgcattgctttttcccccatatctggttctccctgggggccttctatcctgcctgggccctctgctaggagttccttaacttttcccttctccatcctgcagcatcttcatccttccctgcttccaagggctgtgtttctgtagatgaactgtttctcccctatttgaggccagtccttccaactgtattctttcctcattatttctattccttcttcctggaccttttgtttccacctgttgtatcccttgctgtgttcctcacatgccactgggacagcacagaaacagtcccaaggcgtctacctggccaagcacagtggagctactgtgaggacaggatataaagaagcaacagtctggcctcaccaagaaaagggagcattacagattgattcatctgcattacatttcaagccaaagttgaacagtctagatttggatgcaaagagaacagagaaaaaagctaggagccaatagcaaccaattcaggggtcagagtggcaggcatcaagaaagtaggatggacaaaggagagccaacgaggagaaattaggggaaagcgaaacatcagtaggcagaaggcaattgtacaggattaagcctgaggacaccatgttagtcttttttttttttatacttggctcctgtaaattgcagtgagccatgtattaaagggaaagaacatggaggatcaccaagcatttctgtcctaaatatatacatatacatataaatatgtatatatgtgtgtgtgtgtatatatatatggacacacacacatatatatgtgtgtgtatatatggacatatgtgtatatatatatacgcacatacgtatgtgtatatacgtgtagatatatgtgtgtatgtatatatgtgtgtgtgtgtgtatagtgtgtgtatgtgtgtattttaagagactaggtgtcactcctgttgccagtgccgtcgtgcagttatagctcactgaagcctcaaactcctgggctcaagttattctcctacttcagcctcctaagtagctgtaactacaggcatgcaccgccatgcctggctaatttttttttaagagatggggtcttgctgtgttgcccaggctggtcttgaactcctggccttaagagatcctcccacagcacgggaattataggtgtgagccaccatgcctggtcccataatatattttcctttgcaatacagtctatagttaacatccaaatcccatgcaaagtataataaaacacctcttaccagcttcttctagggctcagaaaaactctcttctctccatttttgcctcccttctgatttctccattattattgctctattaattcttctttcttacaaataaaagtatacttacccattatgaacttttaaataatcaacttctttttctcctgtaattaaccaaaaaagttcttggaataatctactaaacacccagtctccactatctcctcagtcaaatacagtgttggcttcttccctaggccattcttagagaattcctctccaaggtcattcgagcccaaacctcatgcccttcttcagcacgcacaggctgcaggctctcctgaaccaccttgaagttctccaaccttggccttgccgacactgcactagcctttgggatcaccctttttcagctcagctatttttcattctttcactcctgcccatccctcttttatcatccctcagtctcatctgcaatggaaacatgacctaatctccaaaatcctttccaattgctatctccttctggatctccaaaacagacaagattgaggctcccgtttgctgttcttggtgtttgaatcactcctgcagcaatttcctacacagtctcatagtaaaggaatctgcacccctgtattctacttctcactgggactgtaagctccttgtgggtaatggctaaatctcatccacctttatatctccaagtctaacaatagtactagacacatctcaggtagagactctggagtgtgactgcctatagagagcatgataatactttctatctcataatacaacgcctagcatgctggctcttaccatcatcatcaagagatgagagttaaattaaatgaacctaataatgtgaagacagatgttagtattgtccccctgtgctgtttctactgtatttgatttcagatattttagtgaaaaaaaatgtgctttgaactatctagatgacaccaaaactgaaatttatcagagacctctggtattctgttttgtgcagacatactgcttcccaaattattttacacagcaccatccccacctcatttcctgtgcttatggacaacggaggcttgcagaattaaagtatgcctatttattccataagaaaatgggaataaatattaagataatggttgggggaggagaaagtgtacagaaaataattaagtcaaactcacccaacattaacatgggggagaagagatttttttcaaaaccctgcctccctagagccctaaaccttttcatcgatttccaataatagtgagaacttttgctataaaattgttttacagcagctaacaagcagtaaatgtttaatcattatacatacttaggagagcagcattgttattttatagattttaaaaccaggggctcatatagatctaagagctttcttcttgcacctagaaagcagcagaaccataccttgaactgtagtttttcagactcagttcttacccgctgtcattcatatccataccattctccaaaagactcatgtaagaaaataatcaccatgcaaagaaaccatccagctcttcatgaaaagctctagttcagtctctaggaggacccaaatgacagtgaagtctaagtctcagtctctaatgccaaggaaatgtcagggaattaagaccctcaagtgtgaacatgggagggtaactcaggctcctcttctaataaagtctaaatgggagttcatcaaactgtttaaaagccgatcttatcaacctaactaaacctaattcttcttgctttatctgaaaccctgttttaaagttcaaaatgaccaagctatgcaatttgtatgcagagaagctaagcagctgagagatattgagccaggactctctgtctagtaagttagaggaagaacaacaaaagtagattgccagatacaaagaaataagcaacatcagagagataccaaataaaagaatgttgacagctcttggcttcaggaaagccaagaagaatcatacattgaggaattggcatttgagcgaaggaggtttagatcatattctttcatcttgaaagtataaaaaggtctggaaagatgtatcatcctaagcacccaccatcgaagttagatagcagcaatttaattccagccttcatattggagagcacataggcaacttaatattcagaaacaagatttggggggacaatttaaagagagggcattttccagattaatggatacagctgaataaatgtgttctttgctttaaaaatccctcaaaataattagcaggaaaggtagcgatcaagcaaaatgttgactatttttcaagctgtgttttctctcctctcagaattattaataaacttaccatattttggttaaaatatttgctcacaaggagtattaattttcctaaaatgaatagggttataatattttaaaatgtatttcaccaacagcaattaatttgtgttgagtgtttgaggatagataattccactgggcaacaaaaatcacttaatcttccatgttgttgcaagagcaaagaaaagcaactgcattttaaaagtttaattagaagtaaaagcaagtttatataatgatatatcacactgctagcaagtaataaagataaacatcctcgcatattatcagcaccaaaaaacagtcaaatttcgctttgcttacagattgcagaaacttctatagtatgaaatggctttttcagataccgcttctgagtttggtggatttttttcccaagaacttgtggttaggataatttgagggattacagtgtagacagtgacattcccttgtatttgagagaagtttgtgcaattcagacatgactgtgtttgcttttagcaaacatactgttcacattttgagaaaaactgctgatgcagtctggtgaaagtgttctagcaatgccaaatcactgacagatgtgctgtctgccaagggatttccctaggaatgttctaattttcttctatctgtttagagaaagttcgtttaaaatctgttaaaatgtattaatgtgcagtgttccattgtatcttgctgtgggcatactagcaaaagaaaagttacaggaagattggtactggggtgcctaccaaaaacttgatcccgccagatcagaaacctgcccaatcctcgatcttacagaagggagagctcatatactctgtaataacttgcattgtctataattttattgtgttagaacacaaaggggctcactattcttccaaactcatttaaaaatatacctgctgttgaaactgcagtctagagagattaggtgatatatccacagtcacagtcaattggccagtgacaaacaatgtggtcacctgcaaatatcaatagaattaagaaaacaaaaggtagttcttaccagtgagttttgcatgaaggatgtgaggctcaaagataagatactttgagtacggatctaaaatttttatttgttaccaaatcaatgttttctatatttcctaaggtgactattaagtcggagtcaaatatcagaaacatcatcacagttataaacttaaccattgtggggaagattaacatggctttcattagtgaattaaaattgacttctgcatgttggtacaacagtaagacaatatcacaactgtactcccaaggaagtaaaatgctaaaaaggacaagttaaaaaaaaaaaaaggaatgcaatactaccagaagtcctaatggtaccagcacatacacactgtcccacatcaatgagaatgctcacctactgcctgagaagtataataatgaacagctatcgttcttgcccatctaaactccctttctttagggcaggagttcttgacctcagcactattgacattttagaccacataattctttgctgtgaagagctgtctgtgtactctaagatatttatggccactacttactagatgccagcagcatctccttcccagtagtgacaaccaaaaatgtatccagatgtcgctaaatgtgttcagatggggaaaggggagatataaaatcactcccttttgagaaacacaactttaaggaagcagccacttcctcactgtactggtagggctgccattcacatcatatgcccagaaggcacttagagctcagtaatctcatggccatggccttcccaatatccacagatccatcctgctaaaggcaccaatgatcagctcttctctgggacttgttctttaattccatatcctacacaacactctcccaaacctcttttttccataagttattcaaagttgggtctgctacttacaaacaaggaagcctacttgattaaaaaaaaataagcagcaaaaataattgttttcatttgtgtaagaaaaaaatagtgcatctgtcataaactaatagtagagtaaggcaggattacagaatcacactccccacctccaccctgcaagaaactaatttttaaaagtaagaaaatgataaggattttaaaaagctaataccttacccaacacctataaaaccaataaagtggtataagctttgctataaattttgaaagcctaagaaaagaaaacaaagattctgatacgtcagccccaccaactcaccctaatccaaccctacacacacccagaagcggtactaatcaaagaaggtaagtagacagatttctgaagtttctcagaactaccctaaatatgaaaaggtatggactgacagaaggggagtgatgaggcaaacccagacaaattcgagaaaaacaactttgttatagaagctcctacatgtccttttgagaccttatcaggactacagtacatattatagatgttctttttatgagaagatgccccctctgggcagaccaaattagaaaaatgcatccctctcatgagcggatgcaacagccctgcaccaagcatgcttttttggaggcagagcacagactggaattgagctccccttccgggcccctcacctatgtttctccattcaaggacaacctgcacacagcagcagttcacagcagccctgccagcagaggctggaagggtccccagagtttgttgacttccacagcaatgtgccaagtgacagaacctttgaaagcccaaagactgcaacaatgctggttgaggaatgggcccagggacagaatattaataggatctcggaagatacagcagggatcaggtcgcccagtgtgggctgcaccctgcttccccacagccttctccaccctcaccctccacatttcctaccgcagtggcttcctaatgtcagcatgtttcagagctgcctgaaagccttgtgataaaacaggttactgggccacatctccagagtttctgattcaatgtgtatgaggtgaggcccacagattccccctgttaaatgatgttgctggtctgaagaccacattctgaaaatcagtcatctttagaaaagtatgtaaaaagcagcagctagccctcaaaccatagctcagaatagggaagacaaactagtgtcaaggaacttgaaatcaaggaagatgaagatcaactcacaccagttaagaaaaacaacaataacaaaaacataaaacacccatcttaatagtgagcaggataaaaataaaaggcatgactaccatgcaaacttactacctgaatgaggagagggtggggaatggcagaaagaaaataacagaatgtaaaagacagatgaagaactcagctggaagaaaatgtaactgaaattaaacaacagtttcctcataagtgttttataatattaaggaaactaaaaagaatcttcaataacagctcaaaattgagaagataaaacacaaacaaggttttgaaaaggaaattccagagttaaggaagtactctgaatatattacataccaataaaaacttaattaattcattagaaacagaaatagaaaaagtcaaagctgaaaactaaattaccatgatggagaaactcaaaataatttcactgaatacctgagaaaaaaggcaaggaacttgttcaagcaaacaaagtaagcattaatttggaagacagatagagtaagccaagaaaatcatcatcagtgtccctgaaacactggaccgtaaaaagaaaaattctcagttttcacacaaaacatttatctaaagtgaagaaagaactgaatccatgggtggaaatgatacagtatcctgagaaaaatttaatgatcagcattgtcatcctaattaagctattacacatcaaggataaaactagagctgttcaaacatctaagaagaaagcaagtcaattacaatagggaaaagaaaatcagcctggcctcacactttctacagcaacagccaatctcggaaaaccatggagcaatgtctaaacttcagagaaaaagaaaaggtgacccaagaatgtcctatcagccaagttgttattcaggtataaaggtaataggtagatattctcaaaagtgaaaaatctcagagaatataaccttcatgaaaccttcttggagagaaaaaaaattgcttgatgatgaaaggtacccagctaagagataaataaaaagaaacaatcctggcatctagaaaccatggtaaaaagactaccagagctggatccaaataaaaatacaaccaggactaaacaaatgggagaatgacatttgcaaaacagaatgaggatgttatgagcctgtgcaatggactgaatacttatgtcttctccaaattcatatgttgaaatcctaacttccaaggtgacagtattaggcagtggaagtcatgagggctccattctcatgactgggattagtgcctgtataaaaaagacctcagagagctagctaatagccccttgcactaggtgagaaaatagcaagaaagtaccatctactcatgagaaagcaagcctttgccagacaccaaatctgccggtaccttgatcttagacttcccagtctctataactgcaagaaatatatttctgttgtttatgagctacccagtttatggtattttgctacagcagcccaaacagactaggacagcctgtcagggtaaaaataatatgagcaacatagtttgaaggtagtaagagaggtagctggaaagaaattagaaatcaatcatgtaatctctcctagtgaataacatctaaaattggtgtagttaaaaactcataaaaactccaacttttgaatgtttttatattttttcttaacctttagaaaagtctttaggaacaaatagctttaatggtgaaaaaatacatagctgaagctcaacaattccttggatttcactttcagtttctttttcttctgttaaattcaggtaaaattaaatttaacatctttattgataaagcagatatattatgatctctgaattattctcatccttacaatgttaattcttactatctatccattttactatcttcctatctgtacatgtgtattaagagatgtttagaacgatgctcttcaactgttcagagggtatttctcggtggtgggatttagggtattgtgttgctttcttctgtataattttgtatattgcctacattttttaatgatgagcataagtcacttgtaaaaatatacaatcaccactctaaaaaggaatacatgaaatataacaccacttttctgacacagtgagtataaatgtatctctttcaatgagcaacatcataaagtgcctctctgggtaaggcatcattgtgaatatccaccctcattgcaaagtacactagaagtgaatgatacgtaagaatgagtagaatgtatccaaggcaataacactataaggctctgtttcatttttgtaaatagatctctggcttaggctcctttaattagcagtacctaacatttcctgagcatttgctatgtgcccggctgcatgccaccatactttataggtattttgttatttaattctcacagtaactataaggtaataataataatggtgacgaagagactaagaacagctcagagttgttgagtgtctactatgtactaggcactgctccaagtgcttttcaggcaataacattcttcagtaggaagtacttatagcaatgggagtacattgtgcagcagaagagaaggctatcaaggccagcttttaaaaatacaaggatttacatttagtacagtgagagaaagtgcacaggtgagtctggccttgtgtagagagaaaacataaagagaaaaaactggcagaaccacgcaattaattaagtacttttgaccacaaaagtgaggggaatccagggtagagcaggactccgaccaagaagatataaaggccttggtcagcttctggttgtcgtggaaatgggatttcaaccattataatgagatcaaatcatatgctaacaaagaaatcagtaattagagttggggccacccacagagctcacctccatcttgggataagatctaggaagagccagacatgcatttttgccgcagataaaatcccaaaaggaaaggttttaagtatgaaagggttgggctgaaataacatactcaagaatattgctattctgagtgttgcttctgcttccagctctgaccaggtcactgcagataacaaattatgtcatttcttatagctctattccactcatcagctccccttctatgcaggaaggagcatgaaatgggaaaaaaaccgaggttcccactcttggtgtcctaagtgatcagccacaggaagaaaaagatctctgctcattttccctctcacttactattgcccaggaatcttggatctcttcagaatagtgggcaaactgagagaaagcaagttcatttaatcctcaaaacaaccctatagattccattctgttatcatcatccccatttcacagatttcacaatggacagggaggagcagcattgaagggatcagtaacctgcccaaggtccattttaacacaagagctttctgacttcattcaggctcccctctctgtgattgtgatttctctcatgtctaaaccattcacattttttaaaattaggatttctatgcttaagtatgtacctttgttcacaactaagttgaggattctatactcaaacacacacacacagagagagagagagagagatgcagttgattttccccaatactaatgtccatgaactgaaagcttaggcaataacttagtatagccacagctttggtttggttcagttctagggtactgctttgcaaattaaaggtgtaatcccttcaaatcactgcaataaaagtgatttgaaatcatactatttgcagtcataatagaaacaaatgcctacttaactactcatggctcagctctggtgagaacacatcaatagagtaaaatgcttttagctttccagagaaaggttccacctgacagataccaagagatcaaatattcactccgcttaggacaaagaagtgtacggattaggacatacttgagaagtcagtttcagaaggcaccagtttagaaaagaaccctgaaagacctctaccatttatttatatttcaatgtattcattccatttcttcctatgtcttttcattcatttgtttatctccttggtctgtgtgctgcaggctaaaactacagcaattaaacacaaggtccttgcatccaggagttcttctcaatccagtaatggaaacaactaacatcatatactattttgctttattttctgctagaggtacggacaggaggtgctgtgggaacacagctaatggggcacctggttcttgcctatgagagttttgagaaggatacctgaagtagggtttagaaactgaccatcacaggggatgggagaggaggaaagataaagttataaggaattctcaaactttgaacatgtgaatgtcctatatgtatctgtaaatagtatataaaaacactatagtatctgactgctctgtcacagatgaaaaccttcaaagagaagctgatcatagacacaattatagaaaccaggggatgttatctcgcccaagtctgcctgactacttttaaggatgctaaattcctaatctctcaaggatgacattcttcttgccccagagtgtgctagagccagagggaccaactctttctccctaacttcctacccaacaaagaatcctcctctacaatattcctaatggatgtttactatagcaaacatcacttgttcagttttggttcctcagtccctattccctcattgtaatagcattttttttttttttgagatggagtctcgttctgtcacccaggctggagtgcagtgacgcaatcttagctcactgcaacctctgcctcccggattcaagtgattctcatgcctcagcctcccaagtagctgggactacagatgcccactgccatgcccaggtaattttttgtgttttagtagagatggggtttcaccatgttacccaggctggtctcaaactcctgagttcaggcaatctgcccgcctcagcctcccaaagtgctgggattacaggcgtgagtcaccgagcccagcctgtgatagcatcttgattcacttttagggacttttctcctattataagccaccattaggatagtgaattgggtgccttttcattccactccagaatttgaggtcctggagacttctggtatattttctgctgtaatggaaaaaggatgagcatgtgtcctaagctcagttaattggaccttctcttccagggctctgaatcctaagaagagtgacatgccactcactcactcattgctgtaatggcttcttaatagccaagtagactccatcttgatactttcctgtttctaagcctagtccctcctgcccgcatcttgattctgttaactccccgatatccttctatttgtaacaaattccttttctacttatattaacctcagtctctgttacctgcttccactggaactctgattctgcttgaatccttccattaatgggaatattactacattgagaggctgctcattccattgctggacctctatatttgtttcaaaagttgttaattcaagctaaagccgggttctctattactagtgtctgtcatcaggaattagaaagaataaattttagtccctcttccatatggcagtcactatagtatccaaggaagggcaaataatcattgataaccacaccactaaagcccttctcccagctgaaaaccaccagggtttttataaatcttctagaataatataaattttcagacaccacagaaatagaagctttgaattgccgatgagcagattaatcattttcagatggtctcagggaactaaacagtcacttcctcggtgggcctctttcgaagagggcactttcatgtttattacttgcaagggttggcaaatggtagaattcttttttaggatgataaggatttatatttctatctagtctgccactaattaaaagtatattatcttccctactgaagttggggtaattggtggttattttcagagcaactcatcagggtgagacagattctttctgattgaggtagcagaggtgttgaacattcattgtgtactgagttcacgtttctagtatcacaatttcccacaccacatgcgtgatagatgtgtcttcaacatttgcaaacaattccaagtcatttctcccttcaattattccctcttctctgacatcctaacaaggttttcattttgtactaatttcactaatttaggaaaacttttgtctgcaatacatacatatacatatatacacacatatacatatatacacacatataaacatatatgtatatatattcatattcttgagaagtaggccagaaacttggcttgctgtgaaaatcagaggggaaataaaaaggatgaatggagaatagtgtctattccctttggcacttcttacctaatactcaagccccttacttgctgaaactcaagtcttctcctccctgctcccacttgccttatatcttctctcaatgagtgaggattaagggcaggtacttctcccattccagagaagcagcagctccatctggagcactctgcctctttctgatggagccctcaggggtgtacactgtaatgtccatcttccctcgtctgctcacgcagaggacaagactctcactctcaccctctttctttccctatctaattttctctcctttctctctctctttcctcttcatttctagtggccaccagctctgaaggtaacatcccagcctgagtaggcctgagccaattattctagaccagaatcagcgggggtaaacacaaacactctcattctctagctgtttcctcaggtgctatggctgttctggactgttctccccttccactgctcagatgatatatgacactcaattacagttgaagagaaatggatcaactgctctagatccaggcccctgaagctactttaatatgtacataagtgttcaccagaggttcagtccagctctctggggtgctacatgggtgcagaaggtccaaagacccagctaataacgaaagttgacttagcttttatttagcctcctttattttttttcccaccaggaaaaaaaggagttgggtcaaacaggaactgggcccaatatcattacaacaatactgcaaggtcccccttcatcccaatgccacaatctagactttgtttttaggaatatattttaggaataataaatacaaaagaaaaaataaatcctaaattatgaacatcgttatttggttttgcaagtcagtcaaagtcatgtaaagagagagacctagtcattatcaggaaataactatcttgaattagtctgtaacaatttcttctcattgagtatttttgtgtttcccttctcttcataataggtaacatgatttcctacttaaaacggtggcagagtttcccttaaaaacaaatttatgttttaaaagtcagttgattcaaataaatattaaatatatgaatgcatatgctggtcacgcacaatttggaaaaaaaaaaaaaaagtatataaatgtcctggagacttctggtagattttctgctgttcctactctgaatggacatggatcattttcatgccactttggggattgatgcatgactcctgttgcttccaaactgtctcaaaagaaaatagcattccacctgacagctgcatgaactcaagtctttctcatgtatgggaggcataagtatgtccatccaacaaatctgccagcattgcctttattctggtactgtctaaggctgcctattcccttctgcacagagttcagccttttgcttccttttttatttattttttttttgagactgagtctagctgtgtcgcccaggctggagtgcagtggcgccatctcagctcactgcaatctccgcctctcgggttcaagtgattctcctgcctcagcctcctgagtagctgggattacaggtgtgtgccaccacacccagctaaatttttgtatttttagtacagatggggtctaaccatgttggttagactggtcttgaactcctgaccttgtgactcacccacctcggcctcccacagtgctggaattacaggcatgagccaccgcgcccagcccttagccttttgcttcttatggaaaagcattcttcattgttttattcactaggcttaggcaagtaccaccctaactctcaaatagcctttccatctgggcacccttcttcatgatgtctttgttcctggaatgtgcctcaaaggtctgatttcttaggtgccaagcagagtaaaacttctaatcttccttctatcaatccggagttcctgctatctcaacaatatactgcatacccaaagcacatgcataaaataaagtttattacaacaagactttgtttacagaagaaagattagactgattgaatacattgttctacactgattttaattggtgctataatctgatctgtctctaaccagctaatcggtatttaatcggttgctttaattttattacaaggcagctagaatgcagctgtagctagagaccacacagtaaataaactacattattattatatttatgcatatgagttttattctgcttgtgtcaaaattatactcacttccactcccctcctaatttgtttgtattaaaccattgctgtgcacttgcatagtgggaagagttaaaaaatgcctttttattgccaagggtaagttatgtgataagtttccagatgtacccaccttcatttgccaaacaatcttgtgattgatttaaatatttatacagtgcttcaattactgacattgtttctattaattaatgatattagggtttaattctacagaatacagaaatagaaacagaacaaattcatgcacaaaaaagcatctgatatgatcaccctgaatgtagtttcatgctagagtttctacgcaattccccagagaatgaagcataccagcattaataaaactctaagtgttttaggggctttgaacatgggtgcgataggttccaaagccctatgtaagtatttgaacaacttgaccttatttcagcttcttgagagaactattagggacagtcacagaatcaacatgaaaaattattaagtacccacatactgcctgcctgaaaggactcagacaactacagcaaacttcgaaaaaatattaataatatcaaaacaccttgcggctgctcttttagatcgctgcacatttttaagatgtaatttactggaagctctcttttgctctttcctgtcatttcagttatgcaagaacacaatgctctcaccctacgccagtctggagagctttgcttttctcttgggaggaggcatggtgcaatgatgagaagaagggcttagcagcaggccgaccctggctccagtcccagcttttacatactccctgaatgacatcaggccatgtactcttaagcctaaatttcctcatctgtaaaataggagtcatcacagctactctgatattagtgtgaggattaaatgagacaacaccataaggctctagccaaggggtccagctgttcctttggctactgtgatctcaggctcatttagcccagtaattgtggctcatctcatagttgtcttctcatcctgctgagattcatttatttaacaaatgtttattgggtactgatgggggtgccaagcatgggctagaaacctggaacacaacactgaaggtccagtttgcaacacaaagtccagttggtccaatgaaaaagaggattagatttgccttttaacaaaacattcctaggtagatgtttatggtaaagctaacatcgagccaagtatcacagaaatatatggcaggacattaatgcctagtgttccattataggaacgctaagcatgtgggagttatttataacctacagctcaaggtcatcaccaaggtctgatttttcactcatgcaaaaattcaaaaaactgaaacctctggcataaacgggttaaggaagggaaggccccttagtccaagcctttccttataaaggtatggaaagaaaccattgttcctcatcagcatgagagcaatacgtgttgtttacatagtattttgccatctgtgatgatttttatgtagtgtaggacaaggactttctaacgctcggctctatactagaccaggtccaaaaatctacctgagtatcactacctctgtcactgaactactgtaacccaataacaggataagatggctaacaaaagatgccctcgtaggaggaactatccagtagtttgatttcatacttgtcctaaacctttaaacttgttctacccacatgtcacagatatggaggttagtgaaaactacctgtgtgtgtacagagcagctgggaggacattttggctctgttctaggcagtcatgtagggcccccttactttgctcctgcagagggtcctgatactgtcactgttctgctcagcttcaaaactctcagcaggatgtcccattcctcacctagccctcacctgctctacctaatgatgctcaatcactgaactggcccagaaataatacctgcctatcctgacttcttacccaaacctggggctacctccctgactggcatcctaggggggctctccatggcctttagtgaagtggtcaaagagaagggtcaactctttatacaaaagaaaaatgagtcatgagctaactgtgaaactctcaataagtcacatattctctgatctccatttcccaaatcacacaaattgagagccatctaaattgcctcccaactctgagactctatggatatacatatatgaatcatcatagcaaatatatatctattatagaagctaaaggaatcttctcactttctccaattagtaccaactagattactccacaaaagatacttgaccttgttaaaacaaaaagcaaaacaaaaatactcttttacactattatcaggaaatctatgcctggctttagcagcagagtataaatatttggttattggatacttttcaatttaggggaaaaggtatatctattgcttaaaaacatttgtgcccttcttatagccaggtcacccattccaagtctgaagaaaataaattgaagtggtggtaaaagttagttaaatttcagaatttttaaaagaagggatatcattcatctctggctagataactctgtaaaagatctatctgtaagaacagaaaatgctcttataagaactttgagactagataaacaaatgcatgccacacagaccaccactcccatctcctcaggctgtggcagacattattaatcaataacagaatccttcccactatgtctatacacagccttcaaatggctctcaatgcagtatctcaggtaactgccagcaacgaatcatatttggcatgaatgataaaaggtatttggaatccctggctttatgactttgactgttaccctgactgccatttagaggattaacagccaagaatgtcacagtgtcattatttaaataaaatagaaagggatcttgcctgcaggaacatgcctctgaatattagtaggggatttcaagcttgaaactctccagaagtttctttttcatcactctaatgcttgactttttcttcctctgccccctccttccttatgaactctcaaggatacttacaggtcagaagggtcttcaggttgagttctggccaaaatttgtggcatttccaagtctcacttcactgaatgagtacaaccctgagacctgtctgggaacatggagtgaaacagaaactaagagagccaccactgctgaggcagggagggatggcctggtgatacacaggaaaggtaagtgtggcagtgcagtgagagatgggctggggagtaaggtagacaaaaggatctaaagagtggagtccaaaagcacaatgatacaaagtgagtgaagctcagggtttagcaagttaacatgaaaaccctagctcctgaatgaagagtaccttttgcatggagcctggattatcttttctgcttatatctttcttttctcctccctccagcccttccctccttcctatatgctccattttcaactccctttatattccttcatctttctctccctacttccttttctttaacttccatttctttctttttcagtcattcctacatttccctttttctctcattctcctttgtctaagctttagacaaccctgctcactagctccttggcctttaagagcttataagggctaaggggctactagtagcttctccccatgcaacatatcacacaggtgtcttggagggacaaagtggggcttgagactcctggatgctacacagcagaggtaagggctcaggtacccaagagaagaaatcaatgaagtaggaagcagaggtgaaaagagtatatcagctcaacaggatcaacaaagtccaggaacactgtcaaaataagcttggcagaaaatcaacagagcagagaacagcatgaaacatgaagtgatacaggttgtgggtgggtggagaaagagaaatacaaggcaagcaaagtggcagcattaataagcagccatgactggacacagacctgaagatggatattaggaagtaggtgcccactgagaatgagagtaaaaaccaaagtgatgaactatgcctttgtaacacctgacacaaaagaaaagaggtatgccagttaaatggcagcaccatgtacagaaatgagtagatatttcttggttttgcttaatatcgctctggaagcacagaattcatgttctaagacttaagaataacctaaaccagcccagtgtggtggctcacacctacaatcccagcactttggaggtggatggatgacctgaggtcaggagtttgagaccagcctggccaacatggcaaaactccatctctaataaaaatacacaaattatctgggcatggtggcagatgcctctaatcccaactactcagaagcctaagtcaggagaattgcttgaacccgggaggcagaggttgcagtgagacgagatcgatcacgtcattgcactccagcctggacaagaacaaaacacctcaaaaaaaattaataaataaataaataacctaagtctatttgggtgccaaaaaatgtgtattctatttggacattacagtggattgacagcatagaaattatttattaaacccatcctactggacctgaaggtgaaccccatcgtaacagggtgcctggtagagtcattcttaactagccatcgatttgtaaaaaattgcaaaagttgttttttttttgttttttttttgttttttttttgttttttgagatggagccctgctctgtcgccagactggagtgcagtggcatgatctcggctcactacaacctccgcctcccaggttcaagcaattctcctgcctcagtctcccgggtagctgggactacaggcgcccacaaccacgcccggctaatttttgtactattagtagagacagggtttcaccatgttggccagaatggtcttgatctcttgacctcgtgatctgcctgccttggcctcccaaagtgctgggattacagtaaaaatttcttatatcaaatgaccgttcttgaattgttaccttggattaacagggagcaactattggcatttccatacagcaatctactatctggggataatctagctttcctggagggatggaaacaaagtgcataatggttgtttaccaatcatataatatcagacaccaataatttgtcattcactctagtgttctacaatcattagaggagctattcaactgctctcagacataccagctatgatcatgtaggaaacgtgattccgtgggctgaatgtaccaactcttcactaacatctcaatactctagactgaagttaatgaccagtgcaaaccaccagagtattacagtaaaagaacagcagtaaaaaggccttaataaatcagaaatttaaattggctattcattttagttacagccattcgtcagagcaaagtgatggtccaattcacctatgcggtaacttacattgatcataacagtactttaagtaatatcatccattaatttattaagcaaatatttgagtaatacctactatgtgtacaaccctctgccagatgctgcaagatatattcagacataaaagaaacaatcttaacctttaagaaacttgtaatccagtaggagaaaaagacattttgtagaagtcttattcaaataaaatatgattccataagataaggctccatctaagctctctgcattgcaaagctgatggcaagaactacatttcccagaatactcttccctggatggttcgagtgaagtttaccaataagaatagagtgagatgtggaagaaaaagagataaagaaactgttctttggaagtcagacaaatgtgcacaaatgaagtcttcctcattgctgtacattgagagatgtccctgctttccttatcgaaactctgatctgtctatgagttattaacacccttgtcagtaatatcacttgtcattaggtcacaattcttgggactaccattgtctaggttcttctattccacatgctttgtttctgtgcatgttgagtccaacatgtgtgtatattttaggtagtgtcacctgtttggatatccacaagacctatttacacaacacctgttacaaaaactcaccccagatgttttcttgtttgttcagtttaatttattatacaaatcttcacatttgaaaatataagcaaaagtgattctaagccactacaggaaattcacaaaagcaacacctggtgtcaacatatttcatcacattttaatgattatgatgtgcacaggtgtgctgaaagtttctcctccatactctttgattcttttttaaaatttttttaattatacaagtaatacacttctagaactaataagcaatcatagcaagcttgtgggacaaaagttaatatacaaagtcaattgtcttcttattgctagcaatgaacaattgggacttgaaattaaaaacacaataccatttacattaatgccaaaaatttaaatacttaggtataaatcaaacgtgaaagatctatataaggaaaactataaaactttgctgaaagaaatacaaaagatctaagaaaaaggaaagctatccacatacgcagacaggaaatctcaatattgtcaagatatcagttcttctcaacttgacctatacattcaatgcaacctcagttttaaaaatcccaagccaaagtaaaagccatctacggcacacagcattccgaaaggtttgggctacctgactattatggcaccaagaaatctctggtatatgagaactttcactttaattcaaaatgttggatgacctgattttcagcagaaatgctcttcaaatcagtttcacttaggctttttggtgtgaagtgaaacgatgcagacaatgagctttggagaatgaggaaccactgaataacttactatggaagtggatactgacatggcaaagaaacgacagcctggagtttttaacagaatgttcccaatgagcaggacctgaagatgtttcttcgttccaaaggagctagcaaagaagtgattgttagcatcatatcaaaataactaaaagctataacacacactcttgaacgtctttcaaaacaatgggatctatgaaggattatgatatcagatcttgatactgtaaatattttgggccattctcctgaatgctttcttttgtcccatgaaaacctaaacttagggattctatgagttcctctactcagctggatttacctgtaaatgcctttgttgattgttgaccaatgtcccttgtaccttttccaatagtctcgatctgaataaacagatggttaaagttttgcaggaagtatatttttcattgggtcacaatgatcccacagattttgtaagaaagatgattttttaaaaccctttcatcttaattcagggtaccaagcaggtaaaaactaacattgaatttttacaggcaagtttcaatttgaacagtagggaattgctattttaatatgtggtccaggaaccaaaatcctagacctttccaatgactatgccaaaacaaactacacaaatatcaaacagaagctgttttctctctgaggtactgaagaagaggtacaaaagcttgccttaagttatccagatgtggggaaaaaaagttatccagatgtgatcttttggcagagaaaaagtttagtgagaagaatattttagcttggtgcaaaagtaactatggtttttgggcaaaaaccatagttacttttgcaccaatctaatggattgtctcatagaataataaattagccttctgtgaaagtaatttgtgataactgaaaaatccttgggttctggattcaagcataagtactttataaagtcaaatcaaagaattagtaaatgctggctgtaacttgaggacatcaagcatcactcttctactctggagttaaaaaaaaaagatacaaagtaaatttaaaaagttaagcagaacactggggaatttttgaaagccagtcatataatgtagtggtatcttttcattttgaatttgggcctttcaaaaaggaggggtatgatttcttaaccacagatatatatatgtaataattctttggctattttgttttacaggtttatggaaactcatggttgatatgctcaggtgcagtcctcctagctacctattttccagtttgaattactccaacataccattatttgatacaggctgtgctgctgtagagatggtagtgccatggtgatttgctacacagatcatcccatcacctaggtattaagcccagcatccattagttactcttccttatgctctccctcccagcagcacccctccaacaggccccagtgtgtgttgttccctccatgtgttgacgtgtgctcattattcagctccctgttgtaagtgagaacatgtggtgcttggttttccgttcctgcgttaatttgctgagggcaaaacctgattactttgaaaacaagttctactgtggcaggcagaatcatggccacacctaaagatgtcaacgttttaatttgaagaagctgcgaatatgttatgcaaaaagattttgcaaatgtgattaagttgaaatttgattaagttaagggccttgagatgaccttgaatcatctgagtggacctaatataatgctaagggtccttaaaagtggaagaaggaggcaaaagaggtcagaatgatgctgtataagacagacttgaccactttgaaggaggtgaaaaggaggctttgaagaaggaagggaccataagccaaagaatgcagggggccacaaagaaaactgaaaagccaatgaaacagaatctcccctaaaggccccaaaaaggaatgcagtacggctggtaccttttcagcccagtgggcccagtatcatacttctgtcctacagaaccacaggatgataaatttgtgttgtttgaagccactgagtctgataatttgttacagcagcaaagattaacatagcaactaagtagatgatttgttgcattataggtggtcacaaaatacaatcctttagtatcatgtattttttcctcttacaagagtaattacatttaaaaaagctatctactgttctagaatcactgtcgttgtttacaataaagtcctttaaatgtgcgcataaaaaactaaatgtgaataaaatgtaaataaaggaatatttttgcctaataaatacaaagaaaatgaaaatcccagcaacctattttttgtggatattaacaaactgattctaaagtgtacatggaaaagcaaaagattcagaatatgcaagacaatattaaatgagaagaacaaagtaggagcactgacactatccgacttcaagagttagaacaaagctatagtaattgaaacagtgtggtattggcaaaagccaccaaatacatcagtgaaacagaagagaaagcccacatagtcttttccacaaatggatctagaacaaatggatacccacatgcaaaaaaaaaaaaaaaaaaaaaaaaaaagaatctagacaaagacctcacactattcacaaaaattgactcaaaatgaatcacagacctaaatgtaaaatgtaaaaccatagaactcctagaaaataatgtacaagaaagttcagctgatcttgagcatgaaagtgactttttatatataataccaaaggtgcaatccatgaaagaaatcattgataagctagacttcattaaaattgaaaacgtctccttgatataagacactgtcaactgagaaagacaagccaaaggctaggagaaaatatttgcaagaaacatgtatgataaagaactgttatccaaaatattttttttaaagtcttaaaactcattaagaaaaataatttaaaaatgggcaaaagacttgaacagacacctcaccaaaaaatacatacagatggaatacaggcatatgaaaagaagctcaacatatattattaggatattgcaaattaaaacaatgataccactatgtacctattagaattgtgaaaattcaaaacaatgacaacaccaagtgctagtgaggatgtggggcaacagaactcacattcactgtggatgggaatgcaaaatgatatagcaacctcagaagacccgcaatattttacaaaatgaaacgtactcttaccatacaatccagcaattataatccttggtatttacccaaagtagttgaaaacttatttctacacaaaaacctgcacacagatgtttatagtaactttattcaaaattgccaaaacctggaagtaattgagatgaccttcagtaagtgaatgaataaacaaatcatggtatacgcagaccattattcagccatactaaaaagaaatgagctgttgagccacagaaagacatggagttactttacaggcatactgcgaagcaaaaggagccaaattttaagggctgcatactgtgtgattccagtgatgggatacattggaaaaaaaaaaaaaactatgaagagaatacaaagatcaatggtttgcaagggctcagaggagggggagggaaagagggatggctagatagaacataggagattttttagggcagtaaaactattctgaatgatataacagtggttgcatgtcattcaacagctgtcaaaacccataggatgtacaatgcagactgaaccataacataacctacagacttggttaataatagtgtatcaaaattggctcatcaaatgtaaaaaatataccacactaatgcaagtgttaattataaaggaaactgggggagtggtggggcgtaggcaaactctgcactcgttgctcaatttttctgtaaacctaaaattgttaaaaaagaaatagtgtattgatttcttaaaaccaaataatatataaatagccttataaaaaatgtcaaaccactcagaagtatccagactaaaacatttaactcccaagtgatgttttcacaccaatcctttcattcctggggcaaatgctcctcacagtttggtatttatgcttccagtctacttttgattttttttttttttttttttttgagatggagtctcacatggtcacctaggctggagtgcagtggcactatctggacacaccacaacctccacctcctggattcaagcaattctcctacctcagcctcccaagtacctgtgattacaggtgcccacgactacgcctagctacttttttgtatttttagtagagacagggtttacattacaatggccaggctggtctcgaactcctgacctcatgatctgcccgcctcagcctcccaaagtgctgggattacagccactagctaccgtgcccagccccagtctaatttttaatatgcttactattacacttatttccaaaaagtgttcaaacataaatggaacattttataaatatcattctgaaatttggacagttccttaaagcaactactagtgactgcactgagcattatgtgaaaaaaaaaagactccagaaaatacatgtgcaaggtggtcactatacaaacacacttttggctttccagagcattgtacagcaatagtcacatagtatgggctctagaaatacttgagtggttggcaattaagtcaagatgaaaaggaatcaggccattaaaatatagctacaactgggaggctgaggagggaagatcgctggagcacaggagattaagggtacagggagctatgatcatgccactggactccagcctgggtgacagagtgagacactctccaaaaaaaaaaaaaaatacaattacatggtctgacagttaaattctagagagaatcaacctttcatccacacagctagtatgccaatgaggtgtccactgtgtagggagaattaaccctctgcatttttcttaaggatttgagctctcttagctacacaaacataggaattgttatccccatcttagaggcaagaaagctgggagtcagggagcttaaataacttgcttgagatgactcaatgattggtgatggagtcaagattgaaaacccgggcaagcctccatgtctcacggtgcccctaaaagtactttctacaggtaacaagcacccaagtggtcttttcctcatcagtcccaaattggccgaaaagatcatctgtgaccaactggaacaggattatatccatatctcaattaaaaccatgtttccatttgccccttccttaaagcaaatcacagttctttatgtggattttttgaaacgtacaaatctagatttttttttttaacacattctggtgctcagttgcttaggaaactgcttttgtcattaggtgggaaggactaacacacttaagagagagaaaggcaaagggggaatatatagtaaacccagtgctgatgtgaattgtatccacagggactataacaaaacaatcagaactcaaagggaaaaggagcttttgagtgggttgtgaaataagctattaagtcatgcaaataaatccaatgtcaacacttcagcctgggctgattggatgcatgcattaaaactcatacttcataagaatttaaggcctctggtgttctcagtttttcttctttttcactttggggttttttggttggagggaggcatttctagagaaagcatgcctgctttacgctagaatcgctcatgaagtagagaatttgtgcatcaaggtttgaaacaatacattattccaagaccttgtccttcatcagtagtttcagcctttgccacatttctgagctccgtgctcaaaagaagcatctcttctcccaggctcctgcacccaaccaggcagggatccaacattcagataattcagacggtacacacattcatgacttcaagatgctgctgttgacagtcgtacaccttaacttgcagtgggtgcaaacataatcagccttttctcccacgaagcccatctttagaagcactgtgagatttttgcctgtcttgttcaagaccatacctacagtgcctagtgcgggacctggcacacatagtagatacgtaacaagtaatcactagtctgttacatgagcaagaaataacttttttaatgcaattgcgtggctgatctatttgtcaccaaagtgtaacctcccctgtccaatatgccatcactttattttccactgcaagcacaagatcttgcagctcaagaaagaactgtgctacatggcatgctctaaattcgacatgccatctcaatttaacatgatacttatgtaagccaatagtcccactttacagatgagatattggagctttatagaaatcaagtaatctagccacagtcccagagctaataaatgataggacaaggatttatatcccatcattttagctgtaaaacatgttcatttttttctttttaaatctgtgctgggctgtgttctgacctcaagtgaaatactgtgtgtttgtatcactcaactcgcacataccaaagtttaagtcaagagcctttatgacttataaaaaacaattgcttgagaggcactgggtgatacataggctcagttaaagcagaaggaacagcactagcatgtcatattggtaagatacaaattaaattgcagttagaaatggactgtcatggtagtaaaactatgggaagagcaaggaagtcctcgtttcggcgtgtcttcaggaacacaccggttaaccatctatttgcccaacccgatttggtctttaaacttgcctgaagaagccagttggagggaacagaaggcttctctcaaggtcaatgtctccctccataccccccacttcaggatctcctatgcatcaggcactgtgctatacaacgagtaaaacatagtgtttgcttttgaaaaattctacaatacatgaacagataattatggcagaacatgctaagtacaatgttatagtaatacagagaaaaacagaaaaactgactcagagcacattcaaaagggctgtttaatccatgcctaagtggagtaaggaggccaaaagttaatgaggagagcatcccagagagaagaaatggtagagccagtggtgtgaaggcaaaagccagtaggacgtatgcagagaagtccatgcagttcagtggtgccagaatgcaaaatgagaagcaaggagtggtaagagacagcaggaaagcttagcttactttttaagtcagccatgctgagcagcttgggcttcaacttgacaatgatgaacacatatttggcaagatttggcagaggacaggttggatatgaagtttagaaaaatccctacagctggtgtggatttgaatggaattggacagaagaccagcccaagttaggaagctgatggagagtcccagcaaaatacaggaatctgagcaagttttatagttttataaatataggaacatgaatgagaataggaatgaagagagaggactgctttgacaatgattccaaaagtaaaatattcaagaagggtgggaatggagtctaccaagaagaaaaactggataaaggcagaataaaaacttggaataaataatattactgaaattacttagcaatgttaataatgttaaatgtgtctgtggtaggcctgaccctctggctgtccattattccatatgtggtcttttctgactggcttctttcacttactgtaatgtttataaggttcatccatgttgtaacatgtatcagtacttcattccttttttttacaagatgatattgaattgacaggatatgccatgtttgtccattcagaaattgataagatatttggcttgtttctagtttttttttttgtttgtttgtttgtttgtttttgagacagtcttgccctgttgctcaggctggagtacaatggcacaatctcagctcactgcaatctccgcctctcaggctcaagcaatcctcccacttcagcctcccaagtatctgggactacaggcacatgccaccatgcctggcaaatttttgtattttttgtagaggtgaggtttcaccatgttgcccagactggtcttgaacttctgagctcaagtgatccactcgcctcagcctcccaaaatgttgggattacaggcatgaacgaccacgcctggccttgtttctagtttttagcaaatttaatgttgctatgaacattcacgtacaagcttttgagtggacatatgttttcatttctcttgggtatatatctacaggtggaattgctgaatcatatggcaattcgtttttcaaccttttggggaaatgatagactgttttccaaagtggctataccatgttacattctcaccagcaatgtatgttcaagttcctctatgtcttcttttcaattatagccatcctatgaggtgatgtggtatctcactatggttttgatttgtattttcttgatgactagtgatgctgagtatctttttatgggcttattggtcatctgtatatcttctttggataaatatctattcagaccttttatccattttttaaattgggtttatacaaatatttatatattctagatacaagtctcttatcagatatatgatatgtaagtattttatcccattctgtggagtttcttttcagcttctggatgttatccatggaaacacaaaagtttttaatgcttgtgtctttttccatttgttgcttgtgttgtctttttccatatgttgttaagacatcatatctaaaatattttgcctaatccaaggccatttgttatgcttatgtttccttctaagagttttatagttttagcttttacatttgaggccaagattcattttgagataatctttgtatatggggtcaggtaaggatccaaattcattcttttgcatgtggagacctagttgccccagaatcatttgtttaaaaggtttttaccatgaattgtcttggcagcacttttgaaaatcagttgatagtaaatgtgagtttatttctggaatctcagttctatgccattgatctttattgttatgtcagcactacactctcttgatcactgtagagttgtcatgagttccgaaaccaggaaatcctccaagttcgcactttttttcaagactgtttcagctattctcaggatcccttgaatttctgtatgattttaggattatcctgtcaagttttacaacaatatctgctgagattttgataggagttgcattgaatctttatggcactcaacaatttttggcacttttaacaataactcttccaatccccaaacataaaaagtcttgccttgtatttagatattcttcaacttatttcaaatatacataaattcagagtttatattttttgttgcttttaatttattcccaagtatttattctttttgatgccctcataaatggaattttctcagtttcattttctgattgtctatcacaagtgaatagagagaatgagtttgtgtatattgttcttgtatcctaaaaacttgctcaacttgtttatttctgataggttttttagtggatttaagatcttctatatataagattatgccatttataataaagtttttcttcttttcaaatatgaatgcagtttctttttcttgcctaatttccctggttagaactgttagacaatgttgaatggaaatggcaagaggggatatctgtgccttcttccttatcttaggggaaaacactcttttttttttttttttttacgttaagtatgatatgagctgtgaatttttaataatgctttttatcaggttgagaaagtttcatactattctatttccttgagtgtttttatcatgaaagggtgttaaatgtttttcaaatattttttctatgtctattgatataatcatgttgcttttatcctttattctattgatatgctatattacatttattagttttcatatgttaaaatgatcttgcatttctgggataaattccacatggccatggtacaaaatatgttgctggatccagtttgcttgtcttccactgaggatttttacatctgtattgataagatattggtctgtagtttccttgcattgtgatgtctgtctgttttggttaacaggatgctattggcctcatagaatgtagtgataatttttggaagagtttctgaaaaactgatattaattttttaaatgtttggtagaattggccagtgaagtcatctgaacttggacttttatttgtgggtagttttttattataaaaaatatatattcagtctttttacttttgatgggttattcaggctttatatttgtagaatcagttttgtttgtatctgtttaggaatttgttcatttcatccaagttatccaattcatagtcatacatttattcattgttttcccttgtaatcctttttctttctgcaaggtgagtagtaaggtccccttttttaatttttgagatggagtctcgctctgccacccaggctggagtgcagtgacaggctggagtgcagtggcgggatctaggctcactgaaacctctgcctcccaggttcaagcaattcttctgcctcagcttcccgagtagctgggactacaggcatgtgccaccacacccggctaattttcgtatttttagtagagacggggtgtcaccatattggccaggctagtcacatactcctgaccacgtgatccgcccacctcagcctcccaaagggctggaattataggcgtgagccactgcgcctggccaggtcccactttttattcctgattttaataatttgagtcttctttctttcctgcttagtcagtctaggtaaagttttctctggtttgttcatcttttgaaccaactctggttacattgattctatttttctattctctatttcattaatttctgttccaacctttattattttcttctgctttgtgtggtttactcattttatagtttattaaggtgaaacataggttactgatttgagattttttaaaaatacaggtacttaagctatatgtttccctcaaagccctgttttagttgcattctatcagctgttatgttacatcttcattttcatcaatgacataaaattgtttctcattttcattgtgattttttaaattgactcattggatatttaggagtgtgttgtttaagttctgtgtatttgcaagtttccaaaaatatgttagatttctaatttcaccttattgtagctagagaatatactttatatgatttcaatcatttgaatatattgaggcttttatggcttagcatgtggtatatttggaaaatgttccatgtacacttgagaacaatgaatattgaaggttttatctctttctctgatatttctgttgtctgcctcaattggcctcacacccagctgttatgcttcactaattactggataatcattctattgttttgaaaaataccctagaggcataaatttctccacagtctgacccaattaaattcaagggcctttgggagttagatcttcaggccaatttttcgttactccaggagggctctcttacctttacctttctttgattctctctgatcatctaggtaatcgatgggttagcttgtagattttatagagctaccagcctccttttaatggcttatcaccacaatgtctattgctttggacaatgaccttagttaggcttgacattccccccactgtttcaaatgaaatcaattcctatgagcttcagagttcttatggactgcttctacccctagcaaaatctgagcctggagctccagagctggcaggcagagtaacacctatactttctgagtaggggacttgttgggggtggcagcctctggctttcttagcttgcctctctcagcttgcctctctcagcatagaatctgcctatgagtaagctgaggcaagggggactggggcctcaatattctcagcctcccatacccggggtagaacatccacctaattagttgggggtaggtggaagaaggtaattcctaaactttccgccactctcaccaagaacttagcctctgcagtttagggcagagggaatgagaaattctagtgacctgttcctcagtgagataccatatcccttgactggaagctgaggggaaaggcagcaccatctctttggccacatctgcccagagtggaggctccatctcacagagctacatgaaagggatagatagcaggctgtgtctgacatgctacagactctcatgttcttagggagattcttcagatttgctcacataagtgcttttgatttgtcatattccattacaataatttccagagactttaaatgagtttctttatatttttcatcagttatggatgttttctgggaaatggtccatggaacaccttattctgccattctggaaataaaactccaagaaacttctctttaagcctctgagacttagaggttgcttattactgcaggaaagcctagtttagcatgatgaaagccgtgtctagtattaaagcagaattaaagtcaactcaaggaaagtaaaatgattttccaactctatctttctctgataggttcttgtcccttaaagctgagtagccgtcactggccagattctagaataatgcccttcctgtttttcttttgttctgttgtccccacttgattgctttaatgtatctaggtagactgcctctattaagaagtcccaagttaatgtaggctacttgcagtctttgaaacacagtgcccatttaaagatgacaatcctagaatcataagagcagggatacaaactattttattcactctagtattctcagagcctaaaacagtgtctggctagcctgacacttgatagctgctcccaaaaggtattttttgaatgacagtgtcaggaccttgctcctgttcctttgttacactggctgccctggggatcaaagcgtatgggagggctatttgtcttatgttatctttctgaaagtatcctcccagagactggttcaaacaggaaccctacctgactcctatgtcctaaaggactctatcaataaagtattccaagattcttctagccaggaggtctggcttcattttcgaagttatctcagaaacctaaagtgtgtactctggtatcattaactgatgtgacacaactagtgtgattccatcagttttataaatgacaaccagtgtgaggaagtcgacaccaaaagaagacactactggacagaaggcaaatgattttgaataatcagcctctaccctattcccccagggagactaaaatgcctaagcaatgctctcgttgatcacaaaggatacatgtttgtcctcttgtttagagttgcaagaacccactctttccaaagcaatcaaaatcctatattaaggggaccatgtctagaagctctggaaaattcctggaatagtaacacaaaaaaggagtcactgtaccaccaccacaagcctctctgggaactaattgtgttctagatgcaagagacacttaacccagcatttgtcttagcagtgtctgcctactatgtgagccttacgccatccctgagactctgccaggcccctgcccatccactcaacacttacagttgaactttgccaggaaatctagctcatctagttctccagctttctaatccttcctctcacccaagactgacccactccttgtcctatcttgacgtccctctggtttatacagagtaattaaatcactggttaattgatgaattcaattaaatcaatgtcttacctgagtccctgttaggattctttaaccttttttggaaaatagccacatgtcaaatttactcacttcttcccaggtcattaaaaaaaaaaaaaaaaaaaaaacacacagaaataactgagtaaaaaacactctcaatctttgccctcttggtatcagctttgagacacctggccaagtacagcctgtgctaagtttcaaagaggaggcagataactttgaagattttatttcacaggggacaacagataaaagtctctgtcaagttgtcattagatgcttaatgctattcttggtggggagcttgaggcgcccctcctcctctgtagacttctagcagattaggtttcagagctttaatttgaggaaggatttacagctgtgaagaggtataatatcattttgatttgggttgtactaggctggggaagccagattacatttgtatgaaactgtattagaccatatgactgaaaccaccaaaatcaaataaagggaaaattttccagagagcctaaaaacaagagcctgtctttccagcacctgagcattgtttcactaactattattctgatttacatctaggggatccatgcagaaatgcggagggagatggcaacaatgcctgtgcttgctggacctatccattcattaatctgtcatcaacctaatccaggggcccatcccctagaacaagaggaaaaaaattaacacttagagaagaggggaagttggcagggggaggggagataactttatgaaaaatagccttctttcatctccggaggcactgtctaattcagagtctcaaagaaatccatcaaattgtctctctgggcctcagtccatccaccgccaccatatgctaccatgtgcgtgtgtcgcacggcatccccagataatgacttacgtgggcaccgtgcctttcctctagaaccatcttaatgctattttaaaatccgactctcatttgcatggaaaacaataaatcactttgggtaacacagaaaacccagtttcttctgagatgaaacatgaaaaaaagagttagctgttgtttgtaccacacagctacacagaactgggcagactaccagcatcttctactgggatttagagatggacgcaagaaacaccacgggtaggactctgaaaattgaaattatttttgtgccagtctctagattcaactagaatgtgctcttggctggggagaatttgggaaagaagtgttttttttttgttttttgtttttttttaattgcaactactaagtttcaaaaatgggggaaaatcatgaagacagccacagacatcttcaggggctgactaattcttaaatgattggttcctctaagagtggttagtggtgaaagagtaaatgatgtatgagaacgatttctctgatttctgccaggagttctactcactcagtaaccacagggaatagaaggatcaggttttccacagaaactacttttagcacatgctgtgtttctacacctgtacttctcttccgaacaactatcttagctccaagttgacatggcccgttaccaaggggctccatgtcttttgtttttgtagtaaagatgacttgaatacagaagaggtgttgtaggagagcgcgtcttctccaaatgctggcagatgacagtttccgcagggacgtaaagaggtgacaaaggcacagaatataatttagtcctgatttccaggtctggctcacaaaactaatcggatgaaaatgtggccaaaagaatacctcggagataaactttctagaacaagctaacgccataatttgaccctaattccaaaaatcatgggaaggacatacttcttagtatctttatcttattctcaattaatcaacaaaccttaatgtaaataaattttctaaaattcattgtcaccgaggaaagggttaaaaaaaactaaagttctcttttgagaatggatttctttccctcactaccttcttagacaatacaacagaggttatttctagacccagaggagacaatgcaacatagcttctccagcctttggacactaagcaagttatcaataatgcagaatcttgaaacctgacactaaactccttcagaggtaggtatcttgtgagcaaaagagaacagagtaaaaggggcaaggatgggagagtgtaagaagaaccatgctgtggacattttacttcttggggtgttagtttccttctatgcaaaatacaactgtagattgccacaagcctaaacaaaatctgtaagaaataaataaccttcaaagcaatttaataaaaagaaatgtgcccaaaatatcctcaaagactttattaatctagggaggcaatagttaggaatatgagacatgagtcaaaccacctgattccacatcccgattgcacgatgaactagctgtgtgatattgagcaagtgacttaacccccagatttcctacctgtataagaggaataatgaaagctccacaactactgcaaaagctaaatcaaataatatgtgtaaagctgttagtacaatacctgcccccacagtaaacacacaataagtattagaaatacaacaaattattatatttaagtataaagcggtaatctgtacatacttggaacatttctgacttgagaagctataaaatcatggatcaaaacagttgtacaaaagatggtgttatgtgaggtcctttggatttaatataaggagccaaataaaagcagtccaaatttagaaaaatctttcaagctattccgcgatgactgtgtctgtcatcacttgggaaaggaaactgtatgctactcgcattctagagagctgttaggaaatgctagctgaccctcaacaaaccttcagcctccccaggaacacagttaggcagcttaatttgggcaagcgaggagaaagcatgagcccgtacccaagcactgcctggtttccatctgcgcgatttaaccacaagccacagagcgcctctgcggacaccaagtccagctgccagggaaaggtttcagacccacggtggtgtcccaacaatttccagttcagtggaaatctggggaacgcacaggctcatagcatatgatttcttcatgtttcattagtttccaggttttaaacaattttaaccttctctctggcacagagctgctgtactgtaagtagaaatcactggactttgagtaacatgagcctgtttcacgtttgtgggtggacatccaattggcacagtgaccttggccatgtcctgactcctctgagcttcactttcctcatctgtaaaatgggtgaaagccaacttcagtgagttctggggacacaaacatgtttcacatgtgcctagatagatgctgttagtctcaactcatttgctatcctgaacttaaacgggttgccaatctactctcacaccactctaaaacaacaaaaaaaaaatcttttcaaaagctaacaaactgaactaggagacgaagaaagaaaattcaccgctacataaattagccaggagcaaagcaagaagctgcccgagtagggcagttggcttcccacaattgattctttaataacttctgtaatatttctgaggcacatcaaaggacagtaacagcccagtgttggtaatccctctcacatataaaaactttcattacagagtgttaaaggcatcactctgcttgagaaatcgcaatcaatagacgttggccttttttcttcttttctatcctggggtaacggcaccagcattttctctccagtaatgcagtgctgtgtggccagagtttcctctgatgctgcagacgagcaccaagatgaaaaaatctttgtgataaatgagaaagaggagaagaagtttgggagaatacctctctgtgttagaaacccgaagtgttccatgctaattcaccctaaatgctgtttgcaaatattggcttagacatgcatttaaaagtcacagggatttgttttaacatgatttcttttgcattcccatgtggaaaataccttattttagagtgagacgccatctctatttcccaggctggagtgcagtggctattcacaggtactatcctcaacccacaacagcctcaaacacctgggctcaagcaatcctcgcacctcagcctcctgagtagctagagctactgcatgccccactgcgcccagcctataaaagatttcaattgaaaaatgtttccaattagcaccctaagagcaggataattttggaatactgcagcagatcttagggacacaaactaaaaggacagcaggcagtcattaatttctttgttccttattatctataatacaattgttagagtcagaaatataaaattacttgcagaagtttttttaaattcagcctatttgtttcctttgaaagattactccaggttctttaaaaagccagaatcacatttttctttttattatgaatgcataaaggccaaaggccactcatagcatctccctcgtaaaccgcatcttgccaaagcccgtggccaatttctggcctccctttactgaaccacttagtggcatttggccagttgaccactcccctccttcataagccgttttcttgcacataaaccccccaaccacactaccctttccccacctctactacctggctccatttgtcttcatagttttataggaatttaagtcatctatttgtgtgtatgtttattatcttactccatgtcccatgcctagaaatccctggtaagttgtagatactccataaatatttgctgcctggctgactcttagtattttcttttgacagattaaaagctcagaggagtgaagccacttgcctaagactgcatagtaagtggccgagtcagaattggaactctgagcccatactcatgacctttatataatagaaaaagcagcctcgggataaatgtccaagagcagggttggcaaacttttcccttaaacgggcagacagcaagtatttttgcctttgtgagccacatatatatatagtctcttgcatttttaaaaaagaatactttaaatacataaatctattattagctcaaagggtcatacacacaggccacagctgaatttggtcttagtttgtcaacccctgctcaggagaataggagcattttctactggattcatgactttaacccaggcccaagaatcctgtgcagaatcaattaagctttgtacaatgattttttttttttgagacagagtcttgctctctcgcccagactggagtgcagtggcgccatctcaatctcggctcactgcaacctccacctctcaggttcaagtgagtctcctgcttcagcctccagagtagctggaactacaggcatgcaccaccacgcctagctaatttttatatttttagtagagatggggtttcaccatgttggtcaggatggtctcgatctcttgacctcatgatccacccgccttggcctcccaaagtgctgggattacaggcatgagccatcacgcctggccagaatgaatgaattttaccttcatcctctagacaacaagatcctcaaggttaccagacttgggcatgtcctacagttaaaaaacagttcactttccacaaaagggagctggataaattcctatggatggacacaatgatcaagaggaggaagaatcctgataaattcctatgtagtaagagaaaataacgcaagatcaagagtggcaaaatgctgaaaattttgtgttattctttttccaattaagaggctttcccccgctatgaagtaagcaggcatcaccagaagtgagaggaggaaaataaccgctctcacctctccagcgtcctgtgctcctatcctgctgagactgtcttttggctactacataaaaagccaaaaaagtgagtccttcacagcatgaggatacttttagctgttggacacggagaaggttttctcttggtcttttattcaatcattcacagaaagggacatcctgtgacctcattttcactctaaagtaacagagaaagccaagtggcttcctgactctgggttctatagaaacccttgctttgatggtgcctttctcctcctctgaggccaagtcatggtgggggctggtggggcttccttccatttccaagacaggtggatctccttgggaaacagctgctgtctgggaatcctggcagcaccagggatagagagagaagagaagctccagtttcaaccctctgagtcactgcaaaagaatccccttcattaaaactagttctcaagggaaaggtgcttagagaaaaaaaaagactcagcaaaatgcataggacacttgggtaggagacatttcattatggccactttgatagcaccactttgaagcagtcattttgattttggtatgaaacttcttggaattttagtagaagttagagaattacctaagtaaatgctttttgatcaaaaataatttatatttgccagtttgtctttcatttctccccttaaagataagggctatgcctgtctcgtttaccattccatctctagtactcaatatggtacctcacatataggaagggtatatttatttaaaaaataactactatgaccatcactactactgcctatgtccagtgcttacattagatacataataatttgttgaaaaaatgaactgctaccatcactactaccattattgccacataattactattgtcaccatcattattcctattggctgtctattgtaaagccaatgggacaagcattatgcttagattatttcaattatcattcccatttcatagatgtgaacactgaagtgcagagaagtatcctaaaacatatatacagtatgtggtaaaaaattgaattaggttattattatgattagtcttgtcaagtaaattgggagaaatgaataggctgagagataaggataaggttgtacttagtgcctctattttggacttttaagcatttcttttcacggaaagggaccagggattcttaaagaaatgactgattccagatctgctccaggaaatagacatgatgaattggcaaattttgttgtggaaagctatcaaaacctactagagtaatgtcaaaaggacttggagctaacttgaaaggggctcccactggccaagacaaatcaacttcaataaaaacaatgaaagtggtagaatgaaatagatcaaatacacaaacattcaaacatttcttaagagtaaaaatcaatggtcacccttagaagttgccaggacaccaacttatgatttagaaaatattaacaaaaagaaactaagggaaattaaacacttaccctgcctttcctgtatggacaacctttcaaagtaacaacacgacatggagggaacgtttttcctcatagaggaatcacagttaataaaagcaggaggaatgacagatttagaaaatcaccatttcacagctcttaatgaaataatgggtctagacaaccaccattcatagctgcaaaacctttgccttaaagcttaattggaaacttgatatttaaggcatcacactgacaacatgtgaatctaggatcaatcctaacttaactaaatgtgggataatagtacattacatcagtggttcccatactttgaagcacattagaatcacttggggaactcttaaaaatcttaatgttcaggtcgtgtaccagatcaatcaaatcacaatgtctggggtaagagtatcagtaattttaatttgagatgttttaggtgattccactgtggagcaaagttcaggaatcttttcattttatggctcatggtgtgatgctccctatgatatattaatgttactatcatagggagatatattaacatcctatgatatataaccaaatatttaccagaaacagaagaaacgtgtttaagaatgactacaaaaatgcaaatcagaaatcaaatgtgtgaaaaattcaaagagggtgtgaatggcatatcttctcaacaaacaaatgtcattttaaaaaatggtgtgttgggggtgggaatggagggctttccttaaaacatgactggaaaagttatgcttctggctatgaatgaataacttcatacatcagactaatcctcctgcagaaagtaattgtgatagatgcataaattaaaaaaaaaaaaaaagctgttcaaaagcatcagagcacaaccaaggcatgcaagattcaagcatcctagatgatgtaggcaaagaaagcccactgaggtgagctctatagttaaagcaactttgtgtcctaagggcatttgcgaatttgcatcgtgagggaataaaccaagtagaaagcagcagctagagcttgatgcagtttctgagctagagagagaagtttggaagttaagggctatagaagcagcagctaggacttgagggactaagatttgtgagaacggtgaaccaaagaaaagtgatcccaatactcctaacgtaatttccccttgagatatttgcaaattcctaaactgcaaacatatgaagagaccaattaactaagcaaaaatcaatgctaaaagaccaaaaacgaaggagccattttgtcagtctaaaagggttggggagacaaaattgcaatttagaagacactaaggagaaagggccatcgtaaatgccccaaaatttcatttgagaaactcaaaaggcttgaattgttaggacaaactagaaatagaccacagaatttgaaaaatatcatttctggattaaatcaatataacttgcttatactgtatccacctgccagaatgttaacatatctctgcaagaagataaaatccacattaaaggaaacactaaaaggaactaaagggggttatttgggcagattaaaaatttcccagatgaaagcatagaatgtaggatggaagaaagagtactaggtaaattggggtaagtaccactctaacaatttaatcaagagaaatgaatacatgtccacacaaatatctatacataagcagcttcattcacaataatccaaacttgtaaacaacccctatgtgaaccaagtgaatggatacacaaaatgtcgaataaccatacaatggaatactattctgcaataaaaaggaacattaacacatgcaaccactattctccaagtcattatgttcactaaaggaagcgagacacaagggagttcatattatgggttaattcattaaaaatcctagaaaatgcaaaatcaccgctagtgacagaaaataaaatcaacggttgcctgagagctgggagtgacagaaggaaatgtccacagtgtggcacaaggaaagttttaggggtggcagaaatgttctgcaccttgattttggtggactcatgggtgtatccctcttttaaagctcaatgaatgaattttacatgggcacagtttattatatacacactataccccaataagctttttttttcctaaaagacagttgaaattccccaaagacagatcaaaaagataagttgctgtattattctattgaagtttaaaaacagataaaatcaatccatgattattaaaatggtgtatatcttgcagagcaggtgttcacttagtgaacaggaaatttctgggtactagtgctagtgagtggtattttctacatctttgagaaatagttacatgggatgtttattttgaaaatatttattgagctaaacacttaaaatgtgtgcacttttgctgtttttgtcatacttcaataagaaaatttaaaggtggaggattgagagaaattaaagaaaatccaagagacaaagcaaccaaaggcaatgcatggatgtcatatggcttatgattttaaaaactcaactgaaaaaaatgtgaggaaatgaatgaaaatcaaacatggactatttatcatatattaaagaatgcttgctcattttattgcatgctactgtgattacatttaaagtccttatctgctaaataaacatactaaagtatttataggtgaaataattgagtaggatttgctttaaacatcagcaaaaaagaaacacacaggccaggtgtggtggctcatgcctgtaatcccagcactttgggtggctgaggcaggaggatcacctgaggtcaggagttcaagaccagcctgaccaacatggtgaaaccctgtctttaccaaaaatacaaaatttagccaggtatggtggtgggtacctgtaatcccagctacttgggaggctgaggcaggagaattgcttgaaactgggaggtggaggttgtagtaagccaagattatgccattgcactccggcctgggcaacaggagtgaaactctgtctcaaaaaaaagaaaagaaaaggaaaaaatacatgtgctcaagtataggttgatcatcatggaagttggatgacagatgcatgagaatccatactattctcttgagttttgcatatatgtaagaatatttttacaaagtaaaaatacaattcaagtgaagatgaggtacaaggatgaggcagagggcccaggagggtgtgaagatgtctattgtgcctatgacctatattctattctttgcactttgaagattaaaatacccacagcatcaaaatggctatgtcaaaatgtcttgcttcagaatttgcatggcaagaattttctcaggggcccagaaacatgacaagcatgaaaagaatgaaatttacgagagtccaattaggtcctgaatgacagccaggcagatatatgatgacaaacagtgtccttcgtttctccagagactgatctactttgggcccaaagagaggaaagtgagcttgtataatcctgggaatttcaccatccttcttctggtccctagttatctccatctgaagcctattcaggttttggaagggagagaataaaatgggcagccaaaaaccagattctgatggcatcagtcagaatcctgacaggacacagatgtcatactcctctgcaactttgaagagaaataaactattttcagaggtggaggttgggttacaaggtaaggatttgaagcccctggtactagctacagcagaatgcctttagtatcctgggcctaaaaaagcaaagaaagagaacatgttatcagagcctggtgaggtaaaggtgggtgggttaggggtagggggtggggagtgggacgactatcatcactgctacagccttgaagggacacagaccctgaaaaacatgatgagaaagacttccatgggagtaaacatcccccatctctctctctctgcccattgcctggtctctttccagtacctcccattgaccaagcccaaactggaagacagagacatggaagcccaggtgacacagtcaacctcctgggtcaacaagcagggcagacaaggtcgcctaataggctaggaaggcgggggatggagaattaccagcacatgcccccaaagggtaatttacaccacactggaatacataagatcttcaaagccacagttagttagaaatgatggccatttggcaaaagctaattcagtcagacccagggttgcagatccttaatttaaatggaactgagtatttctaagcatttcacaagaggcccaaagacaatgaatgataacagattctttacccacacacacacaccctccccatgggggaaacggtaaggagctactcatgctcattctcaagtttgtaaaacaaaaatcttttcttctatattagaaatttccaaagtaaatgcacaaaaaaggggagaaatgtggttgcattttccattgggctttaaccatcactctgcgaaagagaagagttcagagcaaagtcatcacaggtggaaacaatctcaagatcagatgggagaggagtatcctcttccccccacctcccccgctccaggggtatgtggtcctctcttggttggtgatgccaaccctgcttcctctggccctgggttttgtacctgctgctttctctgcccttaatgtgctttcctcccttccttcacttgttaactcctattcctatcttagctcaattgtcactttccagaggaaactttcccatgttcactaatgaggtcaaagcccctaagacatactgtcatagcatctggaacttttccttcatgaaagcactttcacagtttttggtatggctgtttgatattgtctatctccccagctgaactggtagttccacgtggcaaggactatgtgtatctttgagtaccattgcatttccagggcctcacatataatctggctcatagtaggcacccaactattgtcgaatgaatgagtcttcactgcaagataaagtgacaacagttttccactctagagaccatctacgtttttccctttcaatgtacaacatgattttgttttctttcccccaccccccacagcattaaattactggaaacacatcctatgctcatagatgggtagaatcaatattgtgaaaatgaccatatttccaagagcaacctacagattccatgcaattcccatcaaaataccatcatcattcttcacagaactagaaaaaacaatcctaaaattcatatggaaccaaaaaagaacctgcatagacaaagcaagactaagcaaaaagaacaaatcttaaggcatattacccgacttcagactatactacgaggcagagtgatcttaactgtaccaagctaaatcctacatctagattcacagatgcaaaagtgtttaataaaaccaagttacttgcattcttaggctcatgtagatgctgtacgcagatggtcttctaaataggttttagatatgtcaaaactttctccagccacaaagtcaagaatgatcaccttagggttgcagtatactcaattatttatactccttctatgatcaagggtagtagtatctgcattaagtagtttcctccaaaccagaaaggaacgaattggcagaatatatttccttgcctccagaaataacttatcatcattagaatcatctgatatttttgggatctggaatctatgttctgtatttgtgagggtaactatgagacttgaacagtccaccagggatcttaaaggcatgttttcaaaacacagcccccatcaaaacagtgtgctgttaccaaatatgtttgggcaatgccactgtgaaatttacaacatacactaacagagagtttgagaaatcccatggctggtagagcttggcaaagggaaatgtgtttccctcacatatctaactaggaaaccgtcatttcaaatacttcctcttactatcctgaaggccatattttaggaaatgctgcactggaggaaagatgttctagaatagacaggtactacaagactgaaaaagagaaaatttaacatgctttcctgctactgaatctattctatatatcctgtttttcttcataggtgtttgccccacaatatttttgttttctcattatctctaatattaaaatgggagaaaacagtaatacaagcatgttgaaaaactgataccgtgaaatattgaaaatttgaaattgattaatgttggttcctaaagcaaattattttactgaaaaaaatggttctattaatctaaatagatacatttattaatatgtgttgaatacataggtatgtacctaggagttttgtagagagcatgtctgtttagaaataagcatacaaatacataacttcatgtaacgagtatgctgaacaagcatgatccattgcataaaacacaacattttactctccttgcccctctaaatttgattaggtggtaataatcttcctttgcccttggataaaaactacagcaggcccacgagtttgctgttcacaggtaatgggcagttctaaaacaacttcaggttacacatacagtcccaggtgagaaaacaaactccacaaccatgttgcttttgtatggaatctttccccttctcagcttggccctgcttcagactgaaagcctccagatcaccctgtggcccctccaccttattagccagcattctgcctttctcaaggttgaagaaactaagagacagaagggctcctccttgtgctagttctgttataatctagcttggctgtctctgggcctggcagatagttagggctgacactttctcttttgataagcttttatggattctgcagaggtttcctgttgggttcttttctcaaacagctcactagatcccaggtgggtggccagggatcccccatcccaagccccaggtcatctaggcatctgccttggacttcatatgctacttttccatgactccttcagttactgtattgaagtatatcaaaaacaaccccacgttggccctctcctttgcacagtccagaactgatccccaggaaacacacacatctcatgccttgacaaaaactgggaaatattggccacttcgcaagcaggagcattcctaccctaccacccaagcagttggccagcccctcttctcctggccttccagagtttcagggtgagtctcaaatgcatgggccctctaaacttcccaggcttgatgcaggcacaagcctctggttttccaactgcaagaaataattcagagctttctgattagtcctcttaatgcctcctattggggttttgggttacaagatagtacactctactttttctcccaagagggtaatgatgactcaatacatggccacagttgtctctaaagagacatcttctcttgtctcctctggactcatatatacaaaagccatggaccaggatcatgactttctatatgaggcagctgtcttttggtcgctgtattatgggtggctctgtgaaactgagacaatagacaatacaaccattctaacatcctactacctacgtcgtacacatatatatgtgtgtacgtcatattttactatacggtttctataacaacttcaaatagttaacgctataagagcctcaacactccccaattcaattataatctccagctttcactgatcactgctgatttggttataaatgacttcacaaccaaaagcttaccttgagaatttttcaatccctatgttcccagattcaaataaataaaacctacttgaaatatgtggacttaaaatagtcttccaacgcattcctcacacatgaaattactctcgaataactagctattggtgacattcctgatagtgccctagatttctcaacttttgcaagagcccagatggtcagaaagaactttaccaaatttggttacttgtttttaatggaaggattttaaatgttcttttaacaatcatctcagctgcatttaaaggctacttagcagtgtttgcagctaggagaacagataattaccggagtgaactagcaaattcctactggttataacctgaaatgggaagtaatacatggtcaagaatgtaaaaaattacttatatatatatacatttacgcacacattttttaatatcaagtgagcaaaatggtattaaatctggttaattctgcccatgtccatttgaaaaacaaccgtgtaatttgcctaagaaaaaaattctctcatagttaagtcagatgcctaattatatcatcctttatctgggactgtcaaaaataaaacattttggatctattcacaataaaatgacattttcagattcaatttcatacaagttttttatccattatgctcacagatcaaaagtgactggattcatcagccaaaaagaatattttaaagagctgctgagaactttataaaaataattctgattttcttttgtgggggaaacaatttcttttagaggagttagaaaaaagtgagaaaaaattttttgaaagaaaaagaaccaccaatgttactagagagcagagttgacatggcgttactcacagtgactggttaagggtaaaagtgggggaaaaaagcaaaactgtaaagtaactgattatttcactgtcttcacctggccttaattcaaatcagaacacttctcccacctgcattacttcaaacaatttaccagaaaagaagagaaaatgtggattacataacccagagcatatagagcgaaactgcaatgctatcattcagcaatcacagtgctctagtttatttttaaaatagctcagaattggccatgctcaagaagtggtcctacatacagcaagagagctcttcgtttaatacaatacagatttttcctaacagcttcctctactacttcacatatttcttccatatccctacatggccctcctaagaaatatacctttagcaatgaacactaggaaaacatatcgttgtggaaaggcatgggagagagtctactctctttacttgctttagcgtgaggcagaaaatatttcttacagggtagccatccaatacctgagcactttcaaatactctgcagcaggtaatttgtttttcagaagggtgggagttaaaagtaacacagaaagtcataatggggtgagagattagacttttctccaaagttacagcctttagatttagctcctgcaattctgaagggcctcagagataaggaaatcatgttgcaaatgtgagaagtgagatttagagaggtgaagggacctgcccaaggcctcctagaaagaagaagagactctggtactcgaggccctcaagtccagggttctttccacttgcccaggtttatccctggttgtcctctcctctgccccttgatctgacaaatgttcaaaggattacttaaaatagtcccctgctcaaaataacaagggcttgccaaaagaagaaaaacaccttgaaatagagattccaattaactgcctctgattgctggataactcttcaagactcccagaaaccgattctagcagtatgtgttatttgtttatagccaacctttgttccaaaaataacttgatatgttttacagaaatatgtagaatacatacaatgcagaaaattattgcaaaggaggaaaaaggatgggaaaagctagtaatcttggggatgaattgtcatacaccaagaaagcaatttatatacctggtggcttaacagcaaatattataatcaatgcaataatagtgacccagcagaaatacactgtgagttgaaataaaatgttaacaagagtttgtggggaagaataagacacaaaagtcctgataatgtctcaatatgcagggtttggacttctgaagcaggtcactcctaagccttcaagcttaggaaaaaagggaaaaatgagaggacagaggatagatgggacgacaatggggtggggagtcagggagtgggtagagggaaccacaacaggttgacgtccacctaggtatcacttatcaatgaactgaaaatttatcaggtaattggaagctcaaattcatacgtcacctggactgaactgcgcttttgttatttataatgcaatatggtataaatcaattggcttggattttaaaattagagcccaattacctgtgtaagggaatcataaatccaacttgtatttttctaacagggttaacaactcatgatgccagcttaaactcaggaaaatcaatggtctgggcttaagaacaattgtgcgtggtactttatctccctggtctagtgtagcaggtgggcagtctaggagttgggggtgaaggatttgggggagggtagaagcctaaagcaaaggaaacaaacagaaaacattgaatattgctaaaaacaccacatgccaggtaaacaggaaggggggcacttacatatagtagacagtgaaaatctggacacctgttacttgatgaagcatcgcaggagcaaaggcaaaacactcctgttgcttttcttgttctgcaaaactctccagagctaagagagctaatgtgagatgaaaagctaaaaaaggagcgagtcagaactcccactgacagctcccaaatctggcccttcctaaaggcgtttgcgcctgccttaagccagagactcccttctcaggtgcagtttgttgaccctctcttcaattggaaacatctgaggttcactcagtgataaggggcacgtggaggaataaagctgtggcagtggtggaggaattaatagtccaacttttatggagggcagttaacattgtgtatgcctgtgtttatgtaagtatatatacctacatatacacacatatatgttatatattattgacatagaaattccattttcataaaattctccttgagaaatggttgaagaacagtgcaaagatatacatacaaaattcttcattgcggccgggcgcggtggctcacgcctgtaatcccagcactttgggaggccgagacgggtggatcaccaggtcaggagatcgagaccattctggctaacacggtgaaaccccgtctctactaaaaatacaaaaagaaattagccgggcgtggtggcgggcacctgtagtcccagctactcaggagtctgaggcaggaggctgaggcgttaacctgggaggcagagcttgcagctagccgagatggcaccactgcactccagcctgggtgacagagcgagagtccatctcaaaaaaacaaaacaaaacaaaaaattcttcattgcagcattgcttctaagaaccaaagttgcacacaaactagaagtcattcaaagggggtgatccaagccaagtgtattatatttcactcatacaatgtaatactatactgaaattataaatgacgatataaaattctatggacatgatacgtggtaaaataaaacaacaaaatagtattactggatgtgtcaattgtgtgagtgtgtgtatgtgtgtgaataagaacgtgtgggagaaaatcctgcatattaatcaagcttattgctgttgtaggataactgatattttttaatatttttctgttgtgttggatttttaaattttaattgttataaaatagtcaggtattacttttataatctggaaaaaaaaacccagcaatttccattttggatcttgaatacagtaggaaggatagcagggtagcagcagttactgggcaaagcagacgtcaaccagggcctaacaacaaggctctcactgcacaaagcaccagcacctgtcccataatggcttctgttttcacacaaaattccgccaactgggtacatcttctcaaagaggggaaacaaatgcaccaaaattaattgtagaacttatctttatgttctgggggccagaaaactcagtctatactgtgcttctgagagcaaataatcctttctaggcctaaaatacagtctgtcttctattttgggcttgtggtacctctgttgtctcattgttcaagtggatgtaaaagtattaattcaaaaaacccatgttctctgcttaaagcacagaattgtcaacaaaacatactacagaacacatgcctctcactcagtcatttctttgtcttagtttcttgtggtctattccatagtaaggaatttgcaatgttggagtaagagacctaagaggaccttagagatcaccccattcagcatcctcatttttcacaagagaaagcccagactagtcatcaagtgagctagccaggactaaagccgagggtctggtagtcagtccactgtttatcacttcagctctaattccattcaagacacagctatagcttcccccttctggacaatctgaatattcctttagctaatgttgaaataaatcagactttcgacatctgatgtgacatacagagagaaaaaggcaggaaatctaacataatgtactagttagcttttccaaatgcatgagaaatactttcaataatggaaaacactacatatactactttatgcagtcgacttttgcttctgtgatagaaaagggaaaaagttcaggggaagaaaactacgcgggtcatttggtgacgtttttaagatttttactttcagaggcacataatttaaagtgtttttctttttcttctatcaaaaccaaacatagttactagaaaacatctgaaaaatgcaacaaaattttaagaagcaaaaaaagaaaacatgtcacacaattcagccaacaaaaaaaccacagttaaaatgttagtatagttccttctaggtttttttcctttttgaatggttgagcacttcatatatataccatttccaagttttgttttgttttttacctaaattatacctaagcattttatgaattcattaaaaactatttataaacattatttaatgtatgaataatattccatggtatagagtgccaaattttattttttctttatttatgtcatttagggtttttctattatacattattctatgatgagcattgtaagaaatccatcttgatcttaatttctgattattttcttgtcttaaattcctaaaatggggaattgccagattaaatactatgagcattttaaattaccaggaagtttataacaaattttgttgttcctaccaaaagtacatagaagtacccattttataatcctttttcagtaaaacatattttcaaacctttgttaattttacaggtggcaaaattaaaattaaaatttattttaacttgaatctttattattgaaaaatttggtatacccattggccattgtggccatcctttggcagatctactcttgaggtcttggcccatttatttactgagaaaaaaggaaagcattttgatagatccaatctttttttttttcaataaataaataatgaatttttaaaataaattaataaacttatttaattcactaaagcttaagaaacacaaacttctgggctgatcagttggaggctgtagaaaaatgaacggaacacactttttttccaagtatattttgtataagctctatctaattaatgaaaccttcctgcaactttctgcatctgctcattccaagcattagattaacaaacggttgacataaaatgaagagctacatggtatttctttgacatgtggcatataaaaatcacaaactctgtctttaaaaatagagtgttctggttcacactggtccactgagcaaacctatttactgcctttcccacccaaaatactttctaaatgatactaaagaaatgcaaaagtgcaaactcataaccacaaagagaatgggaagaagccattagaagataaatgatttgaataaaagtctgttggcttctgaaccacacagcaaaggaaaccacagcctaaaaagggattgcggcaaaggagggccgacctgcctggttattccagaaagaatcgagcctcagaaatagcaggtacaacacaggatggaagagattggtggggctgaaaaggggggttaattacaggccaggctgaatatgtaacattgaccacccttcctcctggctctccatgtggactagcctgaggccaagcaccagcttcaaggcaataaaaaagtggggagaaccatcacagttatcattagtgttaaaacctcactctaggccaggcgtggtagttcacgtctgtaatcccagcactttgggaggccaaggcaggggggatcacttgaggttgggagttcgagaccagcctggtcaacacggtgaaatcccatctctactaaaatacaaaaagtagggccaggcgcggtcacgcctgtaatcccagcactttgggaggcccaggagggcggatcatgaggtcaggatatcgagaccatcctggctaatatggtgaaaccccatctctactaaaaatacaattagtcaggtgtggtggcaggcacctgtagtctcagctacttgggaggctgaagcaggagaatggcgtgaacccgggagcggagcttgcagtgagctgagattgtgccactgcactccagcctgggcaaaagagagagactccatctcaaaaaaaaaaaaaaaaaaaaaaaaattcaaaaagtacctcagcatggtggcaggtgcctgtaatcctagctactcaggaggctgaggcaggagaattgcttgaacctgggaggcagaggttgcagtgagccaagatcacagcattgcactccagcctgggcaacagagtgaaagttcatctcaaacaaaacaaaacaaaacaaaacaaaacaaaacaaaacaaaacaaaaccttactctagcacattgcgattccccagttcccatgcacacaccctaaactgaaactcttcaagcttgctattcacaagacccacccacttaaaaatagaccgcaacaatagccttcttattgcctcattctttcacacacaccacagatcaccagaaatttaatatgacaagaaagtctaccacagaaaagaaaatgagcaagtaaaacaacagaaaacatgacactggagaaaacagtttaggggaaagacacaaactttaaaaataaaatctagttaatatcgtcaagaaagatttgaggagatttggtaactacaaaacaaaaacagggttctattgaaaaggaataatcagataagaaagagctctttggaattttataaatgcgtaagtaaaaaattcaatagaaagtttgtaggcaacgttggaaaaaatctcctagactatagaccaagtacagaagtaagtgagaaaaaaataaaatatatagatgaacaattcaggaggtctaaggatgactaaccaaattttcacaataagaaaaaaagaaactggagtggagggaattatcaaagagattgcatggtaaaattccccagagttaaagagaaagatgaatgttcaaagtataggaatctacttgataccaagaataattaactgtaaagtggtagaaaaatgaaattcctaacaatttcctgaaaagtaaaaaaaaaaagaaggtggcctacaaaataagaatcagagtagcatcagacttagcagcagcaggattgcatactaaaagacaggaaaaaggattttcaacagagaagtctacacccaaactatcaattgtcttttgagggcaaaataaaaaattctaaacctgcaagcatgcagaaagtttacctcccattcaccctgatatggcttggatatttgttcctgcccaaatctcttcaaaatgtaatccccggtgctggaggtggggcctggtgggaggtgtttggatcatggggacagatccctcataaatggcttgggctatttccttggtgacaagtgagctattgctctgagttcacatgagatctggtggtttaaaattgtgtagcacctcgcttccccactctctctccctcttgctcctgtcttcgtcacattatgtgcctacttccccttccgccataattgtaagcttcctgaggcctccctagaagccgagccagcaccgtgcttcctgtaaagcctgcagaaccatgagccaattaaacctcttttctttataaattatccagtctcaggtatttatagcaatgcaaaaatggcctaatacacaccctttcttaggaagttaatagcaaaatcagaaggcaaattagaaaagaaagaaaacccattcaatccagcaaacagtgactccaaccctggagagcaatggggacatctcaggatgattctacacagcatgtctacagagccacctgtccaaatgggagcaaaatggaggtctgtaagagacaggaccaatagaacaaagagtgtaattatgagcttgaaaaaacttgaagatattattgaggtatatactcagaaaaggcaataggacatcagaaattccagcaaaaacaaacaaaaataactttataagaaaaacttgaaatatatattacagaaactaaaaggtggaatgattttgataaaatgatttaaaggaagagaatccatttgcacctgattctagacacaatgtctttgagtatcacaggaattgtgacagagaccatgtggggctgcactaaataatttagcaaatcttaattgtgcaaatattttcattatttccaactttggaaaaatcacaaaaaaagactactctggtgacagagcaaatgtcaattaaatttgacaatgcaaaaataatggtatatagctgaccgagaatggaaagtggaaggaaaagaaaagcagtgaagaaaagggtattgagtgcccatatctcatcctgtgatgtgtggaggcaagagacacaggctagattgatggaccaatcaggggaggtataaatacaatttagaagtggcaagcccaatagaagttgagaataatgtcatgttatggtgggagcatgtgaaaagtttagtgtaagttagtgtaaggcaaatacttcttgtctttagaagaaaatcagtagataacataaaaaataaataagtgttaactagcaatatggaagtaagaccaggaatgttgaaaagtgattgcatttagggagctcagctggaggtgggaagggtgggactgggaactgttactttgcactacaggtgtttcaaaaccatttgatttttaactacgtgcttatttttgctttcataaaaaacaattccaaattatgattataaaaagcaagtacattgttacaagctcttttactaaaaacaacaacgcataattgagcctgtatgaaatgctgtcttctaagccactggacacgctggaggaatagcgaataaagtataactggatttatttataacgaggagagagcaaatgcagtgtacggaaatgagacacatcattttatctcgacagaacaattaagctttcattagggcttaatgacaggatgacattcgggggtttggagggtaagcacatcaccttcattatcaaatcaaagattatccagtatcaagaggaacagttttatttattctgtattctcctcgaactccccaccccaagctctgtcatgaccctagataagatgggaattgaacaaaagtccccaagtgctaattgcatattctctcacatccccaagattgctgtctcctagccatttgatgttaatatcacagaaagcagacagcaagtgtatatttggatgcacagctaggtacatttcccagaatgtattttggaaggggttagttgttggaaggttggcaagacactagtgactccacgttttggctactacgcctttctgtcctgaaagcctggtgtccatgttatttagaacagcctgggtaaacttattactgcaccctgtgttcacagaaaaggttggttctgagttcaattacaatccctagcagtttaaacgatagctgctgtgctataatctaaaataaattgcttttctcaagaagccatgtaagcctttgcactgcatcttagcagagctgctggttttatctcatctgaaactcaagaagggtacaaaagcaggacctctgaactcctgttgttacctcaaatgtcattcttctacacttctggggctctctcttcaccccaaattcctatcccagaactagatttatgggaaagcaacagtgttttcattttttaatgcaaatcatcattttgtgtttattgttttctatataagctgcatactttgcctggggtcttttgaaagaactctattactgggggcaagatttgtttttcctcttcccacagctagaaggctaacctgctaccatgggccaagatagcaagtatgaggacgcccgcacccaaatgaattggggcacctctacagactctccattcaaacgcacatcctcctcctctctccaaagggaatggaggaaaaggaaacaaacttgtcaagcgctcaatacgtgaaatgataattctggctttctccaccctccacctccccaggagtttttcccaaaggtcccattggcccaagctcaagcctcagcacttctctaaacaagatgcttgtagatccctttgatgtctttccacaaaggcaattagaagggtttccaacgttaactatgtacattctttcagatttaacaaggcaacttaattaacactgctgtgtttctgctagtcaacaagagaaaattgtcctttcaagagattttgcacattgacaaaaataatccagtaatacttttccctttcaaatatttttcttctattgagattgaaagaggtggtttgcagagtgctatatggtatgtgctcagcagcatttttctgaaagggaatttttttatgtccacacaaaaaaaaacatccaggacaaataaaagccaaatgaatactttagacaaattcaaactcaaacttagagccactcagaaggcaaggaagtcctatttctttttataacatacatgcaaccatgccacgggaggatatgaaatgtagctcatgaattatgtttatccttaagttctcttggagctataataattagaaagagacaaagtgctgattctcaaccagtatccctaggaggcactaggaaatggaggaggtgaggacatttctttgatgtctcagcaattggagggcaaaactgacatttggagagttctcaaaatgttgctaaaagttctgtagtgtgttagcaccacagagcgaagacttttcctgcccagaatgccaatagatcccccttgggaaacactgacctcaaatgggaggttgtcaatgctgcactaaggcaaaatgagctccttgtcctgggtcctttgatttctcattttgcaaacttaggtgtctggcagatagtcaatgactaaaggaatcatctagtggtgaaatgatggtaagtcacttatccattcaataaatatgtattatgtaccatctgtgtacagtgaaagtactgctattgaccaagagtctctccttgaccaaacgttaatcaggctcctctgattctctccctaatcaggccttaacttttggacttctgtgtctttctctgtattgcccaattttagcaagaatcctcttagactggtttatccagaacccttcatcttcaatattggattaccctcaatatctgatcagattccatatccaccaccatcccttaggtggtttaatcacatggcctgcctttaggtacatttcataacaatgtatccaattttcctgatccaatttttctgcatccttgccagcatttggcgttattattatttttttccaatttttttgtggtaaaacatacataacataaaatttagcatcttaacaattttaagtgtatatttcagtagtattaagtacattcatattgttacaaccatcaccacctatctatctccagaactcttcatcttgcaaaactgaaactctataccatttaacaactctcaattcctacttctcctcagcccctagccaccattctactttctgtctctacgattttgaatactcaaagcaccacaaatagatgaaatcatacagtatttgtctttgcgtgactgtcttatttcacttagcataatgtcctcaagtttcaatcatgttgtagcatatgtcagaatttacttcctttttaaggccaactgataaggagggacttccttctgtcccattttgctattgattttctacacaccttacagtttttttctgtccctcatttcctgcatcactgtcttcttgtgtggttagtttattttttgtagtgaaacatttaaattcctttctcatttccccttgtgtatatctattttctttgtagttaccacagggattatatttaatatcctaaagttatcgattctaatttggaattataccagcttaactttaataacatacaaaaacattgctcctctacttctctgtccccacttctttaaattattgatgacaaaaaattaacatcttcatgcaatatgctctaaaatataaactgatattttaaaagatgtattagcttctcaaattatgtagaaaacaaaatgtggagttacaaaccaaagttacaataatactagcttttagactaataatttaaaaaaattagtctcatatcatgtagaaaaaaaatggagttaacaaagcattattacaataatactagcttttataattgcccacatttttacctttacggagaactttatttcttaactaagattcaagttactattagtgtcctttcatttcaacctgtagaactcattttagcatttcttacagagcatgtgtagtggtaataaacttcctcagctttttttttttttttaatatgagaatgccttaatttcttactcacttttgaaggacaatttgctgaatgtaggattcttggttggcagttttttttgttttgttttgttctttctgtagccctttgactatgtcagcccattgcattctggactcctacatttctgacaataattctgataatcgtattgatgattccttctacataatgagttgcttctctcatgttgttttcaagattctctctttgtctttcaacagtttgagtatactgtgtcttgtgtcttggggtggatctctttgagttcatcctatttggaattcattgagcttcttggatttttatgtttatgtcttgcatcagatttgggaagcttttggccattatgtctccaaataatctctctattctttctctctcttcttaagcttctgaactctcacaatgggtatgttggtctgcttcatggtgtccagcagctctgttccttcttcttcaatattttttctttctgttcctaagactcataatttccttgtcctatcttcaagtttactgactctttcttctacctgttcaaatatgcctttgaatatctccagtgaatttttcatttcagttattatacttttcaactgaaaaatttctcgttctatttttactttttctgaatctctgtattgatgttgctagttagttcatacatcatttattttttactttttccatatcttttagttttttgagcatctttaagatacttgttttagactctttgtctagtagatccacaattataactttttcagggacagacctcgttggttcattttctttcctttgaatgtgccatacttgcctgtttctttttatgtgctgtgattttgttgttgttgttgaaaaccggacattgaaataaaataatgtgataactgtgaaaatcagattctccttccccttccccagggtttgctttttcattctgaattgttgtaggttgtctctgtgctgaggataagcctgagatgtaaagttaagtccttctcacatcttttgtgagcctgcatctttctctaggtatgagcggtgactttctaatttcccatgtatatgtggctgctttaaaatgtactagtctttaatgtctggctccaaacacaaaaggggaaaagaaaaaaaatgaaaacaaaaggaaaagagtgctagccctttaaatcccctggaagtcacttcagctggagaaagaagggcttgcaacaatggaaggaaatgcaacaacaatggcccctggctctgtctgcacctttgtaatcagaagcaacaattagctatcagagaacagattcctgatttttgaatgacagtggcctttttgcacaccctggctcccataaactgtgtgcaggctactcctggaatctgtgcaaggatgcctgcgagtggggtatgagtagctgatattattctaagagctaaagtcaaccacagttaagggcaatttactgcccaagccttctcttggaaattaaaagccttcaatagactctagagttctaaaatagttacatcagacagattatgccatgcagttgttctctaggtgaggagatacattcctggtgctttctactttttgatcttcccagaatcccctccttatcaattttttttatttagccattttaatagatgggtaatgatatctcattatggtttatatttgcatttctctgatggctaatgatgtggaatatcttttattgtgctctttttttttttttttttttttgccatctgccattctcttcagtgaaatgtctcttcatgttttttgcccattttctaattggactgtttgggtttttttactcttgacttttcagagttctttatatattgtaaatactagttctttgtgtaatatgtggtttgcagatatttccaaccagcctgtaaattgacttttcattccttgtagttgggctttcacaaagcaaaagttttaatgttgatgaagttgaatctagcaattctccttttgtggattatgcctttggtgttaaatctaaggacactttggtttgtttttttatttttattttttatttctataggttttggaaaaataggtggtgtttggttacatgaataggttctttagccatggtttctgagattttggtgcacccaatacccaaacagtatacactgtacccaatttgtcgtctctcatccttcacctccctcctccctcacttgaatctccaaagtccattgtatcattcttatgcctttgcatcctcatagcttagctcccacttatgagtgagaacatagaatatttgcttttccattcctgagttactctacttagaataatgatctccaattccacccatgtaactgtgaatatcattatttcatttcttttttacggctgaatagtattccatggtatatatgttccacaatttctttatccactcattaactgttgggcatttgggatggttccatagttttgcaattggaaattgtgctgctataaacatgtgtgtgcaagtatcttttttgtataatagcttattttcctctgggtagatacccaatagtgggattgttggatcaaatggtagttttacttttagtgctttaaggaatctccacgctgttttccatagtggctgcactaatttacattcccaccagcagtgtaaaagtgttccttttcaccacatccccaccaacatctattattttttgattttttgattatggccattcttgcagctgtaaggtagtattacattgtggttttgactcgcatgttcctaataattagtgatgtcaagcagtttttcatatgtttgttggttatttgtatatcttcttctgacaattgtctattcatgtctttagcccagtttttgatgggattgtttgttttttttcttgctaatttgtttgagttccttatagattctggatattggtcctctgtcagatgtataaatggtgaagattttctcccactctgtgggttgtctgtttactgactgtttcttttgctgtgcagaagctttttagtttaattaagtcccatctatttatctttgtttttgcttttcgtttcgtagtcatgaagtctttgcctaagccaatatctagaagagttttccaatgttatcttctagaaattgtatggtttcaggtcttagatttaagtctttgaaccatcttgagttgatttttgtgcaaagtgagagatgaggatccagtttcattcttctacatgtggcttgccagttatcccagcaccatttgtggaatagggtgtctgttccccactttgtgtttttgtttgctttgttgacgattggttggctgtaagtatttggctttatttctgggttctctattctgctccattcgtctccgtgcctatgtttataccagtaccatgctgttttggtgactatggtcttatagtatagtttgaagttgggtaatgagatgcctccagatttgttctttttgcttagtcttgctttggctttgtgggctcttttttggttccatatgaatttttggattgtttttttctagttctatgaagaatgatggtggtattttgatgaaaattgacttgaatttgaaagaaaaagatttctttaggcaatataggcattttcacaatattgattctatccatccctgaacatgggatatgtttccatttgtttgcgtcatctatgatttccttaagtagtgttttgtagttttccttgtagtggtctttcacctccttggttaggtatatttctaactattttatataagaacattttgccttgccttacatacagagattttctcccacatttattttttaaaattgttattattttacatttaattctatgatccactttgagttaatttttgtatgaaggtatgagatttagatcaatgttcattttttttcccaatggatgtctaatgctctagcatcatttgttgaaaggctggacttccttcattaagttgcttttgcatctttgtcaaaaatcatttgagcctatttatggaagtctatttctgggtcctctattctgttccattttgtatattcttctgccaaaaccatgttggtttgattactatagctatatagccctaatattgggtggagatatatatctctttaatgttgggttggttgattcttcccactttattttatgtcaacattgttttagctattgtaggtcctgtgcatttccatataaatggagatcaaataagtttgctagaattttgttagaaatttaatttctcaaagatcaatttgggcagaactgacatctttaccatgctgagccttccaagtctctactcatttaagtctttaatttctttcatcagcattttgtaatttcattatataaactctgtacctgtttttatttacttatttatttatttatttctgagacggaatttcactcttgttgcccaggctggagtgcagtggtgcaatctcggctcactgcaacctccatctcctaggttcaagtgattctccagcctcaggctcctgagtagctgggattacaggcacccaccaccatgcccggctaattttttgtatttttacaagagagggggtttcatcatgttggccaggctggtctcaaactcttgacctcagcctctcaaagtgcagggattacaggcatgagccactgcacccggcctctgtacctgttttattaagtgtatacctgaatcttttattttctttggaactattgtaattgatacactgtttttgatattggttcctacacattctttgttagcatgtaaaaatacgattaactgttgtatgcatcctgcacccttgctgaactcacttgttctaggatttttgttgttgtagatttctagggattatatatgtagacaatcatatcatctacaaagagagatttatttcatttatttccaaactgcatgccttctattttcttttcttgccttattgttttggctagactttccagtactggttgaataaaagtcatgagagtgaacctcctggccttgtttctaatctcagggatgctctttagcaagtcgagataattcatcactatttctaaattgctgagaatttttattataaatagatgttggattttgtcagacgcctttttatatgatgatattatttactttttttatttttaatttcttccagtgtttcctcaatgaattttcttctgtagcttatttctatggtatattacattaattaattttaaaatgttgaaccaaccttacatacctggcatataataaatcctacttcatcatattacataattctttttattctttgctattatttcattaagaatttctgagtcaaaatttacaaaagacattgaactatagtcttctttcctccctcccccttcttcctcttcctccttcttcttctttgcctggttttggtatcagggtaataatgagttgaaaagtgttcctgcctcttctattttctagaaaagataatataaaattggcattatttttttttaacatttggtataattctccagtgaaacaatgtagtcctagagatttcttttttgggatatttttaattattaattcaattttttaaatagctataggactaggctagggctgttcatttcatgttggctgagtttagctagttttttttttttttttagaaattggtctatttcttctatgttcgttgaatatatgagtgtaaagttgttcatagtatttttattgtgttttagtgaccacaggatctgtatttatatttcctatttccttcctggtattggtaattttgttattgtcaattttgctagtagtttatcaattgtattaattttttagaagaacctgttctttgtctcattgactacctttttcttatttttaattccattgatttattcttttatccttattatttcctctgtctacttgcttttactttatttttctcgtttctcaaaataggaacttaggttattgatgtgaggcctttaaagacttactctttgacctgttgataacttagaagtgtgttataaattttcatgttttagagatttttctgctatttttttgttatggataacacattctgtaaaaatttgctaagcattttttatggcctatgatatgatctattttggtgaatgttcttcggttgcttgagataaaaagtatattctgctgttgttggatggagtattctatatatttcaattagattctatttgctgattgtgatggcgcaatcttctatattcttgatgattttctgtatagtagttctatttgttgttgagagaggacattgaagtcctgaaatataattgatgatttatttgtttctctttcagttctatcagtttttgctttgtgtattttgaggctctgttatttggtatgtacataagatcattttgtcttccaggtggatccattcttttatcattatataatgttccttcttgtttccagatattttctttgttccaaagtccacttttatcagatactagtataagcactcctgtttttttaaaaattaatatttgtatgatatatgtttttccacccttttactttcaacttaactaatcatagaatttgaagtgagtttcttgtaggcagcatacagttagattatgttctattattcactttgtttatctctgtcttttgatggtgtttagatgatttaccttcaaggtaactattgataagttagcatttcactataccatttcattacttgttttctatttgattcctctggttctcattcctctgtttctcttttcttgccttcctgtgtgtaacctaaacattttttaggatttcattttgatatacagtgttttgggaagtacttctttgtatagttttcactgtggtttccctgagtactaaaacctaatatgtgacttgttacaggctacattatcaacatttaactagtttgaaacttcactcccatttaaatctcttgtccttcccatttttcaataacattgaattgagtatcagatggtattataatttttgttttaatcatcaaacatgatttataaaactcaaagagaaaagaacagtttattgtatgtacccacaaatgtctttccaatgttctttcttccttcctaatcctctaagatttcatcttgtattgtttcctttctgtttaaagaactttctttagccaatctttaagagtaggtctgctagcaacaaattcatttacttttccttcatctgagaatgtttttatttcctcttcactctggaagtatagtttttccagacatagaatttacagttgataattctttcagtacttgaaaaatattgtggcatttccttctcatctccattttatgagaaatctgctgtcatttgaattggtattcctctataggtaatgtgtcatttctcttactgctttcaagatttcttcagtatattttatttttaaaagattaattatgatatatcatagcacagatttcattgggattacgtgtggggttcattcagcttcttgaagctgtaggtttctgtctttcaccaaattagttaagttttcagtcatcatttcttcaaatactcgtgtttatttgtttgtttgagacaggatctccctctatcacccaggctggagtatagtggcacaatcacagctcactgcatgcagccttgacctcataggtgcaagaaatcctcctgcctcagcctcctgagtagctgggaccacaggtgtgcatcaccatgcccaatttatctttttcttttttcttttcttttctttttttttttttttgagacagagtctcactttattatacagggcagtgacataatcaaggctcactgcaacctctgcctcctgggctcaaccaatcctctcacctcagcctcctgagtagctgggactacaggtgtgcaccaccatgcctggttaatttttttttttttttttttttttttttttggtagagacagggttttaccattttgcctaggctggtcttgaactcctgagctcaagcaatatggccacctcagcctcccaaaatgctgagattacaggcatgagccaccatgtctggctgtcagctaatcaaatactctttcagtcccattatctttatcctcttctgggactccaatgacatgaatgttgggccatttgtcattgtctcacagatctctggggtcctgttcattttttcagtctatttttggtctattgctctgattgggtggattccattgttttgtcctcaaatttagtaattctaccctctcttatctctaattaacagtagatagtctaacctatcgttaatactatccagcactatttttatttctgttattttttatttctagaatttttattcagttgttttataacttctatttcttttctaatattttctattttaaaaaattgtatcaaaaatttgcagctgctttataggtcatttatatgacagatgctttaaaattattgtcagataattccaatatctgattcatcttggtgtttgtgtcagttgattgtcttttctcattcaatttgtgattttcttggttcttggtatgaaggataattttttattgaatcctgggcattttgcctattatgataggagagactaggtcctatttaagtctttcgttgtaagtcagtaaccctgttaaattaatcatgtgggtcttggctacttttatcagctgtggctccagtggcactctaattttcacagactttgaggtgttattttgttctgcttgattaatctggttgcaagaggccactggttcctgcctctaccccactgccttgtggggcagaacagatttccccacactgggcctcaggtatctctcagtgggagaggaatacggtggggtctgccatctgcctcagtgtctttgggcagggaaggagagtctcaggcatgtgagaacaaagaggcttcctagaattggccactttttgtggttgcatccttgttgctggttatgtcttcttgccccagtgactctagacaggggaggatcatttgaggcacacagagaaaaagaggcttccctgacagtattatttgctatagttcattctttttttacgtgttctgcctgcccacttcagtatttcttggtggaaagggagagtctcagggctgagggagagcagagtccttcctctggccaattatttttggcgaggcttccaattaatctctttggctggtagcgttgaacttgtctgatagttccagagggacatccgctcaatcaggaaaaaaaaaaaaaaaaaaaaaaaaaatcagcctccctgagctgcttcttgttgccaggcttggacttaggaaacactcagttaggaaacactcggtctaggtgaccatcttctgttgggttgggacactctaaacactctgctactgtgctgttcctccaggcctagggaggccagctcattctttttttttttttttttttttttttgagacggaatctcgctctgtcgcccaggctggagtgcagtggcacgatcgcttctcactgcaagctccgcctcccaggttcacgccattctcctgcctcagcctcccaagtagctgggactacaagtgcccaccactacgcctggctaattttgtttttgtatttttagtagagacggggttccaccgtgttagccaggatggtctcgctctcctgacctcatgatccacctgcctcgccctcccaaagtgctgggcttacaggcgtgagcaaaccagctcattcttactgtctttcagcgctctcatttggttgtctcttgtaccattaccagagttggtagttgttcttagcaggaaaaagcaggggaaaatgggtctacatcatcttttctggaccagaaatctgtttattatattttaattgcatatttccattcattttttggcaattaacccttttagatcttattataattatttgtgtacatccacggatttgaaacatcttggtaatttatctttgtgtattttacagtgccttgaacaaagcagattcttccttaaaggtacttatacatgaatgaatgttcatgcatattttctctggggctgtacaatggaacaagacctacctgttaaaagagtggttgttggtagaatgtaaacatgacttataagtgttcatccttgcaaatggacataggagtaacagggagaaacttgcttaatgtgatttacagaaacctggttcagaacataggctcacttggtcatcacttccctctggtcatcacaatctcacaatcatttttctgctttcagcagatgggaacatgtgataatgctgtgacagatttccccaccattacttcctaaagccattacccgcttctagcttaaaaccttgaacacacaaacacacacatatatacacactaacatacacatacatgtatgtttcaagcatccaagataggaagtaggggaacatgatgaattttcttttctagaaataaaacaatcatttgtccaatgaaagatgagcataaaacacccatacctaataacaaatggcacagaacaacattgctgggaatccccaaatagacctcacgaaaacatcactgaagattgcatgtgagagctagaaggcctcaggcagggaatgccatggaatgtaagaccaggcccctgctggggctcagaaataggaatgatagaaaagcaagcaggaagagaccctgggcaattgagttctcccactgagcaagaaagaattgaaaataacagcattaggcaggaaaacaatggatgcctgacctcccatttaaccattgtaatcatgcattgttatcaattggcttggtcttttaagattcctagtcacttgtccctcatatctgtggcacatacttatcactgtgtggatttgctttttggcaaacagaagttttaatttttaatggagtcaaatctattactcttttcagaaacgatctttctctttgtcttcaagtttatgaagtcccctctcactccagtagggataaatactcatttctattctgggtttctaatgattgattttatacatttatttattgctttaatccagctggaattaacattagcatatggtgtaggaagactgtaattcttccaactctaatgcattcttgataagtaaaaaataggatttcctacagtagaaaactcagcctagaaacctgcctttcagtatcctgaggcaggaatggagtgaatgaggcactttcctcaaacctaaaaacctcatcctgttttactggggacttgggataaccttctttatttctcagtgtctcctcctttgtgtacagtagcgacacaaatatccactgtgtttccaaagagaagtcaagtgcttaagctcctcaaattttctgagtacattctatgtagaggattttccattactggttacacttaatacacagggccttgctggagaatgtgaccaggagaactagaacttcagaaaacacaaaatgagctatcaaaggcttggcactttgtaggggtgtaatcagaagaaaaacgagtcctaatatttagaacacattagatgtaacctcttaaactccaaagttctcttcaaatcttacctatttaatttgaaagcaagcaatgttccagtgttaacatttctgatttgggggatgccagatagtgaaatttggattaaacagagggaatttatagtcttattctaattaataaatggacttaacggggttctgaaaataaaacaacctcataattagttggtaattaacatagctaagagccaggtagaactgtccaacctgtgtcatattctcacaggtgtgcccacaaaatacaatattatatagaataaatacattgcccaccttcattcatccagcaagatgtactgacttttcactgtaggcatgaacctgaagggaattaaaaatgaaggatggtccttgctctcacaaaagctgccaaattgggtacactcactcagtgtcttcaaggaacacatggtcaggtttctagattatgcttaactagattgggagagtggattaccctcagaatacccttgataaaagctttcaaaattttcctttactcacaaaaccatgttttcagggaacctaaacagaagtccaatatataagatagaataatagataaaagtataaattatttggtcaaatgaggactactagtgttctcaaaacactaccccacttccaaaatacacacatacacacacacacacaattcctggaactttacagagtagagtttcaaaatcactgcagctgatgaattgacaaatagaaagaaggggtaacagataggtacaaatgtaatataataaacacaatagaatgttaatgttagacaccaagcggtggttacacagggtgttcactataaaattacttcagttttcatatacgtttaattttttcataatacaatattgaaaaaaaaatcccgctcttgattcctatatctgaaagttcttaaagttttagttgagtaaacatttagaattattggccgggtgcagtggctcatgcctgtaatcccagcattttgggaggctgaggcaagtggatcacctgaggtcaggagttcgtgaccagcctgaccaacatggtgaaaccccatctctactaaaaaaaaaaaaaaacacaaaaattagccgggtgtagtggcaggcacctgtaatcccagctacttggcaggctgaggcagcagaatcacttgaaaccaggagaagaagattgcagggagctgagaccatgccattgcactccatcctgggcaacaagagcaaaactctgtcttgaaaaaaaaattggaattattatttgttcttaattgacccctttatcattatgatatgtccctctttatctttggtaaaccttcttgtcttaaagtttactttgtgtaattgatgtagccacattggctttctaaaaattatttctataacatatatttgtattccttttacttttaactctttgtgtttttgtatttaaagtgcatatgttgtagtcagcatattattgggttttatttattttgtatctttcatgcacgtccgtgtgaagagaccaccaaacaggctttgtgtgagcaacatggctgtttatttcacctgggtgcaggcgggctgagtccaaaaagagagttagcgaagggagataagggtggggccattttataggatttgggtaggtaaaggaaaattacagtcaaagggggtttgttctctggctggcaggagtgggggtcgcaaggtgctcagtgggggtgctttttgagccaggatgagctaggaaaaggactttcacaaggtaatgtcatcacttaaggcaaggaccagccatttacacttcttttgtgatggaatgtcatcagttaaggtgaggcagggcatattcacttcttttgtgattcttcagttacttcgggccatctgggcgtatacgtgcaagtcacaggggatgcgatggcttggcttgggctcagaggcctgacagtatccatattgacaatctatgactattaattgggacatttagtccatttatatttaatgtaatgatataattcagttttaagtctaccatctgaatatttatgccatctttttttgtttccttcttccttctttcttgccttctttctgttaaaatgcatatttctaaagtttccatctttataccactattagggtttttaattatacctctttgtagcgtgtgtgtgtgtgtgtgtgtgtgtgtgtgtgtgcatgcatgctctaggactaacaatatgcatccttatcttatcaaaatctacctaaaattaatattatactatctcatgtaaaatataagaacctgacatttattacttccttgtccattatgctgtcacatgttttacttctatttgcattataatcctttcaatacattgtcatgagttttgctttaaatagtaagttaccccgtaagagcttaacagaaaataaagacggtttaaaaatatatatattattccatatatttaccatttctgtgctcctcattccttcctgttaatctgtttccatttgctttcactttcttttaggctgaagaatttgctttaacatttcttataatgcgggttgactagcagtacattttcttaggttttgtttatctaaaacttaggttttgtttatgcagccataaaaaggaattagatcatgtcctttgcaggggcatggatagagctggaagagatcatcctcaacaagctaacacaggaacagaaaaccaaacactgcatgttctcactcataagtgggagctgaccaatgagaacacatggccacagggagggaaacaacacacactggggcctgtctggggtgggatggggggcagcggtgggagggagagcatcaggataaatagctaatgcatgtgtggcttaatacctaggtgatggtttgataggtacagcaaaccaccatggcaaatgtttacatatgtaacaaagctacacatcctgcacacgtttcccagaatttaaaataaaataaatttaaatttaaaaaaagaatttaaaaatgtcattctattgtcttctggcttgaatagtttttatttaggagtctaaaataactcttactgttgttctcctatatgtaatgtctctccactcctcccatcctcagcagcttttttctttacttttggatttttatcagttggccgtcatacatccaggtatggttttctttgtttttatcctgctttggtttgctaaacatcttcaacctgtagtttgattttttcactatatttgggaaaatttgttcatttttttaaactattttttttcctccctcattctctctatcctcatttctggacctcaaattgtacaaatgttagacttctcgcttttgccccacagatcactgaagattcatatattttttctattttttcctcctgttcttcagatcagacaatttctactgatctgtcttaaagtttcctgatcttttctgtagtttctaatatgttgctaaggccattcagtaaacttttcattttggaaattattatttgcagttctataatatagatttgtttcttttttatagtttacatttgtttctctgagatttcccgcctcttcattttatgtcacccattttatgtcaagtccttgaatatacttatctagttattttaaattcctcattttctaattctaatgtctgagttatttcaaagtctgtttctatttattgcttttttctgattaatggagcttcctcttcacacatccagtaatttttttgttgtatgctaaacacagggcgacacatttagggaatctgcattatattgtcttccttatagggtactgagtttttttctggcaggaaattacatttctaaaatattctcttgaacctttcattgttagaactggtctagttcaaatttgtccttagttgtagaacacagccttatggtagtgtacaggtctcactcctgaggctggcctttctggggtttcaactgaatgcccaggttctcagggaaatctgccctctcagactaagaattccaacgtctcccatctctgggcaaccactagtgtctttgttcggctcttggtcccacagtgaaccctctctgctaggcctcatggtgtcttgccctgcttatacatagtcaatccttcagacaatgacctgcaaagaaacctccatgtacactacctccacatgccctacctcatgcatctctcttattcagtaccctactctgctaattccagcccctcagcagcaacaaagtacaaactctgccttatcagttcattgaaacaagcatgtaatgcttggccccacctccttactagccagtccagtgaatgcacccctaggcagaaagccaaggtgaatgcaaggcttgcctcaggggtttaccttgtctcaagggtcacagccctgcattgcctgttagccaatttctgaaaacagttgccgcatacattttatctaattttatagttattcatgaaatgaggtcaagaatgataccagttacttcattgtggcttgaaaactaaaatgctttagtatctctctccactaccaccatcaacacttgaactttacaaatgatcctatttattctaccacctgctactaaatgatgaaaaataattatcaagtgagttgccgaggcttcctgctcttatttctcttaccatgttctcagatatctgactgctagctaatgtctctgcccgggaacaaaagaagccagagaaggagaaagaggaagctcaagttctcccatattctctcttttcaaaagttacgaagagtagaaaatagtttaacaaggaagtttagagattacatgaaaattgtaatgagtctgatgcaccagcttccaataccgtcatcacaaccagcccttccttggtggtagttatgtattggttgcacctgatacctaagcagtagtctgctctcttttgcaataaatcacatctgtctctatgatagactctgacctcagcctaccaacagcatgttttttaatgacactggcttgcaaatgcatctgatttgaaataaactttctttgtaccatttttaggttctgtacttttgaataaaggtgcaatcacagcaaatcaaattctcagaagactacaataagtaaacattaagcagtgttcctttttgaaagcaggagagagtatatgtttaggaatgttcaaggattagtctggttcttttttaagtttttatttattgattttatcttaacagcaaaatacaatgcctggctagagcctttaaatacagataaacaatccaaacaagctgcaacttacgtatatcaatcttctaagatcacctcagaaaagagaaggtggctcccaacttgtcccaagttaaatacatttaagagaagcaaatgggaatagcagctaaagctgacggacagggcaattcgaggcatcagatgctccctttcaggttgctgagatgcttccagatggttcctgtatctgcatggccaaagtggtataatttattttcttagctttttcaatctctctgcatattacatcacaattttagctcaagtttatttttgttgtgtgtatttgacaatcctttggtggtgtggaacttaaatcatcacttcccagagcaagaaaacaaaggctgacacttctgatatagaaggctgcaatctggaaaggacgatggttggaagggcaggtggatgattgggaccaccactaggtttattctttatttgttcaacatgttttcattaaattagggtacagaggtggacaagtcagaagcagtctctctcattatggagtttacactctaccagaggtgagaatggaggacttaaaggtagacaaaaatgcctaatgtgtcacctagagaacacaaccaaaaatgagttacccaacaacttcatacagctgctacctgcagttagtatgtacatgccaggtaagctaggaagaggcctacagcctctcctggaaaatcttgggagaccaaataggttttgatcttgaccattccctgaaaatcctcatctataatcttcaaatgcaagaaggaaccaggaggtgccattatgtttcaccacaagaactcattttttttaattactgtttttttcttttagtgagcataattttttcttttgttgttattgttgttattgttgtttttgagacagggtctcataatgtcacctaggctggaatgccgtggcgccatcttggctcactacaacttccgcctcctgggttcaagggatcctctcacctgagcctccatagtagctgggattacaggcatgtggcaccatgcccagctaatttttgtatttttttggtagaggtggtgttttgccatgttgcccaggctagtctccaactcctgggctcaattgatctgcccgcctgggcctcccaaagtgtttggattacaggcatgagccactgtgcccagccaattttttaattacgtaaattaaaggggtacaagtgcagttttgttatatggatataccgcatagtggtcaagtctgggcttttaatgtaatcaacacctaaatagtgtacattgtactacctcactcccctcccaccccatcatcattctgagtctccagtgactattattctatactctatgtctacatacacacattattcagctcccacgtgtgaggacatgtggtatttcactatgtttctgagttttttcacttaagataatgacctcctattccatccatgttgttgtaaaagacatgttttcattcattttctgtggctgaatagtattctattatgtatacatatatacacacacatatacataaataaaatgtgctgtatgtatatatgtgtatatgtatatacatgtggtgtgtgtgtatatatgtgtatacatatgtatatgtgtatgtgtgtgtgtatatatatacatatgtatacacttatatacacacacagagcacattttctttatttaatcatcttgatttttttggaagagtttcagtaggatgagtatcagttcttctttgcacattttgtagaatttggctatgaagccatccagtcctgggcattttagggggaaggttttaaaattattgattcaatcttactattcattattggtctgtttaagatttctatttctttctggttcaatcttgggcagtcatatgtttacaagaatttgtcaatttcctctacattatctagattgtgagtgtacacttcttcatagtagtctctgatcatcttttgtattcctatggtatcatttgtaatgtcttctttttcatttctgacttttatttggatcttttcttggttagtacagccagaggcttatcaattttgttcatcttttcaaaaaaccaactttttgtttaacttatccttggtattgttatcttggttttcattttcattttatttttatttttaacaaccaatttatatcattcaaacagatagaactgccttgtgcttgtttcagccttgttttctggttattaaaagaagacctgaaccagatacaaattcaccatattttccttcaaggacacttctcataaaagctactaatatgcatattttggcatacaaaatcacatttgctaaaacttttttctgcttaaatacaattcttttttcatttagcaactgcatgttattatagaggtcaattcattgggttataagagaaaagaaacacttattgaagattcacaacatacattccattatatatcgctgttcaatagaatgcaaaattagtaaatatcacccctacaattggaccatgtaactgatagattttcctgtaaggagttaccaaaatgtcatcaaaatctagagtttgacaatttccaggccttatcctgaccttctcaatgcaagttgcacaaatgaaatcagttatccaagagaaaaactgggatagaaataggggttaatagattatgatcctaagttgaaaaatacagagctctcagtttccaagatttaccattttcaagtgtccctaattttgtcccaagagtggctccagcctgggcatgacagctggctgtaatggggacagatagctctttctttctaagaacaagatttaccatttgttttgtctgctctctccacaagctcttcctgaaacatatcagtggcataataaatatcatctcgttttccatcttaaggactttagtactcaaaggtaactgttttgagtccttaaaaaaaaaaaacaagcaaaaaaaaaagtggtttgcaaacttttgtctgtgacataacaccaaagccgtagtaaagtcaatgataataataataataggtacttacttgggctagggactgtgctaggcttcttttcattcattatctcatttaatattcacagttcctacatggcttagtatttcttgcagaccctttaaatgcttacatatagaaatctgccctactatttcaagtataggcagaagttggcaatacaagaaaagacaaagggataagaatccgtccaactggacaaaacaacttcaatccttaaaaagtcctacccattttagaaacaggtcaatgaagctacctgttatgattgtagaagtcatgtctgcttactgcacctaatttgagaattacagaaaaacatttttaaaaatcacatattattctatcactcagagataaacattgatagtgtttttatagttcccagtcttatttatatatttgccttctttttttgctatttgtttaatttttaaaccaaattcggattacatagcaatgcaattttcccatattattagatataatttttgaaagattttaaaacactaccttatgttccataatttatttaacaatttcactgtttactgacagataatttagagtacttaattattctataaatactataataccaaagtataataatgaatttttgcctgcatctctatttctttaagaaagatttctataaatgagattactagatcaaaaaacattaaaaaattctttttctagggagaatatccccatgcccaattccactacatttgccaactagctgaaaatgatggggttttttttgcatgttttaaattgttatataatggtattagattgcattcttctgaaactcattttcaaaacatctttactcaacatatatttatagttattcttgttactatatgttgtttttactcattctttttttgcttttcgaaaatcgtctcttagttgaataataatatttatgtattagctattggtgaacatgtacgttttcctgaattatcaaaaagatactattgtaagtatgttgtgcacattccccttggcatgtgggccatgggagttgcatgtcttcaactattctggatgatgccacactatattccacagtggctgtaccagtttgctctgtgaatgataatcttcattgctttacaacctctccaacacctagaattgttagatttatttttccctttaattttgacaattggatagatgtaaaaagctatactgtgctgattttagaaggcatttcctgattacttttgcagttgtacattctttcattcattaattgtccatttctgttgcttctccaatttatgtttcttcagaccccttagttatttttctattgatttttatttctgattacttgtttgtattaactctttttatatttcatattaattttctactatgaaacattctgcaaatacaggcataacctgaatgatgttgcctcgattaacattttcatggtaaaatgactcttggtttttaaaatccaaatttcatcatctatttttttttttttgccaatgttcatgtagcaaaactttagatttataataccaaactctgcaaaactttcaataaaaggaaatataggaaaatcatcaagatattttcaaaacatattcagtagaacatcagaataatatatagatattttggaaagcaagctgagtgacaacacacgaaacacccatttcagaagttgctgatgctaaaaggccatcataccatcagtgtgagccacacttggccaccaggcactagagcacatttcccagtgccttccccattttactttttttgcttattgttgaaatccccaaattgttgagaaaacactgaagacaattgtagagaagaaaacaaaacaagtgagaatagctactacgtacaaagcaaacattttataacatgttaattgtagaagtcatcaaggatataatttttttaagtacaagtgatcgaggatataatttttttaagtacaggcataccttgttttactgcactttgtttcattgcacttcacagataatgtggttttacaagttgaaggtttgtggcaactttgcatctagcaagtctattggcaccatttttccaacagcacgtgttcatttcacgtctatgtatcacaatttggtaattctcccaatatttcaaactaattcattattattatgtctgttgtggtgatctgtgatcagtgatcttagatgttcctattgtaagtgttatggagcccaatataagatggtgaactttatcagtaaatgtttgtgtgttctgactgctgcactgactagccatttttccctctcctcaggcttccctattccctgagacacaacaaattgaaattagtccaactaataagcagacaacagcttctaagtgttcaagtgaaaggaagagtcccatgtctctccctgtagatcaaaaattagaaatgattaagcttggcgaggaaggcatgtcaaaagctgagctaggatgaaagctaggcctcttgcaccaaatagccaagttgtgaatgcaaaggaaaagttcttgaaggaaattaaaagtgctactccaatgaacatacaaatgataagaaagtgaaacaggcttgttgaggatatgggaaagtttgagtggtctggatagaagatcaaactagccacaacattcccttaacccaaggcttaaaccagagaaaggccctaactatattcaattctatgaaggctaaaagaggtaaagaagctgcagaagaaaagtttgaagatagcagaggctgattcatgaggttcaaggagagaagccatctccagaacataaaaggcaaagcaggaagtgcttatatagatgctgcagcaagttatccagaagatctagctaagataactaatgaaggtggctacactaaacagcagattttttttttttttttgaaacatagtctcactctgtcactagggctggagtgcaatggtgcgatctcagctcactgcaacctctgcctcccgggttcaagcaattctcctgcctcagcctcccaagtacctgggattacaggtgcccaccactacgccctgctaattttttgtatttttagtagagacatggtttccccatgttggctaggctggtctcgaactcctgacctcattatttgcctgcctcggcctcccacaatgctgggattacaggggtaagccaccacacccggccaaaggcagattttcaagagagatgaaacagccctctgttggaagaagatgccatctaggattttcctagctagagaggagaagtcgatacctggcttcaaatcttcaaagaacaggctgattcttttgttagctgctaacgcagctggtgactttaagttgaagccaatgctcattgaccattctgaaaatgctaaggcccttaagaatgatactacaccaactcttcatgttctctgaaaagaaacaggaaagcctagatgacagtacatctgtttatagtatggtttactgaatattttaagccctctcttgagacctattgctcagaaaaaagattcctttcaaaatattactgctcactgaaaatgtacctggtcacccaagagttctgatggagatgtaaaaggaaatgaatgttgttttcatgcctgccaacacagcatccattctgcagcccatgggtgaaggagtaattttgactttcaagtctcattatttaagaaatacatttgtaagactatacatagtgatttatcagattgatctgggcaaagtaaaatgaaaaccttctggaaaggattcaccatgctggatgtcattgagaacattcatgatttatgggaggacaacaaaatattaacatgaaaaggtgtttgggagaagttgattccaactctcatggatgactttgaggggttcaagacttcagtggaggaaggagctgaagatgtggaagaaatagcgacaactagaatcagaagtaaagcttgaagatgtgactgaattactgtaattttacaataaaacttgaatgagtgaggagttgcttcttacgggtaagcaaagaaaaggatttcttgaggtaaaatctactcctgaagaagatgttatgaacatcgttgaaatgacaacaaaagctttagaatattacataaacttagttgataaagaagggttggagaggattcactcattttgaaaggagttttattgtgggtaaaatgctggcaaacagtgctgtatgcaacagagaagtcattcgtgaaagcaagaagccactgatgttgaaaactttactgttttcttactttaacaaattgccacagccacttctgccctcaacaaccaccagtctgatcagtcggcagccataaatatcaaggcaagaccctccaccagcagaaagattatgacttactgaaggctcaaatgatcaccagtatttttagcaaaaaaaatttttaaattaagataacatatttttttataatgctattgcatactagactactatagactgtaaacacaacttttatattcactgggaaacaaaaaagtttgtgtgccttgttttattgcaatattcactttattgtgatggtctggaagtgaacatgcagtatctctgagatatagatatgcctgcattttaagtctcagtgtgacattattgttctactatggttattttactgtgttttacttacacttcaagaaattcactagagggttggtttgacatataacacattttttcccatttaagtaatggcaaactgtctcaaggaaatcatttttgggtaatacatctgatcatcaggaatcaattagtaacatcaaacaaggggtgtctatatttttttctcagcatgttccttatcttttctttgtttgcttgtttgtttgttttctattttacatgtctcatttaatcctggaaaaatgctataaagtagctagctgattctatcttacagatgagggcactgagattcagagaggtcagtagctggctttattatcttcttcactgtggctgcaataaaaaataaccacaaactttgtggctctcacagctctggaagccagaagcccaaaattaagatgtttaagagcaaagatccctccagaggctctaggagggattccattccttgccactttcagcttctggtggttggtgggactcttgtaatagcatttaggtctcccaaaataatccaggatgatttcctcatctcaagatcctcaatttaatcatatctgcaaggaccattttttttgcaaacaaggtcacattcacaagctctagaaatttgatgtggatacgtttgcagagccaatattcaacttggcacactcaccgaaggccacatagcagaatacggtgtcaagtccagatataggagttccagactccagagttcatgttctttccactccatgtgcggttttccatcacattgtgtgacctgtcgtctccatccctcctcacacctcagattcccttagtcttcccaacctcagagtgaggttaatactctgttctctccgtgccagggtctcttccaaggagagtattcaagagctgtgccacccctttacaaattccattgcgcatccgtgacttcctttccaatacccagacagtttcctgagtctagttcacagactagatcaccaaagcaaccttcctgggagtaaatattacatctttcccattcatattagtttctcaaaagtgctcaagagcctgaagaatgacagaagagaaatgctaaagattgaaggagttcagaacacaatactccaaaatatgttgctctagtatattgactattttgagcttaaagacacttggaaaaacagcagatacaaaaaatatactctgagctttcttcttttccttagaaacaggagataacttgtcctccctacgccagagggaaagtagcgttcttatcatcaaagacgagaagttgatgctgagagaaatctgaacaaacacaccttattaaagtaacccttatcttcctagttacttctctacccaattaacctccctagcccaagcccgttggctttgtcacatactcacaattttctattcctttcccaattcagtacataggtgttcaactttcaactctgtctttgggtttcatttccttaagagggctcttgtgctcacataaaaattgaatgaattaaatttgtatgcttttctcccgctgatctgccttatgtcaattcaatcctcaggcccagctaaaaaaccctaagagagaaaatttggcctcccctacaatgtcatcctctttcttttttctggaccttctatctgctggtacttaagatactaaaatggacgggagaaagaaagcaaaccatgttatgtcttctgcattggcctggtacactccgtttgaaggttactcgaagccagcttgctttttgtcaagagattgcttgatctggagccatatagaaaatggtgacatctccaccccgtgacatatgggccagtaagggcttgcaaagttccattctgcacacttctcttcattctaagaacgagtattcattccatttaaacacatattaccaggaattcaatccaacctctctttttacagtctacctagaattactattatactatttacatacaatatggaaacctcacacatgtatgaatctatttacaaactccctctaaattcaagttgtcattgaaattacatctacctgtattataaatcccataaaaatgatgctatagtttttacttaaacaaacatacatattcttaaaacattaggaggaaaaaattgatttttatatttatcttactatttatgatttctttatttttacataaggatctgagttttcatctattttttcttgtcatcccaaagaacaaagcattttttacagtgtaagttggtctgctggcaataaatattctgtttttgtttttctgaatgcaactttattttgactccgttcctgaagtatgagtatctttggatatggacttcgggattggatagtcatatctccttacagcacattgaagatattgtttcattgtcttcttgctttcatagtttttgaaggtaggttggcagtatttagcagtgcagtttcatgtatatagtgtgttgtttttctccggctattttcaagatagtgtcttgggttttcagcagtttgattacaatgtgcctcagcatcttgaacgtgtacatttatctctcaccaattttgggaagtgtgtggggccactgtttcttcaaatattaggttggcacaaaagtaattgtgggttttgtaatgaaaagtaattgcaaaaccacgattacttttgcaccaacctaatatttttatgacccattctctatcacctttccttctggggaaccaattactcatatgttaaaagaattatcccataggaacctgaggctctggttgctttttttttaatcctttttaaaaatacaatctctgttcttcatagagaaaatctatattgatattatcaaattcactgactgctttggtctgcctgtgtatgtatattccaaaggtcagccagagatttgagcagaatttacaccaaaaatttgtaatgctccttttctggccctctttttaatgacattcctcccttactttccagtagctggggttgctccaaactctgtcccctggttcataaggccagaaagactgagcttcctacaggagtttcagccactctgtgtggccctacctgtggcttgacctcaggataatagtcataagaaatttaacctatactacttccaggtgtcttcaacccccttcgagaatcttgctgcctttgttcattcttcagatccctcagagagttttgttgttgctgctgtttgtgttttgtgagggtttacagactacatgggaagcagaaattgttctttgggatttaacttttacaaaaatcacaagcactcatctcatttgtggcagtgaaagtaatatttacaatgttaacgttaaataacataccttgctacaggtttccagtaaatatcttgtattatgctgcgtaagctcctcctatttctagctcattaaataaatattatttgcttgttggtcttatttaacagaaaaaaaaggagtctctatttattaattcattagttttattttccacagattgattttgttactctcctttaataatgaaagttctcagggctattaattttctgctaaatacagctttagccatttaaaatattgatacatagagttcttactctcctaacagtttattatatagtttcctttcctgtttgaatctggagtttttagaaaaaaatttggtttttgttatcattatttctcttttccaagctactgatttttgcatttaaacttttgctattaatgtctagctctatttcagtgtaggcagaacatggaggctgttaacactttatatttcataatttaatatggtttctttgagatataatatatgatcaatttttttctaaatgcttcatggctccttaaaaaagtgtattgcttatttctagagaacaaaatttaataaatatttattaaatcatctttgttagattattaaaatattctatcaattctgtgtttatttgacccatgaaagatcaataaaagtgtattaaagtgtcatacaacaattctacttccatcaatttttccttatatttctaacagcctttgtttcatgtattttgaggctgttaccaagtcaataaaaattcagaactgccttatcttcattgtgaagtctatcttaaagaaaatataaccttcttgattgcatttaatatttttatagcctttgattctatttcatctaaatattgccaagattacttttttttttaatttcgcttctgcctaataaatcttgtccattctattgttctttcttttttaatctaatgagttactttgttttaggtatatttcttctcagtaccctacagttagattttgctttttagctgaaatatacagttgttgtattttaatagactagtttaataaacatttcacaatgagattcagctttacacaatgctttcacatttatatttcctcttttcaacatatcaggtacaggggaaatgtcattcctatgttatgcataaggaaattcaaagccagataggttagatgcatttcccaaggtcattcaggtaatatatggcagtggcaagacttaaccaaaggatgataatactaagaaaatggctttttacaaacatatactatccccttgctgaacatcaatattcagatagactatttggtcaaattatgttttgtgtttttttttttgtttttttttttagacagagtttcgctcttactgccccagctggaatgcaatggtgcaatctcagctcactgcacccttcacctcctgggttcaagtgattctcccgcctcagcctcttgagtagctgggattacaggcactcaccacaaggccaggctaatttttgtatttttagtagagttggggtttctccatattggccaggctggtctcaaactcctggccccaggtgatccacccacctcagcctcccaaagtgctgggattacaggtgtaagcccctgtgtccggccatggtcaaattatctaatttttcttccactgggggactttatactatttatttttattgccgtaaatgatatgtttgtaacactgtaatcttatttcatgctttgtgtagtttatgctttactcttttttctttgttttatatactattggccctccttgtctgtgggttccacatctgtggattcaaccaatcatggattgaaaatgctcagtgatatggtgtggctctgtgtccccacccaaatctcatcttgtagctcccataattcccttgtgttgtaggagggacttggtggaagacaattgaatcatggggggtgggtctttctcatgctgttctcctgatagtgaataagtctcacaagatctgatggttttaaaaacaggagtttccctgcacaagctctctctttttgcctgctgccatccacataagatgtgacttgctcctccttgcctttcaccttctgccatgattgtgaggcctccccagccacgtggaactgcaagtcaaataaacgtctttgtttgtgaattgcccagtctcaggtatgtctttatcagcagcagtaaaaaggactaatacactcaggaaaaaaaaatggcatctatactgaatatgtacagacattttattgtcattattccctaaacaatacaactatttatatagcatttacactgcattaggtattataagtagtctagagataatttaaagtagtctgtaggttacatgcaaatattatgccattttattccagggacttgagcatccacaaattttggtatctggaagcaatccttcacagataccaagggacgacagtacttggtgatttagatcaggctgcacattcttttctctctccattggtttggaagtcatgcatcctacttttgtttctaatagtggcacctggtatatcaaaaagaatattaatatttgttgaacgaatacattttaaaactttcaaatatttagaatatttgagtctacccctagaaaaatgagaatttgtcacaaatttatttctggaccttgtaaatatgatcctgggtttcttattgcttagtgttaaatattaaggtattaaatatttaatgcttattaaagcattattttgtgtgacatattttctctttcaaaagcatagttttacatttgcattcagtattataattaaagttacaatcacttaaatctcactttttgttaacttggtttaattattaacaaccagccacttctctgttactgaattcttttgttgttgttgtggttgttatttagtttttatttcataatcataaacttaactctgcaatccagctaggcatggaagggaacaaggaaaacatggaacccaaagggaactgcagtgaaagcacaaagattctaggatactgcgagcaaatggggtggaggggtgctcccctgagcaacagaagaaatggtctggtggttaagataaaacacaagtcaaacttattagagctgtccacagtcagcaatagtgaccttcttgctagtcttgccattcctgaacacaaagcgctccatggcctccacaatatccatgccttctttcaccctgccaaagaccacttgcttgccatccaaccacttggtcttggcagggcacatgaaaaactgggaaccatttgcgttgggtccagcatttgccatggacaggatgccaggacctgtatgcttcaggatgaagttctcgtcatcaaatttctccctgtagatggacttgctaccagtgccattatggcatgtgaagtcaccaccctgacatacaaaccctggaataattctgtgaaagcagtaaccctcataatcaaatcctttttctccagtgctcagagcatgaaaattttctgctgtctttggaagcttgtctgcaaacagctcgaaggagacgcagcccaagggctcgctattgacagcaatgtcgaagaaaacagtggggttgaccatagctggtaatacggggctcccagtggcagcaccatctgtgaagtctctgttactgaattcttaacttcaatttctctctcagttacctgggcagtgcttcctaaatgttagtatgtttaagaatctcctagagagactgttaatgcacagattgctacagttcatccagagtcctaactgttctaagcagtaggttttatagcaatattttgtaccatatagtgtggccaaaaaaaaaatatctgattttttgctcctttataaggctaactgttttgtttgcctgtgtgtgtgaaggattttttttactttattctttaaaaaattaccaagttgaaatgatataaaacccttttcattaatgttgcctggagtacggaaagtcccttcaatttttgttttttggtatcgggttttgtttttgtttgttcgttgtgctccgaagagcttttattaatctttcactactatttgtgttctaattgcttctgcctcaagaacatctgtgattcttactttggttctgggtgttcaaatctatgatctctattttctatatttttaatcatctcttttgttattttaatttttattgcacctgttcatttcaacagaaattatcaatttttttcccctcttgattttttctttttcttctttttttttttcttgagacagggtctctgtcatccaggctggagggcaatggcacagccacagctcactgtagcctccacctccccaggctcaggtgatctacccacctcagcctcctaagtagctgggactgcaggtgtgtgccaccacacctggctaatttttgccttttttgaagtgacaggtttacatgttgcccaggctggtctcaaactcctgggcttgagcaatctgcctgcattgtctcccaaagtgctgagattacaggcttgaggtaccacacctggccatgagtgttttttaaatagtgatttcttttcagcttccaacacagacttcaattgtgttatgacattctggtctctttacaatattttcttgactaatccatctccttttccaaataatcctactttttacaatctaaacttattctctcatttcactttctgtttcctgatgctgttgaggatgacaaaaaatcccttcagatttctgtgacatatcatcttgggaggtcaacatttactctgagtctctgagatactgttcccttttccttgtccataatgatttctttttactttagtttatcatgaaagagaccgtgtttgccaagaaaaagatgaagattgtctttatgtgtcacttaaacataaatctcttacagctaaatgacatgttggtttacaaaacttatatcctaatttccatcctctagcaggttttccacctagcatacctgttgggattggcatagactcatcttgtatcactacctgcatctgtattatgaaaaacaacaatccccaaggccctcgtagtttcagcatagatatagtgctttaactgtgacagatcctgacaaacatatttccaaaaatattactgccctatttagtaagcaggataatggtcttccaaaggtgtctacatcctagtccctaaaatctgtgaatgtgttagattacatggcaaaggaaaattaaggtagcagatagaattaagtttgctaatcgtctgaccttaaaacagggagattatcctccagtaccagggtgggaccaatgtaatcacaagggtcattaaatctcaaaaacagaagtagaatagtcagagcaatgcaataggaaaaagagttgactggccattgctgatattgaagatgaaagggggccacaagctaaggaatgcaggcagcttctggaaggtaggaaggacaaggaaacacattttcccttagagacctcagaaaggaattcagcctaacatcttagcccactaatatccatctatttcaaacttctgacctcccaaactgtaaaataataaatctatgtcattttgaacctcaaagtttgtgttaatttattacagcagccacagaaaactaatatatgaccatttatttgagtaaccactatttgcattcttcacatgcatatgcaaaagatgtcttcattaaaagtgatgcttcacaaaagtacttacatgcatagtaattcttgttcacttttctgattagcgtttgcatgtttctgaagcaggggaaagatagcagccaaatgattaaaggtcttccctctgtttggccacagcataagggaatcacctgttgaaattgttcattctagttccaccaaacatctcattagtagaattctctacaagaatcaagactagcttgactataaaaacaaatttttagtggcagcgacttctttttggcatatatcttcttgagtatttttatagaaagttgaaccaggtataatagaggctactactccaatatgaatttaatttcattcattcttcaatcccttcttggataaggtgctgatccacctaagtcactccctcataagtgaatgcaaacttaagaaattataccttcataaaatgggcatatttttctaactgtaaaaatgttttctttaaataggcatgactatggcctgtctattttaatttcgtatagcagtaatttcccttggggaaggagtaaaagacaatattttttaaagtttctctctatctagataggatgctagtagaagcaagatttctatatgttctgatgtgaccaagtagatatttctctactcaccagcctctgaaaatccctgtgtttacccaagatttaactaaagaggctaaactcgtgggtaaatattaagagggaattgacaaaggcatattaagtctaaggagtagactatacttttctaaaataaacacataattacagagttaacacagcagcaccttctgccttgtcagtgctgaaggccccatggcagccagtactcttcacttgacctcgtcctgcaaactttctgtacagcagataaaggcccaaagtacactatagtttagtgaatagcataaactcattcatctgtaagtactagatattacaacatcaggcttctcactggtcctactataaaaataattttatgcttgcacattggacacaattgttctggtggcatagctctttagctacaccagcactgaatagaaagaggcatcctctactattagtctgcaacagaacccagcatttccaccattgcaaacatcaaactggatgaagactttttattcccagcaggattaagtcaaaacatagattgacctaggagaagaagcattagcccttgtcaaataagtataattacttgatgacattggttagtaaagctgcaaagaatactgaggaaattaaaccagctaatttgggaaagaccagaaaggcaatatgaacaccataaaaacatgggtaaggaacagtaagatgctgacctttactgttttctctgggcatgatcctgcctggcagagctatgtttaggctcctcagaaaacccgatgctctctttgcattactagccaatgtgaagcaacattaaataaaaaaaaaaagaaaggaaagaaagaaagaaaacaatcagagaaatgcaaattaaaaccacaatgagatatcacctcacaccagttagaatggcgatcattaaaaagtcaggaaacaataggtgctggagaggatgtggagaaataggaacacttttacattgttggtgggactgtaaactacttcaaccattgtggaagtcagtgtggcgattcctcaaggatctagaactagaaataccatttaacccagccatcccattactgggtatatacccaaaggattataaatattgctgctataaagacacatgcacacatatgtttattgcggcactattcacaatagcaaagacctggaaccaacccaaatgtccatcaatgatagactggattaagaaaatatggcacatatacacaatggaatactatgcagccataaaaaaggatgacttcatgtcctttgtagggacatggatgaagctggaaaccatcattctcagcaaactatggcaaggacaaaaaaccaaacaccacatgttctcactcacaggtgggaactgaacaatgaaaacacttggacacaagaaggggaacatcacacaccggggcctgttgtggggtgtgggggtgggagggatagcattaggagatatacctaatgtaaatgacgggttaatgggtgcagcacaccaacatggcacatgtatacatatgtaacaaacctgcacgttgtgcacatgtaccctagaacttaaagtataataataataaaaaaaagaaaaccattaaaacactttagaaatatataaaggtaggccgggtgctgtggctcactcttgtaatcccagcactatgggaagccaagacaggtgaatcacctaaggtcaggcgttggagaccagcctggccaaaatggcaaaagcccatctctactaaaaatacaaaaatttagccaggtgtggtggcgggtacctgtaatctcagctacttgggaggctgaagcaggagaatcacttaaacccaggaggcaaaggttgcagtgagccgagattgtgccactgcactccagcctgggcgacagagtgagactctgtctcagaaacaacaacaaaaaagaaatatataaatgttttcatttgtatgagaacttatgaaatagtgattaagagaatgggctccaaagtcaaactgtgagggttcagatgctggtcttccccttgtagaaatgttatgtaaattatttatgcttcatttcctacatctgtaaactgggggataatactgttacctcactggctgctttgggaggatcagctgtgataattcatgtaaagcttgtagcagagtgcctaatccctaacaagagttcaacataattgctgctgctgctagggagaggctgcaaagcattctgggtaagaacagggacgctgggacaagattgtagaggctctgccattgacaagctgtaatcttgagcaacgtatttaacttctttgtacctcacttccctcacctacaaaatggaagtaataataaccattatgagggttgttgtgagaattaaagagttaatatttgttaggtgtttagactagtatctgatacatgtctgacaaactattcagctgtacatgaatggttttaaagctgtgattatggaaaaccaagggctttgtacggaggaatggagataaggagagtgtgcagcccagtcccactctgtatgcaaacaaagtaattctagctcttttacatatttaactttcaagcaagattttctttgagtaaagggtaatgctgctttaaaagaagaaaggaaggaaggaaggaaagaaggaaggaaggaaggaaaccatggctctatatgtatgagcctcatataaaatatatcagtacaggtcttacaaaacactgaatgtttttatacacattccctagcagatttaaccagatcagttttaaggttccttctagaaaggaagttctccatacgttgaaaagtgaatttcagtacattcaaattttaaagacacgacttcccatacttcttcagggtaaacaaaaatctcaataattctaatttaacatgcaaaagccatgaatattcactacagtcaaatgaataataaatcacccctgggttcaagtgcttgccatgcaaaattgcctatttcctagaacatccagaaatctgtttttaaattgctttttattacttttgctcttgtgatggttgctcttcaaagcaacttggaaaaatgtgccattctcagcattaaggcgataaaggagaagtgaggacagcagaacacggtgccatccacaaaaggaaagagagtctgtggatcagagggctgggctccggaagacagtttttaaatgtcactagataaaatttatgagataaaagggaatgttccttagtcatcctgagcattgatatctacatgaataataaatcaaaaggctctttatccatttactggtaaacattacgaccttaggttgaagatgtgatttactccactgatatcaacacaacagaaatccagtgaaagtatcactggactggccccaagttctggaaaatcaatgatgcgtgggagaacaaacattttgaggggaagagtatttttttaaaagtaaatatttgtggcactagcaacatgagtgcactcattaagatttcttttaaaggattaccctttagtctctcctacatggaaaactcaagtatactcaagttgtcaattgtataatttgatggaaagttatccctagtattttcccccaaattggattgaattattaatatttcacctttacaaatacatgcagtataattcaatttatataaaatttaaaatatacagaacttacagtgattgcaagtacctaagctggtaataaaggtatcaattaatgaaggaaaatggatatgtcaaaggacaggatagtgactacctctaatatgatcagagagagggttcagatcagggaattttcagaggactgctggggatgctagaaatacaatgtattgacttgggtgaaccttgagataggtgtttatttatagttattcattaaactgttcatacatgtcatatgcacttttcctgtacaaattatatttcacaattttatttaaatagtatgtttcattctgagatgactctccaatctattacatgagacacacttatactcaaaaaggtgttcattctttttctctgaaattcagatttaactgggcatcctgaattttatctggcaattgtaaaccaatcagaatagcatggttagattacaaataatatatatattttaaaagacaggaaaataaaccacagataaaatgcattcttaaaagtcttagtcatttcatttcatattctattaatatgatacatttgtgtttcatggtttctgaccccttgtgtccagcggactataaacataagtatgctacctagacccaaactaatttacttaaaggaaggcaaagaagctgaccattataaatacagcatgccttagaaaggagagtttcaagtcaaaaacaaatctggaaaaaaaattaatttgcttcttttttgtaaagcaatgatgtgtcgtttttatgtgcatttgtttacacagtaaaagaaaagacaatcaaataggtaaaatggatgctgtattgctcccttatacacacaaggaattacacatctgtctaacaatgctaaccactctgagcgataattatggatcaatgctttaaaaaatatcctgaattgcctgcagaaatggcaaggagaatacaattaaattatttgtaaaagccagagtctttttttcctatccatctgctacttgaaatgggatgacctttcaaatagtgcttgctgttctcaatgcaaactctaaataaagaagtggagtgtggctttttttttcctttccaggttcagcatagatacagcatttgtactgacattctacaccactccataagaatgcagatttggcttctagaacataaaagaggcgtttcaggaatataaatcaggcttttgtcccataccttcagtcatgacatttggcttctatcagaaaggtgtgcggcttctgagataagtgtttgagaacaagctacatgaagtaatttactccctggagaaaaattgcaaacctcacccccaaacaaaccgcataaagtaaatgtgttagtgaagaaccttttgttaaactacctatggctggggagctaaatagaaaaggtcagatatttaagctaacaatgggctcaaaacaaaccttccaacaggtctctcaataggcctacattatcaactaacaacttgcactattaagactattaatagtaataagccatgctttcttcactgagtctatatatattttacattgttttattgctcccctaccctttttaatttttaaagcatttccagtttggtcctttgtgtgcttttttaaaaattaggattttggacaaactttcatgtatttttcttaataaaagtgtatcaagcacatttcaaaaagttcaaaaaatacagaaatataaaaaataatctattagcacatcacccagagaaactgacttttaacagtctggtgtttatactcccattcatcttaatacataagcgtatcacaaaattagatgatattatataacaatcaaaactaatcaactgttttatgaacatctttctatgccataagtaacaatctgtatcattatacaaaaattttcattacaccttttaaatgttttatgggtatctctgtgtgtgtatagttgtaaaatataacttttaagtgaatttatttaaatacccaactacttatgagtacatagatttacagctttttccactactgtaaacaaaattgaaatgagcatccatacacacatctttgcagttatttccttagtattactttccagaaatagtatagctggaccagaaagtataaacattattagagccttttggttaatattgtcaatctgccttccagaaagtttactaagcaaggtaggtagatttccctctactgtataatactgagaaatatcaattttttggatacttgtcagtgtgagcaaaaatgtcattattgctctaattattattgctttgataactaatggggctgagagttttactggtgttttataactcttcctttgtgaatcattattcagatacgtttcaaatggtaatttgtaaagtattttgaattttggcccatttttctataagataaaagcattatcgttagtgggtgcagcgcaccagcatggcacatgtatacatatgtaactaacctgcacaatgtgcacatgtaccctaaaacttagagtataataaaaaaaaattaaaaaaaaaagcattatcttaaagtacaacaccattaggatttaagataaatacacacacacacacacacacatacacacatacacacacacaatgagaaaaatcattttaattttaaaaacaatactcagcataacaaattaaacaaaaatgcacacatacgccaggtacagtggttcacacctgtaatcccaacactttgggaggccgaggcaggtggatcatctgaggtcatggagttcaagaccagcctggccaacctggtgaaaaaatacaaaaaaagtagccaggtgtggggtgcatgcctgtaatcccagcttctcaggaggctgaagcaggagaatcgcttgaacccgggaggcagaggttgccatgagccaagatcacgccactgcactccagcctgggcagcagagcgagagtctgtctcaaaaaaaaaaaaaaaatacacaggtatgtatgtatgtggtatataaaataagtcaatacgctatcccagcactatttccaattccattttcccatggcaactaaaaaaaacaaaacaaaaaatagaaacaattacttgtttatccttctacatctttttctagtttcataccagtacatacaaacaggttttgatatagtcattctttgctttctaattccaacggtctcatatcgttccaattagtcaaatgattagatgctgccatatcatggacatgctggacatcacatatagatgtatttagttattattattagttccataatatttcacagtatggttatagtataaatatattcaacaatctcactattcatgtgctgtttttatgttaatgttatttgtcttgatttttttttgccactactaaaaatgcagccatctttaaatatacattttcacatcagagattactgactcccaaaattaaggttgcagagtcaaagagcaagtgtaccattaattttgataaatatatccagatttagcaatatatgaaactcttccatttctaagcacctttaacaagcatggatattatcaatattttccaattttgtcaactacttgactggaaaagtatttatttcattgtgattttaatttgtatttccacaactactagtaaagttgagcagagttgcatgtctcttggtcacttaaattttccctctgtgaattgccaattaatatccctagccatttttctcaaatatggtatataactgtatgtcatcagtgtctaagaattcctatttttctaaaatttatattgtttaatgtacattcatatatttaattcatctgaatttttagatttttattgtaaaaaatagtggtctaacatttacaacttactgatgaaaagccaattttcatagcatcttttattagataaacatacatttcccaactgaactgaaaagacccttttttttttttttttttaagacaggatctccctttgttgtccaggctggagtgcaggggagtgacctcggctcactgcagcctcgacttccctggctctggtgatcctccaacctcagcctccaaagtagctgggactacaggcatgtgccactgtaattgcccagtgggttctccttgcctactgcctagacagagccaatttctcaagacgagggaactgcaatagagaaagagtttaattcacgcagagcaggctgtatgggagacgggagttttattattactcaaatcagtctcccccccaaactcagggatccaaacttttaagaataatgtggtggatagggggtcggaaaggggggagtgctgattggttgggtgggatatgaaatcacagggagtcgaagctgtcctcttttgctgagtcagttcctgggtgggggccacaagaccagatgagtcagtttatccatctaggtggtgccagctgatctatggagtgtagggtctacaaaatagctcaagtactgatcttaggttttccaatagtgatgtttccctgtggagcgatttgggaggtttagaatctcgcagcctccagctgcatgactcctaaaccataatttctaatcttgtagctagtgtgttagtcctataaaggcagtctagtccccagacaggaagggggtttgttttgggaaagggctgttatcatcttttttcaaagttaaactataaactgagttcctcccaaaagttagttcagcctacacccaggaatgaacaaggaaagcttggaggttagaagcaagatggaatcagtaaggtcagatctctttcactgtcataattttctcagttataatttttgccaaggtggtttcgccaccatgccttgctaattttttgtatattttatacagacagggtttcgccatgttgcccaggctggtctctaactcctggggctcaagcactctgcccatcttggcctcccaaaatgctgggattataggcgtgagccactgcatccagctgaaaagacacttttactgaatattaacttcatatatttggatctgtttctcttttttctgtttcatttataaaatgttctcgtggctaacaacataccattttaataacagtaactttatattacattttaatgtttagaagaaaaagtaaaaatgaaacctgttgccattctgataaattatattaacatatctattttataggaatgaatgacattttataataataaaaactattagggaatatgagtatgactcttttgacaggcagttttatctccataacatttttcttttttctatataggccttttttgttaaattgttactaaggattttatattttttgtttccaaagtaatttttttctatttctagataactagttattgaaagtataaagaaaaaatttgatttttatatatttattttgtgatcatccagctaacatgttttcttagtaactgtgtaacagtcataaattctctatgaatataatcatatcacatgacagtgaagagagtatcattttcttcgcttaatttttttgtttgattacaacaagcagaacccataacacagtgctaagtaacagtgctaatagcaaatattcctgtgtattcttcctgatttaatatgagtgacttttatattttactgtttaatgtaatgtttgattataggtctttataaatattccttattgtgtttaacttccttccatgcccattttatttagagtattgctagaaatttctaatacattttatcacatttcttatcagtatgcatactgagttgaatacagtcctccataatttatagtcatgtggaatctcaagtgactttattttgaaactgggtctttgcagatgtaatttgttagattacagtaattagaggtcataagggattagagcggcccctacccaatgactgttgccctcataagaagcaaaaccagagatatagtcagacacgcagagagaataccatgtgataaaggagacagagactggagtaatgtgtctgcatgccaagaaatgccaaggactgttggcagctactaaaaggtaggaaaaggcaagggagggccaccccttagagccttcaaaggcaggatgtccctgctggtaccttgattttgaacctctagctttcaaaactgacagacaataaatgtctgttattttaagccactcattaccaaattaccaaacggtaatttgttatggtggttttaggaaattaacaaagcatatgttgtataatcaaatcatttaatcttttaattaatggtataaagttccaattcagaaccagtttgtaatttttgaaatgaagcctattttaaacattttatcatgttttcataagcagatagatacaagttgctattttttaattatatacttccacatatgaaaatgaaattagcataaaatatctcattagtgttatttatctcaagttttgatataacattttgctagatttgtacagttgagccccattctattttctctatagtcttgaattgtttaagaaccatagggaatatctgttttttaaagctttcgtatgttacaagtatcttttaatcttttaaagtacctgtttttaaatatctagtttacatgtaaaactatctgggcctggtgccttttttctagtggtacatgtttaataattttccactttcttctatgattattggtattaaatgtttttattttgcctatgggaataatataatactgaatgtatatatacttttctaaagaatcatcattttcctagatttgaaagtgaatggctataaaatttttttttaaaaaaaatctagccgtaccagtattgattggcagagttgaccaagggaagctaagagggtacataccatcttcctcccacacgactacatatgcattaaatcagaagacgacagtcttccaagaataaaatgaatcatcaagggaataagagcagttctcatccctagttagaatctctaaacaaaccaaagcaaatgtttttatttgaatcatcaggactgtgtcacaatgaaacctagatggtttgtcttcaagtcatttactactcccctaaagtcttatcaaaagtatgctaaaaaagtttatgacatttccactgagctacaataaagcttctatttttttagatacttgacaaaattttaaaaagaattatttttcccccacacctgcacacattttaaaatatcttcaacttttctacaaaacaattttctctacagctctcccagacttcacaaacatattcttttattcatagcagatggaggaaattagagtaacatatttgctctaaaatcattagtgctgcatcagcacttctgatctaaatgacatttcaaggggttattgttacatagagcaagactttgctccaggcagaaagagacagaaaaacaacttgaaaaatgaacctttttttgcaattagcttctgcatcttaatttgttgaatgccattctatttggattttaaatacaaatcaaaggaagaataaagtgatccaattctgtcagggtcataccttccttactggtcagtcgtctgattaatcattatagctgcttcctaaaaaataatgttgttaaaacttaccatcaactacttgattctctggaaaactaacatattcttacttctcagagatatcttgagaggctgataagtctgctctttagcctcaagaaatgcctaaaattaaactatttaactggtgagcttcacatgactgccactctgtccaagagataaataaacatccctggctgaagaatgaaccaacccataggtgtttctttagcacatactctgttaagtccactgtggaattaaaaaaaaaaaaaaaagtttaaggtactacacacctggaaaatgcaatcttgtaaacataggagaaaccacagagaatgatacaagatagcaacaatcatactttatatttttacactgcattacaattttcaaactactttcatgacacttttcttattttatcctcacagtaaatccataatggaagcaggataaaagaggaaggagacataaacatagaacttcagagatgaaagcaacattaaaggcatcaataaccttctttacagataagaaaatggagaccaaagggaaataagaaccttcaccttgtttcagagtcaggcaagcaaagctaatgaagtgaaggcttgtcaccccaagttgcaaaaagaagtcacaaaaataagacaagaaagagaaagatgatagaaatacaggacactaatttggatttaatgtacttttttaaaaaatagaaaaggaaaagcaattctattgaattcgggtttgaaattcaacgttggtctctagggatcacttggctatggtggttttatgccattaccagatccctttgagaaaaatactattttgaaattcatggtttccagtaaatatgttcaaggctttgaagaacatactcctgtaggtgtaaatggtgtatacacatatacacaaaagcttgaaaacactacttaattactgaacggagtctaaacattctacagctcagttaagaagctacacatgcgtctcacacccaccatctctccagctgtcctccacacaccatcccagcaagtcctagctgaccctcttaatactgtgacctctctgttgtataataaaggttgaaaatcatccttcctttgaataagaatatattataactatattattttttgttacagccttctcaaaaatgtatttcaagccacacataggccattgtcatggcatcttttatttaacagacaatagctattttccatgactcagtccagaatattctttaacatctacatctaggatattatcataattataataagagacggcactacatggatgaagctggaagccatcattctcaggaaactaacacaggaacagaaaaccagacagcgtatgttctcactcataagtgggaattgaacaatgagaacacatggacacagggaggggaacatcacacatcggggcctgttgggggtttggggggcaaggggagggatagcattaggactaatgcatgcggggcttaaaacctagatgacaggttgatgggtgcagcaaaccaccatggcacatgtatacctatgtaacaaacctgcacgttctgcacatgtaacccagaactttaagtaaaaaagaaaagaaaggtgcaaaagtgaaaacattaaaagtggaatcatgattttaaaaaataaattcacagtggtgttgaaagatcatatcagggttagaggacaagtctttgggttagaatgaacacttaatttattatcagagtgaacaataattacctcgacattttaaaacagcattttgtcaccttttaaacgtttgggaacagagaaggcgaaacaccatgtctgacacactatggaaagttttataattctcctcaaaaaggaagaaaaaatatttctatttccattccagatctgcacaatatattcttgcatcccatttggtctgattcatttacattttgctgaattctgtttttgtccattttcatcattcaaaagattttaaaaattcaacaacatcaaaaagccatcaaaagatgctttcagatgaaattgcaaagaaaataagcacatgaattagtgaagcaacttccaagttatacaattgtggcacttacatcttttctcatcttgtccgagaattaattgtactgctgaaattagacatccagcctgctccatgcagacaggagcccaagccggaagaaaactctttgaataacaacactgccttctgattcttttcacatggctacatttttgacatttacttcaatattctacccagttgcagtgtgactatgacaaaatatttctgtaggcatgactggcacctctgcggtaagtggcagggaatggaataggaaacgagtccctttagtagctccaaaaagcccacaggcactctgcaaaccttttgcatacatgctgttaagtaaaggatgtgaaaaatggaaaccgtgatgacaattttaatcaccttacagatgattctatgatctactataactttataatggcaaagccactgacacaggagactgacaggcatatattctctctctgcctctaagtctattaaatgtttatttggggggtttacacatggatagagatgaacttaacagagtatttattgaatctatccacggataaattataaatgactacaactttaactaggtggaattttcatggttatttttaatttctaggcccaaatcacttccctaggctctagaactgtcttccaggagatgtcagatgtcagtaatcagagggaacccatctacagtcaatgcagccaaaagttctgcctacaaggtagcaattagagtccagcagtctcttctggaagtgccaattactgttctgtcttcccttttgaatgcctccttaatataagaataacatatcatttttatcctatcagattagaaaatattgtttaaaataacactcacagttggcaagaatgcagagagagaagcactcccaaacagatgctggtgaggatgtaaattggaatgtcctttctggaaaacagtccagcaaaatttatcatgatgtttttatcttcctgacattagtttgggtatactgttgcatatttttaaatagtcttcaaaagctagagttttaaaactctgtgtggcattttgttacgtgaatacgctatagttttcaattatttccacatttgtcagcattttagttgatttcaacttggggtattataaataatgctccagtgaacatcttcataaatacacatttaactcacattctgtttatttcttagtatagattcaaagtgaaaatacagtggttggcaaggcttatattcaagtataattttatcctagtaattatggaattagtatcagcaaacggattcctaagctagaattcaccatcatttactaggagaaagatctgtggtggtaaaacagactctgcttatttacacagccttactaatgggcaatttgccagaggaatccaaaccagagagcatgtatgattgactaaccattacatggaaagaagaaatcagctcctaccaaaagcacattcatttcaagtaatgccagcaacctgctgagtcagttgtattcagcccctatagaaacccttcccaagttcattgatatgtgacacccatgacatatttttaccatcattggttttcatgaatttgcctgtctttgagacctgaaaaacaatctgatttattgaactgaaaaaggcgaatgtagtgaaaccctatcctgtaattggcaaaccttttacctccctggtggcttgagtagagaagttactggctggaggctgttctaaaggaaaacatgaatggccctaaaattaaaattccagactttaggagccaattaatgaggacataccacttttaatccatcactttgcaatatatttaaaatgttaagactcattgttggcaagggaacagtattccccaaagcttattccatgggaaaatgtttttgtggacaaaagagtttgggaaagagtgatattggaatgaagttcaagctgaacttttaatgtgctattaccaactgtgaatctccatggggggctgtagctagtaacatttgtaaacttcttcaaccacaaattattcctgctttatattgcctttgtttctggcaactgggtttctatagcgcattgcaaggcagagcattctatggaacgtactttagagaatgtttctctaggtcagcagttctcaaacattttggtctcaggatccatttccactcctaaaaactgtggaaggccccaaagagtttgtggttatgttggttatatctatggatatttaccatgttagaaattaaaacagaaaactttcaaaacactatgaatttattttaaaatgacagtaataaccaattacatgtaaatatacatattttcccgaaaaaagagctagtgagaagagtggcattgtctcaacatcacattaatatttagcctaatagaagacaggtggattctcctatctgtttctgcattgtgttgtgatatattattagggttgaagtgtgccaagaaaatctagaaggaatattttaatagccttttcaaataactggattttttctctaatactgcatcaaaacttaacaaatggtagtttctttaaaagttacttgcagagtagaacccgaaaccacatcaagaaatttttagtgctctgttatgtgaaaaatccatggtctgtgtagcattttgaatggatcctttccccatgtgaaattttgtaacagtgcacattgctctggacaaaaatagtggttcattggattatgcagatcttccaaatgttgacacctttcattgcatgatataaaaaagaattatatttgcaatatcatcattgaccttttattagaaaaagtctttaagtattgggaagctgtcaagctcatggtggcatatccaagtttcccaaaatttgaatttttgcttagaagcttgaattttatcactatcaacaaatactggccaacggtttacttaaagcaacagactcactttgtgcattttaaagaaaatatgttaaatacttgagtttgcataattatagtttgtctttcaatgcttctttcatgcagaaaaatagtgttccatataaaaggtagctggttcatttcactacccagtctcacaagtgcttttccttgagacaaccatgatatgtcagtacacagcagcagttctttctgcatacttcccatttcagcacacagaatgctaaaaaaaaaaaaaaaaaaaaactcaacaatcaaaatgcaattaaattaataatttttacttttcaacaaggatattcttagaaaaagttgactttttattttttttaaccatagtgcatggcagtgaaaaatgaaaggccaaaagtacagttcagtgccactgtcttgattcatgctatggtgccagtagttttaaaaaacattacatttggaggagccaagatgtccgaagaggaacagctccggtctacagctcccagagtgagcgacacagaagatgggtgatttctgcatttccatctgaggtacccggttcatctcactagggagtgccagacagtgggcgcaggagagtgggtgcagtgcaccgtgcaccagctgaagcagggcaaggcattgcctcactcgggaagcgcaagggatcagggagttccctttcctgctcaaggaaaggggtgacagacggcacctggaaaatcgggcccctcccacctgaataccacgcttttccgatgggcttaggaaatggcgcaccaggagattatatcccacacctggctcggagggtcctacacccacggagtctcactgattgctagcacagcaatctgagatcaaactgcaaggcggcagcgaggctggggaaggggcgaccgccattgcccaggctcacttaggtaaacaaagcagcctggaagctccaactgggtggagcccatcacagatcaaggaggcctgcctgcctctgtaggctccacctctgggggcagggcacagacaaacaaaaagacagcagtaacctctgcagacttaaatgtccctgactgacagctttgaggagagcagtggttctcccagcatgcagctggagatctgagaatgggcagactgcctcctcaagtgggtccctgacccctgacccccgagcagcctaacagggaggcaccccccagtaggggcagactgacacctcacacggctgggtacttctctgagacaatacttccagaggaactatcagacagcagcattcacagatcacgaaaatccatggttctgcagacaccactgctgatacccacacaaacagggtctggagtggacctctagcaactccaacagacctgcagctgagggtcctgtctgttagaaggaaaactaaaaaacagaaaggacatccacaccaaaaacccatctgtacatcaccatcatcaaagaccaaaagtagataaaaccacaaagatggggaaaaaacaagagcaaaaaaactggaaactctaaaaagcagagcgcctctcctcctccaaaggaacgcagctcctcaccagcaatggaacaaagctggacagagaatgactttgacaagttgagagaagaagtcttcatatgatccaaccactccgagctacaggaggaaattcaaaccaaaggcaaagaagttgaaaactttgaaaaaaatttagacaaatgtataactagaataaccaatacagagaagtgcttaaaggagctgatggagttcaaagccaaggctcgagaactacgtgaagaatgcagaggcctcaggagccaatgtgatcaactggaagaaagggtgtcagtgatggaagatgaaatgaatgaaatgaagtgagaagggaagtttagagaaagaagaataaaaagaaatgaacaaagcctccaagaaatatgggactatgtgaaaagaccaaatctgcatgtttggtgtacctgaaggtgacggggagaatggaaccaagttggaaaacactctgcaggatattatccaggagaacttccacaatctagcaaggcaggccaacattcagattcaggaaatacagagaacgccacaaagatactcctcaagaagagcaactccaagacacataattgtcagattcaccaaagttgaaatgaaggaaaaaatgttaagggcagccagacagaaaggtcgggttacccacaaagggaagcccatcagactaacagctgatctctcggcagaaatactacaagccagaagagactgggggccaatattcaacattcttaaagaaaagaattttcaacccagaatttcatatccagccaaacaaactaagcttcataagtgaaggagaaataaaatcctttacagacaagcaaatgctgagagattttgtcaccaccaggctgccctaaaagagctcctgaaggaagcactgaacatggaaaggaacaaccggtaccagccgctgcaaaatcatgccaaaatgtaaagaccatcgaaactaggaagaaattgcatcaactaacaagcaaaataaccagctaacatcataatgacaggatcaaattcacacataacaatattaactataaatgtaaatggactaaattatccaattaaaagacacagactggcaaactggataaagagtcaagacccatcagtgtgctgtattcaggaaacccatctcacatacagagacacacataggctcaaaataaagggatggaggaagatctaccaagcaaatggaaaacaaaaaaaggcaagggttgcaatcctactctctgataaaacagactttaaaccaacaaagatcaaaagagacaaagaagcccattacataatggtaaagggatcaattcaacaagaagagctaactatcctaaatatatatgcacccaatacaggagcacccagattcataaagcaagtcctgagcgacctacaaagagacttagactcccacacaataataatgggagactttaacaccccactgtcaacattagacagatcaacgagacagaaagttaacaaggatacccaggaattgaactcagctctgcagcaagcggacctaatagacatctacagaactctccaactcaaatcaacagaatatacattcttttcagcaccacaccacacctgttctaaaattgaccacatagttggaagtaaagctctcctcaacaaacgtaaaagaagagaaattataacaaactgtctctcagaccacagtgcaatcaaagtagaactcaggattaagaaactcactcaaaaccgctcaactacatggaaactgaacaacctgttcctgaatgactactgggtacataatgaaatgaaggcagaaataaagatgttctttgaaaccaacgagaacaaagacacaacataccagaatctctgggacacattcaaagcagtgtgtagagggaaatttatagcactaaatgcccacaagagaaagcaggaaagatccaaaattgacaccctaacatcacagttaaaagaactagaaaagcaagagcaaacacattcaaaagctagcagaaggcaagaaataactaaaatcagagcagaactgaaggaaatagagacacaaaaaacccttcaaaaaattaatgaatccaggagctggttttttgaaaggatcaacaaaattgatagaccgctagcaagactaataaagaaaaaaagagagaagaatcaaatagacacaataaaaaatgataaaggggatatcatcactgatcccacagaaatacaaactaccatcagagaatactataaacacctctatgcaaataaactagaaaatctagaagaaatggataaattcctcgacacatacactctcccaagactaaacgaaacgaggaagaagttgaatctctgaatagaccaataacaggatctgaaattgtggcaataatcaatagcttaccaaccaaaaagagtccaggaccagatggattcacagccgaattctaccagaggtacaaggaggaactggtaccattccttctgaaactattccaatcaatagaaaaagagggaatcctccctaactcattttatgaggccagcatcatcctgataccaaagcctggcagagacacaaccaaaaaagagaattttagaccaatatccttgatgaacattgatgcaaaaatcctcaataaaatactggcaaactgaatccagcagcacaacaaaaagcttatccaccatgagcaggtgggcttcatccctgggatgcaaggctggttcaatatacgcaaatcaataaatgtaatccagcatataaacagaaccaaagacaaaaaccatacgattatctcaatagatgcagaaaaggcctttgacaaaattcaacaacccttcatgctaaaaactctcaataaatcaggtattgatgggacatatctcaaaataataagagctatctatgacaaacccacagcaaatatcatactgaatgggcaaaaaccggaagcattccctttgaaaactggcacaagacagggatgccctctctcaccactcctattcaacatagtgttggaagttctggccagggcaattaggcaggaggaggaaataaagggtattcaattaggaaaagaggaagtcaaattgttcctgtttgcagatgacatgattgtatatctagaaaaccccattgcctcagcccaaaatctccttaagctgataagcaacttcagcaaagtctcaggatacaaaatcaatgtacaaaaatcacaagcattcttatacaccaatgacagacaaacagagagccaaatcatgagtgaactcccattcacaactgcttcaaagagaagaaaatacctaggaatccaacttacaagggacgtgaaggacctcttcaaggagaactacaaaccactgctcaatgaaataaaagaggatacaaacaaatggaagaacattccatgctcatgagtaggaagaatcaatagcatgaaaatggccatactgcccaaggtaatttatagattcaatgtcatccccatcaagctaccaatgtctttcttcacggaattggaaaaaactactttaaagttcatatggaaccaaaaaagagcccgcatcgccaagtcaatcctaagccaaaagaacaaagttggaggcatcatgctacctgacttcaaactatactacaaggctacagtaaccaaaacagcatggtactggtaccaaaacagagatatagatcaatggaacagaacagagccctcagaaataatgccgcatatctacaactatctgatctttgacaaacctgacaaaaacaagcaatggggaaaggattccctatttaataaatggtgctgggaaaactggctagccataggtagaaagctgaaactggatccctttcttacaccttatacaaaaatcaattcaagatggattaaagacttaaacattagacctaaaaccataccatatgaggcactattcgcaatagcaaagacttggaaccaaccaaaatgtccaacaatgatagactggattaagaaattgtggcacatatacaccatggaataccatgcagccgtaaaaaaatgatgagttcatgtcctttgtagggacatggatgaaattggaaatcatcattctcagtaaactatcacaaggacaaaaaaccaaacaccacgtgttctcactcatagatgggaattgaacaatgagaacacatggacgcaggaaggggaacatcacactctggggactgttgtggggtggggggaggggggaggggtagccttaggagatatacctaatgctaaatgatgagttaatgggtgcagcacaccagcatggcacatgtatacatatgtaactaacctgcacattgtgctcatgtaccctaaaacttaaagtataataataataaaaaacaaaacaaaacattacatttgcatcattaatgaaaatattaacatagtgaaaaagaaaaagagcaacttagtattacagtaatatagtttcgaccttgcagactccctggaaggatctcagggatcaccaggagtctgtgaagcaccctttgagcattgtggttctagattcaaaatgtggccttggctgagcacggtggctcatgcctgtaatcccagcacttcgggaggccaaggcaggcggatcacctgaggtcaggagttcgagaccaacattgcaaaaccctgtctttactaaaaatacaaacaaattagccaggtgtggtggtgcatgcctgtaatcccagctactcgggaggctgaggcaggagaatcacttgaacccaggaggcagagtttgcagtttagctgagatcacaccgctacactccagcctgggcaacagagtaagactgtctcaataaaacttacacacacacactcacacacacacacatgcaaaaaacccttagtttaaaacacaaacacatcgtacagctgcacaaaaatattttctttctttatatcctttttctataagcttttttatatttttaaatatttgtattatttttttaaacttttttttgttaaaaactaagaaaaacacaaacattaggttaagcctacacccggatggtatcatcaatatcactgcctcccacctccacatctcatccaactggcaggtcttcaggggcagtaacaggcatgaagttcttacctccaatgaaaacaatgccttcttctgaatacctcctggagttcttgcctgagactgttttatagttaactgttctttaataagtagaagtacatgctaaaataatgataaaaagcacagtagatagttcataaaccagtaacagtcatttgttatcattatcaagtattatgtactgtatgtaattgtatgtgctatacagctggcagcacagtagatttgtttacaccagcatcaccacaagcacgtgagtaattcgtgacgctatgatattagcacactacaatgtcactaggcaataggaactttttagctccattataatcttaagggaccaccctcatatctgcagtctgtcattgaccagaccattgttaagtggcacatgactgtatatacaatggaatactattcagcatttagaaagaaggaaatcttgccatctgcaacacgaatgaacctggggaatgttatgctaagttaaataagccaaacatagaaagacaaatactgcatgatctcacttatatgtagaatctaaaaaagttaaattcatagaagcaggtagtagaaggttggttgccaggggctgtggtgtgggagaggaaaaaaatggggaggtgttggtcaaagggtacaaagtttgagttaagcaagataagtaagttttggagatctattatacagcataataactatagttaataataatttatacttgaaaattggtaagaggttagatcttaaattgctaagagagtagcatttaagatctactctcaccacaaaaatttatgagatgatggatatgttaattagcttgatttcatcatttagcaatgtatacatatatcaaaacatcactttttaccctgtaaatatacacaagttttatttgtcaactataccttaataaaggtggggtgaaaatgcatattcctgaaacccatcatgggcctactcaaacagagtatctgaggaggaggcagggctacccgagcagcagcgcaggttgtacactgcacaccttgcacaaaggtatacagttagcgaagatttgagcttgaagtttgccttttaaagaaattgcatatgtgaatcttggttatagtagaactttaagtgttctagagcagttgttcttcaactttatgtgcatcagaattacctgtcttggggttgaaaacacaaatttctttgtgccatgcttgaactacctaattagaaacctgagcatctgtattttcaaggaactacttagccaactctgccacctaccaaaatgtgacagccatttttctagactaaaaatggtatagctgtctacaagaaatcaactcaacaaaagctgaagacaacacacacacggcttaggatactcaggcatcatttggacagagtctattcaacagctataaatttgttgtttaaaatagccaatgttttttaaaatgcaactttccatagttttctgttgttatatttgttttcattctgtcagtatggtattggatctcaaccttgtatgttatttcaccaacatcttgaaatttatttagccatattttcatggttttatatgaatgcttactaaacatagtctgattttttaaaaggttttatcttatgcaagattcttcaagagaaaagacaaacttagtttactgtcaaattaccaaactgactcagatttttaaaaaccattcgaagtttcatgttatgcacttaacataaaaaaatgactcaatgtaaatgtcatgtctcgtaatgatcctattcctgggatctttcacatgaaacagagtgggcaggaacattctatggctgccaaaatggaattaaacacatggaaacaaagaaacaaaagcacaactcaccccttccagacaacaggaaaacatgtagataaatcagtgattttccttccagctaaccaatgaagtagagacatgtattttaacaattgtaagggcactgggcttaaggaaaggcaaagtaaaaactaggttataatgttcttctagatgcgaaaatgccaaatctgccagtcactcatgaaaagaacacagccccaggcaactgatattgatacattcaaagattatagttatgtatgattacagaatagcatttcataaactctatcagacagaacaactctttaatggaatgttaagagttgggagagagagaaaagttggtcattctaaggtccaattaatttgaaaactcatgagttatatagaattaaacaaatttttttgactgtggaacttctcagagcccttctgtactaatgtgcattacacctctccaagaagaaaaaagcatgcagcatttttcaaacttttgatactttgatgcttttttatttagcttctgactgggctagagttctctgggacacacccagggaaatattgatacagacaggtcaaacaattaaggcaaatgctcaggcatatacctgaactgtggtagaacaatctagatgccacagaaatggtgaaggcatgcccaacagccagccccactatatcaagtcccttagcctctctccattggccttagctctgaaagaaagatgatgcttattagtaaagtgccttgggatggttgggcaagaaacactaaataagaacaaattattaccctcattacagggtagatgatctaataaaccatctctattacttacaaagtttggaggcctgctatttttttccttttaactacactccaatttgaccttaaaaatctatgctaaaaataacttataggaaatatcccaaaaccataccataaactttcttatcggacctctgtctgtttgcacattctcaatgactgccaatcacctacaggtaaatgcaaatttcttagcctgctgtataactctccatctttcaggagctgtagagtttatgattaagatcatggtctttgtagggagacagacaaggttcacatgcaggctccactctactacatctgaagttatttctcttctctaagccctagattatcaaagtatggtccatgaactggcagcgtcagcagcatttggggcttcctagaagggcagaaattcaggctccattgaaaacctactgaatcagaatctacatttcaacaagagcctcacactgtagtttgagaagaactacacaaattctcatacgctttgaccagctcctctgcaaattggaggtaataatagtaaacttggagatggcattcatcgtctactcctttgaatccatcctcaagtcctaaggtccacgcaaatatccttacctgtctctttcccttcattaccttagtccaagctgttctcatttctctccagatctcctgcaatggccactcaactcattacaatgcatctcctcttgcttccttctattctgtttcacttactgcaaccagagagatctcccaggaaaagcaaatgtgatcagagcttccatgagctctcaaaataaaggccaaaagcctttcacagaactacaacctctgttgagggggtcgcttcccacctctatatcttatcttgcatgatgctccacctggtttcctctgctccagaagcactggtaaattcttttttccactccttgaactagccatcctccttcccgatacagaatatttgcaaaaccatcctcctggtcatcagtgccttcccctcaactctttacctggttaactccttctcaatctttagatgtcagctcaaatgtcatctcccctgaaagctttccctgaacctcctacccagcagccaaacacactgcctgacctgttgcctgtgccccataaatatttgttgaataaatgaaggaattaatgaatgttcattcatatggttattgtgacaatcaaatggattgaaacctgtaaatcatttagcacagtgcctggtagagagcaagagcttacttaatgcagtaccaatggtaatatattttgaatattagtcttgctaaaaactagaccccaagcagtacttaacaggggctaacaattagaatcacctgggaaatgttacacttctcaatgtccaggctctgctgcagaccaattaagtcagaatctctaggtggtgggacccatgcacctgaggattttaaaactctacaggagattctaacgtacagccaaagtgtgactgctttactcgttgtctcactgtggtctcccagccttccagagaatagcatactgggcgtcaagaagagtcctcattaatcatggcatgagtctgtggcccacagaaaggggcagtaatatgaatacatgtagtaaaaatctagcaattcatttcccctggctccttgacagcagccagatggtggaaactctccatctattacccaagccagaagaaaacctttctgggaaaatccaagttgcctgaactactgttgggaggaagtatggtaacacgtgaagatgactctggtcctttgggttaagtgatgacttaacaaaattcatcaggattccattataaatctgtcataattgttttgttgaagcaattgctttgtgggagcaattaattcctactgctaaaaaaaaaggtgagaactcctgagtgttccatcaggcaccaagaaataggtgagccgggaagcatttgcccttaccttctgtcttcttcactactcaagtatttggagtgtcaagagaccacactgtacttcaaaggcctcctcttccaaataaccaaccttctgctatgtaaaaacatgattaagaacacacatatttgtactgtatgtctcactcattttgaacttttcaaaatgtgatattgccaaagaagctttatctcttttaagggtttcacacacacacacatacactgccttggtttgaaaaacaacatagaatgcaggcctcatacaatttgagaaccatttacaattataacctaccaagtcagagctgataccaagccaacacaaaggcctcagaattgttataaaaggaacagaattgctctctggaaataatatcccagtgggctaaattccccctccccctgttcctccaaggtggtaaattgcaacaacaacaaaaaagcatgattcatgaatataaatttttcttggcttttaaaatcatacactggcatagtcctccccgaacttcagccaaatgagaatacacagataatgacaattttacaataagtggttccaggacacaggcttttcaagatccacaaatgaaaggcactataaaaaagagtattattattattattatttcaagcacccagaaaaaccacaatcaatgattagccataacaattaaactaacaatagtacatctggaatcagctccatggtaatatgtacttcatgcttaatagttcaaattaattcaatctgatggtgttagacataccagttaggagctggagagcaccaaaattcacattagcttccacttcaaaagatattatgaaaagagaaggaaggaaatgaggctataaacagcagtggtaaatacgaaaggctcagagatgatatggtcaggaataactctcagctattaggaattcagtgatgaaaatatgaaggctgatatttctatccttgcacattcctccagagtcaatgactgagccacccatctgagcgacagaactgaaaccctaaaatcagggcaattatattcaaagaagagggggccttcttcattctgcttacagcatcctttactagtagcccatttatattgcagaatgcatggagaatttctcattttcaggttatagacttcaagtaataagaaaagagagcaggagttggggcaggcataaaaggtgaggtagttattgcctgattaccttatttgtctcactcctccttgaagattcactagataactgtcttaagctgcactataaatattctctaaggcaggatttctcaaccttggcactgtagacactttggcctaggtcattctttgctgtgaagtgctatcctgtgcactgtaggatgtttagaaacatccctagtctccaccttgtagatgctagtagcatcccccacccccagttgtgacaacaaaatgtcttcagacatggccgtatgtcctcttgggggaaaaatcatactggttgaaaactgttaccttaaatcttttttttttttttttttttttttagatggagtcttgctctgttgaccaggctggaatgcagtggaatgcagtggcgcgatctcggctcattgccacctctgcttccaggattcaaatgattctcctgcctcagcctcccaagtaactgagattacaggcaggagccgccacatccagcgaattttttgtagttttagtagagactgggtttcaccacattggcgctggtctcgaactcctgacctcaagtgatttgcccgcctcggcctcccaaagtgctgggattacaggcatgaaccaccgttcctggcctactttaagtcttaattcacttgtttctgggcatcgggaggaaaatccagagggcagactcccctctagactcttcttcctcagagatgagcatggattgtattgccagctgtgtgcaaggcagcactcttcccacggcatgctgaatcctcctcctaacaccttttgcacatataggcttgttgcatataatacagaaatttggaacctggcagtcttctattcattgtgcagaaaagagttaacacagagcaggctcgagaaggcctatccttagaaggcctgtttgcaatgttggcctttggttagcagctgggaattggagctggtaaacagttccctacactaatatgacatttttcctaaattatagagtggccactatgcctcacctgtttgtacaaacagtgtggtttatgctgaacacctgctttccttctgggagtctggaatttgggtatgtgctaggcagatcagctcccagcagtagccttgggcactgagtctctaatgagtgccctagtaggcaacacttcaaacttgttgtcgcagcttgttgcttaaggaactaagagcatcctgtgtgactgcattggaagaggactcttggacgcttactcctgatttctccagactgcacaccatgcaccttttccctatgttgattttactttgtgttctttcactgtagcaaatcagaaccagaagataacaatgctgagtcctaggagtcctcctagagatttacagaaccttgcaagtggtcttggggaccaccaatgcagggactcattcagcattctatttgtgtgcctctatttctagatacagcaaagacttaaactccaagtcctcacagaatttatgtggtagcagcgagcaaagcattaattctagcatatttcaagcttctttcatagaaaacaagccctgtggcatctcttttttgtttttataacagctttttagagatataattcacatatcatactgttaatcaatctaatgtgtacaattcaagatttatattcatagagtcgtgcaaccacgaccacaatcaattttaggacattttcatcaccccacaaagaaaccctatatccatttacagtcactacccattttctcccaaccacccagctaggcaaccactagagtttctgccgctatggatttacctatttttgacacttcacaattggtcatatgatatgtggtcttttgtgagtggcttctttcacttaccaaaatgttttcaaggttcctccatgatgtaacatgtatcagcactacatttatttttattgctgaataatatttcattgcatggatataccacatttcatttatccattcatcagtaaatggaactttgtattgtttctactttttggctactatgaatagtgctactatgaacatttgcatacaatttttttatgcacatatgatttcattccccttgaatagctacctaagtgtggaatttctgggtcatacatatgtttaacttttaggacattttcaaactgttttccaaagtagctgcaccatttacttaccaatggcagtgtaacagagttctaatttctccacatccttgctaatagttactattaactgtctgttttttttttttgttttttttttttttgagacagcctgtcacccaggctggagtgcagtgatgcaatcttgactcactgcaaccaccacctcccaggttcaagcagttctgctgccttagcctcatgagtagctgggattacaggcacgccccaccatgcctggctaatttttgtcattttagttgagatggggtttcaccatgttggccaggctggtctcaaactcctggcctcaagtgatcttcccgcctcagcctcccaaagtgctgggattacaggcatgagccaacgcgcccaaacttatctgtctttttgctaataaccgtcttagtgggtgtgatgtggtatctcgtaatggttttgatttgcacttccctgatggctaatgatgttgagcatcttttcatgggcttattagccatttgcatatcttctttggagaaatgtctattcagacctatttgccccattttaactgggctatttgtctttttattattgatttgtaagaattctttttatattcatattctatctccaagtttcttatcagatatatgatttgcaaaacacttcttccattttgtgggttagttttattatttcaatcatgtcctttaaagcataaaagttttaatttttaggatgtccaatttatccatttttttcttgcattactgtgcttttggcaccgtagctaagaaaccattgcctaacacaaggtcatgaagatttatccctatggttttgtctaataatgttatagttttagcttttccatttaggactttgatactttaaggtaatttttgtatacagtgtgaggtagggggtccaactttattcttttgtgtgtggatatccagttgtctatggcatcttttgcatcactccaagacatagtttcaggtaatttttgtctatacaaattaaggtaacaggtaccaaaacacagaacctatgtatgtgacaaactgcctgaaagcctttataaaaacttttgcaattggtgttctttttttctattttcagaatatgctcagtattttgctatatcaggaagcagtaccaccattattaccactggtgctactgctgctaataataatagtaactagcagatattttgtacttagtatgtgccagacactacacttgcatttaacattcattaacttttaagcactacacatgctttaacttacatgatcttcctgccaacaccacgagataggtagaatcattatcttcattttacagatgatgatattaaggctcactgatgtaaaaaaattttccttaggtcatagaacaagcaggaaaaccgatttaaaaaaattgagggaaggaatggcactggaaagtggaggtcaagtaatgtcggatagcaaattctaacaaacagtagctaagcacgtatgcgaaatatacaaaaataaacaagccaaaatctagcactggtagatgacattcccagttctgatcaagttgctgacaacaaaggattggtctccccttctaactcaacaaagggtaggaaatcttatcactcaagatatcaatcaagatttatttgatcgctgaaagggttttgtcaacactccaaaaattgtattagtgactagatgattgatggaataagtcaattagaaccagattagaaatcgagatatgaagtcaattacttccaatctgaaaattaggaatcattaaacaataatataatagatggcatcaattttcaaaactacccttcgtgtgtttgtctatagggcaaaattcaagtaaaaaataactttgaaaagactaaaactatagagcaacttgatcttgggagtgttttcccagatgggtagtgggctgagtctggtcagttttcagtggagaaaatgtagacgagataagcagttgatgttcccaaattcaaataactttatggcagaaaagtcagtcaagtttaattctctttccctatactagctgtgtccttaatgataaatacaataataatagctgacatgtattgagtcttacattatatagctctctaggtacctaaaagatgacaactaatttatttaaaccaaggcatatgaagtaagtactattattattcccattttatataagaggaaaaggatgtgtaaagtgctaattgacctgcttaagaggtagagtgagaccttgaaccctgtagtctatgtttgtcctcctaatagtgtctctatatggtttcagaatagaagcaaatagacacataagggttaagcatggctaacctaactccaagttgagtctttttacactaggcaatgctgtcttcaatatatttataataactttatacaccaaataacattttgaagtttatttcctcccaatacagaaacatcactgcatttccactgggattttcagtactgtctgttgtggaactgatctgggcttagtgagtattgctttatcattcttaaataaaaaccattatagagaatgcagaaaacaatttccctttcagtttgcccacttctacccataccgagaaagacggatccttaaagctcagaatgtaataaaagctcacaatataataaaagctcagtatcagaaatgttccaagtccctccactctttctctatagttaggaaactaaaatttaatatagggcacaacgctccagagaattcagtgtatcgaaatgttaatacacttttatatattttaactgagataaacaagaaagagatagggaagccagagcagctatggcaaagacataattatgataagactaatccagctaacagcaatagaagcagatagtgactccactgtgatgctgtggtagagtttgtatggtcagaaaactatatcagtatacaatgttaatgacgcaggagccccattataggaaagcaaagataacttactatgtgactctataaagtaaagttcatccaaaagatcaaagagcatttgtcctattactaaaatattatccaaatgtattttatcaattaaaacttggataaaatcatttgcttcattgaacagtaatttaaaaggagcataggctgggcactgtggctcacgcctgtgatcccagcactttcggaggccgaggcgggcggatcacaaggtcaggagatagagaccatcctggctaacatggtgaaaccccatctctactaaaaaatacaaaaaattagctgggcatggtggcgggtgcctgcggtcccagctaatcgggaggctgaggcaggagaatggcgtgaacccgggaggcagagcttgcagtgagccgagatcacgccaccgcactccagcctgggcgacagggcgagactccgtctcaaaaataaataaataaaataaaaggagcatagtatgtccataaccaaataggaaggaaaatgcctattttgattttcataacagagcttaaacattgtggcaaaactttaaaatgcaggacataatgtaaaaattcttctaccagctctaaattcgtggttgtgctatcaactatgtcacatttctcagtgttgaccacaaaaataccatgagatacatacacattgctgaaatacactatttctcaaactcaactttatcttctactccaataaccctgtcaaaaggaaaactagtctggttacttcatttctggcagatccacattaactcctttcttttaatgctcattaatctttctgttaacaatacttctgaccctcaatacccaccctttcagacaggtcaaaactaaattcttcagtttaccatttaagcctttccttcaagtttttgcaggtaaaatgagataaaaacagacgtttgtattccagccagattgaaattttctactaccctctttgctcttcccattaaattctacctcgcagtttgtttgtttttgttttattttgttttgcgtcgtttttttaaaaaaaattgtttattgtttatttactaaatctggggcatattagatacttgaccaatttaaaatttacatcttttaaatcaattttgaagtgttttcacacacacatacacacacacacacacacacacacacaattggcatgcaacagttgtcctaaggtgaaacaatcacctcatcaacaaagtgtcataggtgttctcacccaaggttgcttatcctaaacctgaaaacctgtaacaaatttaaattacttatataaaactcattacttgtagttttccccttgcaaagatctccagaaatgtacaaataactaatatacatcagtcacaacataatcctggatcatccccacatcaaaaccagatgctcctttaattttaaactcattatcagagagcaagagaaagtcatttcgttttacacaaaacaaaattcacatatgccaaaaaagaaagacccaagagaaacaaaaacaaaaaccctagtgctgacactgatgttcagtgccctggttaaacagtggcccgaaggccacggatcaaaaataaaatagcggctgtatatcactgcaatgaagtttaacaggctttaaccttctggcttcagaaatccagatttttccaattacatgaatgcatacttcctacattccaagagtggagaaagtggatgcgccagtgtggaaatgaaaagagccaccattcactgggacaaccacagaactggctttaacagagactccttagaaagttacgcaaaaaataaagacaaaaaatggttgtatgcggcttgtgtcatcaattttaagtggaggtgactgagtcctaaggtacaatgtaaaatgtatgggggaaaataggtgctggggcaagtcttacctttaaaagcaaaacttgaaaacaaagtataaaagtgcccagcctggcagcatacacccaagccagagagctctgccatgagcatgcatagaaaatgtcaggattcatactattgtttctcataaggactcaacaaaatgaatccttaatagcttaaaccacagaatgagggaatacacagaatgcagtcatttcagtaaagtactatcaggctttgtgctgatttcctgaactaactgcattttattatcaaaacaaaaggaaaagaagattttaaaaatatatatatatatatattcctatatttcaattccagtgtttaatttctggaaggacctatataatggaggcagcatttaattaggaaattatgccaatcaattgtcaaattttcactatgactttcctaaaaaggtgttttcttccaatttctattaatcacaaagaaacataagctgtgactgtatagttcagaaaattaaaacatagaaattaatggcctatgacgttatcaccaaggtgtttggtaaacagtaaactatgagtttggaatcatcaggaagaggcttttgaaacaaccctctggacttcaaaaaatctcttcaggtagtagatgtgtcccaatgtcatggcaattagaacaagagcttcaaagaagcaccgaaggaccactgggctgtttgtgttgtcactaatggctctgtgtatcctctcccagattttcgtgtattcctctttgtgctgtacagctgtcatggccacagccagctcactgatcatttcttctagtttgttctggtgagcttctgtttccatgtcttctctttttgtagcctccccaatatcaatggtgaatatcactatctttggagtcatggtggacactcggtcactaaaacaaaatgtatttgttccatccatgtgagcagaaaatgtgtatttcccactggattctttgtctcctttataaatccttttattcttaggtcctgtaatctccatgttgatgcccaggaagccaccttcgaagatgaggcccatcttggtgcctgaggtgactcacttaagcattcttcagcatgtgcgtggatgctgatgaaatagcccaagaccatggtcaggagagtgttctggagcaacagcagctcagcgagcgtcaccacagtggggctggagcagaggccaggactcgcactgcggcctccagagccactgccgccatcaccaccctactgccttcgcctacctggcactttttgctaatcctaggaaaaacgcaaactcaaatgccttttgtgctgggaggtactgtaaataaatgaacagagaagtctagtgttaagaaaaataagacaggccaagtgcagtggctcacgcctgtaatcctagcactttgggaggctgaggcaggtggatcacgaggtcaggagatagagaccatccaggctaacacagtgaaacccagtctctaataaaaatacaaaaaaaaaaaaaaaaaaaaattagcccagcgtggtggcacgcgcccgtaatcccagctacttgcgaggctgaggcaggagaattgcttgaacttggcaggcgaaggttgcagtgagccagggtctcgccactacactccagcctgggtgatagagcgagactctgtctcaaaaataaataaataaataaaaataaaaaataaaaataagacagcagtacgttactggccgaacatatctgagtcatgcgtcatcaaagaatgttaccagcagtgaatctgtatgggtctgcagcaacctcagttcttacctcttcagaagaaagagttcaaccaaggggcataaggcagaaggagacaccaaagcaagttttagagcaggagtgaaagtttattagaaagctttagagctggaatgaaaggaagtaaagtacacttggaggagggccaagtgagtgacttgagagatcgagtgcatggtttgaccttttgacttggggtttcatatattggcatacttccagggtcttgcctcccttctcccctgagtcttcccatggagtgggctgttcacgtgctgggtggcctgcatgcacagtgtgtttactgcagtggtatgcatacccacttgaggcatgcttcccttacctatcaagcgtccctataaggtcatacaccagttaaactccaccattttgcctcttagtgcacatacttgatcccacgcacccacctcctgagatcttattaggaagctgctgatcaccggttttaggtttcttctgtctgttgggagactattgttccctggtgccagctgcaaccaattattatttgagagaaccatcttaacaactgcctgaccatcacctgatggtcgcctgacattcctggtgggatgtggggtgtccctttactgccccaactcatatctgactagctgactagctacctactgtaacaattacacttgattgcatttttttgttgttatttaatttttatttcataatcataaacttaactctgcaatccagctagggaacaaggaaaacatggaacccaaagggaattgcagcgacaatacaaagattctaggatactgcgagcaaatggggtggaggggtagtctcctgagctacagaaggaatggtctggtggttaagagaaaacacaagtcaaacttagtagagctgtccacagtcagcaatggtgatcttcttgctggccttatcattcctggacccaaagtgttccatggcctccatgatattcatgccttcaccatgccaaagaccacatgcttgccatccaaccactgagtcttggcagggcacatgaaaaactgggaaccatttgtgttgggtccagcatttgccatgggcaagatgccagtacctctatgcttcaggatgaagttctcctcatcaaatttctacctgtagatggacttgccaccagtgccatatggcatgtgaagtcaccaccctgacatataaaccctgtaataattctgtgaaagcaggaaccctcacacccaaatcctttctttccagcgctcagagcacgaaagttttctgctgtctttggaacctcgtctgcaaacagctcgaaggagacgcggcccaagggctccgtgtcaatggcaatgtggaagtacacggtggggttgaccatggctgatagtagggtgctcccggcagtggcagcgtctgcaaagactgcttttttttttttttttttttttgacaaagtctcgctctgtcacccaggctggagtgcagcggcacaatctcggctcactgcaatctccaccttccgggttcaagtgattctcctgcctcagtctccggagtagctgggactacagatgcgagctaccacacctggctaatttcttttgtatttttagtagaggcggggttttgccatgttggccaggtctcaaactcctgacctcaggtgatcggcccacctcggcatcccaaagtgctgggattacaggcgtgagccaccacgcctggcctgattgcatatgaaatgcactatttccccatcctatctcacccccatctttttttaacaaagacttctgaaaatgtatttttcatctttcaaactttgctggacaagtttttatgaatagtctcaacagtgcaagcatgatgctagagagcaattaacctttgacttcagtgttgggagactgcagggagaggtgaagactgcgacaaaccactcgtgtatcatggcaatcgctactccctctcagccatttcttgccaactaggaattcaggcagaatgttgtcagatctttcagttattacagaaaagtaagaaaacctgcattttatgtgaaacttccagattttctagtattttctaatttttgcttgaaatcttttattgttccaatatattttatttctatattcctgtgtagcacacatctggttttttatttgtgtggtttttgttttgttttgttttgttttgtttttaggccagtgagctgacagatcgagacctctgggttatgtcattccttggtcagtagctttcagtctttttcaccactacacccacctcaaccaaccatcctttccaccaaccgatgcccatcacttcctttcagatgttgctgaagaaactatttctccatataattttccctagatcactctatccttcattcctcattaccaaactgttttactcttttagcctttagtatgtatgctctgtggtccattggtgagccctttatctttctctaattacacctggactatagatttctaatgccgaggacccttggtctcctgccacattcacattcccttagcagaatgttgcacacccagcagacagtacatgtatactgtgagtaaatattttgtattcctagtcttgctaggatagaagtttttattctatacttgatgcatttctggatcaaaatattaagtctaagtcaagtctccatagttaaggtaatcttgaggattaaaacacttaggtggacaggcaacataaaacactttatctgaataatgaaagaagaatccgtctgttggtctgaagtatcaaagcaactgtcccaatcctacaaactttcagcattgggacttcctttcaagatgtaagcagggatggaaaatatacaatgcaagcgccattgtttcactctcctgggcctgtgacagacatcattaagtgatcacaacgttcttttcttctaaggctgaatgcagtcttagaaaccattttaacatggtatcctagatgtatcgtgtccatcttgtttatttctattaagaaatagagttggcatgagagctgaagatcctatcatatgaaggtacacatacaatttattattcaaaagccagagaacaacatacaactgctgctgcatctcagtctctctatattttaatttatttattgttttgagacagggtcttgctttgtgcaggagtgcaggctggagtgcagtgataccaacacagcttactgcaacctttgccacccaggctcagaaggtcctcccacctcagcccccaagaagctgggaccacaggcatggcaccaccggcatcccgccatgttaccaaggtctcaaacttctgagctcaagcaatccactcatcttggcctcccaaagtcctgggattacaggggtgagccatcccacctggcctcaatctctgtatattttagaggatagataacttcgaatgggaaaagttgtctctaaagttgaccagtcaagaagaaacaatgcttccactttaatgcctatgccagacttaccttacccattaacttttaatcctgtaagaaagatttgctatgtgatgaggctgcttttgttgcaccttgtaaaacatactgaaataaacaaactgtaaatgactttgcagggattgctgatttaaataaataaattgttataattgtagttacagttatagtcaaggggctatttcatttctcagactctgaaccaaagcaattaggaacaactcagacacaaaatgaccagcatcaagaattacaatgaaaagccaattacctttaactataagaaaccttatttgcatttattaaaacaaatgatctctcagtactggagaaaattatgtggattggttgattaacccttcacttgtaagagaccagaaattacttttcagagagcctgtatcttttctaaatttacagacaggaaaccagtaaatgataaatgatcaaggcccaaggaaaaaactgcatagcacaatggacatctatgagtttcacttgtgctagcatgcattcctcattgtgctggtaccatcatcctcactttcctctggggaatccccttctccagttctgactccagatggtgtagatggagctaacttcactccccactgagaatgagcaaatgaccaatcaatgtatttcaccgatgaatgattcagggagccaatcattaattcgagtcagtccagtactactcaatgctaagatttgagaactactgaaggaactattgtgaaagggaagaatttaaaaaaaatcttgctggcattctgagctggtaagataaaaactttgagcgtctagcggccatctaaccactacaaagtgagaccatgcctatgcgtgagaccaacccaatggaaagaaaactaagagatgatagagacatatttctgatgccatctttgagaagctgcatccaatcattctggaggcaaaaagctcttaactttatagataggcaagccaaaatcttcttactttcattaagccacagttagagctaggtttctgtcatttgtaaataaagaagttaagactaaatgcaaatcacttatagcttattttattactaggtactcaatgtctatgcttttgcatagctaagtgagagaacttaaattccaatactgatgggctattacctcatgcaggtaccctaataaatcttgtttcctctcagtgccattgtttcctcatttctaaaatggagattaaaatggtagctcacaaagaagaaatacaaatggcctataatcacatgaaaaaactgttgaacatcattagtcaagaaggaaatgcaaatcagctctacaatgataccacttcacactcactagaatggctatgatcaaaaagatagacaataacaagtgttttctaggctgtggagaaatttgaagtctcatattggcaagtgggattataaaatggtgcttcaaaaagcatctggcagttccttaaaaagttaaacatagagttaccgtgtgacccagcaagtctactcctaggtatatacctctgaggaaataaatatacaagtacacacacacatacaaattaaaaagtccataaccacattattcttaacagccaaaatgtgggaaaaaaaaccttaaatttccatttactaatgaatggataaacaaaatgtgtcatatccacacaatgggcattatttggcaataaaaagaaatgaagttctgttacatctcacaacatggatgagccttgaaaacattatgctatgtgagaaaagctagtcacaaagaccacatatcatatgattccatttatgtgaaatgtccagaataggtaaattcacagagatagcaagtagattggcagtcaccaggacataggaggagaggaaggacagtgactgttaatggctaggggtttcttttcagagtgatgaaaatgttctagaattagatagtggtaatggctactcaactttgtatttatactaaaaccaccaagtttcacattataaacggataaacattgtgctatgtgaattatttcaataagaaaaatatcttatagaaaaaaaatggtagcctattctgattctcacaaatgaccattataagaaatccatgatgataacaatattaaagtgacgttcttgttggagcctaaggaaaaacaatccatacaaatgcaaaggcctattgtttttaaggcctcagcaagtgctaagagaatgggaaaagaaaattaccaaatagattttcccagatcacttagcttcctttgtatccagcaatggtcaacaaatatatagcaggcatacataaaagctattcggagatctcttgaggttaacagcatgcaacatattgccactgcccccagcctggccaggaatattatttatgccaccctttcacagctgtatcaatctcccatgaaacattcagagcctccttgttaataaactacattatgagccggatgcattgtctggataaactgcattgtccaaaacactgccccattattacagaaaatgcagaatgtaattagtattcttctttgcataaactgcagcttccaaaaatggtgccatattataaagccttaattaataaacaagagttgggccatgaccagttacacttatctgaattttatattgtgaagaaaggccactgttcaaattccgtttacaaatatctaaattctggctagcctacatgaagatagtctaaacagaaagcctgagaattctgtgttgctaatagcattgtgttggtacaccaacaatagcaagccattaactgctgggacataaaccatcctgagaaatgttcagagtggaaggatgataacattgtatttcagctgcatcgtatggtgcaattcttctatttgttcatatgcatttcccatttaatagatggaggaaccagggtggcttttcatatctctgtgaaaccttaaatgtgggggagaaaagtgagctggcaaaaaaacaaaaaggataagtacgaggtattgtggggtgggagcagggttacatcacaatggaatgtaagtacacagttgctttctccatttccagctggtttttattgattttcccctaacctaaccccaaagcaaggccatttacataagtcatgagcattgaactaatatttgggaccataatattaagcagcccattttatgaacctcggctaaaggagcatttgcattaaactgcactcacctgattaaaatccatcaactctagcaccttgagaattgtagagtacctgttaagctcggctgtgggactctgcatactgaggcagaccataatcagaaggcagcaaggaatccgaccgggagaggaaagggaggaggagaacatgtgatgtgtgttgaaaagcagatcgcatgaaagaccgccagtgctcaaatctgaaaagagtcctaagcctactgcaaacacagagctgtgcgaacatgataattctttcagcaaagtccataatatggcttatagggccctgtgaaaacaaggtggatgagatagtattacagttcagtgaagagtaactggcccagcaatggaatgtagcatacacaggaggccccaaaatggtccctgcctcagcagaatgagcaagagctcagagagtccaagccgagggactttctgcagcctaaacaagccgtcttagatcactgccctttccatcagctccaggtaccaagcacaggctcagagtcctatctgtctcagaaggacctgctttaccgtgaccgcaaggatggcatttgaatcagtaataggctgtcagaggccaccttgatgcatttgaagaagagctatccctgagacattggttcaagttctcgatctgtaccacctagctgtgtggtcacggacaagcagtcttgctcatctgaccaagtggatgcagataataaacacatgtgaaatgaatgaatgagagaataagacctctgaagcagaatttctctccccagtgatacagacagaagacaaggaaatactgggtagaagagggaggttccctggcaaaggccccaacctcaagcctggagacctgcggcccctaagtggggcatttctgtttttgtacccaaacggttgccttttggcatgccacactcccttatcctgtacccatataaatcccggaccccaggctccaggagcagacaaggagaagaggagaaaagcagacaaatgacacaacagagaaagagagaggagaaggaatgtctgaacgccgagaggaactcagctgggggcagtcggagaagagtttggccgctgaacagccaaaactccaggggaagatcatcttcccattccatcccccagccagctccccatccatcccattgagagccacctccaccactgaataaaacccctgcatgcatccttcaagcctgtgtgtgacccaattcttctaggatgctggacaagagcttgggatacagaaagctgtcacactggccctctgcccttgcagaaaggcagagggagcactgagctggttaacacttaagctatctgtgaatggcagagctaaaagagcattgtaacactggggccacaggcacccacccctagacactaccatgggactggagcccaaagcactcactcttgctcctgcacctggccatctgtgtgctccctctcccacaaggggtttgagttcatggtggttgaacagagagccgcacccctgtcgcatgccccatgagtggggccagggaactcttctgtttcatcaacactattgacatttgaggtgggatgattctttactggggaggctgtcctgtgcattgcaggatgttcatccctggcctctacctacaagatggtagtagcacacatactccctcaattataacaaccaaaaagtctccagacattgccatatgtctctcaagagccaaaattattcccagttgagaatctctaatttatccttcagaatgtacattccaggatctaaattaatgagccatacacccagatagtgccccctaattattaggaaaacttacatagataccttcattatcactggaaattcatcaagacaaaaattttactgagcacctattatctgccatgtagaaagatactgttcctgctcctgagaagctcacaagtttaagtggaaagtggcattttacaacttcacatcaaagaaaagagaaatgttcaggtaaccatctttccaataaataatagaatatccttctatctgattagagaggtgaactgtaaagacaggcaagaatcagagcatatctctttgctattaaaagaatactacatgtatcaaagttgctgacatttgataaggtgaatttttggtaattttgactcattttagatgtttgctgcagttgtttattgctgggtgcagggagtctcagactcaaaggacaatcttatgaggtggtttagcctaagagcataagccaaaagagagagctctggaatgaaactgcctggttttaaatctagattctgccatttgcttgttacgtgacccctggcaattcattaaccccttcaatcctcaaatccttctctatgaaaaggagataatcaatgtacctacctcacggatttgttaaaagggttaaataacttatgtaaagtgctgaacacaatgcctcccacaaagcaaaaattgtaagaacaatagctgttagcattgttatattgatattgctgcctctccattttattatgatcttttttattgtagtaaaatacatgtaatataaaatgtgccatttcaatcatctttaagtctacagttcagtggcattaggtacattcatattattttgcaaccattaccatcatccatctctagaacatcttttattttccccagttgaaatttcccattcctccctccaccagggttgttctcttaaaccagtccttacccagcaaaataccttctaaggaaatgaggacaaagcttttgtaaatgagactaaaggcaattcaaactcaggtaccctggaaactgaatagaggtagtgcttaaaatggccatttgggccacttggggttatgttgatgagtttagtcaccatgaaccaactcctaggagtaacattctaagtgggtttttgttttgttttgttttttgttttgaggcaaatggttcctggctctgtggccttcccatcttaccatcacagaagcattcactctactcctctaatcaatattaacccagaaaaaaagtccagggacatatatattttggtagcctagaattaatgggaaaagacaagttgctgggtctaaactatcaaagtcacgtactttttaacagagaatgaacaaacctcctcccttcaagaatccacctgtttttgcaagagcattctggggtgggaggaaaaccttctgatttctagccagctcctcaaaatagctaaagagttcctaatttcacctcaaacctctgtttcagcacctactgtgttgtgccaagttatttctcatccactatcatttttgacagtggatctgaccctattgcaatcgagtttaaggagtttgtagacaggaaccctatctgagctgtcagcacgttgcctgatcatcttcagcaagtggtctggcagaagcatgcaggtaaggatgccctgaagcaggctgtcaagaaaactgaccaatgagaaaggtgttttgtgctccacagctgaagccaattctgctgggacatcccaagacagactccactcggactcaactgataatacacactttacatctgtcactatctgcccaggcatattgactttgtaacattccccccaggcacttcaagtccagtttcgactctgtgacttttgcctgtggtcactttgcctgaaatgccctttctccttctccttcttatccattcattaggatctagcaaaatgtacctcctttgaaaagcactttctgtagccctcaggcacaagtggggatggctgtgttggaccagaaaaagcaaccattgaaatttccaaactgaatctgtactttgatttatttcagtgtggtataatgtatggtataatatatggcaatgttttccaagtctgactgtacatcacagtgacctgggggacttttgaaaaatagattcccaggctcccctccaattaagacagcaggtcagaaggttgcaactcaggaagctttacttaatgtctagaagtttcccaggatattctgatgcatgaaccgtacttgaaacaatagtcagacattgctacttatcagctgtgtgatttggggcactctgagcttgtttcctcatctgtaaaatagcggggaagtaggggagtgtcacaaggtcttagaaaggaccacatgagggaatgagtgcaaaattcttaaatgatgcctcagtaagtgaaattatgatgctaattacaacgaatgtccttaaaaagctacttttcacttccaatagtccagcttgcaaaaccttcctctatcagagaaaaatttagtgaaagagtaaatgggcttcacaccaggatgatagcctggaaaaatcaaaagagacattgagacattgcccacatagaaagcaggggaagagcatgttcagtttttctgaaggtctatattcttcattcctactgtccatttctcctgattaaaagtctctcccaatagctgagaccattaacaaatataagcccatcaaatggtagctaccccactttgtaaaattaggcttttgtgtctctcatagaataatgttctaacacttcactacctgtaataaagtatttgcaccacaagaaaaaaatgtatttcatgaccagcaggctacaaccagcattctgcttttaggaacccatgcgtttgattgtatcctaagttggtaatgagtcaccacttttgcatttagttaaggacaccaaacaatgactctgtgaacctcagctcagactgcccctgagtcctcagaagatgcctaaatatggactgttctgtagcgcttaaggatatcaaatgacagtataccatgacaatcacaactaatcgaagtcccctgcagagtagttcctcataaagagatggagatggaaaagtaggaacgtttttcaatgctatgcagaaggaaaataatacctactgaccatattcatcctttcaaaggtctgccctgaaggcaagttgacaacacccaggcttggttctcccttttggaagagctaacgctaggagagttcacccttgctccctctggcgggaatcagcagaacagagcgggaggcactgtggcattaggattgcaaaccctggcttcggacacagtgctgcttgaatcagaatctacactgcagctgggcaactggctgaggtcacatttttaggctctgagctgctttctctatttgcaaagtgagaatacacagcttctaaggtcataatgcagatcaaattatatataaagcacttaacatgtgctcagtaaaaagtcattgatctaattattgttgtactttattgtcattaatatcaagggaatgacagcatagtgagtctcctagggatgcaggtcaatagatgttgaactgctattatgcagcaggtactgtgctaggtcctgggtaataccagagcaaacaagatcaacacaatctgcacctccaggaagcttatggtctagttcagaggtaggaaaaatgtgttttgtttggcctgcaccttgtgtataaacacaaaacatagagcaaacattttaaacttggatgacttcacaccacagtccagatttctggcttctctttgaaaacatcagaaattctgagagtaagggagatttctgtccacatgccaagccttctaagtcccaaagcaccaaccttccactggagagtggcctgctggctcttctcattaagaaaaatctccctctggctacacatgatgaggggcctggaggaattaagagagatgaggtagctgaggacacaggtccaggggaccagaactgaagcaaggaaggagaaaggagactcagcgctggttctctttcacggggtttttttgtctctcagctcagctcgctctgtttggctggacacagaaaaccctggaggagaattctgattccaacttgctctttgcacagttaattatttggagctcccagaaggttggagagaacaatgacttcccctgcagtggcagctggactagcttagttcccttttctgcccccaggggtcagaacccaaggaaggggggctatttgttttggccttaaaccaaatctgcctagagacacagagcgatgctctgacctgagaccacaaaagctactatttcaatgcctggtaaagctcctctctcttgccgtccacagcagtctactgacgaaaaacgcgttttccctatgcaaactgtttacttctctcctttgcaaattggaagtaatgtaaaaaaaaaaacaaaacaaaacaaaaaaaaaaaaaaacagaaagaaaagaaaagaaaaaaacctatatgcacaagaattccatctctccttgcaaataagatatttcacatttccttaggcagatagcatgcagacaagtaggggaactaattgggatggatcagtgaaaacaacgaaagctcatttatacacaacttgctaagtgtccacaactttgttctaataggggatccatgacaagtccctcaaaaacagagaaacaggagagaataatttacactttatagttgtgagccctgtaacagtagaacaaccttcctgcagtcccagagagattgtccccacatctaaccaaaaccattaccatcaatggtgtcctgcattttgaacagttgttaatgaagtcttgcctgacccaatacagagtgaaatgggtgtagttgctgctacaggctgccttctagccttcctgcatctgaatacattttctctgttggctgttctgatagagattcatctggaattcttaactagataaatccctcaatgacaaggtaaggcccatcttctgattaaacttgtattgaatttatttatttggccaatcatgtaatccatatttattaggtaccttttaagcaccaagcattgtgctgagtgacggggatatcaaggtgagtcaaaacaaccatagtccctgtccttagaagtccagaggggctgggtgcagtggctcacacctgtaatcccagcttttagggaggcagaggcgggaggatagcatgagcccaggagtttgagacctgccagggcaatataggaagaccccattctccacaaaaagggggaaaaaagcaagtccagagaaaaggaagctactaatcaaaagatctcacaaatataaaactgaccctctgaaaggtgtataagaagtattttggtactaggaggctctattacaaagagttcgtctagatatggggtggcagataatttgtctcagaagaaacagtacttgagctgacatttaaagccaggggaaaagcatcataggcagcgggaatcaaacactcaaaggccttgccgtgaggctgagcagtaaacataaggactgaataaagaccagtgagattggtgtggagaatgcaaggaatagagtgatgaagatggagagttggtagggaccgtgcaaggccttgtggagcacttcaaagatttccagcaacataaagctatttaaagatgtttaagcagggtataatggtggtagttgatgtgatcagatttacgctttgaaaaaatatagattagagttggcattttggggggacacagagtagatccaggtagatccaggtagaccaagtagtctagacctcctaggtcacaggtgtctaggaggggatggtaatttggacttggatggtatggcgctagaggtgatgtagccacattgacatattctaacaatagttactctggtaccaacccaatataccagagtcatccaatggcccaagagtggtactaactgtaattcctgattctgtgaagctgagtaaaaacatttagaaagaccaaactaaaaaggatctgaacgcatctgtactccctcatccccagcagcaaggtaccaccacgtactctgagtgatcatagctttatacttgaattgacaaattctgcataagactccacaggaaacccattaaataggcagggaagaaaatgctcaccattcagcattgacaagaaagatgataacaagcaagttttcagtcaaagtgggtaaaatgttgaatttctactctagtgtcattagcactgcacctgattttttaaaacaatattttggttaatcaaaactctgggtcaatcaactgttccacagtgacagctcctgtggtcatcaatctttgttatcgcttgaagctgacatggtctcggtccacaggagagtaagcagcaaaagacaaaggtttctcttcatttcccccaaagggagttaagcaatgagtcataaaagcatctaaattattcacatggctttccagaagtttatgattcaagatttgggagagataattgaaggaggtggggtgggaaacgtaacactggatgaacacatttattttgaaaatgaaaggatgagtttctgaggtagacccaattaccacacacagggcttcaggagcgacagcagcggcctatggttccgccacacaatgcttcattcattccttacatgggttcggacgatcattattaacctacagtcacctgagaaaagctcagtgtctgccaatcagtcacactggacttttgtggaaatggaaaaaggaagagagagtaagaagggagggatggagcaagggtatggagggaatgtgaggaaagcacaaggaggggccagaaggtgtcagctggtggaggagataaaatgttttctgtttctgttttacttgtagggtataagaaagagacatcagtgtgaagatatgccactgggtaggggctgagggttgtttgtatgtttgtttgttaataaacgtggcttgaattagatatatggctctccgttttagtatataagaaatacaagtaaaagagttcagctattgtgaaacttcattctcttgccaaatggagtttccttgactgtaatgctccaagactgaaccatgtacattcactatttataaaagctagacatgcatttattgaacctaccagatgtaggtactgtaaccaggcatgattaacagtagaaagaactgaaaaacccttcatgattcagccttagtttaccttactggttttatctcctgtgaattctcctttaaaactaagatcacagttctgtggttcttggaattcacaaaaaaaaaaaaaaatgctctacttcccctctgtgtatgtgagtattctctctgcactgaatgcccttcctccttcatctagcagcactgctcctctctgcctggaattgtctaattcctgccattcctcggatctgtttagacataacttcctcaggatgccatcctgaattctgagctgagtcaggtatcccttctcagggctctcactgagcttatctcaacagtagtctaggtagcattcaatcataattagatagtgtgcaagctttctgatggcagaggctaagacgttatcatgtttgtatccccagcccctagcacaccatgaaacacaaaatgcccaataaatttttgctgaataaataaaaaaatacaatacttgatacccaactccaaggcactttcagtgtagttagtaaagatagaacattttgaaacataacacagcacagggcaatatgaaagaaaataaaaaattaaataaatctgttataagcaacaaagcaggtatttagagaaggcaaagattacttttagctggggtgacaggagcaacagaatcaacgacaattcaatgtgtgttcatgacacaagtcctgtgttagttgttttcaacaacaaccctgtaacttgataatattatccccattaacaaatgtggaacccaaggttcagagaggtaagtgatttttcaaggttatataatcagcaatgccaggatttgaatgatgaatctaagatttcaaaacactgagaatggaaaggtgggtatcccaggtagagtaaaaacagaaacagaaaaaaatgtgcaagtgcatctcagtgtaatgtatgtcctggggattaaaaacaaatcaacttgatataatctattataggaatgctaaggatgctgatcctagcaagtaagctgtgactagactgctgggggccttgagtgtcatgctgaggaacttgggtgctgaggagccattagaagctttggagtagagaaaatgtgatcagagctgaaactctgaaagccttattagagagtgggagataggatgaactggaaagataagaaggaagtttgcaggcaaggtaattctgttggggacaaaaaaacttttcctttatcttcttatgttaggtatttgggggcctgcaaattaaactgacaaaccacagattaacaggagaaaagtttatttatgtgcatatggaagcttacaaaagaagtaactcaataaatggttaaagttagaggcttatacagtcttgcctgggtatccatggggaattggttccaggaccctctctcgccctccatcggataccagaatccaggttcacattccttatataaaatagcaaatataacctgtacacatcctcccgtataatttaaatcatatctaggccaagtgcggtggctcacacctgtaatcccagcactttgggaggccgaggtgggcggatcacttgaggtcaggagttcaagaccagcctggccaacacagggaaagcacatctctactaaaaacacaaaaattagccaggtgtggtggcacacgcctgtaatcctagctacttgggaggctgaggcaggagaaatgcttgaacccgagaggcagaggttgcagtgagcctagattgagccactggactccagcctgggcaacagagtgaactccatctcaaaacaacaacaacaaaaatcatatctagattacttataacacctaatacaatctaagtgctacataattattacattgtattgtttaagcaataatgacaagagaaaaaagtctatacatgttcagcacagatgcaattttctttttttcaaatagttttgatccactgttaattgaacctcagatatggaggggcaaatgtataactaccttagtagggaaaaaggagtgggagaaaagacctctttggaaagaataagcaggtttctacaggaaaaacaatgagagataagaaagtttgtaataatgtttgttcatccaggtacgagtggtctctctgtcttcttcaaggctataaaactcccccagagaggatatttatgatatattgagtctccttcctaggagtaaaagccaccctgaagaaggaatttatgaaagcctcatttcccagaagtttctgctattagtcaaataagagaagctctgagacggttttttttccgcatctgttgaatcccaaatgtcttcagcttaaaataatcttcagaccaactctgggcttctgagtgggtacccgacattaccacctaggagcctagcacaactctccagctccaaaggcactgatgtctgggatggagggaaagggtggattcaagccctactgtgagagaagacaccaacagcccctaacagctgagttattgtgcgtctgaaagagaaggaactaatggtgacttaaaagcattaagccaagatgacagagagatcattgtcaccactaacacaaataaggaagccagtcaggagaaagtactagtttgaagggggaaattttaaacatgctgaataagacacagcaggaaaaatctctaggagacaattggaaacgtggaaccagaaaaccagaaagtgatcagtgcaggaaatgcaacttgggagtcatttgcctaaagccataacttgaagccatagtaaatgtgggtatatctccaaggattaaggaatagagaaagaagactagaaggtaagcaacaaatcttagttaatactcaaatttagatggtctgcatgtgacattaacaagtgaaagatacaaagaattaagattaaagtgcccagtataagtctgacactaaactgggaactttttctatgtcattttatgacgtaggcactacctctatttcattaaaaccaaggctgagagtaatgtatcttgtcaaagccatataactagtagacaacagagatgggatcaaaggcatgttgcctcactcagggaccatctgactcatgccttcatggacaggactgtgggatggagggcaatggaggaagagttttcaggagtgcataggatgaacgtagtcaaaggcaatggggaccgagaagaggccactgaattctgagtcctctgagaggactcacctctcagaaatagttgcagtataaggtctaaaatcaaggcccccatattttgtgctgctttgacatatggagaaattcaggagggcctcaaatgacctaatgacaagttcccctcctgacatggtttggctgtgcctccacccaaatcttatcttgaattgtaactcccacaattcccacatgttgtgggaggaacccagcaggaggtgattgaattatgggagcaagtctttcctgcactgttcacatgatcatgaatcagtctcacaagatctgatggtttttaaaatgggagtttccctgcacaaggtctctctttgcctgctgccctccatgtaagatgtgacttgctcctccttgcctttagccatgatcatgaggtctctccagccatgtggaacagtaagtccaataaacctctttcttttgtaaatcacccagtctccgatatatctttatcagcagtgtgaaaacagactaatacacctcccagctctgctcctgcaaataaagtcccccagccaaacaaccctccctgtcatgtgaaccaggcatggttcctgcttattcctcttattccggagtagtggatttcagtttcctgccagcctgcagaattattcagacaagccgacttcatcctcccatagaaacagggataatcccacccctcttaatactaaagccttcttcccacatcccctgattgctcactgtgttcccaagtgcaactcccacgtggacctgtgtggcactcagggtccttcctccctgggctgtgagtatatgtgactaacaaactgctgtctcactggtccagtgttgttcagtcatctttctaaccctagggtgggaccctttctcaccaaccaggtaagtcgagagtggttagaacaacagaagacaccagagtgtttactgtggaagtaacatgggtgaaatgcttcactttaataactactggctttattacaactgaagaaatctgagaaatggatgattactcttttctaattttatataggaggaaactgaggaacagagaggtgttcaatggatacttagagtgagacagcaccaaattatttttctcactttaatgttgcattgttctcaaatattttttttacaagatcctttccagatgcttctatgagaatcacatatatccagtatttacagaaagccattgcaagcaataaggaaaatccaaaaagcaaaatatgggcaaaggataggaacagataatttccaaaagaagaaataggaatgccaatgatggcataatgtccaacctcactatgaatcaaagaaattcaaacaaaaattacaacaaatatttttgtccctttttggttgagaaagctttatactacccactgttggtgagattttaaggaattggagatgctcatacacagatgggataagtagaaatcagtatctctctgaaaggcagggtagcaactttctcaaaatctttaatggtagtattttatgaaaaaaaaattcattcgtaggattatatccaaaggaaacaacttgtgaaattcataaatgtatatggatgagaatgcttattcattgtttttttataatataaaaaaaccagaaacaatctaaatgcccatcaaaaggggataggctaagtaagttgtggtacacctataaaatagaatactatgcagtcttttaagtggaagatgtagatgtatatttatcaacataggaagatgatatttggttttaaaaactaggttataaagctgcaggtggaagagtacacatattatgtaaaatgtttataaaattttgtgtttttctacgtacacgcataatgagacatttgttgggaaatttgcaaagttttagtattccatagtcttcaaatttcaggtgagtcttactctcttctttagtttatcccaaaggcacatatcagtaatcaggaaataaaaggttgttttcactgggggtgggggaacacatggagaggaatgaataggtcacctcaaaaagaaagcatacttcaggaagaacttacacaaattacacaacatactttgcttttgcacttattttttatttcccaacagataacacgtgaaattccagaaaggggagaatcaattgtgcattcgatttttcacagggagctcatgaaactaaggcttctgtgcagcagcagggccatggagtggaaactggaaggcgactggggtcagtaggtgctggccagtccctctctgattgaaaaggacatgtgaagggtgccaagtgagacctcctctccaagttctcaacaatggctacttttttgcgttttattttgtgaacaattcgaacccacaaccctggatacattccacttgtgtaggtttccccttcagacagcaaatgctgctgtttccaaatccaatcatgagtgtttgctgttggagcgcttggtgtaaggcatgtgtgtcctataaaatatgtttctcaaaacttaactttttaagaaatcagtcactggtttatctcccaattctatcacccagaagaagagaaagatgccaaaacagatcccacagagagtttcattctgaaaaacagacatttaatgtagttattctgaaaaaaatacaaactgtattatgtcactttagaaatttcaaaatagagatctctaggtatcccgttaggcatctgtcgtgctcccaattacattactttcgacagccctaagagaagcaatatttattggcctactaagtctttaagaatgcaaaacttaacccatctggaactagttgtgttgttggctccagggttccttacatcagaacaaattcagacataaactctgggacagttcttgaatattgcatgaaggtgagttgcaggcattcacacaacacagcattgtcttttaaagcatttttataaagcagatccaaaggctggcaaacctttccttcaccataaaggaaatctaggctaaaggggaaaataagaagtttatgaactattaaaaaaataaagctgtggagttagggagttatggattaggttccaatccattaattcttttattctctggcagagctggctgaagatgtgcagccctctggcgggtaacagaaacattcatgtccagaacaatcacaaaaagggagagaaatggctggcagagcagagggcggatccactcatttggatgttaatttatacagaaatctggaattcaataatctcacatcccccaggtaagggagcgatccactctccaatttcatttgggagttctattacattaagcaatattctgtttggccagacatgccattcttctcttgaaggaaattaatttcttgattcttccatctaataatctaatataatcccaagtcagtgctttaagttttctcatgacactactagacaaaataaactctgaagtacctcttgtgggaactcacaagatacagatgaaaacaaaagaagaaagtaaaattgaagagggtgaggccagggacaattaggtattgaactgcctgccctgcctctgacacatgatacatgtgatttgttaagacgattttctatccttaactcttcactaagtagggctgctttacaatttccataggaaatttatttttaagtatgtaaggcctgtgaacaggataaataaaagattacaaggaaaaaaaaaagcagtgatttctggttgtttaaaaggcaactcaacaagcctttcccagcaaaaggaaaaggtcaggatcaataaaagggcctttcctttgggaggagatctgttttcaatttaacaaaaataaatccttatggtgtagtcttctgaagaccaaggaaacatcaagctatacaagggatctggccttaccaggataagaaaacttcttcatttgatattctccaataatatcaaaacaaagtaaactgtacccactttgcactctttctcggccccctgcctgttagtgaaaggccagttaacctgaaaaatgaaaaccagctcttaaatgtaaagatgatactactcattgatgcaatgttatcctgatagtggcttttcagagatatcatcttaagcgtgatatcaacagggggaatctcacatacgagtagaggctggtttagaaaaatcctgcaggatatggagtgtctttggtgacagaagtcatactcttaaaggtatcttggtcaaactcatcatctcttactctttttatattagccgggcgtggtggcacatgcctgtaatcccagctatttgggaggctgaagcaggagaatggcttgaacacaggaggcagaggttgcggtgagctaagatcgcgccactgcactccagcctgggtgagaagagtgaaactctgtctcaaaaaaaaaaaagtactggctcaactactatgatgagaagcttttgggagatactcagtggtaatgtcagccttattttctgtggcaaatctgaatctttgctgccgtaacacagttgttttcaacatttaccctttctacactcataggcacacacacaattttaactgatgaattcatagaattcataaacctgacagtgtcccattgctggaaccttagtcatacccattcctagctcttgctaactataacttctccatttttccttcctctcaagaaagtatattagattgcaaggttgcaagagagtaagagtcttaaccttaaatatgctttcatttattagaaaaaaggaaatcatctgcatccttcagcaatttaaatattattagagaaaaacctggtgggattcagcatcaaagttattctcctttctggcatgacctcctctcagcacttcttcaagtatataaatcctaccaatacctcaaggtccatctactctgtattctgaaaatactccaatctcctctccctggaatctaccaggactctcaaactcaagtgttttccagcagtcaggaaagttagttgcatgctgcaggccaattttcaggcatgtgtgtttactggatgagtgatgaggacatgacaacagaagagaacacgtcctccctgaagggggcagcagccagtcagtcccatcccattgctgtcaggtgggaatgcaggcccatagctacccgatcttccaatgttttaagataagtcgaaaatctgcattctatggataatatctcaacttcaaatgttggctcacttaggatgacaatgactctgtgatctgcattggacccatggaaccactaatttgcaacctctggtttctacaaaacatgaagctgactgataaatgacaagcttgtgccatttatcagcaagtgtttgctatttcacatcatcagtcacatcagtatttcagagagccataaataaatgtataagttataggtaacaaaaataaagcagggctttaacttaattatctttaatttagcttatttaaagtttcaaataacatgtaaagagggcctgagatatttatatttagaaatttagagacattggttaaataagttaaggaacaatgagccagactctgaagtcccagcaaggagggactgtatctttgttttattcagtacctatcaagagtgctaagtacacaggtttgaatggaactgatttgaatcatttaaggaaaaaggttccagacaaacattgcatgcattagaaactgagtatttcccgattaaacatacaccacccttacatttccaaagtgtcagcaaagcattctgttctttggtcaaatcttgtaaaagccacttactcctaaatatttttactttgtaaccttcaccgttccaagttcatctaaaagaataaagaaaatacctggcacagagaatgcattcaaagtgtattagttaaatttcactaaaaagaagtaaacaaaagacaaaaaacttcaatgcatcttgattctctgtagagagagcaccttgtggcttgggcttcttctatcaaacacatacccacacctttttgtcagataaactcatttggtttttcttgtgtaatggggtgagtattgtacaaggtttcaatgccttttttttccaactcacattgtcccttagaagctcgaagtactaacaaagtgcttcaccacacaaaagtgctgtctacatttgtctggcaaatacgatgccaaacgaaaagcctgatgagtctgcaattcgtcatgggcatgatcaagctccaggctgcttccaccagagagcaaattcaacattataaaggaagtgtggacaggaaagccttccagcaagattctcagaatatggacatgagattcaaagactaataaaatgggttggggagacggtattgatgaagaagcagccggagaggaaaaaaggaggatttgagcagatgtctgtcactaaagaaagtgaaagacacagaggaaagagaagatctatgttatcacctgtgatcctaaaacaactctaggaattaggccgcattatccttgcttttatagaggaagaaaatgtggaacagaaaagctgaataacttgtcacagtcttacccagccaattagtggcttaactggagtttggccaggtctttttgtctgtatagcacaaaccttgtgaccacacagcactaacttccaataagtcacccaaaaagtcagctgcatgtaattagctctgctgtgaaactatggactggggaaagggcattgttcatttgttagcttaatttttgttaaaggcatacaagaccaaccacaaaaaaagaaaaacaaaaacaaaacaaacaaacaacagcaaaaaaaaatcagccagagctgtagaaaatcaactctgtcattagtaagtatattttattcaagtatgtgttattaatatatttgagatctcccaaatactaaagagatagaaatttagatacattggagataaacttcaagtaagctattttttcactattgcataaatgggaagatattttcattgaaaataatgttcctttactcaatcacccaatatttattgagaaaccacctgggccagacattgttctgaattctgaagatcagagagtgaacaagaagcaactgactttgttttgtttacagttcagattgaacaaagcaatggcaacagagaaagaaagagaagccatttatggtttgtgataaatgctgtgaaggaaatattttctgatagagaatgaatggaaaacttcctttaggcaaagaggacaggaagggcctccttaggtgattgtgtctaaatgagtcaagcatgtcgagggttgaagaaagggtgctgcaggcagagagataagagtatgctaagagccggtgaggacactgaacttagctcttcctgggaagtggcagccccttgagttggtgcagtgaccagggtggacatgtgtagtataagcttcagggaagaggtgagtagaaaccagccagcccctcatgggtctggtataccactagagtgcgtttggaattaattgtaagcacaagagaaagctgttgaatgattcagtcttcaacaagggaacaacatgaacagattggtggttttattttggctgccatgtgaagaatggatgacacgacactcgcatagaagtggaagactagtctagagtttggaagatagcacttggacgtcctgctggatgcctgccattaccctctggatctgccctccaccctttcctcgcctgttgcctgcctcagaggctggcttacatggactacggcccagggctctctagcttccagttagtttggtcaatgggaaaccccagccagagatcagaagggaggagaaagaacttaggatattagtccctcagcaccctgtcacctccaagcagagtttctcacaggttggttgtatcccaccacccagggctgctggtccttcaggtggcctctgccaaggggcctgtcacacagctctccctcaggtcccaataaccttccctctcctatgcctctttcctcccctttacccttcaggagttgagtagcatcagaaaacgctgcagctagccccaaggtactgcactctgtcttgtagtttgaaaatgctacctttgttaaactctagtcaaattacccaatgtatggatgccatctgtttcctgtggggctgactgatacaggaagagagaagcaagatactattttgacacgttcagttactgtgatccttgagtaacattctgtttagcttgagttcatataactcaaaaggttatcaaggaaatcttacacccttttacctttttaggagaagcaacaaattcaccaaagaggtaaaatgccaaaatcatgggcgtgcggattcagaaaataaaataagcattagtggtcatcagtatttgatttcaggccaattgttagagctgtcgcttaaaaatttagatgtacatttctcattccatgtttcatttattcaatcaatgtttattgagtgcctactacttgcaaggcactattttatgaactagacatagagcagagaccaaaacaaaatgcctactctcttggagcttacattctgggggagaatcagaaaataaacaactcaatgatatcttatgtgcttataagaaatggttaacaggaatagagagtgggagatcagcaagaggactgctgatttataaaagacagagtaggcctttcttaaaaggtgataatctgagcagagatctaaaggaaaagatgaagcaagctacggcgatgtccagggcaagtgtgttctgggggcggaaatcatgagatgacgaggtgtgggtggcacttttgagtaccagtagaaggccagtgccactgtagcagaggaagtaaggaggacattggcagcctatgcaatcagggagacggcagggacaagatgaatagcctcaagaactttggcttctattttgagacaataagtttttatggttttgagtagaacagtgataggaattgatttaggttcaaggggctcattctggctactgtgttgcaaataaggtggcaaggatagaaatagagaacacttacgcaaaagtctagagcaaagatggtgacttagaccagggttgtagcatttatatttgatatgccatttaaatatccaagggaacatgagtaggcatgggatgtgtaaccgaagtctagagttgaaagaagaggtctaagctagagatagagatttcgaaaacatcagtatttaaccttgacagtggatgagattttctaggaagtgaggagagcattaagagacaagtttttaaggatggagccctgagtcattacagattgacagatcagaaagaggatgatgaccagcaaggagaccaaaaaggccagtgtggttaagtgggaaaccaagagggtgtggtgtccccaaagccaactgaaaaaaaagtatgtcacgaaggaggaagtgatcaactgtatcatgtactgctgatagatcaagtaagaatagaactgagtagaaaaatggatttggcaaccaaggggccatggatgacccagacaagtgcattctgagaagcggtggggatgaaagtgggatggagagaacatgtgcaggcaactcctctgatgttctttgctgtaaatgggaagcagagaaacgtgggagctggaatgaattatgcaggcttctttctttttttcttttcccttccttccttcctgctttccttttttccttccttcctgcttgcctttctcccttcttttctttcttccttcctttatctttctttcttttctccctctcttactctctttatttcttttctttatctctttctctttctttccatttctctctttccttcctttgttctttttctctctcctttcgttctttcatctctttagtttagagacactacagcatcttcatatcctctcagaattgtctagtagggagaggaacccaaatgatgcaggagagaacagataattgcggaagccaagtgtttttgtaggcatgtgttgaggttcacggcaccatgaaggccgagggtggaagcagaacagttcagagagcacatggtctaggagcaggtaggctagtgagagcatgtggaggtttcctcctgactgagctttgctcagtaaaacaggaagtaagggcatacacatagcaggaccagcagagagaagctattggagatctgagaaaagggtgggaaatagtcatccagggcaagtgggtggagtagggtcctgcagtaggattgctgagcagtgtgttgggctttaaactgcctttcatatgaatccacaaatcctactaatattaatgaaagatattaattttcatttttcctgctcccgtcagcttaaaacgaaaagtttctctacttagcccatgaggagtcagaaaagaaaaagtaatgcccagcaaatttctccttcctaagctagaaaggaaaaaataagatattcatgtaaggaaaataaagaagacatggcaacttgaaattatgaagaaattccaaatgttgcatttggtagtgttcttaagctaccataagagatcttcattctattctgggtagggagaatgtacgtggcagttgctaggaatgatcctttgcccgtgatccttcccatgtggtaccccactgtccccaatagacctgagtggcacaaccaacaaaacaacattcaaatatatggaaatgatctttattttagactctttctcatttagcctgttgggctccgagaatgtgaaaaataaatctgaagccttacttttaatagctttcttataaattatccccagtatgtaaaagcccagctcctagatataaccagaagaagggggaggggggaaagactaatgacctttgacattaaaatttaaaatgtcctgcatgcaaatacactttcctgccactcttttgtaatgcaataaccagcaagaattagaattgcaaaaattccaaaagagctacatggaaattatacaacaaagtggtttcacagtgatattgagaaaggaatatgaaatgaatacaagataacatagagacagaatggggtgttacagatgtatgagtgaacgtgcgtatgagcacatgcatgtctcagagagagcaacagataaaaaattatttctttttttatgttgctcttcatgagcaaaattttaagacagacactgttctggtcacatttcaataatgtgacacatggtttctatttacattccaaatgagttttcactaaatgactttcgaaatatttacttgcaagtataaaggagaccctttgaatgtctgatttgaaaaaagaacaaaatcaagcaattatcaacatagatgttctaatacaaactgacactattttcttccatgtcttttttttttttttttttcattcctagacaccacaaaagaccaatgctacagatgtctctctttcggctttaaatacttcaactgtgacaatgatagtgagacagactgcttcaggccctgtagctaggacataataaataattcaaacaagttttgaaaaatcatttggcccatataatataccagctatccgaacatttaccaatgcccgccccctcccctcacacctcatccttattttcattttttgctgcttccatcagcttaaaatgaaaagtttctctacttagcccatcaggagtcagaaaagaaaaagtaatgcccagcaaatttatccttcctttgctaccggcttccattaaattgaaggtgacttcacattgatcctgggttcaattcacatatccaaagagacctcagtgattaacataaagggcagtccaatcaaggatagacacctccatgtgtgtatggtgagcaatttggtgggatgtaaaacataaatgatgtagcatcagaacacctggtgtggatgatgccaccacttgcctacccagttattctccacttcttgccctgagtttttctttctctctctctcttttttaacttagataaaaaataatcagcttcttaacctcccttgcatctaggagtcatcaaaaagatatcggttgatcaataagatcaataagaatttgataggcagggcttccaaaaaagtctgttgaaaagggaagactcagataacacagtttgttagtgtttgccttttgcccaagatccttccctctttcttctgcctgtgatgcccagggatggagtagtcagtttgtagcctatgaggacaaaagtcccatggcaaggcataaccatgcagaaagatagaaggaactgtgtcccgctggcactttgaacttcttgaggcatcttggggaaaataagcccctccttggtctagcagtatgtgacagttaatttcaggtgtcaatttggctaggccatggtatccagatacttgttcaaacatatctggatgtcactgtgaaggtaatttttagatgagattcatcattaaatcagtagactttgagtaaaacagattaccctccataatgtgagtgggcctcattcaattagttgacaattagttgacagtcttagaaaaagagtagcatcccccagggaagagggaattttgccagcagtctgcttttggacttgagtggcaatatcaactgttccttgggtatttattgtgttggcctaacctgcagattttggactgagatctcagccttcataatcatgtgagtgaacggcttaaaatcgatcatctctgtctctctctggagaaccctgactgctacaccattacaccattctaactgggtttctgttcactgaaactgaatgcaattctctctgacacatctgagatcaccacttcatacactgtgtaactgtgtaggtgtctgtgaccctcagcttccagatctacaaaatgggaatatgagtactcctgactccacaggcttgttggcttacacacgagacagaatgtgtaaaagtgctgtgctgtgttaagttacaaagcccaatcgaaatgatagggatcattatcatggtgggctcactgtcaattcacgactgtaagtctgttatgattgtattcacttaaaataataatattcttcaaatctgaccataaaaagtcattatagaacatttgaaagttcaaaaacgcatgaggaagaaaacactcaaccacctccatcattccatagctactgtcatctaccaatacctagcatttattgagttattatatagcaggcaatgtgtgaagcaattcaatgcattatctctaccctgtgaaggtaggtactattttggtgcccatttggcatatgggtgaaaacttgtcaccggacatatagctagtaagtggcaaatccaggattcaaacccaggtctgaattattctaaagcccatgtatgtatccagcaacacatggcgatgagctgtgttctttaataatgtattggctactacaaaattggagtgtgatcaggtaacccttacatcaggaaaaatggggtatgcacattgctcagcatatacacaaatcaagactcatattacaaggctgctagctctcttgtcagggataacattttaatttgaaatgaagtggaagaatgtttcatatcagctactccggttaacactgctttttacttcagataaagatatcccttctgtcaggcaccctgaagtttttctgtaaaaagttgtgttcatttgtttcaaactgcccatacatccatggtctcatttcattttccctatagcccgctgagttaagaggggcaggtattattaactccatttcacaggtgaaagaactgagccctagagaggttaactaagttgcttaaggtcacacagcaaattagtggtacgacggggattggaaagcctaacgcctgacatccagcgtggtatgttttccatcatgtagtgctccatcacctgtcactcccaccattcctgaggggcttggagttgatggggcatgctatcaatttctcagggtaaaactgtcctatctgggtaggaaaatgcacacacacacacacacacatatactagacacactgtaattgcatctgccaaaatggttttataacaatccagtcaaggatacagaaaactcccaggctgcctttcagaaacaaagcccaaaggatcaatttcatcatgaaataggatttcctcagctgtaggtggatgggtaggtggggaggtggatgaactgcattaacaatggaacagtggactgcagggtaaaagctcatttgacattcactgctattaagcagtggcaatgtaaacctggggtagcaaagagcaatacccaggaaaaaatacgaagaaaagtttcaacttaacccttctgtaactttctatttataagtctcagggtattaagtctcattctttagaaataacaaatgcatattttgactcactctgtaagatatttataagaaataaagagcaagggggtattgattaagaaaaaactaggatgagattatagatatattaatatgtgttaatatacaacatataattacatataattaatatataataaatgtacaaatatataatgttatataaatgacatgtcaatatatgaatatatatatttcaagatcatattcttaacctgaaaccaaaaaaagtacaaatagaggtaacatattgcattgtctatttagcattgaaaccaggattttcagatagaaacatttgcctttcctaagctacgcaagccatcagatatttacctcagtggcactggtctcagtgaaacatcttaatgtctcttctctcagttggttagatgaatggatgtcataaggtaaaaagaggaactgcaagatttgaagctcatagaaaaaagactggcactgggaatggcagttaccgggagattgaaacaagaaggcttctaaatatgctgtcaaaaccagcaccagtgacctctcatcaagtgaggggcagcactaaaagctataccttctagaatgatgttaccttgaaaatcatgaggaaatctcaagtgtctttctactacattagcaaaaggaagtttagggagtttagacaccaagagactggaccttctcaaaagggaatttgccacagaatcatagatgttcaaaatgtgaaccaagctttctttcaaataaaagtgaatatcagggcttaaaacagaaagacacatttcatcaaaaatgattaggggcccacgagtgttgactggggaatgagaatagtgggtaaggttagggggaaagccagaaaaaaaggtgaatcaaatatacttacactaaaaatcctggggctccatgtgatccagtcacggtaccttgtcacagagagaaatgtaatcagggatccaggaagttctttacaggtttacttggtgtgatgcttaatattaggtgtcgactagattggattgaaggatgcctagatggctggtggagtattgtttctgggtgtgtctgtgagggtgttgccagaagagactgacatttgagtcagtggactggagagaaagatccaccttcagtgtgggtgggtaccatccgatcggctgccagtgcagctagaccaaatgcaggtggaagaaggtgcgataagctggcttgctgtgtcttctggctgccttctttctcccatgctggatgcctcctcccatccctcctgcccttggacatcagattccaggttcttcagcctttggaactcaggaacttgcaacagtggctcagactttggccacagtctgaagcctgcactgtcagcttttctggtttgagcctttcagactgagccactaccagcttctctctctctcaatttgcagacagcctatcctgggactttgccttgtaatggtgtgagccaactcttcctaatatattcccttatatatatacatacatatatcctacttgttctgtccctctggagaaccctgactaatatacttggacacatgaaaaattattaagaagagatgtctattcttaatgcattaagaatactgtaaaattattctctcctcattgctgcctttctgaaaattcttcatgtggttggcagctgactcaggagcactctctttcctggcacttatccaatggctctaacacccaatctgggcagcctgtccggcttactgtctccatctctccactcttgcttatgtacttcaacacagactctttatttctttacttttatttctgttttctttactttagggaggacctgggagtttaccaggaagctcaaattcttcctgtatagaagctaggaaaatagtgaagattgtgactatccatactcgaataattttatcctataacatctcaacagattttgtctctaagaattctattgtctcaaataaacccagaagttagcactttaacatgggagccttttcaaatggtagagtctcaaggccacatctgactccagagatcatggtgttcctacaacactgagatgatgataggaactacagttgaaaacagatctttctccccacatcaccttgatcaagtcaataaatgttagtatatgccaggtactgggctaggtagtaggaacacagagataagcaagacaagatccttatccctgaagaagtcacagttcagtgtagtatttctaaaattgcattccttagaatgaaagtgacccttgtaaaaataatccatggaccaaataccttttggaatgtggcatgctcaatctccttttggacatttttcatgctcatcctaatgcgaaatgattatataaacttcagttctttactccagcatttcccacatttaactcatcgctgacccatttggcttgcaaaacttacgtcttgaattgagcctacaaatgttaacagaaattctaccattagcttaaaaaacagacaaataacaggcattttaaagataaaataagaaataatgatagcattttaatataaagtaaatagtatttcaaccaaaaggcaagtgaatctgtatgttgtcttaatggagattatatttgtttgctcactacagtttataagaacagagaggatgataaagacaccacaatgatgaccatgcacagagtgtttctatcagcaagcctatattgtgggtctttactcacaatattttatttaattcttacatcccttctatgaagtaggaacttatatttcccattttcctccataaagaaatcaaggttcagagaatttgttaatttgtctgctacgatcatgtgcctggtaagtgatggaagtgagattctaatccagactatttactctgaaaacctagtggctcccaattctagttatatatcccagagaatctactgttaactgatttaaaatgtccattagcagagaaacagattaacaaaattcggtgtcttcacatgatagatgatcagatggctatcagactatctgtggcttctgaacagaaataagaaagaggctttggcaagctctagattagaatcaaagaaaggctttccctcttgttaagcaactcttgttctattgcgccccaacaagagacagaatgtttcaagataggacaccaggtgactgtgtggcctgagctgcccaacctgaattgggtgttgttttatccactgtctattacattgggtgcactcagcagcagctgtctgtatcaaatgaaagtagattacacgggattgtactattaggcttactctggctatccctgttttaacccaaacctaagacttcatggggcattttttatgtagttacctgaagaaggaaaaaaataaagcctactttacagacaacattgcacgataagctagctccagcctgaagtggaccctgaatattataaccccactcaaggtgagtagccctaaaggacattgaagaagaaaaatcccatcagtgggcaaaacttcaaataattacctcttgtggtcaacactgcctggaaaaatagttggcctgaggtattgttccacgttaattcatgggctcatgaatgaggcattaggaagaaaaagaggggaagactgaaagggaagggaacaaatacacagtaaggcttctcaaacttttaccagagtgtgaaaatatctgtctatgtgaatgtagactagaaggtccccactgtggagaaggcactcagtagctaggtaggcaaggcctctttccctgccaactcagagcttaatcagcatattcataaaagctatttagtatctacggtggccaaatacagaggtttgcatgggctgaccaataaggacttcaccagttctggccactgccactcccaaatgtaccacttgctagaaacatcaataaggaaatctgttggagagttagttttttgattcagtgaataccaatgtgctctcccacatttcctctaccttttgtggtaaggtggggccatgtgactagtgcaggccaacgggctacgaggaaacagaaacctgtcatgcctgtgaggggccctggcaaggcataccgcctgacctgcacaccaagtgatgaggtcagagaatgccagattgctctgcattctctgtatagaggaaaattgccccgcaaactgcctgattaatataccaatcctgaatcaaagatacagaaaaataccctgactggaccctccagccacctgggggcatgctgtttgtatggaccccatctatcatagaggagatgaaaatgtatacttcttggaaaagacatatactcaataagaattatttccctgtttgccaggcttctgtgaacaacctcaaatgttttattcaccttgatggtctcccacagaaccttcttgactaagaaactcattttatatgtacatatatttatatgtacatatattaaaaagtaaagcaatttagttggtgctcatgggattccatagtctcacctagtaccccatcctcaacagtggaatggccagttaataacttggctgtggttccagttaaaagacaacaccctgaaaagctaaaggactatcctacaggctgcagaatgttctcttaactagtgattaattatagtgctattttcccataccaagaatatatatgtccaggggtcaaaggggagaggggagagcagtgcctttcaccattacacagaacaaatcactcattttgctttccttaccaggaaatttgaggtctgctgttgtagaggtcttacaactcaagtgaaaaatgcttccaacaatagatatgataaaagaaaaacttcagccgagttaaatttaaaggactttaattgagcaatgaatgattcacgaatcgggcagcccccagaatcacagcagattcacagactccaggggtgcctcatggtcagaacaaatttatagacaaaaaaggtaaagtgacgtacaggaatcagaagtcgggtatagaaacagtgagattggttacagctcagtgtttgccttgtgtgaacgcagtttgaacattcagcagtctatgtgtggttgaagtatggccgctgggattggccaacactcagctattgttacaggtgcatactattaacttaggttttcaattttgtctgttaagctaggttacagttcatccacaaagactcaaatatagaagtatggccttttcaggccatatttagtttgctttagcagatgcaagagtgtttctatgaaattggaagctgaaactgtccagtggacattttggacacctcacaccccactcaaactgagtaaaaagggagttattgtgttgggaggggtcattagtcttgattatcagttgggaaatgaagttcctgctcagcaatggaggccatgaagagaatacctaccatgcaggtaaatcctctggagtattcctgctactgccgtgtgccatggtaaagggttagactccagcaaccccaaatgagcagaagcattgagggtttcctggatagaattactgatggactgtttgttcaagggtaagttagagtatgttaagtcagagcaaggtattataacttgaaagttgaaacatggagaaaaaaaaaaaggagtattattgatatttggtaccaagaaagggatcagagcgaaatttgtctcgcgtggctgcccaatatcctctggatattcttgctcataataatgtttgctccacatcatgaattcttccttttcaaagggaatttcagaaaactcatatcctttgcagctaaggagcaggcatgcggtctgccctcctcttctcaggccacacaagacttcactgtggaagtgagcaatgaggaaaaacaggctatgtgtggacattcatttttccagtataggcagtgagaaaggtatccagatttggggatgttaggataaattgcaataaaattaaatccttcgtatcctagatgttacagtcaggaaaacattgtggtatccagtaagtagatggtgacaattgcctcataagcccagttctaagaaaatgttctgcagtcaacagcatgtcaatggctgttttctgaccagaccagttctgcaacatagttttggacattgttcccaaaagcttagcctcaagcttatttctctgggtctacaatgattcttccaaatgccccatatcctttaataaattccttctctatttaaattagagcccattctattgtttgcaactaatgctcctgaccatattttccttctcccactttcaatacccaggcaaagattgttttaatcattcacaacctaacagttctctctcaggaaagtctaatctagcaatatttttttctgtggaatctgcaacctactcctttacctttaagccataagcagtgaatgaaactgactcctatttccagaatcccacctgcattccttttccaactcaatcttctttcttagcctaaggctagcctatttattgtatgaaatattcttttctgtcagtgaacatggcaacatctttggctaagtcaaaagcctaactcttcatctagctttcaacttggaagcacatccctggacacacctatgctttgaaagtaatatttatctctctctctctctatcccactgttcaacaatcattttgtctgctttttttgagttacactttgcatatcaatactctttctgaaaactcctccaaagtgttaaatatctggcatagtcatttcaaaacaggaacggagtggtctgcatgttaaagaaggcaagaatgccagaaattgtcccatttcccatgttgatcagtgactgtgtaactcagacacgttgcagaggcctacatggcctacttcctgagaggggggtctcactgccttgtcaggattccagtttaagagcacagggcaagtgagaccactgaatacagtcatttaaaaagtgctacaggaaagtatttaaatagtcatcttatagaagggggtgaaaaagcacatttattgatgcagtaattaaaaaaagatttagatccagtgtgtcaattcccatagaatcccacttagcccccttatctatgtcaaagcaaacttagtttcacatcagcagtgcttctcatttatcttaatgctaaggatttatttcttatgcaaaattgttcattttcaccagcctggaactttaaaaaaattcacattctcttcttcaagaatttttattaagccaagatgtcatcaagctgaaaatctcagacacaattttggctctcttctgcaggaaactcagaggagtgcccaatccaggcaacagcagattagcactggcactgctgacaggttcttaaaagtgttggaaagagaagaacaaaggtggtgtacaatgattgacaaagatttctgctataaactaaagttgaaccaataaatatgtctagactctgccatgactatctgtggcctggaagctgcattcttcagaagaaaaaaaaaaagttgcagttggaatttggaatggttttgcccccatgatgtgcacacaggactttgatgagtagtctgatatgcagaagcatccagattatcactgagatagaaatgaaacatccagatgatagattaagtagattgttcacttctcatctatatatatatatatatatatatatatatatatatatatatttgacatcatagaggcataatcaaaatctgagtaggtaaagtcactaaccagaatacgaataccaagttacctgtgtggtttcatggaaaaataataggggaattgacatcatctttataaatgttgtatcaatgagaaaattatgacagtcggggagatctgatctagcccatctgcctcctgtctttagcattcaagctgccaagctagctttgggagacatttactttacagtttaaatgataataacccttccccccaactcaactgcctttgtaaagctaatgagggaccaactgagggaaggagagatgcctggatgctgctaaggtacagacatgaacaattgccagccattattccagagatcacaagatttgcaacttccctaattactcctgcaggcaacatcactattgtagattggccttttgagatactgtttcaggttttttgcatgtctggcacccatggctctacttggacccaccaactgatggttcctctggccagaagcaactcagtgtaagaggacagcttcaactccctatgattaaatctccaacccagccaatcggcagcaaacacccattgcatagccatccctacgccttcgcccaaactacctttgaaaagcccctaacctacaagccttctatgagattgatttgaataataactccatctccggcatggtgtggctagccttctgtcaactaaactctttctttactgcaattccatggtctctgtttgtgtagcaggcaggaagaacccactgggtggtcacagaatttcaaggctgcaaagagtcagactttactcaaatattctaggcaaaaaaaatagaatttaagggttacgatctgcacaatcatggtcaaaatcaaagacacatcgaaacagttaaaacgcaacagttatcccaaggtcaaaaccaagaatatttatttattagtgtaccctgtagctctgtacccaattaagcccaaacatctccctagacttcatctccataatcatatgggtatctgatacccgtcaatgcaattttcttgatcactaatgaaacattccttgttcattgcattagtctttataatcacaatattaaatcattttccctggtgttttcccctagcaacaatttatgagccattacagaatttctgttttttttctatgtcttctctcttctcataagttaaaccattccagtatcttgcaaatgaccagacaactactttaagactttggttgtaactagagcttcctaccaagctatgtaattaagccacagtatctttgctcttctagcttacaagataatcatctgattcccttttgttaaactatttgccctttggccttatagtttattcacttgggaactagattacagtttcccagactatatagctacagagaaattattgtgacttattataagtttaattcatgccaaacaataccagtctgatttctggcttaataccaccttctttcataaagctggaccatcattttgcctttaatcatcttcttgattagtatttttccaagtgtttctcaactcatttcttctatagaattaaaacattcctactggatgggctactcattttaaggatttaaaattttcagtctggatttggggttacacctttgatggatgagcttaaggaagatacgaaaatggcaaaattatcttcatgatgacatcataatggatagaacaaagtaaattttataaaatggtttcacatgccttattccatttgatacttaacagacttgagaactggacagagtagatatagtagttccctcttgtgcacagggaatatgttccaagaatcccagtggatgcctgaaatcctgtatagtcctaaaccctatacatactgttttttccctatatatacatatttatgataaaatttaattaatttattctttttgagatggagttccattcttgttgcccaggctggggtgcaatggtgtgatctcagctcactgcaacctctgcctctcgcgttcatgcaattgtcctgcctcagcctcccgagtagttgggattacaggcacctgccaccacgcctggctaatttttgtatttttagtagagatggggtttcaccatgttgaccaggctggtctcgaactcctgacctcaagtgatctgcccaccttgacctcccaaagagtgggattacaggcatgagccactgtgcttggccaaaatttaatttataaattaggcacagttagagatgaacaacaataactaataataaagtagatgccagcatcactacttttgtgctttggaatcattagtaagtaaaataagggttccttgaatataagcactgtgatactgcaacagtggatctgatcacagagctagctataatgtcactaacgggcaagcagcacagacatcacagatacatgggatgattcatacactgggaagggcagagcagggcagctcagatttcactgtgctgctcaaaatggcatgcattttaaaacttacaaattgcttatttctggaattttccatttaacatttttagatcgagttgaccacaggtaactaaaactttgaaacagcagataatggggaactactgtattactatgcccatctttataaagcagtggtttccaaactgtgttaatgcagaccaaattcatgacattgtttcaaccagtgcagctcctttcatattagttttttaaaaaaacacatctaagtaagatcaccatttgaaatgaatagagtgtatgttggcttttaaataaggaatgtttaaatgcccctgatagaggaagaaaccaaagctcagtacaaatggtaaactcacatctccacctgtaaacaccaggtaaaaattgaaggagcagggacaaccacccaagtctccagcctgtgagacagccaggtgaggaggggtccccagaagacctccaactggcctgtgcaccggggtggagcctcgggaatttcatcatgtttgcagcggggaggagcctggcccttccttttcctgtgtggaacctgggattcaagctgtgggcgggaagtgctctatcagggactcaagccttgggagactccctctttcccctttacttctttttcacccaataaaaccctgctcaccctctccatcggtctgtgaacctaaattttcgtggctgtgggacggacaagtaccctgtctttaactgaactatggaaaagtcctgcaatatttttggcgcccaacgtggggactcgagaaggggtaagtgagatgcaaaccaataattctttttccctctcccttctgagtcttctcatccccgtggccttttccttccttttttgggatggaccggcgagcagcagctgcccactgctcctcactccatgccggggctgggacacatggcctaagtgtcctgcacagcctgctggctggttccccgtcactcctggctgtcccagccttccccttccctggccaagggatgtaactctatcagacagtaattaagcttaaatttgtctccctggtggaggaaccacttgcaaagaaatatgaggttcttcctcaggcacttttaaactgtttcttttctttccccttctctaccccatcagcaagttaacttaaatttttttttcttttagaagatgttgtactaggctagcctccacccacccccaacaactgtcagtgtattctctgcaaagtttcggttgtgaaatcaagcctccatcttgttttatatcctgagggcatggctggtaattgtggcaaggatttgtttagcaaagccttgagaggatgaaccctgtaagattcaatgtctgcatgttttcctagccctttctcttaaagggccccacccagcaactgggttttcttctgcctgcctgtgtgtgtactgtacgtaatgtttgtcaagagaactctaattaatacagcctaaagaaagacaagtgcttgaatctaatattttttaaagggaagataaagtctggtacctttcagttcacatgactttaatctttaagaaatagaaacagtcttaaaaactattggtcaaatgcaggtattatcaaaatgtaaataggtaggctaaataatgcaggtcagatgcaaggtttgctaagtgttttgaggttacaaactgctttttgggttttcagaactatattgacttgccagcttcacaactggtaaggcctggggacacacggaactaaccgcacccttaactaagaaggcaaaccttggctgcagttagcacacaattaaagcaacttaacaagttttagtttacagttaaaaattgctaggagttaattgaatccactagaaatagatttacatgcaaggtgtatgagaacagtaaaatgtgtttttcagtaaaaggttataagaagtcatggaaatgtaaacttttgcctagggttaaggattgttttgagttacattaggaaaaagctgaaggttccaagaagtggtggaagaattgtggaaattaatcttgcagaagaggttctctgtgtgaacatactgactacattcaaccaagggtattatatggtttttctgtaaattgagcgttgaagtaaaagcataacgaggttttcctaaggtgctaatcttaatctgctctttggcaaaatttgtaaagggttataaaaggttttcgcttcttcaaaatttctgagtcatcattttgacaaaataaataacttttggtaatgttgacaaaaggagtcaaattctgtaaaatatttttacagacttattgtgagccacatatgagtgaccatggcccgtgacacagccctcagaaggtcctgagaacatgtgcccaaggtggtcagggtatagcttggtttgatatattttaggaaagcatgagacttcaaatatatttaagaaatgcattggtttggttcagaaaggcaggacaactcaaagcggagccttccaggctataggtaaatttaaacatttttctggatgacggttgagtttatctgaagacctgggatcaatagaaaggaaatgttcaggttaagataaaggattgtggagaccaaattttattgtgcagaggaagctctcagatagcagacttaagagagagcaggttataaaatgcttcttatcagacctaaaagggtgcctggctcttagttgattatctcctggatctggagagaaaggaatgaaaacaaagggggaaggggattctctataaaatgtggatttttcccacaagagacgttgcagggcaacttcaaggtatggcaaggaaatatattttgaggtaaaacattttgatttttttccttgttatgccacagtcagattggaaagtaagtcacgatatacagggttaaataaaacccatctgatgaaaatttatggtttgtaagccatgactccccaggctccttagataggaatttgggcaatattaaaaaaaaatcagagcttagtcctcagtaatctggaattccgtttcataacatcaagtgttttaaaccttgaacatttaacagccttcccaaagtcaaacttcagtttcaaaatcgtcttccctggtacatggcttttcaaatacttcagagggcccccgatgtgtccagaactaagagaggtaaacagaattatttgacatgtttaggtacatgggattgccaaaatgatgctcaatcttctttaggttatagctgggtgaataatgccaatatatgttccaaaattgtatgggatttctaaaattctaatgtctgagtatatgctatcaaccataattaaggtttttatgttaagttatagtaaaccacggagataactaaacttctttgtcagtcgtgtttctaattgtaactaccctggaaattttgctattcacagacaattgttgctttaattctttttcagaagatggtttataataagctataggactttgacaggtgctttcaaatacaggcttctgataactttggatattgtgacactgaaatacaggaaaatgtacaggactcaaaagctgaaatgctcatgattatcaagcaaaacaagagttagccaaatggactgaactcaggaagctgaagcaacctttttgacttttgcttggaatattgctaatccatgtttcatttttcagagtcaaggaaacttattttgaactatttacagcctttaacaattgagtaaggtatactcctatgaacaaagtttgaagcgtgtttgtttctctctgcctggttcctctagaatttggaaactatctgtgaatattgttatggcaatatagttgtttgcatcagtgccaataagaatccatttttcttttgcagcaggacacatttggagaaagtagttattttaccaaggttttgactggaatggtatgcttccctttaaggagtcaagctcaacttgcagagccaataaaagccccatggggaaactggcctcatactgttgtctatgcagtccctgtacagggttcctgacctgtggtcagtaaagaatgtcactttctagcaggtccaagagctccaagtttattgtgggaccttaagaggagaggatcacccaactcacaggtatttgaggatgcaaacccatggctaggctcagctttaaaaggtcttatctgtgattccttgtggaaaacatttccatcagtgccaatccaaaaagcctatgtagaaatagttattcttgctgcactttatgcaaataatcaggccaagtgtaagactaaagtctattttgcaaagcactcagtcctaccataatttttttaacaaaaatgaggactggagagacagaaattatgttccaaaatttgccatacatttgtcattaaatgctaaactcattagttgtttttaagttttcatctaccttttagaccaaccctgcttgctcctgtgaaccaagcagcaatctccagctgcagctcagaaagaacaggagggatgggtaatgtagaaatatggatcaatattctagctctgaacaattatcctgcaaaccctgccaggtgatggaataaatagggtgcccattaccaggaggtttcctttttgggaaagtaagaccaagtgaactaaccaaagccaagcatcacgtatccaaatcctggcaagcataactatagctaccagttatctgggtgtgtcacaagacatccttttctctctcttgttggaggagaactgggttccacagcttcactttagcatttgtcttatgataaggaggccatgcaatgccccatccgagatacatttttgtcccagactgaattccaagcttcacatcaaagccttaggaaggaaaatcggatcttagggatccagaggcaaatgacaacagaagttaaaaggcacagcacaggtgagcgtgactgattcctgctgattaagccaaccccaaacttcctgtttcatggataaaggccacgttaatatccatggcataaatgaggtctacggaactccaaggctactgacagcaggggagatagggcatacgtgggtaagagcggatgattcccacccctaggcccccctgcttcatgggtgcaagttgctttaacacccatggtggcacctaccaaggtcactggaacttggggatgcaaggatagaagatggaaagaggatgctcttccctctctacctcacatacctaaggtatctgctggaagaaaagggaaccaggtatgcctgctcccctctttctagatgggtagccattcatcttcagtctgtatccctttcaaatgcatcctgaacctctgggactcctttaaaaggcaccttctttttgcctttcttctcctctgttctctcttcactaataggtaattgtgtctccatactacaaggcactctcctcagatgcatcctccaaactagaaagagttggtttcccaaaccttaaactggttagcttaggattgggctcaggggaaggggacccagaagcccaacgtgccagcaaaagggtaaagttttttttgccagtcaggcttttggcctccctctacgtgtgcaaactggcaaaaggcctcaggatctttgagctgtccttaccctcccttcatttcgttttgatacatagtttctaataacctggtttgtctgttcttgccttcaggccattaaactctaaacaatcatgcaagcagagcctctgacaatggccctttctgctgtgaacccttagatgggcctctgccgtttccccaaaacagcgccccctctcagcaggaagcagttaaggtcagtcttcatccttatccttaatctaaacggcagctggatgtacctctttagagggaggaatgagacagctaggtgggagggggtccccgaaaaacctccagtcagcctgtgcactagagtagagcctcagaaagttcaccatgtttgcactggggaggagcctggtccctccttttcctgtgtggaacctggaattcaagctgtgggcaggaagtgctctatcagggactctagccttgcagaggctcccggttccccctttgtcttctttttcacccaataaaaccttgctcaccctctccaacagtctgcgagcctaaattttcttggccatgggacagacaaggaccctctctttagctgaactaaggaaaagtcctgcaacacctccaacaactaacaattgtttccagtgcacctccattctccaggagggagaaggccaaagcacataagtggagaatgcacacgttagcccattttcaatagtttaatactttaaaaaatagtagtgttgctgactttcaagctttagcatctacacgtgctagattcacttattgactcattaaactattcttttaccaatgagcttaccatatgccaaaaactatgctatactgggaacccaaaggcacacagaaaaactagaagactatttctgcaccagtcaagaagcacacaaatggacactcatgaagaaactatagacccaaagaaaaccattgacaatataggacaaatggcatatcaagtcctgaggaaagagattagtaaggaggttaatattttaaaaaaaatagaaaagggagaaataatgaatcactggaaatggtcccatcaacctgcagttcttcactatttttcaacttaaaattggatacatttatagtcacttgacctctctaggtcccaatctccccatgttcaaagtacatatcctattgctagctctctctactttgctaagtctattgtgaaaatatcacaatataaaatactttgaagccttttagggaagcttaaggtcttctacaaataaaataacaagaagtaccacttggctgaaaaatgaaagaggtaggacaccaatggtagtaaatcacttgtatcactttgttcagaaattatttcatttttttcattttattgaatatagacaaattatagttgtatatctttatgaagtacaaagtgatactatgatatatgtatacagtctggaatgattaaatcaagctaattaacatagccatcacctcaaatacctaccatcgattctcctaactgaatcattgtaccctttgaccaatatctccccatttcccctactcccagcctctgggaaccaccattctactctctgcttctatgagtttgattgttttagattccacttgtaagtgagaacatatggtatttgtttttctttgctagcttagctgacttagcataatgtctgcttggtccacccatgtggtcaaaaatggcaaaatttcctcatttttaaggctgaagaatatttcattgtgtgtgtgtgtgtgtgtatatatatatatatatcacattttctttatccatttcatctcacacctattaaaatggcaataataaaaagatgaaagacaagtcttggcaaggatatggagaaaggggaacccttgttcactactgatgggaatgtaaatttgtacagagctggttcaagggaaatccaagaacatggctgtgaggcaaggaccagatgagggtattaagggactatcattacagtggaaaaattaaccctatcttttttgagagaagccagttacaatgcttgatgctatccctgacacactctctctagcaacaagttccttttctttcggcccttaagtaaggctataagaagaacagaacaaaacagcaaggagatgaataccaaagcactggccacacttttcccctgtgggcctgtcttattccattcatgctgctataaaaaataccacaaactgtgtattttataaataatagaaatttaattctcacagctctggaggctgggaagtccaaggtcaaggtgccagtagattaagtgtctggtgaagtcttgctctctgcttccaagacagtacattgtttctgtatcctcacgtggacgaaggcagaagggtaaacaggcataaagggcctagctagttcccccaagcccttttaaaagggcaccaatcccattcatgacggctctgtcctcatgacctaatcacctcaaaggctccacctcctaatattatcacactgggttgttttttgttgttgttgttttgacaaggtctccccctgttgcccaggctgatgtgtagtggcacaatgtcagctcactgcagcctcaacttccccagactcaagtgattttcctgtctcagcctcctaagtagctggaactacaggagtgcgccaccagctaatttttgcatttttttttttgtagaaacagtttcgccatgttgcccaggctctcactgggtcttatgttccaacatacgaatttgtctgggggatgggtgacacatacattcaaaccatagcagggccttcaataggtcattagagagagagccaaggaacaccagtgtggctttttgcattgaacaacgataagttaatggaagtttaacatagcccacagtctgtagtcagaggtcagaggagtaaggccttacatgctacagatgcccacaaaggagataagaggaagccagaagaaatagaaatttgtttgtcagtggataaagaacaaggccaaggttttcttaaatagtgattgatgaggccctggtttactgtaacagtgtacttgtgattttttaattttgtaaaaattgtcccagtgtgtaattctctgtttatacctgagtgtggggaaatgaattttaaggaaaaagccctatatttcctgataaatcacttctataactaattggttatttaatgattcatctgtgtaaaaagggggactaatggttttaaaataaaatttcatcaacagttgtctctttcataaggtttgaaaacaaagaaaatggagatgatgatgcaggtgtggctctttaacagaacccacaggggagcacacaggctctggggagagcaaacaaggcaagggctcagaagactaggttctaatcccaatgcccctttctcccggatatttaatcatagtcaaattacttaatgaccccaaagtacagtgatttccttaatattttacaaaagaataaaagcactatggacttttcttcaaacagacatatcacccctggcctcaggagtttaatattcagtgactctttggcaggtcgtgaactgcccatcagtcccagtggttgttatgaatgtcctctgctcatccatccagatcccctccccatctttcttcatcctgactcttcctgggagggtgatcaatatagacctgccaataggctcctgcaccctctagcttctaattgcattctgtccacgggaagccctggtgagagttacatcattccaggattgggagcaacctgtaagaggccccggacagctgtgtccatcctctgaaaatgaaggctgttctcaggtgacctgctctacccagatctttttccttccaggttctttttttttttttttgagatggagtctcactctgtcacccaggctggggtgcagtggcacaatctcagctgactgcagcctctgcctcccaagctcaagtgatcccctgcctcagcctgctgagtagctgggactacaggcgtgccccaccacactcagctaatttttgtccttttagtagagatggggttttgccatgttggccaggctgatcttgaatgcctggcctcaaatgatctgtctgcttcggcctcccaaaattctgggattacaggcatgagccacagtacttggcctccttccaggctctgataaatgtttcttcccctcatctcttaaagcctaggggaggttatggactgaatgtttgtgtccctcacaaaatttatatgttgaaatctaatcccaatgtgatggcatgaggaagtagggcctttgagaggtgattaggacatgagggtggaacccttgtgaatgggattagtgcccttataaggggctgaaaagaccagaattctaccccttcaccatgtgaggacacagcaagaaggcatcctctattaaccagaaaatgggcactcattagacaccggatctggacttcacagcctccagcattgtgagacagacatttctgttgtttatgagccacctggtttaaggtgtcttgttttagcagcccaaatggacaaacacagggaggtaagagcccctaccagcccctgtccaccagaaagatggggatctgaacagaagccagaggtgtaactggaatggactcaggtgttttcctcacagagcagataactaaagctagaattcttgataagaaaaatgggataaagaaataacagttgcaaaggtaagaagcagagacagagttatagtccagaggccaaaaggataattttaagaagaaggagtaggtctgaaagtgatgactgagactagcccttggctgtggtgattaagatctttggtgacaatagaaaatgtaacaataggagtggtctgttgtggtgatagaatctgcagaccggtggaagtccatgggcccatttaccatgccacaggcaaagagtatattaaactcccacgaagagaagtgcctctggattcattttgccaacattcactgtactgatattagccatggacttgcagagggtttatttactattgcagcctggctctctgctgtgtctgaaagttgaccttggtgtcctctaagttttatcccagagaaaaagacagcaattgagctattccccaggcacagggggcaaaatttgaaattgacataaaaccaagattccctgtctgacttgggcctctgggattgtattgctgcatcctgtggtggcaaaaagagtatcctgggcagtaagtgatttcaattccacttaaagcaacaagtatttgctgaaaaccaaccatattcttagtaagaagatgggtgctgtaggagacagagaattaaatgaaatcattccttccctccaggagcaaacagcttcatgctagaaataaagctaactcaaatgcaacaaacagaagacacacacacacacacacacacacacacacacacacacagagagagtacttttcaagattagtaacaaagagattatctacagagataaagacagaagaatccaatgtctgcatgttttgttattcatgtgtataagttttctaactttcctacattcagtgtgaattagtattgaaatcagaataaaaaagcaatatttttttaaaagcctaatttttagaaattgatagtaaaaaatgagacagccctgggctgaagtcccaggcgtccttcttcctaacaacttgaacttagccaagttgcttaactacttggtgcctaaatgttctcatttataaaactgggaagatggcatggagaggcaatgggcattttctggcaagaaactaagaaaaaaggccataaccaataagtaacttatggaaatgaaaaaatcttttaagttttataatcttgctttagttgatatcttaaaacaaaattttgaaagttattaagtcactcataaggatttcaggaagcactgcagtgtaatatgcttaagaatggagatggttcaaatgctagctcggctacttagcaatacctgtcctcaaataagttatttcaccctacctgagtctgttacttcatctctaaaatggagataatcctaaaacgtacctcacaggaaccttgtgaagataatgcatgtaaaatgctatcacagtccttggcatggaataagtgtctaattaacttttatatataattataattatcatctaaaaagtttagtggtgtttcagacaaatctaagagaagataagcatgaataggtatatgtctttttcatctttgtatttcaccagtgctttgcacagggcctgtcacaaagtagggatctgagaaatacttgtgaatgaagaatgaatgaatgaatgggctgattttcctatttgatcaaaagccacatccatatatgactaaatctgagtatataaaagaagataaaacttgtgtttcaattcaatctagtgagttaaattaaaagaagaaagggaggaaggcaaattaaaagaagaaagggaggaaaagaagcaggaaagagggaaataagacaaaaagaaaaaaaaaaaaacaaaacagaagttggccaggagaaagggtgtctccatccttaaatattttactccttattgtgtgatatattattttgtcagcttcttctagctacaattcccaaggaagggatagagagcagcagcttccaagtaatgacccatgtgggtataaagagaaatttttatcatattagaaaaaatatatttatatacatgctaccaactttacctagaagagaagagcaagggattggaaaacaaattagcataaaatccctgctccagctttttacacatacagatgttttcctgcatatttatccatccttctgagcactgctcaaatgttacatcctcagagaagctctcctggacccctcatcctgggctggatactctgtcacatgctctaatagtgtctgatacccttccactagaacagggatcactgttgtaattaggtaattatttgggtaattaattgtttaacatctgtgtccagtgtcagtatgcaagcaagctccatgaaggcagtgttcctgtctgcctgttcaccccaaaatcaccaacacttgcatatgccttgcatgaaacaggtaagtgaacataaatgtgtataaggttggcatccattctttgtgcattctgtgtttgtgaatttgcccactcaataaaatgcatttgtaacctcaacatcgatacttgccacatttctgtggtcatttttgggcatcacagagaagtgaaaaatttgtcacccaacatgtacattccccaagtgaagcagaacaaagcaaagctccaccttcttgctccatctctcatactgtaaacaagggtctttttctgatctattaaatgccaggttgttggggtgggttttcttttgcatttttgtacataatggccccaaaagaacagtgctgaagtgctgtctcttgttcctgagtacaagaagaatatgatgtgccttacagaggaaacatgagtgatagaagcttcattcaggctcaggttaaacagctcaggctgtgtcccatgacttcagtgttaatgaattagctatatgttaaataaggcatctttaaataaaagtaaacatttaaaaagtttacatattaatcaattaacaaaaatgttgtgaagaaacagccagtagcacgtgcctgtagttctggtttctcgggaagctaaggtgggaggattacttgagcccaggagttcgaactgcagtgcactatgattgcaccactgcactccagcctgggcaacagagtgagaccctatctcttaaaaacaaaaaaaatattgtaatcagaggctctcaggaactcaaccctggatttcccctaggggcaatggttcattatttgctaattcagcgtttgtggagactttatacaacaatttcctatgaaaaatcaggatcaactatatatatacatagaatgtatatgtgtatatatattttacatatttgtgtgtatacatgcacatgtgtatatatgtatgtttagtagtttttaaccattttggtgttatacacctgttgtaaaaatttaaggaagacgtggatactaggggctgagggttgccacaaagggaggtatgtacatatatacagccctgtgctatgcatctccagggcaggagacagggtgttgacattcacagtatagcctaagtgaatattcctactccatagaattgttcagtgtggtgacacttcatgcaaataaatacatgtatacacatacacatttgcataagattctgggcatttgtggcctcctatcgtgtacctcaggtaaaaatcctgacagagaaataatagatacacaaatataaatatatattatatatggcacattcaattttacttcaaatgttttacataggctaaaattgaaactaaaatgctttgcatttcagccaccaccaacagggactagacaattccaaaatatatgtatccccagaagaaagataatttgttgtgaaacactggctaaagacattccctaaggtaaactaaacacaggcagaaaactgagagttgaaaaaaaatatatacatatatagagagagagatgagagttgaatatctatatgtatatatagatatgtatatatagagagagatgtgtgtgtgtgtgtatatatatatatatatatagagagagagagagagagagagagacagaggagagagagagcacaacaagaatacgaaggttggccaggtgctgtggctcaagcctgaatcccagcattttgggaggccaaggcgggtagatcacgaggtcaagagatcgataccatcctgggcaacatgatgaaaccctatctctactgaaaatacaaaaaattagctgcgcatggtggtgcacacctgtactcccagctactcaggaggctgaggcaggaggatcacttgaacccaggagacagaggttgcagtgagccaagattgtgccactgcactccagcctggcgacagagtgagactccatctcaaacaaacaaacaaacaaaataccaaggttaacctgccccgtttgctttcctaagagtctaagattctctggattctcaggtctgtatggtgggcagcaatgtaaatttaagcttctctgacatctaagttctttggagacagtaactattaaacacctgactctgtcccttgaataacagacatttcttagtaaagcttttaattagatctgttggttgaggatgaaaatagaaagacaccagaaggaaaaaaaaaattcatccctgtaaatggtcctgtggaaatagtaactaaaacaattatactgttaataattcaatgttggtttaaaactatacaattgtgagttatttatacagaccagagttggcatgtgttgtaccacaggtggatgtgaggtcaccaagaaaccacttcacagttttcccagaagtgtagcgtcaaaaaggtcacttgtggtaaaagatcttttggattagtcttttaaatcaatgcatgaattaaagacaatttacatataaataggctaatactctggctttgaaattaaatggatttttaaaagatttaagtaactgcagaaaaggtcagttaggcagtaagtgtacataatgtgattcttgaaaactgctgtcttgttggtttattaatattttgtattcattgtcagtgttgttctaaaattgtgtgcataattagcaatgcaccaaagtcaacggcaggtcccaaaagtaaggaaagcggaatttacaaatcagtgaaggaaggacaagtctagatttggacatgaaaatagtcaaaattaacctttgcctatatattaatacacattagattcaaatatgtcacaacatattctaaataagcatggcatcactcgctccagttaaatttaccttggcatttagcctcactgataaattttcaactcttccaaaatacaaaagctgcagtagtctcctgagttatcacaacaggatcatgattgtaatttgaaatcctgattccccttttagggaacagaaacctgcagtttttccaactgtaatgaaaggatagagcgaaacttccataggatcaaaccacattccattaccaccactcctctgaacattaatgtaccttaaaacatattgaaccataggatgaatatatggagcaggggcatttttaggagagtgaaactattctgtatgatactacgagagatacatgatgttacatacttgtccaaacacacaggactatgacaaaagattgagtcctaatgtaaacgagggatgacttcagttaacaatagtgtagcaatattggttaatcaattataacaaatgtgtcaatccaatgcaagatgttaaccataatgaatactgtgggcaaagggaggggatttgtgggaaacctctgtactgtactttctgctcagtttttcagtaaaactaaatttgctgtagaaaatcgtctgttttttaaaatagtgaaccaaatgtaataatgcactcaaagactctttttagacaaatggtttataaactatattcagaggagccctagtggtcctttgctggccatttggtttaggagtgtttgggaaaatagagtaggagagaagagggaacaatgaagaaaagactgctcaagctggccccttatctttcacccctgtttcaaacaaagcaacaaccttttcacctgtacatattgtttctccacattggagcccagtaaagaagggtttctcagctaaagagaaaaaaaaaacatgaaaatcaccaatgtatgctcaataaagtatcttgctacataaatcagcaactcaaagaagaaaaagttaaattataaaaaccttgctaataatgtacactaattccctcagctacttaataaacatttaactaaaactttctgcctgaccattattacttcctatgattgggctaagcataagctaaatgactaccttggaagaactccaactaagaagtatttatttcacatcaacaatgaaccagtactctgttagaacatgcaacatgctttggaaagacaggtgaaatacaaagcatcattccagctgtccagaagcttatcatcttacaggacagagaacatgaacacaacaaaatgcagaaacaatataatacacctgaggcacccagcacccaacttgatgagctaaaaaatagatttcaggtcttctgtcaggtgttaacaaattgtcaactctgaataatgtgagggccagtatgaatgagaacagtccaatccccagttaagccccacttttctaaatcttcttctctctttaaaaaagcaaagtgaatgctaacgtagtctatcagtaatggacagtgtcctcataaaaagacatatgtaaaaaggaggggaagtggaaggtaagcagtgcttactattttatcatattcaattgtatacacacctcctctcaaaattggtgtccccctatcagtagttactaacaagttagttcccaggatcttgcagatggtgggctggtttcagacaaaggcacagtggtccagaggatctggcaacctctttcaggggctgttgggagatgccctgacggcagcagaagcagcctccaatgaggatggcttcctgctcaagacctcctcacactcctcttgcataaataaatgatttagacaccgttttctcctctaatagccagcactacaccaaagagaaaacactccgctattgatgacaggagagggctttttttgtaagtgtgtatgtgtgttatgctataaattaccctgttggtgggtgtaaaaataaatatccatgtatatagttgtgtatacacacacacacacacttacacagagagaatatgttacagttaaaatcatgctgtcgacagccactcaaatctagagcaatttatggctctcaatgcagtcacacattcaggataaagacaggatgataataaatactttgaatattaccagcataaataaactgcctgaggagcttaaacatttgcaacatagccttgctggctcacactgacaaccagcagacctgttgccagtgagcgactgaaagatcaaacatgattaaaaatgcaaagatgctgcacccaaatgacatgctttatttgacaatgaactctggactcagaggcaccactgcaatctatgagcaaagtgctttttggtaattcatttgcccactgaggccagctactgaggaatcacaatacaagtcccttttaaagtaggcacagttctttacagccattagtaattccatcttgagactgcccttcgagaaaacaatttctttttttttttttttactgagaattgatggtttgtgttttgtcaaaatgagccccagaagttgttaagaacttgtgtaatacattagctatgagtagccgaataatggtcttcaagtaagtacaggaaaatgaatggctgtgatgaagatggtgggcaggtatccttttactgaaactactaaagcaggggctgaagtcaggttttaaaaaagattcttgtgaccataagacacaggaatgtccagtggaagaaagccagttctagcttggagttttaggaacaagccagtttccttggtgtctcagtatcatttgattctatagtatgttatttcttttatttacatacatatgacattcatgatttctttttaaatatccataaattcaaagtggaatacaatgtcacaatgtcttaagtctcagaataagatgctgagaagaccatgaacaagtgatttctttttctttttctttttttttttgagacagagtgttgctctgtcgcccaggctggagtgcagtgggcaagatctcagctcactacaatctccaacccctgggttcaagcaattctcctacctcagccaccctagtggttgggattacaggtgcctgctaccacgcccagctaatttttctatttttagtacagacagcattttgccatgctggccaggctggtctagaactcctgacctcaggtgatctgcctgcctcagcctcccaaagtgctgggattataggcatgagccatagcgcccagacaaacaagcgggggtttcttaaggaagggcttccaagaaaaactgcttacagcgtggcaagaagtagaacagggaaaggcaagaagccaagcgagggtgtgattcagggtagaatcctctgagggacgttttcccaccagaggcaaggaaactgggctttcactctcactcaccaatcactctgcagctaagagccatcctgggggttcctaaactccaagcacttccagctctcagcagacctagtgaagccagcagctccaattggtcctgcaaagaccattgccgaagcagccattggaaggtaaatacacagaagctggggcagggctcacagatatgttgaaaggtaccagggcagtgctccgacaccttctgctacagcaaagaagcaaatggtccaaaaatcaaaatgagggtagaataaggttggagaattcaaaaagtgcagaaaaaaaataaaagtcccccttctctcacccccaccttccactcacccttcacctagtccttctttccaaaggtaacctttgtttacagttttctataaatccttctaaggaaaaatatacacatatactatgtatctatttaaacattctttttaaaaatatgcagattggacaactgttccactgttctactccttgctttttctcactaaagaatatatcttgtattctagatattatattagatctatatacatattctaaatagagagatgatagattagacagataaatgcaaagaggaaggaagggaaggaaaaatggatggatggatggatggatggatggatggatggatggatggatactacacttcattgatttaaagataaaacagttttccacattttaacatttctgaaataggctgtcttatacttgacagcattttagatttgctaaaatgcagtagatagatatatagctatttatggatggattgacagttcacacatagctctgccacttgagaagtagtgcaggatagtagttaagagtatattaacacattgcttattaatgagatactttcgtacttgaggaataaggacctcttttgatggggctaatattttaataatctgataaattgtttattaactttaaattttcataatgagtccgtaaatgagtttgatttatagttttctattctgtgctgtctctctcagactttggaatccatattacattggcttcataaaaacacactggcagtttttttctttatttgtgctatgggcaattttgtttacttttataattctttgactatgtaatacatgtactgtgtatcaaattcaaaaagtacaaaagggcatgagtaaaaaagtatctctacctgtcttccagctgcctagtcccttcccccagatgcaatcattgtaatccgttgcttttgcgttcctttagttatgtatgacacatacacatatgcacaaggacacacacttttactcaaatgtcggtataatagacacaatgctctgcatcttgcttttttttcacttcatgtgttttgtagattgttccataactatacacagaacctccacatcctatctgatgacttcacagtattccattatgcagatataaaattaattttaccagttttcatttttaaatagaattaacattatcagttccttgaaatgcaaaattatttgcttctgaaagcataaagacctgtggctttttaagatctttgataactgcttcagatttttccgatgttattaaagttctctttcctgttgaatatgtttgggtaacttatttacctgtttaaaaaatacattccttgaagattttcagttacttttgcaaaagttctcctttgaatattttaatttctttagccatggttctttttcctttttcctttgttttttgtttttttttttttaagacagggtcttactctgtcctctgtctgtcacccaggctggagtgcagtggcacgatcagggctcactgcagcctaaacttcctgggctcaagtgatcctcccaccttagcctcttgagtagttgggactactggcatgcgccactacccctgtctaatttttgtattttttgtagagatggggtttcaccatgttacccagcctggtcttgaactcctgggctcaagccatccagctgcctcggcctcccaaagtgttaagattataggcttgagccactgggactgtctgctttccattttttgtttttgtactccctaactttttgagtaagtgaatttcattgcttggcattgttttcaaggtgtgttagtctgttttcatgctgctgatgaagacatacccaagactgggaagaaaaagaggtttaattagacttacagttccacatgacaggggaggcctcagaatcatggcgggaggtgaaaggcacttcttacatggtggcagcaagagaaaatgagtaggaagcaaaagcagaaacccctgataaacccatcagatcacgtaagacttattcactatcatgagaatagcatgggaaagaccagcccccatgattcaattacctccccctaggtacctcccacaacacgtgggaattcggggagatacaactcaagctgagattttaatggggacacagcgaaaccatatcacaaggagacagtatttgagcttatttatgattcttatggatttatttttaaattagaaaacctaatttcttatttttatctttattatttagttctttctgcattttttccagttttttggctgtccctttcttaagtcagatgcataattcctttatttttattcttttttaaatattcaggtgttaaaggctgtatacattttcttctaagcgaggctttagctgtagcccatagctcagatgtgttatattttcattatcaatggtgtctagatatttttcaagttgggtttaaaatgtttctttgaattaagagttgtttatcaaagagggttgttgtttgtttgtttgttttgagatggagtcttggtctgtcccccaggctggagtgcagtggcacaatcttggctcactgcaacctctgcttcctgggtcaagcaattcccctgcctcagcctccttcatagctgagattacaggtgtgtgccaccacactcaactaatgtttgtatttttagtagaaacaacgtttcaccatgttggccaggctggtctcgaactcctgacctctggtgatctgctcacctcggcctcccagagtatcaaagagttttaaaatatccagattgtaaggttttgataaaactgatttctaatttattgcattgtaatcaggtaatggggactttatttgtacttcagcttcttgaaatttcctgcaatttcttcataacttataaaggccatgtgtttgtattacattgttttattatttgatatattttgaaccacatattttagaggggctttcctatcacaaacatatttcaaagttgtttgcaaaatattttgcattttctaatcaccataagtgaagtgattagaaaacacatcagggcttctgtggctcaggatttggtgcttgcctcacatagacacaaccagtaactcttactcttgtgccaaatgatgtaattgccctaggaaaatgtttctacacctctcttgcccactttcattgaagaaatggtgactgaatctgaatgtcaggaagggttgtgggttgtggatatggcaactgcaaaactgcagacaatagagatgtacactgcttttgtggtagggacaggatttgagcagtggaaaggcataaataagaaaaagagaaattaattcatgattaagacagattctggcataaagaaattgcagtagtagtagtagtagtagtagtagtagttagtgctgaataccgtatctattttctttcatcagaatctgctggttccatttcatagttcagaggtctcacaaattcaggcaatattcacagctgtggacatagtaacttaggcatattttgcattattaaacgattgatgctatctttaaatttaggttgcaacataacatacatgaaatctgataccaagtcttcacattggcaactagatgggcattgaacacaaaactagaaattgttttatttttataaaatatttaataagatttaattaaagtgtcataaaaatccagctacattgaaatgtttgatttaaatgttttttattagctaacccattcttcattttgctttttaaattctaatgtataattttgaatattgtgcaagaaatatgactttcttaaaaacattaaaaattaattttaattttttcaatgtataattaatttatatgcttgaggaaaatatattcaaattgtatacattttaaatacaaatgcagtttaatttctaattctttagatcagggatcagcaaactttttctgtaaagaaccagacagtaaacattttgggctgttacaacgactcttctctgtcactgccctagcacaaaaggaatcacagacaatgcataagtgaatgggagtggctagagttggccctggggccttagtttgcagatccctgtattagatcataactgccaatagacaaaaagtatcttaaaaaaaaaccccttgattataacaacatgacaattttactgaaatgaagatgagaaaaaataacttaattggaataaatatataataatttaagaaatatttcagtcttttaaaaaactcactaaaatgtcatcagcccaataacagaacatgtacaataataatcaagagctgttgtctttgatatttggtcaattttcaatcacgtaaaaactagggcttcacctatacatttagattttgtccttaaaaaagttatctcatggcagaggataaaaaacacttctttaatggcttactagctggatttgttaatttttaaatatttagacagatggtatatggcctcctttttgccctgggccccataaaccttagatgtaggcctgaatacaacagtgatcaagagacaaaggccctactgtcttgaattacagtctagtaaattctagtgcacatccattgactctaatttagaccagtcaatcatctattctcacatgcactactgcaatagctttttttttttttttttttgagactgagtcttgttctgttgcccaggctggagtgcagtggcatgttcttggctcactgcaacctcctcctcccaggttcaagtgattcttgtgcatcagcctctcaagtagctgggatcacaggtgtgcaccaccacgccctgctagtttttgtatttttagtatagatgggatttcacccggcctcccaaaatgttgggattacaggtgtactgtacccactgtacccagcctgcaataggttttttattgctctctctatatctattcttgccctcaccaacctattttccacataacaaattaatatgttaaaaacataaactatcacctctttcctaaaagctcttcaattgttttccattacattccagattaaatccaaagtcttttatgattagtattattatttttgagacagagtttcgctcttgttgcccaggctagagtgcaatggcgcaatctcggctcactgcaacctctacctcccaggttcaagcgattctcctgcctcagcctcccacgtagctgggatcacaggcatgtgccaccgtgcccagctaattttgtatttttagtagagacagggtttctccatgttggtcaggctggtctccaactctcgccctcaggtgatccacctgcctcagcctcccaaagtgctgggattacaggcatgagccactgcgcctggcccaaagtctttttttataacatatgaaatcttgttcttccctatcttccaactttatcttgtgcacttccttccttgcccagtattatctggccttttattgtacttctaacatattgaggcatttcttgcctcgggacctttgcacatgcaatcatctggctacagtgtttctcctttccctactcctttttcggggctacttttttcatttttacatctctgcttaaacattttcacctccaagaagacttgtaagtccattcagtctaacatatatgattcttgctatattctgtcactgcatcctgttcaatttccttcacagccataggaagaaaacctgtaattctatatatttatctgtttacttgtatatttcctattctgtaaactctttgagagccaggataatttttattttgtttatcacttccagtgcccacaatgcctggaaatcatacatactcaaaagatagttgttaaaaaagtaaatgaatatcaattcatttgttgaacaaataaatatgaaatggataggcacattctggacctatcgaaccattctagcatgaagcctttattcccagagtgatagcaatatcagggtccccccaactaatgattttcaagcccactcagatcctttattcatgctgtatttccaagctgaatttccttcccccacttctctctgccttctcaaatatttatttctttcactaattcaaacacacttctctcaacaagtctttggtacccttttcagccccaaataataggtcttgatttctacatttattatctgaatcattcactttagtatcatcttacggtgcctaattctttctaaatctaagttccttccatagtgtatgtagtagagaccatgtgcacttaatccagccagcagcatggagtggaaccccaaaacatattgatatcattggcagccttagcctgtgttccccatctgactcttacatcccactcaggaaagcagaccctaaacaaaggcttacaactaggtagtttattttgggaaaagaaccctagataatcaaattgaggaacgagggagagtaaaacaggggaaaagggtatcttaaatcagattccctagaagtacactctgaaatgggtacgcttgtacaagaaattgattgaaatagtgccctcaggagaaacctatggggaaatgagggagtaggatgggccagggaagaagccacggaaagatatggcttcagctggagtccagccatggcccaaacccagagtatggacaagagtatggagtatgaacagcaccacagagttattccccttgacagcttctgttagtccttggctgtggactgcccttgaccaggcataggggatcctctaaggtatttctggggaagttcatttccctcaatagagggttaattctcctgagatgagttcagctgtgagaccttagtatccaacactctaagcagctggggcatgggtgtgttgacccactaatggtggtcttggtaggggaccaacagcatcctctacagagggaaatacaatataagtatacattctcaagtcgataacaactacaggcacctagggctcaacctgctggaatcttccgagaaaacttacatgcttcagatgtatatgtataatgtgcttcagacatgtctaaacaaggcatggaagagattatttatccaccaactcccagtccccaccagtcaggggttattccgtgggttaataactctcttatacttccaggttgccagtctcactcccaaggtggtagaaaatagggatgaaaatagggatgcccaatgccacttaggcaagaggcttcaggtcacacttgccctaacctggtttccacagcgacagccctaatacagaaagggagacaagaggatgtgagatgtgtcacaggaagtgtccaatccactaactacttgccctagatctttggagaattaaataacctgtcctactgctatgcatgacagaagccctaccagtgggggctagttggccttcacattggctcctggccttctcattggctcatcttaggtgtcttgggctatctgcctgatacacattttcagttaggcacgtcatgtgaccttacagaccaaggttatgcaaaagagaaatgaaaattaacttattaatcttatgacagtattgggctctctgtatttttctcagggtccctgacactgatggtattatctcattctttggtgatgattatgtgtggaatgtttcatttaaaaattccagtgttgtctctcatgaaagcctgatacggtaggctctatatacatactggtgatgatcgtaatatgtgtgtagcacaaagtagtccctgaacaacatttttaatggcaaacagtgattccttcccccaacaaattaagtaaaaatgataaattcctacattgaaagaaatcggcaaaacagaacatttccttcaattcacataatcattaagaagtatcattcataaggggttagaaacatataatatccaaccttcctgtttaacagagcccagcaaggactcaaatgcacagttcattactgtcattatgagagaatttctgccaacaagttacagtcaggttactatcattcaatcatgttgctaataggactaatttcatggtaattggcatattctagaccagagaagaactcaaatggttgtggaatcattaatgatttatgctttcatggtaaaaatgacaatctattagtttaccagatgctggatcaagccatgggccattaacaggagggtgttctcagaacgttttcagaacaaataccagctactttattttcagcttgcagacataatcacatgcatcccctatcagatccaccactatactgtcagatacatcataaattaaaggctccatgggctcattattggctcttattcgtaaaagcaacacgttgccctggcaagacccaaaatattaaatgggcatttaaagaaactgcaaaatgtgtagttttggaaaaatgaaatcttccttaaaactatttacagtactcaagttttcaaaatgtccttcatcctcgattttgcctcaatatttgtttttttgttttttgttttttaataaaagcaaagaaaaaagaaacaaattcctgccctgtcaggaaagcttttaggccgagtctcttaggaactgggtgtcatttattagtaaacctaatatgctgccttcagaagaacagaggtgccagcatcaaataaacaggcttaaaaaaaaaaattccaggaaacttaatgtacactacgttagtaaccaggacaactcttgtttcccagcaatctatggcatagatacgttggtatgagataaagcctccatctttcctgaatcttcaaaacaaatgtaaagctgattaaaattcctcttctgtcttgcctatgtacaaggctgctctcccaataccaagcaatcctatttggagacaatgggatgtttgccaaaccaaaccgaaataaataaataaataaataaataggagagtttctgttttcaactgttgatggcatcacccttgccatttgtggtgatcagattatccacctagaaagtgtaagaaaacaagtcttccggttagcacttactgggcaaagggctgagtttcaagaatcacaactgaaatcggtggggttgctctttgttaatgggaaaaagcaccatgttaaagtgaccagggcctggtgtgtgcaccgcatgatctgtgagcatgagttgtgtgtgcaacatgcttcctcgtgattaccgcctatacggacagtcactgtgcattagtgcattggtagccagccgccgccaaaaacaggatggcattcttccatcgtgattagaggttttgtgagcattttgggatgggggacactttctcagtaaagactcttccgccccattcacgttcattcagctctttctaggggaaattaaaagctgcagtgataatcccttaaggacaacttggaagagtataaaaggtgcagtgtataagcaattggatgagaaagccttttatgtggaaagttactgaatgggtggctgagggtggtgtgagtggggagaaagaggggcagcttttcttttctaaggtggggagcagcggggatatcatggcacttcagttccctttaatcatccagattcctacgctgtccctgcccctggtgtcaccttgttttgcagtgccagctagctcctccctgccattttcccctcaaagagggagaggggagcaatgcgatttttggtaaggacccagtttctcgctgaatgccaactcagccagctggcaccgaacaggccaagccttcttcagaagaggttagcaaaatccaaattagcatggtccattttaaaaacttgcttttatttaaagactgattcatgacaaacagtggctcccgtactgaggtctggcaccccaggggctggcatccaaccaaacacatgcaactaattgccaccctcggatgacacgcaactaacaagctccattttgaggcagtagattcactaagaatgtaaccccggaaggcagcggaggcagaaaagctcctttcataaccctgtcctaggctaaccatggcagcagagagcctgaaaaacacttttgtttcattgcaccaacaatttagctccacggagggctacaaacacggctaacttgctgaaaagtgatcaagggcactgcgatccccctcatggttataggaggcaggggctctgcttttctctttgctcaaggaaacacacaaaattgcctactatcttgaaactccgcatcttgcaccatttgcaaatctatcgacccccagtacttccccttatactttagttcagatgctctcaggcttcctttgtacaagcaagggctctggagccaggatgcctaggttcaaatcccagctccaccattcattagtaattggcaagtattttaacccatctatgcctcagtttcttcatctataaagtggagagaatattagcacctacattactacgagtaggaacgagtcaatgtaataatgtacataggacaatgcctgacatatcatcactctgttatgaaagctctttgagtctgagatagctcggccttatgaagaaaaaatttccctttgcataagctgcattttagtcaaagttcttgcttccctgtaaacttctagagattcaacctctaagcctttgtttaccattctttctcctctcaactgtccttcctccattgcacagccctgtatgactaaatctcatcatcctccaaaaccattcttcaatgccacctcctccgaggagacttctctgccatcccagctgccatgaatccctgcactcttggcatggccatggcaatttctgcaaacaaatgactgtgttttacttgcctgttatatttccttttctagactgacagatccttttgagcataatccacgagtaactagcacatagtagatactcaatgaatatttggtaaagaagtagatggtcagatgaaagaattgctctgcataaatgagtagctttatactatggttatgctgggcattactcaataggcaggatgggggaatcgtttcttaaggactttcatagttgctttggcccaaattaagagttgtatttaacttgtcatcaactgaggctcataaataaaatctatcaaagaaatatgtcaattaccaccttagtcagcttgggctgccataacaaaacaccaaggattgtgtggcttaaacaacagaaatttatttctcacagttctagaggctgaaagtccaagatcatggtgtcagcagattctgtttctcctgaggcctctctccctggcttgcgtatggctgccttttcgttcaccatgtcacatggtctttcctctgtgtgcttcctcccctagtatctcctcttcttcttcttataagggcaccagttgcattggattaggtcccacccttatgacctcatttaacattaattacctttatttttatttttattttatttatttatttatttttgagatggagtctcgctctgtcacccaggctggagtgcagtggcgcaatctcggctcactgcaagctccgcctcctgggttcgtgccattctcctgccttagcctcccgaggagctgggactacaggcacccaccaccacacctggctaattttgtttttgtatttttggtagagatggggtttcaccgtgttagccaggatggtctcaatctcctcacctcgtgatctgcccacctcggcctcccaaagtgctgggattacaggtgtgagccaccgtgccctgcctacctttaaaggggtaattaaggttacctttaaaagttgtctccaaatacagtcacattagggattcaggcttcagtgtatcaattcaggggaatacaattcaggccatcacaatgacatatacatatagaagcatgaatattctgtatattacttaagtgcataggaggaacttaaccataggaagtccacaagcctttgctccttaagtcctggcatccagatcttcattatgttagcaaaagttcagacaatggaaacaaatgtggcactcaaatacacaactattttatctagatgaaaaattaagctttctttggaatttgtgggattcagttggggggctcagttgcttctctcttagaggcaggaaaacatcagcaccccaggcagcagccacaaccctgtctcctgttaaagccattgcctctcccaagaacaaatgcaaattcccagctaaactcctgtgcactttctaggaggaggctcactttggtccttctaggatcaatttatctgaatcttttcttttgaaggcggacctgcagctttatgtagccctgaaactctgaaccagcttctcatgccagcaccccttctttagtcacttcataattcaaattgctgttatcagcatacactatttgtactgatttgactttttcacattgttttaaatcactaatttcctattaggcagattcctcacatcaataccataagctaatggctcccatggtatttgttcatatctttctcttaagatacttaacactttttacctggtaggaggatgatttatagtcatatgtgtctttcttgccagaccttttaactacttaaggttagaattgcatcaaacccattgttttatcccaaccagtgcttaacatgatatggcacacgtagcagagtcacagtaaaagtttgctgtaattcacatagactttgccaggagtgcatagaaggattaagcatcagaagcaatgcaatcgcaaaggtatctcgtaccatcaaggggtgaggccaacatcttagaaaattaagatcaaatatcatccttcatttttaatttaaagcttctagccagttgacccagaaacatcccacacctccaccatgacttaccaatttgtctgaaataataaagaggaaaatgagaggctattagcgccacttccattctccagtcaatcattgttctaaattattaatcagttgaagtattgccaagaaattttcaggcctctctccaaaagtgtaaagtagtcattttcaagtgaacaattaactattttattcatctagaagttgtagaatttatagacaagctgatttctgtggattttcttccccccttttggatgctggtggaggtaagagaggtctacatgaactacaaatagtttcctttccatcactcacttattaataactagaatcctgtttaaaaggaatgtactaaaatattttctaggctgaagcaggaggattgcttgaacccaggagtttgagactagcctgggcaacatagggacaccctgtctctacaaaaaaaaagaaaaaaaaaaagaaattaaattagctgggtatggtggcatgtgcctgtggccttaactacttatgaagctgaggtgggaggacgccagagcccgggaggtagaggctacagtgagccatgattgtgccactgcaccccagcctgggcagcaaagagatactctgtctcaaaaataaagtaaaataaaatatttcctgaccagttcagcatttataatattgttcctaatagcatgccactcctgactgatcattgctggcaaaagcaaagtgatcgattgtcaccaccctgtttgtccccaggattaacttggtaaagaagtacagccatggtttctgctttcgtggagcttacattctagaggagacagtgaaaaagaaaggtaaatagacaaatgaaacaactacagcaaattttactaaaaaaaaaataaaataaaaaaaggaaaaaagaggctaagataaagaaaggggaggtgtaccttaaataagatgtcgataaagacctcactagcaggaatcatcctccgtggatcaggagaatcctgaaactggggacctcataggcagtccaatccaaagtgtgaataggccatgaacatttttaaaactatatattcagttctggtcatctattgacctcagagacactagatttccagtggcatccactactatgactgcaattgctgaggggtaattttctgagccagagttgtagcatgcaatttgccttgtcattctcatctgatgctcattaatagtcccaacttttatgtaaggtatgtgctttcaaaggtagtgtgatatgtggctaaaaatattgatttttttcttttacacttttgtttcttttaaaaggaggaaaagtgagcactaatttttttatttcaactgtatcttttgaaggttcattatgcatatattttgataatcttgtctatgagaatgaaccctaggacaattaaatatcctttaattttgagatgtgtagtctggaaatacctacatggccgtcctaggctttaggttcattttctttgagaggctcaaccccatattatatcagatatatttacaggtcaaaaggcaagattgaaacaaatttagtttaaagatcttaactggcttttatttgtgattctagaatcagacaaaacctcactgtataaaaaagaatgagtgttccaatgagctgagcagaggaggtttcctttacagctggaaaagggatgaagaaagcagaaacaaagaaccaaaagcaaattggttgtttccaagttactttccttgtaaaggttaaagcagagggacatccttatcatattggctacaactggtctagttgaggatttggctactagttctcccccctgatttcttagaaggtcagatgaaaaacttggttttggcttggtggccaaaacttcagcatgagtaattctattttggtttggactgttgagcttggttcagtagttcagtccaaaccaatggacttctataaattttattcaacatacacgaaacagtttttgtatgtgagatctgtgaaaaatatttttatacttttgcatttaaaattatttgcttatgtataatttggttaatttaattttttaaattgcctaaaatttcccagtaatcaacatgcagtttcaggaattcttaagaactgagaaaagctaactcataaaatgtctctaagagtagacattttaataactattacatttagtaattaatcacaatagcataaaatttcatttattgacatatcattaaatatgacattgttcagattgtgcaatttctgcatacactgaaatcaaagtagtttttctctctctgttagttctgaatattttcataggcccttgaaaaatacattggccctagtcattagttcctggtacctaaagattaaagaggcaatagaatatgtgtgtattcccaggtcttacatggcactagatagtgggggtcttttccccctaaataaagtggatgctattataaccatgcatgactccagttagacccagatgaatgtaccaaaatcactaccatttaaaaagcataaaaaaccttgccctcaatttactgtgatttgcaaactctcctctgaagtttcactgaaccccacttataaatatcatcttgcttctttagcaaattctcaaaccttagtacataagaatcacccagagctcttattaaaaacagattcctgggccctgaccccaaagaatcttatttaatagatctaagtggagcccagaaatcagagtttttaaccttctgaaaccttaaaggttgtataagcctttagaaaacattagttgatgtgagcagggttgatgataacagctggtaagattagtcttgacttgagctactgaacaactcaagtccatttaggctagtctctctcaaccctggctcatactagaatcccctggggcttttaaagcactttacccccaaggattctgatttcttctgtatgggcattggtattttttaaagctaccatataaacaaattgagaaaccctaccagcctaagggcatttctgtcagaaaggattaacccacacactgcggtgatgataaggcctaacactcctacaaaatgcaaacactgaagcagagatttcgcaagactaaaatccatctggagctcttgattcccagtttgtgtcagcctcaacacacccaagttggccttaacagttatggcacaagaaaatgagcccttccctttagttttcatcagctggcagaatgatttagtagctctattataaaagcaactccattataattacagtgtttgaattataaacaaaacaagaaaaatacagaaggaatagtcctttagtcaaaactgtaaaacagaacaatttctggctgcagttaaaagcaaactgaaatattaagagtaagctctccagccctttgattcttgcctctttcccataggagcgacactacacattttttcaattaagcagtttgacaacctgaagaaacccacagtgcatgatttaatgagcatatactgtgtgcatggtaatcggcaagctgacagtttgctcatttcaaactgacaagagagcactacacattagtagaaaggtttcttgggtctcttttcattaaataagctttacagttgaggaacattccaactgtattggcaaagctgtcactaatggtccccaggcaaccttaactctctgtcactctccaagtcctcaagtcttgatgaagaaattgcttcttaaaaaacaaagcacaaaaacaaaatatagatatttaaagttctctggatgttgtcaggggcaaggtggagctttctgagccatgaatccactggtgatttcacagtacatgaattctaacccagtatgtgctggttcttcatgcagatcactttataaactggaattgtttttagaaataatgcccaaactgttaaattattcaatagtttagaaatgattcagtgtactggaaaaaacataggccttggtgacagagagataggggttcgaattctgactaaaatacttctctgtggccttggtcaaattacatcatttctcaggggctcagtttcctaatttatgaaacatggacaataacatctgctttgtatgaacaagatcgtaaaagtctttcgcacagttactgacaacacaggcatacttaaatagagactagtttacccacagaaattcagagtatggggttttaacaaagctaactatagtctgactgtcctgagatttctaccatgagcctttattggagttctataagaagaaaaacagtaagctaacattcactcacaaatgggattttatttaatcctactaagattctgaattttgggtgttattacacctgtttttataaaatctcgaaataagaagggttcttagaggtcatatgaggaatttctgacattttaacttttctgattacaagaatatgaaactactgtttccctctttgctctgcttgtcagaaaactcgagtgaattctcatgctaaatgtatgtttgcaactctgttagcagtagcggttagcagatttgtttcctgattttctatacatatgttagtaaccttacttaaaatagtttataagctaccctgaaggaagttgagatttcttagctaactagtaagatccataacaagaatccatgtcacctgactccaggctaggacacctcacatataacatggaaatgacatagaaaaccccagaagcaagtacagtgaagccatagcttattgcttgggtcctatgccatgaagatgatcaaacatattagccttctagttacgaggaaaaaatatggaagcttcagggtccttatttctaaaatagggataatatatatttctaagatcattgtaaagatttagagagaatattttcaaaatcagccagtgtggcattcgatacatagtaacattttaaaagtctgaaatgttgactctaagaaataattgtagttctactaattacaagtaaaacacaaatgcatagacccttaaacatgatttagaaatcatttatccctccaaacttcacgcactgatgtaaaattctgccccaggctaggtgaagatccatacttgctgtctttctctcatgtcacagagtacatggagatctggaaaagttgtccataaattccaaattcttaatataaacatgtctattggaaatacagactcttttttttttttttttgagacagagtctggctgttgttgctcagtggagtcatcttggctcactgcaacctctgcttcctggagtccagtgattcttttgcctcagcctcccaagcagctcagattcccaagcagcatcatgcctggctaatttttgtatttttagtagagatggagtttcatcgtgttgcccaagctggtctcgaactcctggcctcaagaaatccacccactttggcctcccaaagtgggattacaggcatgagccactgtgcccaaccagaagtacagaactttatcaagaatacacacatgtgacattttcaggtttaataatttatacttcagggtactcacaaaactgggccaaaatcatggtctacctctatgtgaaataccaagtttccctatgtctcacagccatgactccactggtgacttcacagtacacgaattctaacccataaattgactatatccagaatgtagccagacataccataaagatgttcatttatcttcaagggagtccacaaaaatagcactgtagttcctcatatgcataccctaacaaaaatgagtcagtggtgtttccccagagaaaaacgatgctgtgcagtggaagcagctttggaaacagacagattcagatttgaaggctggctctgctatccattagttgtatgacattggacaacatagtatgaacctcttagagccatagattcttccactggcaaatggaggaaacactttgaacttatataactattgtaagcaggggttatgttatgatttaaatgtcccctccaaaaattatgttaaaatttaactgccattgtcatggtatggagaagagggaccatcaagaggtgggaccactgagagatgattaggtcttgagagctctaccttcataaatggattaacatcattatgaagaaagtaggtttgttatcatgagtgagttattataaaaatgagtttggccctctcattggctcattttcattttctcctgcccttctgcttgcctccatgggatgacaagcacaaaggccctcaccagatgccagcaccttgctgttgtacttcccaacttccagaaccatgaaccaaataaatttattttcttttaataaattgcccaatctcgggtattctgttatagcagaaacaaaatggactaagacaaatgatatttaaaatatttaaccattagtatggtaaaggcaccaaccagcataggcttaatgcctgttctggtgcatactaattaaatatgaactccatttgaagaattttgaaggcatccaacttgatcctagatcatgggaggtgcttaaacatatacaacgcattaaatgaagcaaacacgtgttgtaaaacattacaataaaaaacttagcagcagttatactgagatctctatactctccaattacattttttcacctgtgttgtttttattccatgattttattaaatgattgttagcttaaagtgatgagccacttgcgtcttttgactcatgattgagacagtcgtcaaaaaattctagatttgaaaagacataaagtgatctcacttggaattttatcaagtctatattcatgtataatccttatgtcttcttaatttaatgactcctttattatgacacactcttcttctttatctctgataatattttttgtcttaaagttgagtttgtctgatattattatagccactctagacttcctatgctgtttccatggtgtatttatttccatcaatttattttaaacctatctgtgtttttttatttaaaggctatctcttaacagaacatagctgttcttgcttttttatacattctaatcatctcagcatttttttgaatatttatttatttttgtttgtttggtttctttgcccacaaaacttattcattttgtcaatcatttgaaagtagcttgcattcataaagcccttgggcttaggtctttttaaaaaaaattcattcatctgtttttatgtgtttattttttcaagtttcattttagattcagggggtatatttgcatgtttcttacctgggtatattgcatcatgctgaggtttgggatatgaatggtagcattacccaggtactgagcatagtactcaccatttggtttttcaaccttttcccctctcccttcttccctgctctagtagtccccagtgtctattgttaccatcttcacgtccacacgtacccaaagtttagttcctacttacaagtgagaacatgtggcatttagttttctgttcctgcattaaattgctaggataatggtgtctggctgcatccacgtggctgcaaaggacatgattcgattcttttttattactgcataatatcccatgatatacatgtaccaaattttctttatctgatccaccattgatgggcacctaggttgagtccatatctttgctattgtgaatagtgctgtgacaatgaacatgcaagtacatgtgtctttggtagaatgatttgttttcttttggatctatacacagtaatggaatcgctggatcgaatggtagttctgttttaagttctttgggaaatcaccaaactgctttccacagtggccgaactaatttacattcccaccaacagtgtataagcattcctgtttctcagcagcctcaccaacatgtggtttttttttgtttgtttagttttgttttgtttttgttgttttttttttttttactttagccattctgactggtgtgagatggtatctcatggtggttttgatttgtatttctctgatgattagggacaatgagcattttttcatgtttgttggccacttgtatgtctgtctccctttgagaagtttctgttcatgtcttttgcccactttttaatggggttggtttttgcttgttcaatcatttaagttccttatagactccagatattagacctttagtggttgtgtaatttgtgaatattttctgtcatcctgtaggttgtttactctgttgacagtttcttttgctgtgcagaagctctctggtttgattagtctcacttgtcaatttttggttttgttgcaattgcttttgaggacttagtcataaattctttcccaaggctgatgtccagaatggtgtttcctaggttttcctctaggattctcatactttgagttcttacatttaaatctttactccatatggagttagctttgtatatggtgaaatgtaggggtccagtttcattcttctgtatatggctagccagttatcccagcgccatttattaaataaggaaacctttctccattgcttttgttaactttgttgaagatcagatggttgtaagtgtgcagctttatttctgggttctctagtctgttccattggtttctgtgtctgtcttgtaccagtactatactggtttggttactgtagccttgtagtatagcttggagttggaaaatgtgtgcctccagctttgttctttttgtttaagtttgctttggctattcagtctcttttttgattccacatgtactttataatagttttttccagttctgtgaaatatggtagagtagttttataaactacctgtataaaacctgtagattattttgggcagtatggccacattaatgaaattgattcttccaatccatgagcatggaatgtttttccatctgtttgtgtcttctatgatttcttttagcagtgttttgtggttccccttgtagatatatttcatctccttggttagatgtattcctaagtattttatatacttctattttttcaggctattgtaaatgagatttccttcttgatttggctcgcaagttgaacattattggtgtacagaaatgctactgatttctatacattgatttaatgacctgaaactttactgaagttgtttctgagttctaggaggcttttggtggcgtctttgagttttttaggaatagaatcatattgtctgcaaagagagatagtttgatttcttcttttcctattaagatgcattttatttctttctcttgcctgattgctgtggctagcacttccagtactatgttgaataggagtagtaagagtgggcatctttgtcttgttccagttcgcaagggtaatgctttcagtttttgcccattcagtatgatattggctgtggttttatcatagatggctcttattatttagaggtatgttcttcagtgcctactttcttgaagttttttatcatgaagggatgttggattatagcaaaagctttttctacatctagtgagatgattctaaggctttttaaaaatcctatttatgtggtgaatcacatttgtatttgctcatgttggaccaaatttgcatgccagaatgaagcctacttgatcatagtaaattaaccttttgatgtgctgttgaatttggtttgctggtattatgttcaggatttttgcctctatgttcatcagggatattggcctgttgatttctttttttttattgtgtgtttgtcaggtttggtatcagggtgatgcacagaatgagtttgggaggagttgctcctcttcaattttttggaatagttcagtagaattgtaccagctcttctttgtacatcaggtagaattttgctatgacactgctacattttaattagtgattagtccactgacatttagtctgattactgatatgattgcatttagagctgcaagtttattatatgttttctgtttgctcctccacttcttgtttttctttttcttccctctgcaacttttggatcatttttttcttaatttaggattctattttatctttggattttcggtggtttttctaggaattaaaacgtatattcttgatctttcacagtctacttagatttaattttatactatctcatataaaattggaaaaccttgcaactgtataaatccatttgccactgcctccattctttatgctataaagtcatatggattacatctgtacatattacattataaacaccacaagacaatgttataatttttgctttaacaggtcctgtgtagttaaagatcttatcatgaaaaactagtcttttatatttacaatttccaaaattttttcattccttcttgaagacttaagattccatctggtgttatctcactttatagcctgaacaatctttcctttagcatttctgtggggcaggtctgctgataataaatgctcttagtttccttttatctgaaaatgtactaatttgcctttactcacaaaggatatttttgctacacatagaattccggattaacagtgttttgcttttttttttacccctcgtttgtactttaaaaacatcatttcactttttctggcctttataaattctgatgagaagtcatcgttcatttaaagcattgttccaccaaagataccgtgccatttttctctggctactatcaagattctctctttattgctggtcctcaccagttggaatatgatgtacctatgcacagttttcttcaaatgtatcccatttggggttcactgcatttcttgatctatgcatttatgtatttcaccaaatttgaaaatttgggcccattatttcttcaaatattttgttctgtttcattctctttctcttctccttctgagactccaattacatgtaagctagacattttaatttctgttacacaggtccctgagtctctgtttattttttttattcagtcattttaagtctttttttctgtctgttcttccaaaagaaaatttctatggatctatctttaagttcactaacactttcctttgtttcctccagttgctgtaagtatactcaatgagtttttatttcaaatactgtatttttcagtttcaggatttctatttggttctttttgcagtttctgtttactaccttcttattcattatgagtttattttcctattatttgtggagcatggttaaaatagccactttaaaatctttgttaattcccacatttggctcatcttggaattggtctcagataattgctttttgtcttcagaatgagtcacattttattgggtttccatatagcgtgtaatttggggttgtatgatatgcaagtattgatgttattgtatgaagagcttcaatcctgttatagttttctgaagggtattgatttatttgttttagcaggcaattagttatactcaaatttaaaactatcccctgggtagcagctcgaatctcagttcagttcttttatctttgtgataatttgtgtctgctccatcaagaatatacacatgacatatacctcagaattacatgacgtgatctcacttggaattttatcaagtgcatattcatctacaattcttacttcttcttaatataatgatttactatcatgaaatgttctccttcatctctggtaactctttttgtctgaaagtttagtttgtctcatattaataaattcaagggtcaaccagaaatttgggtagtgtttatatacagatttgggagcttcccctctctgcctctcttctttccaagattctgaattcattttcctgtggctatgattgccctgaaccctgttctttgggtcttcaaaccaaaaacactgtgagttttctattggaggatggccacccgaagtgacattaattttagcctgttctcactctaaaagttgtaaaatgggaaactcactctggaccgacctgtgcttccaagttttgaatttcagctcccctccagaatctgtctgcttaattttattctctaatgcttccaggtaatttcttttttcttttcttttttttttttttgtttttggtcttttggtactttatagttgatatctgtgagaatttcggatccagtagaacttacttagccatattggaaatggaaacaagtaaaaacatttaggaaacattcctttgcatttcctaacacctctcctcaaaatacttaacctccgtccattccctcatttagtgacatttgagtttggttttaagtagaaatagaagccaggctcagggcttccttgatcatcttgccaagtacatgagaagacttggaatgaaaacacagcataaagttaaatgatagaatgatagaacatcaatcaattctagctcttagactggtggcatttaatctcaaagcaatgaggcttatacagaatcatgactaccagtgattatctacatggtactttgccacgttattttaccttatttctttggtctcagatatctctaaatcctgcctcattgaaaactgcaatagataatatgccacgagaaacagaatactgaaaatcctaaaatgccaacccagagttggtaattgcacaattccttctaatcataatcattatggcttccacttcttgaaagcttctgtataccagccaccttgctaaccactttacattaattgtcagttaatccttcacaactattctttgagcagttcccataactagcttcattttacggaggaagtaaccagagttccgagaggttgagttcactaagagcacacagcaaacagtagaactctgagtcagtctttgtaaagagaagaaatagcaaaggggttttggagacatcaggcacatactctttactattaggagagaagatagaagtctttctaggagtaagtagggtttctaaaacttaaatagtctacagtcctttttgtcagtaattattgatattaaaatgccacccttccagaaacaatatattttatattgacagcttttatgtttaaaaagaaccttctagccgggagtgatggctcacacctgtaatccctgcactttgggtggctgaggtgggtggatcacttgaggtcaggggttcaagaccagcctggccaacacggtaaaaccccatctctactaaaaatacaaaaattaggtgggcctggtggcgggcacttgtaatcccagctacttgggaggctgaggcacaaaaattgcttaaacccaggaggtagaggttgcggttagctgagatcacaccattgtactccagcctgggcgacagcgagactccatttcaaaaaagaaagccctccttcagggcttaaaacactaacccaaacaataacaaaaggatcaaataattatatgtaaaggctcatatgaaaaggcacataacaccagtgctccattttacctcatttcatttactgcctttaaactttgttttccaggtaaaccatctaaacaggcaggtgacctgccagagaaaaatctggcacattaggaagtaaagatgcctgcctcatcccacaacaagatgcagcaatgtctcacagttctacaactctaggggcaatcctgcccaactttgcaaattttgcataaaccatgggtttcaagtgactttggaatgagagggaaagggaaggcagcacgaaggataagctggctgacattgtaaagtggatacaggaaactgggacttaaccggaagcaggaaaaggaatatagtatctttgtgttctggtacataggattattcaatatacatatttattatacatgttaaattgtctgagacccggaaatgagagatactgttaaaggagtaaagatgagatgaggtaacagaaaaggagaggagtaaatatgagtcctaaggaggggttacatgagcacagtcccctgacgacatgctagagattaccagattagtgcattgctcctactttcttgctattattattattattattatgggttttttttggcagggtctcactctgtcgcctaggctggagtgcaatggcatgatcttagctcactgcaacctccacctcccgggttcaagtgattctcctgcctcagcctcctgagtagctgggattacagacacctgctaccacatccggctaatttttgtatttttggtagagatgaggtttcaccatgttggccaggctggtctcaaactcctgacctcaagtgatccacctacctcggcctcccaaagtactgggattacaggccctttcctgctgtttttaaaaatacatattcaacatatccggtgaaatcattcaaagatgcatacagataagtgattattttactctaacgtaaagcctctttgtaagacctacccttcactgtctgtcccagcatatgccctaggacttcctctgaccatgaacagtaccatgccactgaaggagatctgtttcaacagagcctcctcctgctgctcctaactttatttccattccactagcttctcaaagtcatgcaaaacataacaacctgactttgtaactgtttaaccttactttttacacgtaaaaattattaaatatgtgtaactgctggggggaggataatataatggcatgtcagtcaggtaacaggtaagctacatttcatggaaaagaaggggaatgctttcttcagaaagtgaagtcatcattcttttatttaactgacataatatttataccccaatttttaaaatggcagctacaaatagaagtcgaaagagggtaaattctccaagggaatctagccctgaaattttaccattttaaaagttctattttacaagtacataggaacattactactattataaggatactcacagcaggtcaattatttcaaactctttgaaaaaaaaatcaaaattaagtaaacctacctttcagaagactgctacctcttcggagtcctcagtggcaggatgcacagagcttttatagagggtctaagcaggcaggtattcctaggatacctacaccaaggacaagaaattcagatgattatttcagcagtgatccagatggctctaggtacaatttcattaggaacgttcaccatgaatactgagcattgccacacaggtactgttaaaagcgcagaatgaaggtacatatgtgatttttgcaggcattgtcattaatctgtacattggagactgtggctcaaaagggtgtaagtggttcatacatgatcacacaagaaaaggggcagaaccatgccttaattattcatttctgattcctagtccagggttgtttcagccacatcatctgatcctcctcaagaactggaaagtcctggcactggggctttccattttgcaaaaagatgaggctgacccgtgagtctggtgggaagagtctttctctggttttctggtggtctatgccaagtcacctgtctgaagtgtcctgtgtggccagtttactcactttcccttgaaactctggtgtccacagaatctgaaggaatctgacaagcaaagaaacatgggtttttttggtcccactggcctgagtttgaatcctagtaatgtgtttactacttctgtgtcctatgtagctgctcaacatcactgaggctcactttctatctctatcaaacgggtataataatatttgaagggtacatttatgaagaggattttttttttctaaatgagaataaagtatcaagtacagtttctggcacatgttagatgctagggcaaagtgaaagccccatgacccaccttacttgcagggataaccccaaagtggacaagtgacagggaggctattgagaccttgctgctcataaatcactcaatgacaatgcactaatcccctaactggctggttcctcactgctctgacctctacctctgggtttccttcatgtacacttctttgaaataaaaatatcataaacaccaattcattccctaggatctcatttagaggtaatcgtttccttttttaatctaataatcttggtctacatcatgttacatggtcagctcaatgtagtaattgaaagcagatgatcattcatttaacaagtatttattgagactctactaaggtgtcaggcactattctctatagcagtggacataatagtccaagatcaggccatcatgctgcctaccttctggtagaggagacaaacaaacaaaatacatatgtaaaatacatgagtggttaaatagttctaaggactctggagaaacacaaagtaggaagggagatggtgagtactatgggttgaattctgttcccccaacccctccccatcaggaaaaaagatatgttgaagtcctaaccctcagtacttagaatgtgaccttatttggtaataggattgatacagatataattatttaagttaagatgaagtcatactggagatcggtgggcaggcctctcatccaatatgattggatataagaggatgaccacgtgaagacacagagacacaggggagaaggaacgccatgtgagaataaaggcagagattggagttacatagctgcaagccaaggattgccagcaaatcactagaagttaggaaaaggcaaagaaagattcccctgcagatttcagagggagcatggccctggtgacactttgatttcagacttgtagcctccagaactatgagacaataaatttcggttgttttaagccactcagtatatggtacttagttactgccaccctaggaaatcaatacagtgtgtttggggagattgttgcatttttgagcaaggagatcaggaaagatctcactgaaaaggtaatgtctcagggaagatttgaggtgcaggggacaaccatgatgatggctctggatgaagaaattctaggcagagggaacagaaagtacaaacctcccaggcaggtgcatgtttgtatgttagaacagcagggaggccagtatggctggaatagccaggggagagtggcaggaaaccaggtcagagtgatgacaaggagctggagggtgctagaccttatgggccactctaagaacttaggcttttacttggagcaaggtgggaagccattgcctacttctgagcagaggtgaaccaagatctgacttacattttaataagctctctctggctattcggtaagaataaactgaagaacaaggccacttaggaggctcctgcagttatcctggtgaataaaggtgctagccaggtagcacacaggagagtgaaaactggtcagtcctatgcgaaatattttgaaagcagatccaaaaggatttgcaatagattgcaggtagagatacgcctgacttcttgatagtacatagaattaaattagaaaccgtaacaacttaactgtactgatcatctgaataaattatcttctcaaatgccagaccagccaaagatattagcaacaggtttaacagacagggaataagtaaccagaatatataaggaactcctaaaatcaacaaaaagaaaaaggtaaacaaataaatattttttaaaatcatgattcaaagaaggaacaatggaccatggacataagaaaagcagctcaacctcactgatatggtttggctgtgtccccacccaagtctcaccttgaattgtaactcccacaattcccatgtgtcatgggaggaacctggtgggaggtaattgaatcatgggggtgggtctctcccatgctgttctcatgagagtgaataagtctcgagagatctgatggtttaaaacatgggagtctctctgcacaagctctctatttgtctgctgccatccctgtaagatgtgacttgctcctccttgccttccaccatgattgtgaggccaccccagctacacggaactgtaagtccattaaacttctttctgttgtaaattgcccaatctccagtatgtctttatcagcagcatgaaaactgactaatactctcactaaacatgaggaaaatgcaaatgaaaataatgggattctactttatttctatcagactagttaacatgaaaaagactgacacaattcagtgttgtccaagatatgagaaaaaatagcatattattctagtttacttccagcggaatcatgaattggtatattattctattgagcaattttactgtattatcaaaagtgacagtacacatatgccacggcatagtaactcttcttggggggtataccagggctaagaaacatacacataaggggacatatattaaatcagtataacaaaacttggaaatgacctaaaagtcacccttaaaggcaaatcagtaaataaaatatgctatatttatatgattaaaggacatatggctgttaaaaagaatagattggttttataggcatcagtgtggatgtttcataaatgtcatgggcagaaaagcaacacaaaggaaaatgttaacatacaaacacaatagtatgtattcattgtaggtcggggtccccaaccgccaggcggcagaccagtaccagtctgtggcctgttagggaccaggccacacagcaggaggtgagtggtgggcaagcgagcattaccgcctgagctccacctcctgtcagatcagcggggacattaggttctcataggagcaggaaccctagtgtgaactgtgcatgcgagggatctaggctgcctgctccttatgatgagaccctaacgcctgatgatctgaggtggaacagtttcatcccaaaaccataccccccacctccccatccatggaaaaattatcttccacaaaaccagtccctggtgccaaaaagttggggactgctgctgtggatacacatatatgtatgtaaaagtataaacaacggactagtcaaatacatcccaaatttatggtagggaattttaggcaggggtacaggcagcaaagaaagtggagggtggagggaaggacaggacattattggtgaaaatgatttggttttatcaataacttctttaaaaaggaaaaaaacaacactggaagcaaatctgaccaaacaaaaacagatactcgttttgggatagtgagagtacagatgatcattacactagtttttgtgctcatctgtgcttttttgttttctgcgagtaaagaaaggaggaaagggagggagggatgaatggatggaaggaaggaaggaaggaaggaaggaaggaaggaaggaaggaaggaaggaaagaaggaaggaagggagttaccagttctggactgcacttaagctaatcgctaatcatagatggggatagatgaggttagtttttttgttttgttttgttttgttttgttttgttttgagatggactttcacacttgttgcccaggctgaagtgcaatggcacaatctcggctcactgcaatctctgcctcccaggttcaagcgattctcctgcctcagcctcccaagtagctgggattataggcacgcgccactacgcctggctaattttgtatttttagtagagacggggtttctccatgttggtcaggctggtcgaggttagttttttaaggatgaaactcaaaactatgttttaataatcagcgtgaccattggtgattcctagcagactgtctcagcgtggagggctgaatttcagttcagcccgcagagggaaccatctgtcatttggaatgacaaggagctctctgccaggggaacaccagaacaccggaagcagccatggtcttcactgcatccccactggccctggaaccaccaacactacaggacacaggaacacacaaagtaaaccaagggtacaccatggacatcttttcaacctttttaaaagcacattgcaattttctagaatcaagggaacaatatgcttgattagttcttcagcagatttggcaattttgcttgtcatatttctctctttaaagcaagttggtcattaaccttccatgttctaggacttgagattaggttttccccccacaaaatgaaaactttgcttaaaaaaaaaagagtttgctttaggataattcatttttgctgctaataactgcaagatcctctttgagccaaggaggtcattcttgaaaggggctagaattgtgaagaatgttccttctcttcctggagagagagtctgtgaaggcaaaaaagtttgcaggaaagttcagtaatcatgaagtgaaagcccaaagtgacctgaatacttcctcctgggtcaatattgtatgtttaaaaagaaacaaccaaaccttcaaagaaaaatctggccatccccaaatcccaatacatgaaactagaaggcaggaggcaccagtagaatgctggctttgctctcattgcttggcctccatcacagttacaatagttgcatatcatccttttgtacgtgtcatcctaaaaatgggatttggattggtttctaacaataaaacgagcaaggtagaaaaggaatattatgaataagttaccaatgtaaatatgctattttgcgcctttgaatttgagtgttgataaacatgattccacacatggaaattagacttttcagagctactacactgaatcatttaatttgtctgagtaagtacttataataatgtggctgctctgcactgcaataaacatcgggttttcaaatgaacaaatgaagtatgtgatactccttataaatggaactgcagcaaagggcgttcagctagggagctgtgcactaaaatgggatgggtgataagaacatctctctccagctccactgatagtgaaaggaaagaatcatatggcctctgctgctacattttctgttcctggacagaagcaaggctgaagcctcactgtgaaatgatgggggactgttgctattttgggttgtcacagggtaacttgtcacactactcaggacacatgaggacagataattctgttcctccagattgtggacttgagaatgctttagtaaaatagcacagggatatattttggatagtggttaaggacatgggtttgaatcctgggctctaccaaccaaataggtgcatgattgtacccaagtaatcatcagtcttctccatgctcattttcctatttggtaaaataaggataataactttggcttcctcattaagttattagggggattcagtgagataatttatgtaaagaacctggcacatgattagaattcaccttttttaacattatcattttaacattatcatcacatttttaacattatcattcaccttttttaacattaacataaccattttaacattatcattatatatgtcatcattattattatatttaaccttactttcattttaatccattattcaattttccttcaacgctcattaaaagcacaactcactacattgtttagtaattaattacttttgttcatttaacaaagtatttatactttgttatatgtgccaggcacatatgctaggggctagggtacataggtgatctaatcctcctggaagctattagaggagatgggcatgagtcaaaggctcccataggaagtgaaacctttgaaactcagggaacaggtctaaaagaaaggagcaggctaggcatggtggctcatgcctgtaatcccagcacgttgggaggtgaggtgagttgatcacctgaggtcaggagtttgagaccagcctgaccaacatggcaaaaacccatctctactaaaaatacaaaaattagccaggcatggtggcgggtgcctgtaatcccagccacttgggagactgaggcaggagattcagttcaacccgggaggcagaggttgcagtgagccgagatggtgccactgaactccagcctgggcaacaaaagtgaaatgctgtctcaaaacaaacaaataaacaaacaaaaacaaaggagcagatcactctaagagatactaaaacaaaggaacttaaattaaacctgagacctgaaggatgagaaggagaacaagggatggaatgatggctttcttgagagaaacacaacaatattcaaaggcatggagtatacagcactttatcattgttatcaaaagtcattgcaaaatgatctactgaatagctcaattaaatctaacaactatgtgacaagcacctactatgagccaagcgcagtgccaaactctagaaacaccatagtaaagacagatatgatccatgcctgcatccttacctcccaacacctactactatgtttgaaaaccacaccaaagtcaatatttactttgtaaccaataaattacccctctgggtttgatcacagagagatttcacctgcatggaaaaactggaatgctttctctggtcagacaaggaatgttacatatgccaaataattccctttcttcttagttgctggatatctacaaccaaatttagtttattccatgggcctaccaacttatactactaaagatggccatgtttctctttcatgattaattgttctattatttgtagactacctttaatttagtaaacagcctcagcctcaaattatttggaaagttattagaagaggagaaaaaagtaaaagaaaacaaggaaaagagatctcaagtttcttgagatctgggaattgtccaatgtgctttctgtagtattcgtggtacctaacatggtgctggatggaaagcatttaataacttctgattgtcagatggatgaagaatataaagctttcctggttcaacttgggctccattagaaggagggaagaactgaaactcggtagatcagaatatgcctccccacaacatccttctttagcataaggattattttgagctgattattttgagagactgcagctacaggagaagatctgaaaacagaagagaagttacctttttgtaaaaggattttacatctataaaggaaatttctactcataagggtgtctccctttctataccaggaagagaaggatgaccaaatcactagagactcttaccaatggagaagacaccaacttaaatctgcataacaaaccttactcatgtttaccatacttttcctgggcatccctccacaactgactatcccccatacccttcttttttttctttcagtggacaatggtatttgagcctgatctcaaagccacctctttgagatttattcatatctctgggtatcttccacgtgtacatgagatacacatatttttaacttctgtttgtttttctcttgtttctgggtctatcccaacctaaggaccataaagggtaaagagaaaattatttttccttccctacacttacttttctctagtctccaggttcagaggaaagaactcaaaaaagtggctgaaaagtttagcatgattttcattgtaaagcagcccaataaccaaacagaagcaccacataaaccaaaagaagagagtggtaagtgaaatataaggtaccattagagatttctctcagggaataagattcttgtaacaaaatatttacctttcttattctggtgctagtaaaaataagagaaatgtcacaattttaattaatgtctaagcaacagggaaaaatattaagctactttatgacaaaatggaaatatatttgtaattctatatcctaatgttctctcagttattttggaaaaactattagtcctttggtctcttctacattaggagagcaaaaagctataatatggcctatctggctaactatcgggaatcggagaaatcaatttaaaagaaatttggaagacacctacattatcgatattagagcaaagtagagatctgccttgttcacagcaaagcaatccaattcacacacacacacacaaaacaaatgttgcatttatggaagtattaaaacatctcatccttgtccttagcttaacatattaatgagaatttctgaattaatctccaatcgtgaactgtgtctaggtgtgatataagggcagtaaatactgtgcagcttgcttcaggcatgttttatgacagattctctgacagatagaaaatctttaagattaaattatttctgtattttcctaagaaactcatcagtactaacaagcataccacttccccaactagttgataaacagaaaagaaaatattattaagtgatggcacttgaggaaatagttaaaaggagaaactcagaacataagattgtgattatatataatgaggagattctcaaaatggcacagaaaggaaaggaacgagttgaagctgaaaaacgtatgtttttaggaggtaagttattccataaagcaattactaaaatgtgagagttcttctcatggttctcaaccttatactctgaaagagaacttcttataatgcaagactaagagagccaattacttcagcaccaaggtacatcctaaatctctggacttggcagttcaaaaaaactcttggaaaatgttcttctaaaatcttcactaacagccctgactttagaaatgtagactctaaaaggatgaataaaaactaaccaattagatagcaaaatggagaagagagagcactgaataaaaagacctgccagagttcgggttgtacctctgccaccagcctcagacttagttcatatttacaataaaaccataatcataaaaattaataattatggaacacttagtatgccaagaacttttcatatattatctaatttaatcatcctaacaacctatgagggagacaccacataagagaaaagcagttgaagagtttgtccaagaccacccagctgctctgagtgatgggttaggattcaaacacgatttttttggaccccagagcccaacccttaaccactcactctgcagaatagttcagaaacctcctaggatgatctaaaaggcttctttcaacaatagggcgctaagatttatgagacatgattgtataatggaaaaaaatctcaggtttttgaagtgactttgtagcccagttgagcagcttcttctctaagcctcagaatcttagataacaacactacttaccttacaagctggcctaaggatcagagataatactagagcccttagccccaagtaataataataataataggcagcatttatataatgctcattatgtgctgggcaccatctaaacatttttttccccacattaaagtatgcaatcttcacaatgaccttaaaagtactattattttgtactttttatctaattgtataagaatacaattagataaaaagaaaaaaaaagagttctattgttttgattcctgttttaccaatgaggaaacagaggcaaagagagttaaattacttgacctaaatcacagttactaagttgcagatcttggattctgatccagacagaatgactcactggacaacccaaaacatattggaggcactcctactgatacataaagaacctccttgccatgcccaatgtctgtgtcactctcacccaaagtaacaaatttaacataaacttgggaggatgaaatacatagggatgcccagataacctgcctactgtcattccgcagattgtgcctttaaaaaaaccaatttcaatagaaaccagcaagaaagagatacatcaggtatgtcagacatacgtggtcacaactattttttctccttcctggctaatcactccctttgtgttgataatgtgctgctttaaatcaattcataaaaaaaaaaaaaagcacagaggcaccataaaagtcgtttttcctgttttcaatctggaagaaattcagtctcttattcattttaaaaactattttaataatagcttttacttaacccaatatatcaaaaatattatttcaacatgttaataaaagttaataagagattttacgctaagcattcaaaattcagagtttactttacatttaaggcccatctcaaatcagactaacctgattagtctgaatgctcagtagccatatatgttgctagtggctaccatattagacaacacagttctagaaagattggcttagaaaagccctggttgttgatatttataggtctctttccttgggctggtcaaattccccagaaagatatctttcaatctcctgccttaggggtataagcctgggtgccattgttctgagatttaagtatgggaaagagcagaagccccatcatattgtctttcacttaagccccgattttcatcattatacccatcctcagctatgcatggtgactccaatcacgagccctgtagttggtccaacccctccagtcttcctcctggggaagtagggagggaggcagttgggagaggcagttcccaggctatgcgggttgggcaagaactctggggactggttagcagttatttgtcattctttcaatgttcttttaatattccttcattcccactttcatacatttacagtgccatgaattcctgacacgttctagaatctcagtttagattttaccgtttctctccccttttaaatcagtccctggccttttaaggcagcttctacaattgtattctgtgaccttctcctctatgatttttgttcatattcccctccccttttttaactaacattttttatttgaaataattgtagactcacatgaaggttgtaagaaaaaatacagagaaggtccatatgccctttatccaattcccttcaatggtaacatcttggaaagctattacacagtaacacaaccaagatattgacaatgacacattcaaaacacagaatgtgtccatcccagggatcctcttgttgctctttaatagccacacccacttccctcccactccaccccttcttaacttttaaccacaaatctgtactccatttatataattttttcatttgaaaaatgttatacaagtggagtcgtacagtgtgtaatcttttggttttgtgtttttttcccctttaatctattccctgaagattcagtcaagtagtttcatgtattaataattcattgctgagtagtattcgatggtatggatggaccacagtttgcttaaccattcacccaataaaggacatctgagttgtgtccagtttggggctattacagataaagctctatgaaaattcatgtatgggctttggtgtgaacataagcttttgtttacttgggataaatgcccaggagtatgataagtgcatgtttaattttgtaagaaactgccaaaccattttctagagtggctataacattttacattctcaccagtaacacaatttctctgcatcctcaccagaatttgttgttatcattatcttttattttagttatttcaatatgttcatagtgataactcattgtggttttgatttgcatttccctgatggttaataatgttgaacatcttttcatgtgcttatttgccatctgcataacctcttcagtaaaatgtctggccatgtattttctaattgagttgcttggatttttttactgttgagtttgaaaattctttatatattctaaatactagtcctttgtcagatatgtagtttgcaaatattttcttccagcctgtagttattcttttcattctcttaaaagggtcttaggccgggcgtggtggctcacacctgtaataccagcatttgggaggccgaggagggtggatcttttgaggtcaggagtttgagacctggccaacacggcaaaagccagtctcaactaaaaagaaaaaaaaaatacaaaacttagccagccacagtggcatgcacctgtagtcccagctattccagagcctcaggcaggagaattgcttgaacctgggaggcagaagttgcagtgagccgagatcgtgccactgccctccagcttggggaactgagtgagacactgtctcaaaaaagaaaagaaaagaaaaaaaaaaaaaaaaaaactctttcacggtgcaaaagcaaaagttttaattctgatatagtccaatatatcaccaatatatcatttgtttcctgttatggattgtgtttatgtgaaatctaagaactctttccctagccagagattccaaagatttttctctaatgccttctccttctaaaagaagggttctttattctgttccgttgatctatgtttctgtcactccatggatagccacatagtaactatgcaatacttcttgaaactgggtagactgattgctcccactttattatttctttttcaaaattgttttagctactctagttcctttgtttctgtataaattttagaataatgtcatctatatatgaaaaaaatcatactgagatttttgataggaactgctttaaacctgtatatcaatttgggaagtatcggtatctttactacgctgtgactttcaaatcatgaacacaacatttttctccatttatttacatttttaaaatttatttcatcaacattatatagttttcaacaaacaagttttataaatgttttattggattcacataagtatttcatatttttgagctaaggcaaattgtactatatttttaaaatttgtgtccacagattcattgctagtataaagaaatacaattgataatttaaatgtctatctcatatcctgccaccttaatgaactcaattattagtttttcatttgtttgcttgagatagggtctcactctgccacccaggttggagtgcagtggcacacaggtattggcacaaacacaaccttctatagcctcaacctcctgagctccagccatcctcctgcctcagcctcctaagtagctgggatgacaggcatacaccaccaggcctggttcatttgttgttgttgaggagagatgaggtctctccatatttcccaggctggtcttgaactaggctccagcaatccacctgcctcggcctcccatcgtgttgggatgacagtcatcagtcactacacccagccacttactagttttaagagttggttttgtgttttttcgtctttgtagatcacttagtgttttctgtgtagaaaatcatgacatcagcaaatattaacagttttctttctttccatctgtatgcctttcatttccctttcttgccttattgcactgattagaacttcctgcactatgttgaataggagtggtggaaccagccttgcactgctggactagactccatttcgtcgtggtatattattcttttagcctgaatcctgtttgttaatattttgttcaggattgttgtgtctctatttatgacagttattggtatatatttctcttttttgcactgttttttctgtttttcatatctgagtaataccagcttcctaaaatgaattgcgaagtgttctctcctattttctggaagagactgtataaaactcctattaattattctttaaatgtttggtaaaattctccagtgaggccatctgggcctaaatatttattttcagggagtttttaaatgattaattcaatttttaatagttatgggcttttaaatattatctatttcatgataggtgaatggtaggaatttgtgtttttgaggaagtggcccatttcatctaagttatcaaatttatgtgtgtagagttgttcatggcatttctttattatccttttgatgtctacagggtcaatagtgatatctcctctttcattcctgatattgtaaccaaatgcaggtccagatgcccactgtttacagagtccagttaacaagagtgaggtctagtagaaagaaagtcattttactaaaaccagtaaaggggaaatggtcagattcccgcccaaagcaatcactttgattttgggggaaggcaggggtttaaaaagggaaaacttgataaggaaggcatgcaagaattgtactaagtataatatctgtgtgtcttgttctggtagctatcttgggtctcagtctacctggatggtgagtcaagacatctgggaatatctttacttcccctttattcctgaggatattttcacgggctgtaggacactgctttgattgttgattattatttcattcaggactttgaatgctttaagttcctgagcagccatggccaggtttttaactagccactttgaagtaatctctggaattttgcagctgggtctccaagcttattccgcctgtctcaagattagcccctggaacttctaagaaggcacagtaattagatactagtatatacttagacaaatgtgaagggagtatatatggtgaaaaagggagggacgtggagcctatttctaggctgaggaaaaggcttctgcagtttttcaaggttgtatcttgaaaaccaagagaagagaaaaaaatgttttaaaatgcatttggaagttaagttgcctagttacaatattggtaattggtgtcttttctcttttctttgtcagtcttgctagactgtcagttttattaaccttttcaaagaaccagctactcttgttttcctttgattaaagtttgcatgatacatcttttcccattattttactttcgtctattgttatattgaaagtgagcttctcatagacagaatatagttgggtcatattttttaaacaattctgctaatctcttccctgtattataagtggtatatttagaccatttaactttaatgtaattattgatattttagaatttacactgccattttattttttgtttattttctgtttgttctctttgtggttttctgttttctttgcccagacttcttataagctatttgaacactttttggaattctgttttgatttatctaaagtgtctttcagtgcatttctgtatataattttttaaaggtttctctaggtattactttatatatttataactaaacagtttactggtgtcatcattttaccagtttgagtaacatatagaaaccctatctccgcactttgcatccctttatcttccccatttataatataattattttaaatacttcctttacatgcatttacatccacatcagaatattgcaatttttgcttcaaacttcaaacacaattagagctctcaagagtacaaatgtttttgctatgtttttttcttcctttctgatgttgaagagatccatttttaattgtcttctttccaattagataactcttttcttttctttcgaggcagagtctcaccgtgtcatccaggctggagagtgcagtgatgcaattatgcaaattcttttagttttccggctgggcgtggtggctcacgcctgtaatcccagcactttgggaagccgaggcaggcggattgcctgagctcaggagttcgcgacgaacctgggcaacacggtgaaacccgtctctactaaaatacaaaaaattagccgggcgtggtggtgggcgcctgtagtcccagcgactcaggaggctgaggcaggagaatcgcttgaacccgggaggcagagcttgcagtgagtcgagatcgcgccaccgcactccagcctgggcgacagagcaagactccgtctcaaaaacaaaaacaaaaacaaacaaacaaacaaacaaaaaacacaaattctcttagttttccttcatctgataatatttttacttcccctttattcctgaggatattttcacaggcaataggatactggcttgactgttgattgttatctgcattcaggactttgaaagctttaagttcctgagtctcagcagaaactcaaaaataatacatgtaggaagagctaaaaaaatatacaataaaccggatcctatcgaatttaaatgtcaccaggctacaagaaactgattctggcagaaaaaataaacatgtgaaaaataattacaataatgtgtgataagtgcaaaaatgcaggtatgtacttgtcacgatgctgacacacagagagaatcagcactgcttgagagaatcagtgaaaacttctcagagatgtgtgaaccaggttctgaaagttaggtagtaaaaggacttcctgggtgaaggggaacccagcacgaaagccctgagaaaagcggaaaagatggtacatttgagaatctgtgagactgaatgcctggctgaggtatagaacacccattggaacaagcaagagatgcagtagaaaagacagctaagggaaggatgctgggctagagggcctcatcctctactaaggagtaaactttatcctgtgtaccacgaggagctaccgaacagacgaaaatggtgagtgtaatatttaaagcaatgattgctactataacactctttttaaagtagcttttccatgaattattaacattatctttagtctaatacgtatcaaaatttagtttatggactggtaggatgtgttaatggccaataaaagtaaaagactcagccgattccctgccttctacactccattttacacacactccatcctgcctgccgaatgacttcagtgtctctgtgaccagtgagtgaagcagcatgcaatgagatcatggctagatggcagcacattcagtgaagtgcttcagctttcctgttgcttctgattccctggcatttgtcagtgtctgtcaaaacattaacatttcttaatgtatattttgcattatttactaaatgaaaattttccaatgacagtggctgagaaaaaaaaatcagatttacatacagtatgtcaagttcacattcgatgccccagaaatgcccagtccccaaagacctctagggactgcagctcatttgttgtccctctccctctcccgtttattatgctgaccctctgcccagccacatagctcaccccacccccttagaagcatctagagttggctctagacatgaaatggaatagatttctgcatttacataactgctatcgcacttctggtgaaaagtagtttcagaaaaacacagaaaaaaataaacagaagaataaaaagtgtctatgtgataacataagggcttatttaactacgtctttatttcctttacagtccaactattttttttttaaaactgcatgccaccttcatgctgcctctcggaggggacttgatcttatttagacccggtggcgagggtccttcagctccgtgaggagctctctagcactcagtcctctttagaggaaagatatcttcagagcctaaaggccttgaaagaaatgacacatttttaaaaacagaaaaacaagcatgaaagtggcccatcagaaatgaaggtgtgaactagaatacaatagacagcgaggaaggagccaaaaatcctcacccaggcaggccaggatatatgcagatagggaggaaattgggaggcattcctttgctaataaagatgatttttcttctaattttcacatctttcatgatgtatcttttgttttttgttttctctctatgactgctgttctaaaataagtgggctttaagaatatgaactacagtccgcatgtttgccagccccatattctgcgatgaacttgacatgtgaatgaatcaattctgcagaggtgaaaagttattcctacaaagtccccagttttccttgtgagaaagatccctacttacctgtaaacttgttaattaaatgtcaaaggtttttatatcaaggacaataacacaagccaacctgggaatctgcttgtctgaaataggtaaagagtgtctgtgtttatttagaattgattgtacactttccttcattctctacatagattttattttctccccacattcttctttttctgtattgccttgagggctttctcttataattatgtgacaaattatatctgaattatgttcaaataagcaaggagactgaggttttctgttaaaaacatatggcctatcagtaatgaatgaagttttgcccatatcatgacatgactttattgaaggcaccatctcatatatgcagttttcaatgtggtgtctaacagatttgtgtaaaatgtctaaaattaagcaaatgcaattatatgagttagtatcatcttatcatgtacattttgcttgataatagaaaagcaaatgaaaagtttattagcttattacaacagtctgtttttgatttttactttagactctattcctctttattttctcctcttctgtttcgggtcattattttatctggagaacccaaaatccaattcttcatctgtatttaccacatagatctttagattctcttaccaatccaacagatttctgaatatttaactaccctattgtaagttgtcttgtttagaagaaatggaatctaagattgtggcagtaaaggacaagctgtcaatgtgttaaataaattcctgttgaaaagtaacggcatgcactgtgtgttaacataatttattagaacaattagaacccatccttgttgtcttttaattagattattccctgttctggtaattacactagacaagggagaataatagtcttgggattctaaaatcatctgtagactatgtggaaagagaataaataatcaataatgctaatgtaccggaaaacttaaattcccagaaagagatcttttatcatgagcaatcctttgtataaacagcattatttctcaatgtctatgcttatcttgcccaaagttgaaaagtgaagacactggacaaataacagatatttattttactgtcagaaacctggttgggctgggccacctctggcctctagtggctcagacattgcttcagtcccttgcaaaatgccaacaagaaaccgcaaatgaaggatttaaaattccatgcagagcagcatatctagcagtctgaatgcctaagggaaaggatgcagggcttttaagttctggtcctaggtgaggaatcataaagttcctcaatttaaaaaaatatatacaaatggacaaaaatgtcttagaactgagaaggctactaaatattaaaaaaaaatttctgatatttccatacatgaagatgttatttgcagaaattaataggcaggctgtatgtcaggaaagtttctggctctcagggatgggctgaggcctttagatgtgaatcgaactacatctctggttttatgtttggaagaccacagggaattccagtgctccaaggacgctccgagggcctacacaactgtcatcaagcatgttaggacatcctagagagtagttcccaaaacttctaggcttcagaatcttgacaaagtcatgggtgggcatatcctgccctcacggataaccctacagttgagtagaaggatgctggaatgcacagaattgacaccagtgaatctggagttctctgtagtaatgagcaacacaaatatctcaccaacagtcccactgttatccgagtctgccttagtcaatgtaaactcctaatgagaccatgtctagacagtattgatctcccaccagaaaaaaaaaaagaactcagagtgtgacttcttttctagcttagcccaaatgacaccctaaaacatgctctttcattcactcattgctaacacttttcataacctgagatattttatcaactaggcagccaaggacccataggcttcttcgcaaggtatatgtgatattttttatatttaaaacatctttgatattcaaatagcagataagaaagttacttaagcttattaaagaacctagagaaattaaatgagtgtatatatatatatatatatatatatatatatatattttttttttttttttttttttttttttcccttgctaggcaaaggagacaggcctttaaaaaatgaaagtccacataagattaaggtgtgatcattcaagttaatgtgggcaagatatctaaaggagaaatcattagcttaagctatccaaaggattttacacacagtcctgtggtttaggagcagaggatcacccgtactactgtgctatccatcccagctgggaagacatggttctttatagaagtaccccttaaaattgtcaggggtgctattaagtacttagggttccccactattcttatctccagactggtcaaatctaccaggcatctttctgatatatcagatagatacaatctatcatagatataccaaagatttatttgcatctgagtgtcctgtggtgaggcattccacagcaggctgtgcatcaggtctgtctgcagaaagtaagaaagaaaggaatacagtttaaaattcacgtaggaatggagtttaaaaactccccaggcaatgtgaaggtgagttaggactgggaaccacaagctaaaaaggagaaccacagagaattctttctgactttggggctgaaatgaagctgaccgaggcattcaggtggttccagaggctggaaagtctcatacgacaggtttttttctcacaaaagagaagtgaaataagtaccttattatgttccaacaatatcaagatacaaatctatcttttagaaaaatgctaaataaaaacacagtcagagagagacttccaccactataaatagtttcttataaatgccacctagagacaaaattatcatttctatgatcctaaccaaaagagccttgcatgtcttggaaatactttgccctctaaagcaaccagaagaacattccttcagtctatgtgttcttgtgctggattttgaaacttttgagcatttgctcccaaagtgaaatttaaaaggctaacagcagggacacctggataactagaaaacttacctattgatatcacaggctgcttctccaaatggactgtatataatttcttgcaagcatagtaaaaatcctatacttgcttgaaatgaaatgaaggaaagcctatcatgaatttctttttctctgtgttaatgaaagacacgagcacaccatgataagcaggagagaatgacctagtgttcatccttctcttcttgtccaacgcaggtaactataggtgggctctgggtagagtatatgattgctgcatatttctaagaaataaagttaatttacaggctacctcaatcctgacactctaggggtaaggcaagcatgcatgtatgtatttctggtaatcaagagggagaaatagcagtgaaaaatagagcttggatatatatcttaaagacatgccactgatttcaaaatagggcaagagcacttatgatttaatataattttgttggaaaaagttaactctctccaaggaaatacagagcttagcaaataccttataaataatacaaaggcatactatagtgtttagtagaatcttattcacccattctgatttggacaaatgttaaatgagacaaacaggagaaaagtttattgattaggtaaccgattaaaattttggtgaaaagcagaagtagtaagttccagaaacaagaaataaatcatgtatatcaacaagaggaatgaaggcattttgtgcaatcctggggaatagattttcttaggtatttcataaaatcattgactctagggcaggaaaaaaccctacacacataaacccacagcattctttttcctgcctccacagttgtaaaggcccgatgataaaacctgtttcctaagacttccccagaatgtgattcaacacattttctatttttttaaaaaaaaatttctgccacttaatttcatgtgataattttccccaatgactaaccaaatatgcttcactattatataaatcaattctttcttaatgccacaagtgaaagtgcaaaggtagctaatggttttcttctcataaaaatcacactttggctttttcctttcatatgtaattaatcatatttgtgacaatcttccaaacttacttgaaatttttctgaatccctttcaaatcaggacaagaactagaaatgtctatacaggtttaatatgaagtaaagaaaatgtttttcattttcttgatttatttctgaattcagcttgctcttcattagcgctacatagctgmcttattattcgtggtcccctatgaccccctgatcattttccctgagggtgcatatttattcactaactatgttacaatcatgtgatctgctggattttttctgatagtctactctagatttgttctaaattaataaatcccattatttttggcttctactacttctatttattaaattcattctgaatatgaagtttattttcaaaggaattcataattctttactccrrgcttggttctaacaatgaatttaataagaattgtatttaatcaatgtttaaatatattaagggcaaattttgtaaaaatgttagtgttccaagctttccatttccccacaaattaatttttttagcctttccccttaatccactttcttaaaaaataaaattttttttgtgatgcagaattatgtgaacaataagaaaaaaataattagaaaggtaggagtaaactaaaaacaaacaaacaaacaaaaaaaaaaaccaaaaaactaaggctgcagacttaatagaactaccatagctacttaagggtaaatgattaagagagagacaacgtctggcttctgagcagagcacagagagaaagatcaccaggaagaaaaaagataacagggaattttaaggacagttgccatgtgtaatgcataaaatagttttcaaaattcttggagaggtaaaaataaaatttagatttattttttaattatttcacttgcgatgctatcttaagattgaaccacatggggccccagaatttatttaggttatacaaatatcctccaattctgatgctgattatttcatatgcagacttcagttacctttacatgtcataaacacacataccccagaaataaacttgatcatcccataaattttcaagagctctcagcctgctgtaaatgaaatttcaccattaactcacaggtcgatgtctgggacaacctcaaagactgcttgagtaattaataaatttatatgaaaacattggagtgaaaatgtctgtcagtgtcaaatacataagaggtaatggctgatacatagtaatgcagttttaaaccattggcaacatatctaaacaaaggtatcagagaaaaataaaagaaaaccttgtaacttgtatgataagcctcttgcataagattattaagaaagtcataagcacttacggctttattccttttctatatagatagattgcccagaaaaacgtggactgaacctcagctggaatctgagggctctgcttgtctttaacagcttagctacattgttagagagcaacactacataatacagcatgccctattcttaaggcaatacataaaattttaaaacctgaagctaaattaaaaggttatcacccttctgcctaatgtattatatatttgtaaatgatatctgtctctaaaaaagatgtaccacaaagcaagagcatatgtgaaacaataagagagaatgtaggagttagaaacacatttaggtatgtaggaaacacaaacttcaagacattcccaaggatctaaataacctatacacaaatatagcaaagtcatatcctaagggagaggatttgagttctaaagccggagcctaaggtaaatgttgcatatagtcaaacttaccattgaagatcactttaatcacctgtagggtgcaagttacattgctttgtgtattcaagactgacagtgaatatttgagaaaatcagttgagttagaataaagaaggaagcaaagaaaagtccacctacagatattagggtattcaaacaacctcttctttaagaaactagcaaatctccacctctgagtttttatcaggtaggtgatgaagtgcaaagctgtaaaccctccaacagggcttattccactgttttaatattcacatttcataacttggacatatgcattaatggatgtatttgtcattgttaagattaagtaacataatctttctttttttttttctttgagatggagtcttgctctgtcgcccagcctggagtgcagtggcatgatctcagctcactgcaacctccgcctcccaggttcaagcaattctcctgcctcaggctcccgagtagctgggattacaggtatgcaccacaaagcccagctaatttttgtatttttagtagaaacaaggtttcaccatattggccaggctggtcttgaactcctgacctcaggtgatccacccaccttggcctcccaaagtgccaggattaaaggcatgagccaatgagcctggctgataaccttatttcataagcaaaagcatcatccacagggtctggtccagagcagatactcaatagggtgctacattttaatctaactcttgtttcatcagacccacaaacacattgctctttaaaatcctgtagagaagaatatgacaacctgcaccttttctttccaagatggcatttccagttagggtacctctgaacagctgttgcttgcacattttaggcatggtgaagatctacacctgatgctgggttcctaagtgggcatatggtgaatccactgcacacagaagcacttctttatgcttggatcacattgcagaagattggacccctgactggggctacctttcccaagccttaacagcacatcaggctcaaatcacagggctatcaaatgaggagatccccttttccaaaaaaagcatccctatcaactctcccaggaaagcacatgaactcatgttatccattcattcttatcttggaaaatacacccacaagccccttttactgccacttacagtaggatgccacaaaaattcagaaactggaatccttttccgtcccttctcctttccttcctccctttcttcttttcttcttccttaccttgaaatttctgcctgtggtaaaaccacaggaagaaggaaagtcaaatgaattttcctattagtcgacatttctgtgatacactcattttttttggtccccgtatgaactccctccagggtatttctttatgggaataaagtatgccaaatgaaataaagaacttgaagcacaattttatccttgacatatgtagagagaatatgttactcctgaatttatggtgcaatgcaactcagtcacttccttttcctctttcccctagtttgcacttcctacttattgctgcataccatcacaaatttatggagtgccaatggctgtggcctctaggcagctcccaaatgactgaatccagacatcattgtcttcagttcccctttggcattagtctattttccatccctcttcctttattgaaatctgcttccaattatttttcataagatggtttagctttcttttatttcctttaagttgaaactcttttatttctacctttcatttctatgccctcctgggccttaagcacagttcttctacatttacaggggttttcatttagaaactattgagaactttactatcaaattgtactttttaagataatttttttgcaattttaactaaaaggagatttttagacttttggaaagtcatggctccaggtctcagatctcagctgtaggttttatcactttgcaagatgatgactagagttacagcacattctttcaacccatgcccaaaacttcaaagatggccacccttcaacccctgaagatttcaactcagtgttttcagaaaattggaggtccaggctttggagtcagacagatatgggttcaaatccagcctctggcacttaatttgaatacaacctagagtaagtcatttaactttcctgagctttgatttccttatctgaaaaataagaatatagatacttacctcaccatattgttataaagatgaaatgaggtaatctttgtaaaatatacacaatgtctagcaggtggtaagcattcaaactggtagctattttttattgttatgagttaaaattttgtatataatggattttttttccaagaaagctcatcaagctgaccttaagtagatgttactcccaaataccacccaattccatgtctacatacttgagaagttactaaacactttaaaattgaaattgaaaactagggacaaacatagatttgaaaccaaaggaataggtaatcagttataaatttggatataacattatgagcctctatttcagaaaatacattccttttaaagtatatttactatagttatccatgcagactgaatatttttatcaatagttgcaaaaccatttcctgaaagggaaaaccatgtaattataactagattttcacatgttaaccttttatataagggaagaacaagaagtagatatttgctaagagactgggaagaaagggaagagaagggagagagggagagacagagagaatgagaatgaaagcaaagaaatttgacaaggaatactatttggcttttggcccttccgtgtaccaacgtagatgtgtgattataccatttaggattgttgtcaattctttccataggaacagactgaacaatgagacatctacctctcaacccaaagagaataaaattgtcatttccctacaggacttttgttaatacaaaaatgaaatatatatatatatatatatataaaattattatgatttcaaaaataaagccaaatatctaaatgaaaccatgaaaataattagctccgatccaacagagtaagtgaggtttttactttggaagataagtaaattctttcagagcatgagaatgaaaaattgattgattccgatctgatctctaaaaagagcagtctgatttactttggtatcaaacagacctgcttctaaatgccatttctgccatttacctgttgggcaaatttcttacctatgcacttggagtcttcacccttaaaataggtatgaaaataggtagaaaataggcttgccatgctttctctctctctccctatatcccatgtctctccaaggagcaattcctaatgtaattgatcaaattcaagcatatggagtcttatttactaagtggcatggtcactatacaataaacgtgacttcccccacttctacttcttctcttctaagttgaaaaaactctaatctctcaggtcaggctaactatttccttccctctttcctgccttctttctaatttgaggcaatagcatccatgagcccaggcgatgtcagggattcttgtttttatctcaacactttcattcttccccatcccctcacaggcccccattcagaattcttaagcatgctatttgcttgagggggcatttaggaagtcccatttaagacctctgccagctctaatcttatctcttcagagaggccttcgctgactatccaatctaaagtacctacctttatcagtgttctacactggaaggtattgggcacaggtgcaactaataataaagtgggtggtactttgttgccatttccatgttagggcctttgtgtctgcacttctctctctctctctctctctctctctctctctctctctctctcatgctctgcatctttaaatcactaaggtctcagctctaatgttatctcttcagagaggccttccctgactatccagtctaaagcagactcctcattcccaccaactcactccattacattaatcttttattttgttaatagctctcattgcatcccattactttcttctttatttgcttgttgcccatccctacctccttcccaaacacacttattaaaacaccatgaagacaaaaaggtattgtgctcaccacttgtttatccagagccaggtgcctgtccaaagtagatgcacacctgccatgtcctatggccaaccaggtccaatgaattcctttataaagctcctctcctcagctgacccagaacaccagctgctatactgaaggctttcacactttcagatgaggtgtctttatcttataaatttcttttctctaagcagaatttatataacctactcattactttgaatagcatcttattcagtataccttattggtatttttcagtaaaccctggtataaggcacacagctaagtgaatgtccccacatacctataagagagtggctagatgcctttcttacccacagggatggtttcaaagaaaccttttacactcactcccatatacacacatacacaaaggaaagctcacatttgcattccagatcatctccaggaggagggaggagaaatactcttttaaaagagcaaacctaaaattataatgctcttgaaaacattagtagttaacatttactgttaagaaagccacaatcccagaccaaagatagctgagtggcatcttaaattgaagatagtttttaagtcagagcttagaaagtctcttggaaatctctttaattcccccacagaataaaatatggtacagattctcaggaggtccaatagaggctttcctctagcattagaacagatccttctttgatcaaggatcagatgaagtcattggtgtgaatttactaggcatatattttttcatatataacagaaaatgtcaacactggaatctcactcagcactaagatgctcacactaagaggttcaggaaaatgagaatgactcccagaacccatctcacattttctaagaggcatatattcattgaggggaacgtctaacagaatgacctatattatttacatcagtacttcctactctcacttttttggccaattctgtgtgattaaattggcaaaagttcaatgcacacaaggtgcaactcaattatatttaagatcactcatttatgtcataaagtctttctcaaaaaacaaaagatgccagccccacagaactttatcatgtcacatagaccccattaatgcagtctatcaacaatatagacagattattatattcagggaagttccctcaagaattgccttacaagttcaatttaaaaaatcaaaataaaacaagccagtactgagtctttctatggtatagttaaacttgtaatattttatacatattttttgaaagtagccttgatataaatcctgaaaaaagaaaaaaagcaaagtccacatttctataagtgtcacgatgataaattttatgtatcaacttgactgggccatgaggtgcccagatatttggtcgaactttattccgagtatggctgtgagggtgctttggacacacttttaatatttaaatcaacagatgcagtaaagcaattgccctccctaatgtgtgtggacttcatccaatcagctgaaggcttgattaggacaaaaaaaagctgaccctcatgcaagaaagaggaaactcctcttacctgatagtcttcagctgggacactgattgtgtcctgcctttggactctaactgaaacactggctcttcctgggtctcaagcctgttgatcattggacagaaactacaccattgggtctcctgggtccctagcttgccaatgccagatctggggacttgccagcctccatagtcacaagagccaacttctcataataaatctctttctatacatatggatacacacatcctactgattctgtttctctggagaaccctgactaatacaaatattaaacccaaataaaaacccaaatgcaagtattaaacccaaacccaaatccaaagatgaacaactttcttcatcagtctggcacctaactgcatgtctctttatgaagtatgtaatattttttcatgagctgccatatgtcattccatcactcgctctagaactcttttaggcacttaaaactttgtatattatattaaaatttaatgtatcaagaaaggatatagtgagaataaactgaaaagagtagttactaatgccaaatataaggcagtcttgaaaaaaagaaatattcctctgtaatctcagtactttgggaggccaaagtgggaaggctgcttgaaaccaggagtttgagacaagcctaagcagcatagtgagaccctatcccctaaaaatcaagattttttcaaaaaaagaaatattccattttttcagtaaaaatattaaacaaatttcaaaaggcagaatggacagcttatacatataaacatatagggatatgaaacacatagttaaatatctacctatactttttatttcattaatttaattggatacttaaaaacatgtactttactcaaattcttatgtgagcatctcaacacatggtttattcaaattctgatgtgagcatctccaccatataagagcctcctttttagccctccaactgagttttccagagttttccacaaaactccaactgagttttcttcccttggttcaaaacaggacactccttgaatcatgtatgatggtgtttctgaaagttgtctctgaaggcacaagtacctatttatataatattagcagctttttcttctaaataaaaatatttctttgaacaggtatatattttgatgtctatgatgtatttgtctcttgtattgctttttaaatagacttttcaaaatcgctgtttggaacaacatccaacagttggaattgtgaagtcatagcccctggaatcatgactaactgtgttcaatttccctgctcctcttttatggatcctagcagatgaccttcacgagcacccaaaacaaaccttgggtgaagccacttcagcccactgtgacttcctaaagcagtatttgaaaggacccaaatataaagcaaggtcgtctcttctgagggataataaattcagggggaagcaaacctcacctttgtatttgaggatatctggtgtattttagtgcaattctgcctttaagataaagtgccagctgacttaatggcagttgtgatctctgcttcatttcatcttttatctaatgatccgctagttagtaaacctgcaaatcctgaaagaaacataagtactctttttctttgcagtgtaatcaccaacaataaagctttatttttttgcattaacattcaactgcaatgtatttaaatgttccacatacacaaaaacacctgatttttcccaagatttgttaaacatagtccctttggtgtccttagtaacactgcaaagatgtcttcatgtaaaacttaatttgagtcctgattaccttactgtgaaaaaccgtaaacaccaaacaaaagtaagcataatatccaaatgcctaaaacataatacccaggttgaaggaagtgtaaatgttcagattcaccagtgggactagaatgtaaacttcttgggttgtggttcctccaaatcatctggccacctgggtatcatatcccacaagcatatggtaacactgatagagtaagctcaaagtgttccaacaccaggacatttcatggccacatcagaccaattgtatttttcacttcctctctttccctaacttttctcatacaaagcttcctacatttcctttggcacttagtaatacttaaatgcatcttcactgtcttattcagtgtttttagctttggaaggtgtatcacttgggattgctttcagatgcattaattgcaatctagctaaccaacagcccaacagtgatttaaacacagaaagctttcttttccggatatgcatgtgtgcatattttgttttgtttttcatgcaacaagatgtctgaaggtataatctgacactgagctggtatctcatggtgtcatgaatgccccagcctacttctattttttttttttttttcctctgctgtccttcagtgaggctttcactttcattgtcatagacggctgctggatctccaagtttgacacattctccctaggcaagaagagggggaaaggcaaaggggaaagaggatgccagccaagtcagtctctttctaaaagctttccagaaagttccatccagtgacttccacatacatctgcccagccacaaatgggtcatacagtctttcctaactgtaagagagtgtgggaagctggatatgagctgagcattgctgctccaaacaaaatcagatttctgttaggaaagaatggatgtaaagtggatcttaggaagggaacaaccaatgcctaccatacacaagtatttgtggtgagcagacatggctaagtgcctcttcctatctagggaggttcagggaattactcaagatctcttttgtgccagggaactagggagtcagtcatctcatttgctttcatttcctcatctctgaaatttcctactatggtattcctcttagaacaccatttagaagtgttatggttttctgttcttaatccaaatgtgacaaaatgtattctccttcttctctgataacaaaacccaaattctgacgggcagcatgtgcttagccttagataatgaataatgactggtctaacccaatcatggcgatactatgttcttttgccattgattggtattcagtagtaggcatgtgacctagatctaaccaatgagtggacatacactggggggactcatgaaagatttttcacctttggtaaaaagtcatagttgcaagaggagaaagccttttcttcatatgcctcttctttcctgttttagatgctgtcatgttaacgctttgtgcttagagctgtagaagccgtcttgtgaccatgaggcaatagccaaaagaggaaagagcctgagtatgaaagacactgggtcctttatgatattactgagttgccaaactaaccctgggatcctctacctcctgttttctcatagtaataaatatccctgtgatttcagcactatcactttaattttctgttacaggcagctgaaagcattcagaactcacatactatcttaacatcatcttccatgtgttatgggccaagagtatattcaagagtgactacaaaactacattcattgtcgtatccctgtgggactcccttaaagttctagtgttctgtagtgtactttccacagcctagaaggatatatgtttccctctctccagccctaaggaactcttaatttaagactgacaagatgaatgagttacaatgagggtgaatccaattcaaaagacgtaacaacaagcaagaaaagcaaagaaccttgtaaacacccatgttatggagtgtgagagtgtaagcttaaggaggcttttattttggggagaagatgcatcacctctgtttgaatgagagaaattaagttgtaattatgatggtgtttcagttaaattatttgatgtggaagacaaggagaccattcccaacatgttatttagcaaagaatatggaggagaggcagaagactgtgatggaaaacgttcagaggccatcaaccaaaatggtaatgcattcgaggcagataaagttgcttcttgctagacagaggtggggtgagccctgacatacgtcttcaaaattgcaaaaggcacagatctgggggggaaagggggttgattcaccaaatctcagaatagcagaatggcaataaccctactccaaggcttccagttttcctcagtttaactccttttgcatactgcagccaaagagattttttttaaaatgaagatcactcagactgtgtcctcttcctcttaatctccccaaaggaagaaaaaaacaatgatcaatggcaaatggcagttgcaatgaagcaacaccaagaacgagcttcgtgctcgggagagaacattgcatatcttcctgtggtttccagtgctctacacacttggggaaactcctttaagtaatgaaccacagaaatgacccctggaaatataatcttcaaagtgatcttttaaagatccaaatatttcctgttcccactctgcccagagatcttcagtggctcactactgcttccatgataagatcctaaaaccttgtcacaatccacaaggccttcattgtccatccctgcctgcctcactgtctttatctcccaccacactctgccttctctatgctcccacctgacaacttcttcagtgcgtggaccctattgtactctctcaggcctcaaaaccatgtaacatcctggacttcctcttcactggtctaatgcctactcatacttggcttctgagattgtacttcactccacatggagattatccacaaccatgccccactccaaaaccaggttaccttcccaatgtgatatacttgccatagcactcagcttccttttttataatactcatcacacttgtgattgattgactctcttctcctttacattgtaagatccataaaggcaaggatcatgtctgtctctttctgatgtgtaacaagcctgaacatacatacaataaatggccaggtgtaatttaccattgtgtggatgccatcttgggaggggggattctaatagttcaagggcatgtatgaaaaacagactcatggtaaaataataagaatagaaaaaagttactcagagtggtttaatggctggggtataccttttactattttacttagacatcaaaggaaaatcagtgtcctccctatcatgttccatgattttgtacaactgagtttagagcacaagctaaggtatcagacagcatttgacagcccagcttcactacttatcagctgtgtgaggtgatataatccctctaatccctataaaccttagtttcctcatctttaaaatggggataatgacaaaagcttttcaataagggtttgtgaggattaaattagataatacatggaaagctttcatcccagtgcttgccacagagttagcatgcaataaatgttataaagagttctttattgttctgcccatcaacatctgagacagaatataaacacaactgctcctgggcctggtggctcatgcctgtaatcccaactttgggatgccaaagtgggaggatcacttcaggccaggagttcaagaccagcctgggcaacaaagcaagactccatctctacaaaaaatgaaaaaataggtggatatggtgatgtatgcctgtagttctagttacttgggaggctgaggcaggaggatcaactgagcccaggagttcaaggctgcagtgagccataatcatgcctctacactccagcctgggctttttaagattccatctcttaaaaggaaaaataaatcaactggatcactagcctataagagcttaacaattgttaggtagtattactatgggtgttattgttttgttatttgtggcaaaaagtactagtgctcacctgagcacatgacttccttatgatcaggtaggtccatgtttgtcttggtcactactccagcccagtgcctagcacagtgcttgacacatggtgtgtatgcaatgaacacttaatgagtacttaaagatctaaccagtatgatagtgcagattctcttgtaagcaaatgaatagagaaaggcagtattccacagagaaggagacaggaaaaaagaacaggcttgattttactaaaaagaaaaacacacttttaagcagtaaaattagaagttcccatttcaatggcacaaaatagagaactcactgagaattgtgtgctataacatggtcaaagcagaggccgataatgaagggagcagcattcagaaccatcacatgtatggtcagctttcagaccctgaaaactcgattaaaacattccaggaaaccgctgcactttcattctaaaggaagattgtgaactctgttcacatattacaccccttcatattgctttgtctaccagtgtggccttttatgaagtgagggcttctttcttctaccttgctccatgacaatcaaacccaaaatgccttccacccttaaaaggaagttttggtaagtgccttattataactatcacatatgacacaaggctcaccactaatcggagacagatgagaatgaattacttaaataggacagaaatagccattcacttcaagaaggtcccagtttcttgaaagtctgtggcattgagaccatttacagtttgctgtcaagattcctagcagtgctcattaccttggctagcaatccctctggactacagaaaacttatctgaaatatatataatcacaggctgcaatgcctaagtgcaacaggatgatttaaaaagcaccatgatagtgttcccccaggacattcatctctccctgtctattcatctttgatccagacaaaaacttggaatgcaatctgtatattgatattccctaaaaaggatttcaccagctctttaggaagaattgttttagcggctctggaagtctagaacattctgcatttgtggtatttacagcttttgtttctatttcataaaaataaagccccactaagagcagtattcaattcctatcccaataggagtatcgaatagtggttaagcacatgttttttggaacgaagcagacctgtgttcatctctgggctcctcatagacctcttcataaacttaggcaaggtattcaacctttttgagtctcagctatatcaggtaaattactatgcgtgcacagaagagcttaataaatgttagatgttaatggtattaatattgttttgctgctgttttcagtttttctagcagagattattagtattcacccatgtgcacaggtagaccgcatttccacccatgcacacaggtagaccgcatttccaagcttcagtggagttacgtgggtccaaatgactgagttccgatcaatggaatgtggcagaagtgatgtacaccctttcctggatgggcctacagaaatcctctagactctactcctcactctccttttcccttctcaggcaccctgaaggctacttgttaaagaatttagagctacaggatggaaagaacctggatcctacctaagaacctcctaggagagccacccttcagaaacatttgcagtggattctgaatacgatttttttttttttttttttttttttttttttttttttttgccgagcacggtggctcatgcctgtaatcccagccctttgggaagctgaggtgggtggatcacttgaggtcaggagctcaagaccagcctggccaacatggtgaaaccctgtctctactaaaactacaaaaattagccaggtgtggtggcacgtgcctgtaatcccagctactggggagactgaggtaggagaattgcttgaacctgggaggcggaggttccagtgagccgagattgtgccattgcactccagcctggtgaagaagtgggactacatctcaaaaaaacaaaaagatacatatatatgatatatctgatatatgatatatatatgatatatctgatatatgatatataaatgatatatctgatatatatacatatggtatatatgatatacatcatatgtatatatggtatacatgagatacatcatatgtatatatggtatacatgagatacatcatatgtatatatggtatacatgagatacatcatatgtatacatgagatacatcatatgtatacatgagatacatcatatgtatacatgagatacatcatatgtatacatgagatacatcatatgtatacatgacatacatcatatgtatacatgacatacatcatatgtatatatgacatacatcatatgtatatatgatacatatatatcatgtatatatgatacatatgtacatatatatgtatatatgatacatatgtatcatatatatcaggtatatatgatacatatgtatcatatatatcaggtatatatgatacatatgtatcatatatcaggtatatatgatacatatgtatcatatatcaggtatatatgatacatatgtacatatatatcaggtatatatgatacatatgtacatatatcaggtatatatgtacatatgtacatatatatcaggtatatatgtacatatgtacatatatatcaggtatatatgtacatatgttcatatatatcaggtatatatgatacatatgtatcatatatcaggtatatatgatacatatgtacatatatatcaggtatatatgatacatatgtacatatatcaggtatatatgaacatatgtacatatatatcatgtatatatgaacatatatacgtatatatcatgtatatatgatacatatatacgtatatatcatgtatatatgatacatatatacgtatatatcatgtatatatgatacatatatacgtatatatccatatatatgatacatatatacgtatatcatgtatatatgacgtacgtcatatatatcatgtgtatatatgatgtacgtcatatatatcagatatcatatatacacatatatcctatatgtgtatatatgatatatgtatatatgatctatatacatatatatcatatgttctatgatatatatgatatatatcatatatgatatatatgatatatatgatatatatgatatatcatatcatatatgatacatatgatatatcatatcatatatctttcttttttttttcagttaagctactgggttttgacgaagctcattacagcagttagcctacttcagggtttctcagcctgggcactactgatattttggactacagaattctttgttatggagggctgtcctatgcattgtagggtgttgagcagcatccctggcctctatcctgctagatgccagtagtaacctctccagtagccatgacaaccaaaaatgtctcctgacattgccaaatgtcacctgcaaaatcgcctccgattgagaaccagcagcccacactggccaaaacatcaccatcattgctatcatcatcatcataggatattgatagtctagtctctcatgttccccttgaaatcactgcaaaaggactcaaagttccaaaagaggtccagcccagtttttttaggagaaaaaagtgaaatgacactaaaatttaagaaaaggtaagggatcaagcagtaaactcaaagttataggagaccaaaaaacaaagtaagaaccaaaataaatataatccttttttaaaaaagctagtttgtgtagtcccagctactagggaggctgaggcaggagaatggcgtgaacccgtgaggtggagcttgcagtgagctgagatcgcgccactgcactgggcaacagaccaagactcggtctcaaaaaaaaaaaaaaaaaggccggtttgatcactttggtaacctagaataaaatgattaaaacaaaaacaaacccaaatatctgggtctaggaatttcaatgtgtctaacaaatgcttatagaatatctaccatgagataagcattgggctgaatataacttggtaaataaaacagatataatccctgccctcatagagatgaaaggtaaataaaaatatggagttttttgtttttgtttttgtttttgttttttaagacagtgtcttgttctattgcccaggctggagtgcggcagtgagatcatagttcactgcagccttgaactcctgggctcaagtgatcatccgtactagctaggactataggtttgcaccaccatgcccagctaatttttgtattttttttatagagacgcggtctcactttgttgcccaggctggtctcaaactcctggcctcaaggaattctcttgcctaggcctcccaaagtgcttgggattacagtcatgggccattgcacccagccaaaatatgatggatttttcaaacagcttaaacacagtcatgaattgaccactgcaataggcagacttctaaagatgtccctgcaggattcccatccctgggccgggcatggtggctcacgcctgtaataccagcactttgggaggctgaggcaggtgggtcacttgaggtcagaagttgaagaccagcctggccaatatggtgaaaccccctgtctctactaaaaatacaaaacttagccaggcatggtggtgagtgcctgtaatcccagctacttgggaggctaaggcagcagaattgcttgaacccgggaggcagaggttgcagtgagccaagactgcaccattgcactccagcttgggcgacagagtgaaactccctctcaaaaaaaaaaaaaaaaagattcctgtccctggttatccaattaaacactagattaggtgctgccatgaagagacttagcagatgtatcaaggttactagtcaaccgactttaacataggaaggttatcttgaattatctgggtatgcctaccctagtcacatgaggttgtaaaaacataagtggaaggtggaagaatcagtcagagtgagaaagcagaagaggatgcaggagctatgctgcagagggaaagtcagattccaaacacaagaaagaaaaagataagatgaatcattgatggttctaaaatgtaggaggctctgtgtgaggaccagaaagaggcctgagggagctaagggtggagccctgcctaacagacataaagaaaatagggacttcagtcctacaaccacaaagaaccaaattctgtcaataacctgaacgagtttggaagttggtttttctgcagtctccagtaagaaacacagcgctgctgatacctcgattttagcccagtgagacatgtattgggcttctgactgccagataataaatgtgtgttgttttaagtcactaaattcatcatagtttgttatgacagtaatagaagactaataaaccattatgcattaaatatcacagaaaagaaagggtttaagaaaataggtattaaagtatgccttatcaccttatcattcatcaatctgaggtttactaaacacttgatgggtgctcattagtggaataaattaatgcactcatattttcattcatttgttaaaaatatgcatacagtgcctcctctttgatggtccctgggtgaggtattgaggttacagtagtgaaataggtattatcctctgtttataacagctcataatggaagtggaggacagaaacatgtacattcaacaataatgcaaagaacataataaagatattaacatcatcattataaaactatcagtaaaagtgtgaataagggagtacagaataataattacagctgacatctattgagtacttgtctcatttcccttcacaacaagcctatgagactgtattagtccattttcatactgctatgaagaaatacccgagatgggataatttataaagaaaaagaagtttaatggactcacagttccacatggctgagaagacctcataatcatggcagaaggtgaaggaggagcaaaggtacatctcatatggtggcaggcaagagagcatgtgaagaagaattgccctttataaaaccatcagatctcatgagacttaatcacgagaacagcatgggaaaaacctgcccccatgattcaattacctcctacccactgggtccctcccatgacatgtggggattatggtaggtacaattcaagatgagatttgggtggggacacagccaaaccatagcagagacagacccatgattcataccatcttgcagattaagaagctgaggtacaggcaggtgaagaaaccagcctaaagttactatcggtaagtggtggagctggaattttaacacaggaggtccaactttagagcccatggttttaaacacttcattgtgctgtctctcattgcagaagggtgaggaggcctcacagaagggctgagatttgggatgaataccttcatcaagaaaaggaggagccagtagaagaaactgcattggtaaagccagagattcaggaagaaggtggatggtgtggcatattctggaacagggctctgtattggcaaggaggggtggcagatgaggttggagcctaagttgtcctgacttgaaagacttgaacctctcagcagtttgaatttcgttctaaagctatcaaaagaacctattcaagagcatgatacggtaaatcatcttcagcaactcacatatcatttttaacattgtttcaggggatattagtggacactcttaggaacgcagtgtatagcccacaagtataatgacacttattaatacaacttagaaaacaccctttgaaaatgcatcaaaaccctaaaagattcgattaactctatggaaatgaggataaagggtagatgcatgtaagaatccagctgtcttctatctacaaagctcttcatatccacaaccacagagacactgctcagcttctgaatcgccttagttcacaataaaatagaaataaatcataataaaataaaatagggaataaatctatctgttggctttgagaaaatttctcagtagcaacaaaccaactgctcaaatcagaatcccccaaaataaataaataaggtacctaagagggaatgcatgtgttgaccaaaaaactaaaaaattctcccatttctgtctgacgttgaaaaaaatcataggtatttggcattttagcctatgctgttgaatgtggtagccactaattatatgtggctatttaaatttaaataaggtaaaattaaataaaatttattttctcagtcccattagccccatttcaagtcctcaacagccatatgaggccactggccactgtactggtcagcacatgtatcagacatgtccattgttgcaggaatatctgttgggaaaaaaatgaactacttatttagataaaagtagtgatttgttagacatgcctaataaaattcagtttattttaagattatgtaattaaattcagacttacttataagagtctgaattttcattttaatcgtttgtatgtatttcattcctcttagtatgaagagagtctatatcaagagactctctatggagacaggagccagtttgtattaggccccagctctgtcttgggctctgtgctaggcatttcatatctgttatgctacttaaggctcatgactccctgtgagataggcatgcttattctcatttttccctaaatggggggctgtgacaaggctgaagcaaagagagggcacaacatcttttcagggttaacacttgagaaacatctatttcttcttaagtagctctactgctgcttagagaagtagagtatgtagacaagacagttaaattttccacagatggggtttacttagagggagataagatttcttttgcacacaattgtagatttttttttaaatggtcaaaatcctcctgttctagcagtagctaagaagtgactcggggaagcattcaacaagtaggaaagaagtctgctcagatggaggccctgaatcagagatgcctgtcatctgttcccaaaggctccaaactcctgccacaaatacactgagggttcctctctctataacttcttctctttattttctctggaaggaatgtacttgatacttatttttaatctgagtctccttccacaaaaagtgtagaggatgtgctacccagcccctaaagttttgcctcttggtattcacacttgtgaagtcattttccatgtggaagagggctgacctgtgtaagcaataagatgctgcagaaatgtatgacttctgtggctaggttagaagagccatgagtccttaaagctttcccccttttctctctcttgagtggctgtctctggaggaagccagtcaccattctatgaagttactcaagcagccagtggagaggcccacatggggaggaactgaggcctcccaccaatactctccatcaagctgccaggcatgtggtaccttagaagtggatcttacagccccagtcaagccttcagatgactatagagccagaaccactctactaagcctgtcccaaattcctaactcaccaaaataacatgagatagtaaatgtttactgcagttttaagcagttgagttttggcataatttgttatgcagcaataggtacctaacccagagggtttttccagctttgcctatgggcaagtctacagatgaaacaagctgcttttcatatttagtgctctctctcacaattatcaggagatataattatcttaccatccaggctgtgattcttgcacacaagcaccaagtcatccattattgcagtctcccttcccatgcttgatgaataactgggttcctgtgatttttcctcttttctttccccattgactgttgaaattgtttgcctcaactattgagtcccttctcttcagtttgcctccttttcttttcctcctacatgagcagaagccaggaaattgaatgtattcgatcacaaagtatgcatgaccctcagcaacatgagcctacaatagtctttttaatgaccagaggaaggttgtgaggactcttagttaatttgttatgaacacccactcccataaggaagctgctatgtatttgtggaataaattaaataaaatcagcaaatttgcttattatctatttcctgccctttgaacacaggtttacccataaactacatttgttacacactaactgaatatggaaagcactatgggtaatgcaaaaaatatagcttgtctgttttcagtgtactcataagcaaatataggagacatcacaaagatgcaaatatgtattcatattcacatacatgcttaagtagacatttacatatcaaagacagtgaaggctaagggccaaatgaatggtacacacaagtgttaacagatcttcaaaagaagatgttatggctgtgagctgaattgatcagggcagcctttatgcaggaacaaagtcttcagaaggtttaactatggcagatactattacagatactacttgtttcatccagttctcctttagccccaagcatagagactcctgcacatctcagcctcttatgagtgggcaggatcatgtgactagctctacttagtggggcacgagaaaaagtaacatgtttcatttcttaagtcaaagaaaaaactatgtttaattctccaatctttctcccccaaaagttcacatgctctggggtaactagaggatgttagtggctccctcagcctgggtctatctgaatgactacaataagcagagccccctgacaactttttttgggcatgtaccattagcaagaactaaacctttctttgtgataggccactgtgatctggggactcatttgttactgcagcataacttagtctctcctaactaaaacagagattcccaaagatggagaaaagcagagcacagtagaggtagcttataagtcatgtcttatatgacctttctcaatgacaaacctgtgtgctcaccaagacatagcttgttatgacatatctgaatagaattgaaggtttttaaataaaaacataagaaggttggaaaggcagcagaatgagctactgcctgtgggtgatctttacacatctcagaataacaggattattgatgccttggccagaagcattcctttccctctgttttctttttctttgagattgcaagccatatatttccatttggaaaacagtatttcataacctctaaacctaacatgagtcctgtgaaaccctagtctacagttgaatggccaaaaataaagacttgaaattccttcaaagctatcccattttacaaggcaatgctttctctctctaccaagaaagtgttcctgcttgatagattcccctctcttgctgtatattacacttactgctctcctgtcactccctattctcttcctagttgtttgtgccttattaaattccacattttgaaacaaccaataagaatcagaaagcctgaagaagccctttctcatacaatcagagctccctttttatctaggaataaattatattttccaatcaattcatgagtgggattcattgacaatatactctctttgtaacatatttctgaatgagtagtaaatggtcttcaataaggatatggcgatacattttagctaaactgtttcataccgacattaactcccctgttaacttacttaggagtctaaagacacaatcaaatagctgtttctgactattattctcaaagcgaagctccaggccgtaatctcaggacatgcatgaaaatatcaagtaacaactcaaaggcccatttcagcttcaaatacctttgaaaattcgtgagtttgaggagcagagtgggatagcaggcgagtggaagaggaggcttctgagaaacttaattatctacattttagaatgtttcagtctttggccttttaatactgtagtatagcctggcttctgtcattctgaagggatttcccagcttaacaaaatcccaaggaaccaacctcagattggtctcttacctaaggaaagattctggcaacacaacaggaaggatttggaaaatttaatgaagattttgaaatacccctaacacacttaaattaaagataatacctatttcacccaaatctcctaaccccctgtggaagatcaattctaatttttgaggacaattattcatgtgttattggcttgaagtacagaatgtattagtaagtctcttcagttctaagtaacagaaaccaaatcaggctaggttaaaattgaaggggcatcattagaaggacccaagagtgtctcaaggactcagaggcaaagatgcagccagttccccccagtgccgggaaccagaaggtgggcaggaactcagggaatacagcccccttctatctctgcttctcaattctcatagggaaatatggttgtccacagatctcaggtttacctgtcatagttctagccacatgcaaggaatgactgcatatctctgaattccaaatttcagaaagtgagaccttggggtgggagatggggcacgcttggattcggtgtctaactctaattcaaacaacttttgccacggagccatgtagtagccaaatatgtttctaaggcccaagggaccactcttacaaagatggaagatagttcactaaaaagaagacatgctttctagactccacagccaccccagaagtgccaagataaataatagggagccagagtttaagcaagggccaccatcactgcaagttgtctcatccaacttctccctttataggaattgacatgacttcaaatattcatgtctgacaccaacgaagaggaatgtctgttcttgagctctttttctcggttcccaaggggccctcagtaccctgctttaccatttagtgtggattctgacaaaagaacaaattaagtactttgatttgattcttaatttttccttataaagacttgcaataaatattgtgggtacctagaaataatccaccatagtgcacaacacaatctgttgacttaccttagcttccattttccttcttggtctgacatataaattcaccttgctgctcaattctgtcacctactattttcagcatgtatgagcaacagtaaagtgcatgcccacagaactcagaaatgagaaaactaatattgctctgttatatgcataatggatcaatacagaggtatttaaacacacaaagaaaaaaaaaaacaggtcagcaagacttgactttcaactgatagagaatattaacatgtttatgggtagaaaaagtggtcagttgtagaaaaatatacaaagaaaagctacaaagagatgttggcagtggccatttaagctctgtctagggaaaggaagcctttagttaatggccttcaagtattctaatgtagggacacggcacccctactgtggaaagagatgcaggaggtggaaggtagctaaggccttggagtttcagttccacaggcaaggctatccttatcatgagaactgagcagcatgaagctatctgtagtctgacagtcatattgtatgttgtgtcaaatgaaaacatagcatcactcaattccttttgttctcttctcttgctaaacacacaactatctgatgctctggcttcccatggacctcaggcctgcttagaggatggaatgcaatagtcccactagtctgtgcagtgggccaactgctggttgtaaaatcacaaaggggccttctaggttaccgcgtctcacaaacttgggtaatgtaattccgtcttgaagagagagtcccccatgggtaagaccatggaccatggtaaatgagtgtaccccaggagaactgcttgggaaatagtcacttagcctattctcctggtgatgccccagacattgtcaacatggaccccttggagcatttcctcgttgatgtctacatttgttaccttactcttaattaaattttctaaaaagatggcacaataggagcactgagaacatgatttttaggaagaaaaggaatcccatgtaaacccgtttccatctgtggttcttgcctttctgtccttatccatagggcagctcattcttgcatatctgcagctcttgcatgcctgccattttgtatcttcctttttctcgttatatcagaagcattataataagttacattagaacccgttttgcatattttaacattgccttcacagtgaaactatagagagctttatggtggcactctagtgaatattctgttctgcttctgttacatgactaccttaggaaaagtctccgagaactcctgtctcccatgattatctctcctaatcaggctttctactatcaaactactcagcaaaaggaactcaccaacctatagtgctaccagaagtctaataacataacactgtcaccacaactttttcagcactaaacatgatcatttttaaaaatagtaagtttattaggtatataatgatactttccaagttccagcctgtttataaaggactctgtataaataaggaaggggcccaggaatggtgacatatttaacgtgtaagtcaggatgctaaatgtctgactgtatttgtttatttttttctgaaatggagtcttgctctgtcacttaagctagagtgcaatggcacaatcatggctcaatgtagccttgacctcccatgctcaagtgatcctcccacctcagcctcctgagtagctagaactataggcacacaccaccatacccagattttttattttttgaatgtatttatttatttatttatttattttttgtagagacgaggtcttgctttgttgcccaggttggtcttgaacttctggactcaaatgatcctcctgcctcagtctcccaaaggattgaaattacaagtgtgagccactgtgcccagctcctattatatttttaaaaggaatatactgaggaaaatacaaatggagttcaactgataaaaagaaacctctgtaatatgagcaggtgaatacaatttacaagatcatacttcagtatgaattcagtaggaattgcatgttttgcctgctgtgtgtccctaagggtgacacactcctgaatgggactttagtttgccataagcctgctttgttttgtttgtggtagaaattccatgctatgaggaaatgctttcatttcttttgatatctcatgagcgcttgttgcaaaaaacatttgtaggcaaacagcttcacacatattaaaaacttgtagcagaaagttaattccctaacataagttgtccagctcagggctctataatcctgtaattcattttggttccaataaatacgtactttctgtgagaccctttggggaaagggtaattagatatttcacatcagtgggatatctttccttcttttgctccccctccttctttccttctccttttcttctctttaattcttctacccagaaaaattctcaaggagcaaaaatacattactctctgcatttttataagctggccagttttgcttcctggcttttgaacagaaaattatgcctcaaaaataatcccacattattctctaaattcattttcctcagtcattagcccataacggcaattttccttttgaaaataaagaataatgatcatttattgagacaaatcctcaatcagaatgattcaaagagaatacaaatttaatgatcaccctgagaacccaagtaatacatctcaggaaataataataaaatttatgatggccttaaaattgcttaactcctttcaggaaaccctgaattatagggtagtaacataaccaaggactggcaacaactcacaaaagtctagaagagttttgcctttgagttcatagacaaagatgcttaaattgttccccgttcaaaaaataaagattatttattatttactttcctgtgcaccggacactcctgcaacatgactataactcttgcgttcttagatttgatcttcaaggtctctgaatgatgaaaaaacttgtagggtagcatgccaaccaacttgggttttttgtctgtttttgtttttggaggaggggaacaaggcagggagagagggagagggagagagagagagagagagagagtgagagatcacactaccaggagcttcataaagaaacctgcaatgcagaaccaaagtggatgaaagcaaaaggatacaacttttccctccagatgattttactgggaggaagaaagatttgaaactattgagtgctttttctgataaccacctatggctctctccaaagacacacatgtaaagttgggcaagttgttttctgtcatgtcaggaaaatatttagtagcagtcttacaaaagtaagcactcagcgccgtcccagggagctgtggatttgctgtgcagccttgtttccttcaacaggttcctttgttgctttgtgtgttctcccgacaaagggcctgcccttcttctacagatgggtttaccattctctctgaatgaagactattcagaagtacacaaaccaacaaaccatccaagctgcctctatctgatggtcctggtatatccagagtactaaatagtggcctacaggatgggaaattcacactgactgactccacaggagactgagaaagcttaactggctgatagctgtaaagtcctttgaaggaacaagcactgtttaaaattctaagtagtaatcttataatttgctaatggaaagaaatataacccagctaatgtgtgcctcccatttcagagagtatgtttcaacagcaaagccctttacaatatttagataaacttcgatgtatagaaagtgcaacagcaaggtaaacagcagggcttcccgctatggcattttaaaatgtggtgggtgaaatttgtcactcctaagcaagtgcctatagtaaaaataaaatatcactatttatatggtatgtgttaaaaattgtccactctccccaactacaccagatcaaaacctcttgttttttaaattatgaaattattgaactgtattgagcacacccctacttatgagttgtgtaacctggggcatgatattgaacccctctgagtcatttcctcatctatctagacaaggctaatggtaatacctacattgtagggctgtcgttagaattttaaaataatttaataaaataaaggctagtatttattaaactctaaatacatgtttgctgctatcagcagcagcagcatcggtcggcaatcacgccaacactcctcaaagaaaacagttctgaaaaggctgtgtgcatcctaggtctgaagattttcttggtctaaagagtctcttgggctagtgaccaaatccttcattaatttcaagagctctgggaactctctgaaactgaatgtggaatggtataactactggtctgtgcacatttttctagaaaacctcacatctttcatcacattaagaggttaagaatcattgccatatgtagtcattagcttacctttatctactttctacttctaacggagaactagagtcctgtttagaacaagtaaccaggacagggacagaagaaggagactatgcatctgtcactcttgctgattagtctccaccctctcccagcttctgcgggcctcctctcccaagagttgcgatcctagacccacctcccatctgcagtctcaacctatcctcttctaaggactaatcatggcatatggcaggagagatttaagactagctaggtcaatgctctaagctcaacatcaagtcacctctgaggcagggtgttgtcatggaatgatcatgacctctgaaataggaaggtctgtgtttgatttggcttgaccacttactggacgtgtgaccttggaaacgtttacttaatcatgtcttttgtcacctataaaataaatacaataagatttacattgtgagtctatgagagagaaatgagataatatagagaatatttttaaaatgggagcatatgtcaggcaacagtagatgctcagcaatgttcttttcttacctgggcttcaacctggcacccttggtcaccttcccaggacccaaatccctctaggaataaactctggcccttgctggcttctttattcttcctcccacctacatacttgaacccatccaaagaaataggtctgactaccttggaaaccttttctgatgcttactacttgtccaacattcatttttctgtaccatgtgtgtagatactggattccccatcctagaattctacccacctcttgggctaccctgttacaatgtgtgactgactatcctactcccactttccaagttaaccacttaattgaatggctgcccatcaacatactccttaaatgccaagttagttctgtcaaacccaatccacagacaagccttatcctcaaaccttttctgccctctgccacagtgctaactggttcattgtgcttgttcagcatgcagggacctttaatttaatgggcctctcccatttttcacatatcatgaaagttatcaaatttaggttaattaagtttaagacatccatagttattcgagtgaaaacttgaaggcagcataatggataataatggtaaaatgataatttttgagctcttagtagatgccaggcatagtcctaagcagtttaaatatatttttttcatatgattttcataacaatcctacatagtagattatgatcattatctctactttataggtgaggaaactgagacttagagaagttaagcaaatggccaaaagttatgcaggtagtaagtagcagacatagaattgagaagacagcccccattctaaataagtatgaaaaatttcagggtgtcaatttttagctaaggaaaacttattcatgtgtgtgtgtgtgtgtgtgtgtgtgtgtgtgtgtgtgtgtaaatgaatagatattcatttacttatatatctatttcccaggcctcaatgcaatcagagatctctgaagaagtgaccatattatgaacataaatttttgacttcataactttacagtgataaataacctcaggttatcaggatcctaaccttaaaccacctgagattttatcactgttcctttagtaagcaagggatttttcaaccctgagacagataaaaaatagattgtatggtcaatgaaatccattatattcatactttttggttgagtttaggtaatggaacaatctgagaattttgtatcaagtatttgtgatgtttaagaggatttatcatatttaagaatctgacagattgcccctgcaattagaagtacaattgattactgacttctaattttaggttaaaaagtttaacagaatttgatgtttttaagtagtactgagatgtttaaataactgaatttattctttatgagtctagtatatttgattcaaaacatggcttcaaagcttagaaaggttttgcttgttaaggttgtgagcttgtactgccaagtattcgaagtgtttacaaagaaagtaaaattgttaaatgtgtaaagttattttaaaatattgatgaatacatttaacaagtaaatacaaaagtgtatttaagtagacattattcttttatggcattcataaattcataaattgcacaagataacctgagttgctctaaatgcttttcaaacttaagtttaggggagcaacatcagcaagatggctcactagaaactccagcactcatcccttccacagtgacagccaaaacaatgaataaacaactacactttaatgtacataactgaaggagagtgctagaatacatcaaaggagtaacagaaaccctggtgagcacagaaactcaggacagccacaaagagaatggaaggaaacatcacaactccaccaccctatccccagctgagatgagccagaaacccagaggaaactttccctataggaaaaaggcaagcaagaggattccagtagcctccaccaacaccttggacacccacagtcctcactactggagtccttgtagtcttcactggcactaagtccagctgagggagctgcctacaggccacacagccacactcacctcagagaaggaactaatactgtgctctattccctgtagcccacatggcaactgtgctatatcatcttagaactggaactactgctgaagtgtgattttctctgagggtgagcaggcttgacacccctgcctccataaggctaagctgcctccaaaccaccccaaaccagtggccacagccaagctgccagcagctgttaatgcctttccccatggagccaaacagtgaaaactgctctacctgccctccctcaccttcacctgccctctcccttcacctgccctcttgtgctagagatgaagcaatacattccctcctggggaaacagtgctttggcagaacagctccatctgcttctctccgctgcaactgtacactgcttctaggggtctgagccaaaatggcacagtatctcccaaggaaatagtgctttggtaggaccctgtatcccaggtaaatggtgcctgggccacacagaacagtcatgcctgagttaaagtgtcacattgccccttggggaatcattgccttggtcaagttaaacaactgtgcatcccagggctgagctgatgtagtatcttgtgtcccaaggaaacagagtagaacatgacctaagacagtctaccctactggacaatctagtaccctgctttcctgaagctggactagcccactagagtctgaactgctaagacctgctgtttcctggggagtggactcatcactgtgctactccctgccctccaggacccaaacaatacccatgctcagtcattctagggtacttgctgccactgcgcctggccacatggagtctgggatacagatatgccccaccattccaaggtctaaatttaccactacatagttcttcattctcagggacctaagctgccactgaaccctattggcttaggctcctaaattatagctgtaccatgcatgctgtgctcaaacccctaaaactctgcttctttcccagagctgagccagggctgtatcctattccccaggggtagaatcacagctacaacctgacccactgaatcaaagctggtaggggctgcctaacagtcatagattctggctctgtgggaaacctatatttgacccagctacagagagtgaacctgtaccccaggacccaagagccacaataggcttgtgaaactctgatattagcaccctgactccatagccacttcaagtaccaatccctggaactcaaagcaatggaactgcttgtaggccatgtaagagggatcctcttgtttaattatccccattgtgaggaaaatcagaataggaggaccccaaaagccctgccactgaggacattaacaacctatgttgtcactgccactaccatacccctttttttttaattatactttaagttttagggtacatgtgcacaatgtgcaggtttattacatatgtatacatgtgccatgttactgtgcggcacccattaactcgtcatttacattaggtatatctcctaatgctatccctccccctgcccccaccccacaacaggccccggtgtgtgatgttccccttcctgtgtccatgtgttctcattgttcaattcccacctatgagtgagaacacgcggtgtttggttttttgtccttgcaataatttgctgagaatgatggtttccagcttcatccatgcccctacaaaggacatgaactcatccttttttatggctgcatagtattccatggtgtatatgtgtcacattttcttaatccagtctatcattgttggatatatgggttggttccaagtctttgatattgtgaatagtgccgcaataaacatacatgtgcatgtgtctttatagcagcatgatttataatcctttgagtatatacccagtaatgggatggctgggtcaaatggtatttctaactctagatccctgaggaattgccacactgacttccacaatggttgaactagtttacattcccaccaacagtgtaaaagtgttcctatttctccacatcctctccagcacctgttgtttcctgactttttaatgatcgccattctaactggtgtaagatggtatctcattgtggttttgatttgcatttctctgatggccagtgatgatgagcaccaccatacacttttacagcctaagtcattcaggcatccacagttactgttgacactgaatgcagctgaagaaactgcatagatactataccactgaacctacctggaaacaaagtcaccacacttttcctaattagcacactaagatccaactacaggtgaaagtctttctctgcaaaagccactctagaaagtctggaagaggcaatttttccaccaaatgcatagacattgatgtagaaacacaagaaatatgaaaaagcaaagaaatatgtcaatgccaaaggaacaaaataactccctagtaacaaaccctaatgacaagaaaatcaatgaattgccagaaaaggaatacaaactagtactcttaagaaactcaacaagatacaagaaaatacagatagacaattcaacaaaatcagaaaaagaatttattatataaattagaaattcaacagagatagatattataaaaaataattcaattaataaaataaaaaatacaataggcagcttcaagaacagacttaagtatagaaaacaatctctgaacctaaaaataggttatttaaaattacttagctagagagaaaaaaaaataagaaagaaaaagagtttttaaaaaagactacaagacttataggacaccattaagtgaacaaattttcatattatggcagttccagaaggaaaagatgtattaaaaaaaaaacctaatttaattatctaatagctgaaaatttcacaagtctggatagagatgtgtatatacagatccaggaaactcaaaggttcccgaatagattcaagccctgatgcacattatagttcaattgtcaaagtcaaagacaaagcaagaattctaaaaacaacaagagaaatgtgtcacagtacatttaagggaatccccattagactaacagaagactttcagcagaaccttatagaccaggaaagaacagaaagctacattcaaagtactgaaggaaaaaaactgtcagtcaaggatactatatccagcaaatatatcctttagaaatgaggaagaaataaaacgtttctcagagaagtaaaaacagggaattcatcaccactagaacagttttacaagaaattctaaagggactcctgcatctggaagcaaaaaatgattatcactactaagaaaacacacaaaagtataaaactcactggtagaggctgagcatggtggcttacgcctataatcccagaattttgggagtccaaggtgggcagatcacctgaggttgggagttcaagaccagcctgactaacatggagaaatcctgtctctactcaacacacaaaattagctgggtgtggtggcacatgcctgtaatcccagctacttgggaggctgaggcaggagaatcacttgtacccaggaggtggaggttgcagtgagctgagatcgtgccattgcattccagcctgggcaacaagagtgaaactcatctcaaaaacaaacaacaacaacaacaacaacaacaaactcactagtagagcagatacacagaaaaaaagagaaaagaagcaaaacttatcactacagaaaatcactaaaccacaatgataaataataagagaagaaagaacaaaggatatgcaaaataaccagaaaatagttaacaaaacgacagaagcaagtcatgacttatcaataataaccttgaatgttaacagaataaattccccacttaaagacatagactgacttaattgatttaaaacaaaagaaaacaaaaacatgatccaactatatgctttctataagaaattcacttcactactaaggatacatacagattaagagcaaaggaatagaaaaagatactccatgcaaataaaaataaaaagcgagcaggagtagctttacttgtatcagataaaacagactttaagtgaaaaaactgtaaaaagagacaaagaggatcatcatataatgataaaggaatcaattcagcaagaagctacaacagttatatatgcatccaacactggaacacattgatatataaattaaatagtattcaatccaaagggagagatagaccccaatgccataatagttggggaccccactctcatcactggataggccatctagaaagaaaatcaacaacgaaacattgagtttatactgcattttagctcaaatggacctagcagacatttacagaacatttcaactgacagtggcagaatacatattattttcatcagcacatggaacatcctcaaggacagatcacaaaggccacaaaataagtctcgacaaatttaaaagaagtgaaatcatatcaagtatcttttctgaacacaatggaataaaactagaaatcaataacaagagggacttttggaagctctatgaatacaacatgctcctgtataaccaaagactcaatacagaaattaagaagaaaatttaaaaatttatgaaaatggaagcacaacatatcaaaacttatgagatacagcaaaaacagtgctaagagaaaagtttataacaataaacacatcaaaagagtagaaagactttaaataaataatctaacagtgcaagaacaaaaatgaaaacaagaacaaaccaaacccaaaattagtacaaggaaagaaataacaaagatcagaggagaaataaatgaaattgagactaaaacttacaaaagatcaatttttaaaactttttttgaaaagataacaaaattaacaaaccacgagctaaactaaccaagaaaaatgtcccaaataaataaaattagaaacaaaaagagagaccttacaactgataacccacatatacaaaagatcattagagactagtacaaacaactgtacacccacaaattggaaaaccaaacagaaacaaattcctagacaacctaacaagattgaacctagaagaaatagaaaacctaaacacaccaattacaagcaacaagttgaatcaataattttaaaaatgttctatcaaagaaaagcccaggacctgatagcttcactactgaattctaccaaacatttaaagaagaactaatgcccatccttctcaaactcttctagaaaataaaagagaagggaattctttcaagctgattctacaagaccattattaccctgataccaagccagataaggacacaacaaaaaaaggccaaaatccctgatgaacatcgatgcaaacatcctcaacaaaatactagcaagttgaatccagcatcacattaaaaagaacattcaccatgatcaagtgggatttatcccagcgatgcaaggacggttcaacatatgctaatcaataaatgtgatacttcacattaacaaaatgaaagacaaacaccatatgatcatctcaatagatgcagaaaaagaaaagaaaattcaacatcccttcctgataaaaaccctgaacaaactaagtatagaataagtgcacctcaacatagtgaaggccatatatgacaaatccatacctaacattatactgaacagggaatagctaaaagcttttcttctaagaactagaacaagaccatgatgcccactcccaccactgttattcaacataacattggaagtcctagccagagcaattaggcaagagaaagaaataaagggcattcaaaatggaaaggaagaagtcaaattgtccctgtttacagatgacataatcttaaatacagaaacccatataagctgtaccaaaacattcttagaatgagacaacaaaatcagtaaagttgcaggatacaaattaacatacaaaaatcagtaccatttctatacaccaacaatgaactagtgaaaaaataaagcaagaaagcaaccttacttacaatagctacagaaagaaaatataaaatacctaggaataaatctaaccaaggaagcaaaagatctctacaattaaatgacaggacactgataaaagaaattgaagatctggttacaaaaaaaggaaaatatcccatattcatgaattggaagaacttatattgttaaaatgacaatgctaccaaaaacaatttacagatttgatgtaaaccttttcaaaataccaatatcattcttcacaggattagaaaaaatcctaaaatttatgtggaaccactgaagaccccaaatagccaaagcaatccccagcaaaaagaacaaagctggaggtagcacattatctgactttaaaatatacaagaaagtgataataactaaatcatcatgttactggagtaaaaacaaacacatagaccagtggaacagaacagataaatcagaagtaaatcctttaattatagcaaactgatttttgacaaaatgccaaaaacattgagtgtgcaaaggacagtctattcataaatgatgctgggaaaactggatatccatatgcagaaaaaatgaaactagacctctgtctctcacatatacaagaatcaaatcaaaatggactaaataattaaatgtaaggcctcgaactataaaactaagaggaaaacattggggaaaatgcttctgggcattggtctgggcaaagattttttggataagacctcaaatataaaggcaacaaaggttaaaatagacaaatgggattatatcaagctaaaaagcatctgtacagcaaaggagacaatcaacagaatgaagagacagcccacagaatgggagaaaatatttgcaaactatccatttgacaagggattaataaccaaaatatataaggaactcaaacaactcaatagcagaaatgctaataattcagttttaaactgggcaaaagacctgaatagacatttcttaaaaggagacatacaaatggacaagaggcatatgaaaaaatgctcagcatccgtaatcctcagggaaatgcaaatcacaaccacagtgagataccatctcaccacagttataatggctactatgaaaaagacaaacaataacagatgctggagaggatacagtaaaagaggaatgctagtgtactgatagtgggaatataaattagtacagccattatggaaaacggtatggaggttcttcaaaaaaactaaaaatatctacaatgtgacccagcaatcctgctgctgggtatatatctgaaagaaaggaaatcaggatattgaagagatatctgcatacccatgtttactgcagcactattcataatagccaagatatggaatcaacctaagtgtccatcagctatggatgaaaagataaagaaaatgtggtatatacacacaatgaaatactattccgcttattttatacaattaagcctaaaatatattttaaaaaataataaaatcctatttgcagcaacatggaactggaggtcattatttttatgtgaaataagcccaacacagacaaatattggctgggctaagtggctcatatctggaatcccagcaatttgggaggctgagggaggattatttgagcccaggagtttgagaccagcctgggtaatatggcaagattctatctctataaaaaaattaactggctgtcctagctacttggaagaccaaagtgggaagatcgcttgagcccagaaaattgaggctgcagagggccgtgtctgtgccattttaactttactccagcctaggtgacagactgagaccctttctcaaaaaaaaaaaaaagaagaagaagaaaaataataagaatgacagacaaatattacattctctcactcctatgtggaagcttaaaagtgtggatctcatggaggtagaaagttgatgggtgctactagagcctggaaagggtggcaagaggggtgaagagaggttggttaatagatataaaaagacagctagatagaaggaataagttctagtgtttgatagcacagcagggtgattatagttaacaataatttgttacatatttcaaaatagctgcaagagagaatttgaaatgttcctaacacaaagaaatgataaatgttcaaggtgctggatatcctaattaccttgatttgatcattgcacgttgtatgcatgtactaaagtatcacatgagcctataaatatgtataattattatgtatcaataataaaaaacattaagtttaaaatatatctttaataaattaaacttttgttaaaagcccaaattatagtaaataaacccttctgcatacaaaaagtgatctattagccactgaaaatcttataagagagtttttatgacagacttatgagcaataataagtattttaaaatataaatcagatcatgtcatgccttggcctaaaactcttcattgtttaacagttactcttatgagaaattccagtctcccagccaaggtctatgaaactcttcaaaattgactcttgtccacttctacctcctcaccaattatcaacctcactaccccagtcactttggccttttttcctctttctgatacatcatgagcttattatggcaacaagtcttttatatttgttaacttctctacctggagtacttttcccaaaatattttgcaaggtgggctcttgcttgacatttaactctcagctcaaatatcacctcctccagatgcctcctctaattgtcctttacaccaataacctctgacacattcatatgttttacagtcttaggaatatcctcaatgcctgacttaccatattcatttattggctcccatatttatttccccctctcccaaataaaataaaagctcaatgagagcaatatcttgtctttcctaaaccattgcttggcacatattaaatgctcaataaatatctgttgcacaaatgaataaacttaaataaataaaacacatctttgccttaataccaagttatttttaaatcatatccttatgtaatatcgaatccataagactcaattatctggggtttatttgacaaatttgattatcttatttgggggttaataccatgaatggctaaaaataggccaattgccaagcagagcacacaagcaaatatgatccctccccaggatgcttgccatccaaattacaagcattgaaaaatcttggcaaggcgcctatgctaataagaaagtgatccaatattcatgagaagaacttgaaaaactattatttttgcctgcaatcttcttggcttttccataattaatatgtcattatcatcagaaggctaagagatcaagagtggtaaaagcaacctttcatgtaatactcatagggacaatggtatttagcaaatatcacattgacttctggtaagagaaataatccagaatctgtggttgctagaaacctagtatatggaaaaaatagaggggcagttggcatcaagacagaaaggtagggttttaaagctgatctagaggtagaaaaaaacacattctagagattcctgaagaaacaaattccaagtactcattgtcatgaaaaacggtatgatggagtcctaccctctgtctgtattgttcttttttaaatagatcttcctggttaggtcaggaagaagctattcttgaatgccagttaatacattcctccatttactcaacattctatccctacaccaaattagctcagtagaaaggctatctagactatctactacctaggtcataatacattagcaacctgtacaaatgtcttttcagagtttcagtttatagcatgccgtggtttgttatccagggtgaatctaggaaacaattagatctataatctcacagcaaacttcatttgactatatttgcaaatgttatcaactatgttatttttttaccatcatatatataacgattgatataaaaagtttttcttacagttaggaaaaatttgtctctcctgacaaagtggtattcttccttttgcaactaatggcagttatgtaacttgcttctcttagatggccttggccatctaagaagctcagagcagaactaacttgtttaggtcgtctagaatgacttcttccgatccctatttttctctgcttaaacttgttgttcagttctgttaggacttttgttttgttttgttttttacatatatgccttttctcattagttggttaaaatacgcttttaaagtgtataagataaaaatagtagagccagacacggtgccttacgcctgtaatcccagcactttgggaggccaaggtgggcagatcatctgaggtcaggagttcgagaccagcctggccaagatggtgaaaccccatctctactaaaaaatacaaaaattagccaggcgtggtggcacacgcctgtaatcccggctactcaagaggctgaggcaggagagtcgcttgaacccaggaggcagaggttgcagtgagccgagactgtgccactgcactccagcctgggcaacaagagtgaaactccgtcccaaaacaaaaaacaaaaaaaaagagtaaataattttgaaattttaagctcccttttaccaaaaaagggttctgacttctggccagaatgtagtaaatgtcaagaaatcagtcacagctgaggtagtgccaggaatttggtgtgggggacaggaggagacaagcaaagactatttaaaaacaatgaattttagcctgtctataagtactcttttctatgaaaacataaaaggaaatttcccttacaaatgttgattgataaacatgaacgtctatatggaaaataatgcgatatctgagctaaaaggactcttagtgaactctgatccaatctccttgatttgaggatagggaaaagtgtaatccctaaaagattaaatgatatttccaaagaaacaacaagttggtaattaagtccggcctgaaatctggggcttctgcttcccaggttatgagctttctaacactccaagaactgtgaaccctggagggaaggttgtaatctgactttaactcctgaggacatgtggatatgcccttcagggtccagggacatttgggttgcacattaacagttaaaatatgctaaagcaccgcattttctccaactccattcaatgcctaaggtttattgtttgttcagttttagccaactatatttcctgagtgtttcaaaaggcagcaaggtggcgaggatacaagggaaagccgctacacattcaacataggaatacaaagattatagtagaattctacgcatcaaattccaattcaaatttcttctggggtcagtgtcagtatctcccacttcctcctgacacatcctgagctgaagatcccttttaaattttctttctaagaaaaaaaaaaatataggtttattgatctcctttaaatgatagctttagaataacatgtcaaattatttctgtttcttgacttattctaggaaaaaagacaaagaaataagatattcatataaatgaaaagtttcacagccggcaaccaactaattggtatatatttaaacacatttaagatattacttgattacattcaataggcataatgtccatataagaacaatggttttgtttggaacatataaaagtgatagttctgtaacatgtatttatttaactttttattttgagataattatagattcacttgcagtggtaagaaataatatagacagatcttttgtatccatcacccagtttctcccaatggtaaatcaagatattgacattgatacaatccacctcagatttcaccatgttagatataagttctaaatttctcatcaaagaataaatatgccagtatgttcaattctttgccttctacttttaaacttaacttcctcgtaaagtaacctttttcgattacctactccaccccgactcattccaattcctactccaccccaactcattccgatcacctactccaccctgactcattctgattacctgctacctgctctgccctgactcattctccacgctgcataaccattttttttccctccaaagcactcaccccctcactctctttaaattagccaattggaattagtttcgcctgcgtggtctaatcctagccaacaggggaacgacacggcagcaggggccatgtgcctcagggataagaacaccttcccctcccttgtccaagtgtgcgctcaccattgttccatctgtaagggcgtacccttctgtagaagtaacttgccttgctgagaattaaaagaaaattttatattcgatgccgtttcttttgcggcaccgaaactttatatataacaaccactttgacattcatttatataaagatcaatttttaatagctacaatctatagagcacttctatatgccagaccaactgctcactgatgaacaaacattcttctagttcattcctacaaaaaacaatttaccagtggaggcaatagtgaggactgtagcttagaagctttcatgctacaatgtagtatatgctacagtgtagtaccctatagctgtatgggtggttcattttaaaaattgtatatgcagccattcctcaataggctcaaaataaatattgacagaaataggtaagtaaatcaaaagagaaaatcaaagccaggaatcaaaagaagaggcaaattgggttaatatgattcaatttacgtctgggcttcttggtagacaggacaaaaaggtaaacagaatgagatatgcaatcctttttgtcaaaaggggaaactcatattgatcctttaagatatagatgtttaaaaatatgtctatgtctgtgcacatacccttatgctagctccagctcagttttttaaaataatcttttcagtcagagtttatgaacatccaaataaaactgtgtcaacacatgcttaatacatcagtaaaactatttttaataatgtactctcctattgaatatgggttggttttctgacttgctatggcccattgagtgcacagatgtcacagtgttctacttccaggtagtccttaacaaggctggcagcttctactttgaaactttccaaaaaattagcttccatgatgtaaaaaaaaaaaaaaaaaaaaaaaaaaaggccaatccagaatactacatgataaacacttgtgaagagactgaggtcatgtgcacagcaccaatgcacagatacgagtgaatccgttgatcttccagggcagcatagccgaaagctgaatgcagcctagtgattgacccagcctacaccaaatggagcggaacaactacccagccaagccacgccccaattcctgacctacagaaccttgaaaaataatgaatcactgttggtttaagcaacagaagttttgaggtagtctattacacagcaatcaataactgaaacaataacccaaactgataacctgaaaattcattttgtaaacctgcatctaaacttggtacaataattaaacattttctgtgcaagtagtccctcttatatgactagaatgtgtggaatgcctaggagcagcttttccaaatgaattcatcaataaacataaaacataaaatgaactgctctagttttcccagagattctgcctagaacagactgccctaggacagatgattaagttagtttgggtccaattcatgactacataacatggagttagttatgtcttaggctacgtcccttcaggcaacttggagcctcccagggttaaagaagctctgccaaaactcaaaatcaatagggccatttaaatgatgacatccccagtgggtaaagatatttgactccacacatcaatggcatgagctactgtcatgggcattcgtcaataggttgaagatctcattaaagctttttaatttctgcttagtggtattaggatttaattgatgccaaagacactgcctgtcactatacagtgatgttgtggcagtcagtagagaatgtcttacacacagtcctagaagaccttcctagaaaggccagggcagttctactggctgcatttcctggcttgacaggctactgctactttatagtagctctctctatgttgttctaccttcccatcatccgtgcacccatcttcttttaccagcaacccaattttctgaaaaactactccatctttattcttagtccatgttgctcagaagggtttgattctacccacagcttcaggcatgggcacaccacccagatcaggttgatcaccctggacatataactcaagacagtgtcaatgagatcaaaactttgaactctcaccaatactattggaaatgagaaactctattgtttcccactgggttgctaaactggtagaatggaatgggtatatataactgacagcctttttgccattccagggagataaaccctaagaacaaacaatgcatagatcacttgatcttctggatccagcagttctagaagtcatacgtgtctatattttttcagtatataagccaataaaatatcattttcatctaggctgttttgagttgtatttgctatctcttgcaatcattctcagaaactgccaaaagatgggctgctgcacaactatgggatgatggaatgccatttattttctgggacagtgcaatttattacaatttattacactccctttctgagccatagatcagaaagtacccgggcgttaagacaacagcacttcaaaaaacaatatcatacttgatcttcataaagttaagtgagcaaacaaggaaactaagacattaatgagacatgtggttcaaaagtcatccatcaaatcaaatatggcaccaagactggaaaccaagtcttcatgaaatgcgaggtttctgttgcttgaatcaatggaccttaaaggtgatttggtcttatggctccccaatgtcagtccatggattgggatctgttgccagagtatgttcaaatcatcaatagtccacagagtaatgagaaaaataaagaaactttgataggttttaatggagcaatttcatttcacttttaaagcctgaaatttcatccttccaggtttgtttggttttttcttttggtgttaacatatcctctttttgaaataatagcaatagtagatgtaaatcatcttttttggctaaatataaagtaagcaagcccatagcctcccctggaaggcactgccattgtttccaatactctcagctttaacactgacagctacccttgctctctttctcactgacacccaccaactcaaccagccctctcccaccacacaccctttctcaggtcacctctgtgctctccacccttggagctttacctctgggtaattcccttgtcttttgtaatgtatattagagtgtatattagagtgtaatgtatattagacgtctataactcctgctattactctgctcagcaccttcttaggacagaagcagctatcctttctcctgagaaggtgggaaaaaggcaaattatgcatacttataaataaatatttgttggtctcaaacaagtaaatttataaacattgatactaacattactggaagcataaaagcattagaaagacattaaatgccctacagtagagtgaaaattaaattctgccatctaggagaatagtatttagtcattaaagttatgattataaatactttgtaataatatgcgtaaatgcatatgatataaggttaagtgaaaagatacataactacaaaatacaactatgttaaaatatccatgcatggattaaaaaaatacagctttaactgcatagtggagttaccggtaatgtctacttttatatttatagaaatctctgttgtccagattttctgcaatgggtacatatgacttttgatggggttcagaacatgctaccacaaaacatggcaccttggcattttgaatattttaagctgaaggagtctgagaaacagcatgtgctggaaggactctctgaagcaggtcagaagccccttgtgtgagaggtccctccctaaacccagagaaaaggagcatccttatctctgaagatggagggacacacggagaagaaactccaggaaccagccttggtaagtttcccctagtttactacacttagttcatatgcttttccacaagtttccactcttcatcaaacctagtataaaagcactcaggtttaactgattcatcagattttccttccttatgaatgctctagtgacacataaaacttgtattaaatacatttgtatgcttttctcttattaatctgtcttttgttatagagccctagccaagaaactaaaatggttaaagggaagatttttcctacactttaaagtgtacaaatatatatttattaaagttagttccaattattatgtagccaatatttactgattactctactctgtagatgccaagaaagccatactctttcctgatagtttcctttgtgtgacaagatttgccacagatgtaggcaatgttggtattatacttttcttgacagctagaataacttctgctaagctaggcaaccacatctctccaagccatccttaatgcctaatgactgccactgcacctgacctagctccagggctgaccctttcatgtttaccccaaggccatgcccatctgggaaaccacctgggcaggtaccttccaaccaaattaaagtcaaggattccatccactatcactaaactagcacaaaccaagagagagaaatcaaggcaccacataggggttaggacaagtaatcaaagtcaggtagaaatcccagaagggtggtatacaatttatatttccctagtgaggcccattctagaataatgggaaaggttcactgttgtcagaatgccaagaatgaattctctgaatctggccttccctgaaatcaacacttaggttctgacaacctctaaattcatcctcactaactacatcaaacatttagcatgctttttattgtggggatgggggttgcttttgtttgatttggtttatctggcatctgaaacaaaagatgggaaaggatgacattcattcttaacctcgtgtatagttaaccacatcaaaaaaggctattgttagatacaaataaacgttaacatacattagttccaaaaggctaaagcctttcaggtgaacattattggacactttctcccctgtgccagacaaaactatgcatggcttattcccagagtcaccccgtcctttccaaggcattctatgctgcctcagggatgcaaacaattatggtacttccaggagagaaggagcacataaattctgtcaccccttgaccccaggatccaatttcacagcaatgggtgaaaggattttttagtcaagagatgatgtgagacgcacagataccccttggagtcatttgggtgacagcattaaagagaatgaaatgagctatcttgaaatggaggccaagtgcagtcactgcatctggaaagttaggctccttgatattcaaagctctggggctcggcaaaaaattcaaagagcttttagtattcaaaacaaaacaaaaaaaaacaaacaaaaaaacaaaaaacactctttaaaaaattaaaatattcaaaactgtggaaaacttgcaagaatcatatcatgaacatcccatactgtcttcccaagattcatccatttgctattattttgccatatttgctttatctcttcctcctcctctgctccccttccctcaaacaaacaaatgaaaagtggtttttgctaaaccatttcggtgtaggtgtgaacattaaaagcttctaggaattacagtagtctctcacacatacaatgatcaaaatcagggactttaacgttgatagaatactatcttacacgtagtccatatttacttttcttcaatcccgagtgtcctgtatggccactttcctccagtctaggatcgcactggcttttagctgtcatgtctctttagcctccttgaagctggaatactttctcagccttcctttgcccatcatgtcattaacattcttgaagaggacaggcctgtggcttttcagagaatctatgctggtctgactgttatatgaggattagattcatagtacatgtttttgaaaggcatactacctaagtgatagcatatccttctcattgcattacatcagttggcacctgatgaaacttggtcccattcttgatgtgttaaccttgattccttaaataaggtgttttctgccagattacctcactgtatgtgtgtgtatgtgcaggtattcctctttttcccttttataattaataatgtatgggaagacttttttctgactgtgtaaacaccctgctaatcaacaagctttcactcaatggtttaacacctattgacaattctactctgaatcaattattactataatagttgtaaaaaagtgatttttctaactctattatttctttcacagcaattagttggttttctagtgcaagaaacagctgccctttctcccttctttccttcctttccctccttccttccttcctttctttctttctttctttctttctttctttctttctttctttctttctttctttctttctttctttcttctttcttttggttatatcttactcatttgattcttaagtgtcccatttcaagctggttcctgtgtcattcagacaggtcctcattttttttttaatcagtttttattttctggcacaacaaaatgttccaggcttttcttgtcctttccctgctctgaaactgcaattagtcattgctctaagcaggggtccccatccccaacctccaggctgcagactggtaccagtctgtggcctgttaggaactggctgcacactaggaggtgagcagcgggcaggggaacctaactgcctgatctccgcctcctgtcaggtcagctgcattagattctcatggcaacattaaccctattgtgaactgcgcatactcattatgagaatctaactaatgcctgatgattttagatggaacagtttcatcctgaaactatccccgctcccctgccaccgatggaaaaattgtcttctatgaaaccggtccctggtgccaaaaaggttggggaccactgttctaagggcccttatttttagtggggaatgctatttagaaagcaagagctgggcactcagtgtgttcactgctgctaggagtgttattgcttgcaggccctttaagaggacaagtaagaattataaatatatattgagtcatgtcttcctattgatacttctaatctccatccaatagctcaggctcttccttgcctttccccaatccacagttgtactgccctccttccacagtgataagcctgactccccacaaaataatacatttacttaatcctacaatggatacaaagtaatttcagaattgtcccacaaataacacaaccaagaacaaatgtataaagttcaagatttctttccagtacttctgttgtttgattgaaggccatgcccatctgggaaaccacctgggcaggtaccttccaaccaaattgaagtcaaggtactgcattcaaaataacttgaatcagtatttttttcctatgtgtaatcatgtcatccatttgatatatagttaggttcatttactctgtactcaatttcccccatcttgttatttaatgttatttcggaatatacaaaccatgaacatggtttcaaactcaaaactatataaaaaggtattcagagaagtactacatcactgtcttccttccctaactcttctaatgctattcccaccctgtagatgaccaatttcatatcttctagtttatccttcctgtgtatccttttgcaaaaataatcagacacatagataaagacatttttatttccccttctttctacctgaaatgcagcatgctatatatagtcttccacattttgctttttgcactaccaatatcttctggtgatcactccaatcccgattcacagggatcttcctcatcctattttacagcacactactgcattaatgtattatggctcattcaaacaatctcctcattacaacataaccacgatgatgctgcacatattattatgagagaagttgaacatattttcatatacttaaggacccttttttatcaatttttgtgaactttctaggtctttgctgcttttctatcggatttatggtctctttagtctcctcaacgtgtagtaactttctatatattagcaatattagcattttatcagaaatacatcttgcaactatttcctcctggtttattacgtgtggtttatggttttttgccatgccaaagaggattttgtttaatttctaactttacacaatcagattttactacatctgaagtttgaattgtgaaaaacctttccttgtgcttttcctttttgttataaagcaatttcttatactggctaatttttaagtatccctcattacactatacatgggaatgtatgtaagaagaaaatcctatttgcctactgaccgctgggcaacttcaaaactgcatgacctttatttctgcaggcccttcatttcctagctgcatccctttcattttccctaaccccaggtttcctcagcaggccagcttcactagagagctgtaaactaaacctaaattactaaagaacacattactcactcatcataaccataggaatctttctctagagcaaataagaattagtagtacaaatctgttttataatcacatactttcacaaagcaagaatcaccaatagtatactttattgtctctcattgatgggtacattttctcttattatttttattatcaaataatccatgtttattttaggataaaattaaaactacagctaggcaaaaacaaatcaagatgttggaactgttaatattttagggcatatatgtaaacacacacctatttaaaaactctcttctttttatacctattaaaaaaaccctctgttctctactatacttgctattttgtaatctgtttccattttcatttaatataaacatctttccatgttactaagttgtctgcaaaggcattttaaaaggctacatggtattatactgtataaagacataaaatattgaaccaaatattgtgctcttaggatttaaaaaaaatatcgtaaacaactctgagaaaatttactcagacacacaccttcatgaatttgttcaaatgcttctttaagataaatacctaaatgtggaattgcaggattaaatagtacacaagattttcagggttttgatatacgtggtcaagttgccaccagcagtgtatggtgggttccctttacccacactgaacccacattagtgttatctttctctgtaatcctttttatctcctgatttagcaagactaaacaacagtgtaaagttctgcaaaagcaccagataagcaaatttagaacaaaacattactgatgtctgcccaaaactctgtaaacctgttcctaggctctaagctgtctattgaaatgtcctaagaaaccatttcactcagagaagaacatttttttcactcttcctgcacagctcagtctttacgatgttaaaatcctgtacaacttcctaacagcccttcacattcttcaggagcccgagtttggttctggttataaatgcataggatagatcccatacgggaagcatagacctaagaaatttatggaaaggaatttatgggaaagcttctctcatcagggctgtaccaattaaaaatccataaataattctcccttgtcagtttctgtataaacacattggccttagaaatttttacttcaggttctagtctaatggcctacacttctaaattatgcttttaattgaaaaacaataacatgcattttttttccagaaccatctgtgctttcccaagaacatgtaactactacagataaatccgctactttgaacaccctaattatccagtttagggttccaaaagcttaggaaaataatgccattcctgaaaaacagtacgtgatcagaaacacttgctttaaaattcgatatttggtgtgtgaagcttcttaacaagtgtttattaaactgcataatttcaaagcctggagtggtatattgcaatgttttcctcggagttgatcacatttgcatatctttttacacttcctgtgaaattaatattgccttttgtatctcgaacttagctaatataacttgccatttttacttttcactgctatgagtaatataaagtgaacccccaaagggacccctgcaacgcctacataagctttattctctcactgttgtattttttcatatgaatatattaaatcaagattaataaacctttgcagaatccactggtcctgcaaaaaggcaagattcataacggtaaaggctgctcagcaaataaaggaaacctgctcctaaaactggagccaaaggccggggttcatggagctcttgtcacatccaacagtgtgccagagactcttcacctcacaagaagtctttcaacagtcactcaataatatgtgcaaaagtggcttaaccaccaggataccaaaacccagccggtgattatcaggctgccttggctcagggatacatctttgtgagatgccaaaaactgaccataatcccaggattttaaaaatttcagctgggcttatggggatggaatgtgataataaagaaacaggatggtaggggctgaggaaaagtggaacatgatgagaggctcctaaaagcaaatcaaacacagaaaagggaaatctctctgaacactgcataccgcactgggcacaggagtcctcagttgagcatcccccactcattgggccccagcagctactttgcctagctaagaatctgctcaaagctcagggaaacctaaatggcaatacaaagaaagagttgggggcagcttcaagatagcaggctactggtacaaatactttgtgaggtcagaaaggctcactatcatgacttgtactgctgtcattgattctcctacttcaagatcatctccaacttggtcaagaggcagagtaatggggattcagggccacagttagggtgcagcaaatgaggtacaaaatttaagtagaactaaaaacaacctcagtagccaggtgtggtggccatgcctgaagtcctagctacatgggaggctgagataggaggatcacttgagcctaggagtttgaggctatagtgcactatgattatacctgtgaatagtcactgtactccagtctgagctacatagtgagatgcccatttcaaaagaaaagaaaaaaaaaagaaaaatcctcagtaatcaagataataatacttcagtgcaatctttttagaaaccaaaaaaatcatggtgaagaaaacacaattttaaataaatattaatgccctgccaaccatatttgagcctgcatggacacttctacctacatttttaatatattttaaaaattaatttttttggagaaccttaaagtcattgaagaaatactgaaaaattggaaagtaggtatattaaaacttacaatattaaatgtaaatattttatttatactaaaatcagaattcattataatttcactttcctgactctaatgggacaaagtaattttatttttatgttttgagatagagtctctctctgtcgcccaggctggagtgcagtcgtgcgatctcagctcaccacaacctccacctcctgggttcaagtgattcccttgcctcagccttccaagtagctgggactacaggtgcatgccaccacgctcggctaatatttgtatttttagtagagacgaagtttcactgtgttggccaggctaggggacaaagtaatttaaacatgttttcaaaacttacttctttgtttgtcttcttttcaatggaagaattaccatgtttgacattctcttatcacctagtgacaatcataaatgatttttaattaaacaatttactttctttaaattaattttattttgtttttccttagctttaggctccaaaatggcttggcactgtactaatccttatttaaaacttcaatgttttgttcatcatggatttttctggcatttatttgatttttgaaaaaaatggaattaaactatttgtcttgatcactaagtatgttgacattctcttaaactgtgcattaccttgttccatccaaatcaaagtcaaggatgtagccatctcagacaaataacataacaatgactttaagtgtggaaagaagcctaagatcttttattaagtgaaagaagtatgtggcagaataatatgtatagtatgggctcacttgcacttaagaaaggccagaaaaacattttaaagaataactctaagtcattacacatcaaataaacattgacggcaaaaggtaaaaagtgtagttactgaagcaagagtttctaaatcatggtgctgcaaaataatacactgggtgtccaagtagcagtaacaactaagtattaccctctgctaacatctgatatctttgaaagattgtctctacaataatgtcattctcattcacttgtagctaggtactttttttttctagagaaagagatgggatttcagcatgtgtactaggatgacaagcaaacactgtaggttcaaggaagttcatgggcatctcaacaatatgtgtggtggtgaaaaatacactgagaaccactcatctagctgctactgatcctattccataagctaggaatacgtcataagtactgttttgtcctcgcgttggggatttttgttttgttttgtttttttgtacctcctcagtatcctcctctgttaagtaatagcatttttgtttgctttttagccaggtttatggaggtataatttaaaaatagtaaaatttacacttttagtatatatttatatgaattctgacaaatgcatatagttatataacaaacaccacaatcaagatacagaacatttctatcatcccaaaaagttcccatgtactttgccatagtcaatctttaccctaattctccagcctctggcaactgctgatttgttttccctataattttgcctgttcaaaaacatcatataaatgcaatcataaaccatttatgtctgacttcttagtgtaaagcatttgagattcatccatttgatgcatatctcagtaatttatgcctttttattgctgaatggcatcctattttatggatataccacagtttatttatccatggtaataggatttggattatgatttcacaaatcacccatacttcctttcaggtcatgtggtttataaagggctgacccgaaagttccagagatgcccatagccaggcctgatcaaataacatattcagtcatcctgataatatggatggtttagagctgggcacatggtttgatgtaacaattttcgattcaagacaactgacagaactattggtaagaagttactgatggtataatggaaactgtttctggtagctattgcaccaccacaagggagccccaacttgaggataataaagccaacaggaagcaaagtgcaactaagtggatgagataccttcctaacctagtttgagcacctggatccagacatgcctaaagatctacctgtagacctgtcagttacatgaacctataaaattccttctagcctaggccaattttgattatatccctcattcctgaaactaaaatctcttgactctacagcatagaaagaaatctttcatcaaggaggttacaagagagtcttggaaacaagacacaaaaaatggttttgacatcagacaccccaactttaccacttactacttcctaagtatacaatgtcaagaattctctttactcctataaacctgtatttcctcatttccaaaatgcagagaataattccttacccattctaaaatattatcttgagaatcaaaaaaactaagttggttcaaatacaaaagaaaaataaaatgtatgattattatacacacaaaataatttgtatatgaaaaggagatattaagtgatgacggtgagagagaatcaagaggcattataaggatcaatgcagaactccagtgcttatataaggatcaatgaacaataattgtaactagaggtatttcttgagtatattcttgtgttaggcattgtgtcaggtattttacctacattatatcatttaacattctaaatatcactaaagtaactttttaaacccatttttgattaggcttagagaacataaaatactttttaagttaaagtactaactggcagaggccaaataaagacctaaatctggaccactgaaactagtgcacacttctaagttagatggaaggcatgaagcaaacactttggaaattaaaattcagttataaaaaccatcacaacacaattaatttagcaactacattcctttatacataattgtgccgagtgcatctaactcattaagatgtagaatgtttatgctgtcatataatattatcacatggtaataaatgaagttgcactatatctctaaacatctggatttcagagccaattttacacatttaattcagctatttggtgtcttaaacacatagcaaaaatacacaaggaaaaaatgattgtacatctggcatcaagatggctccaagaattggactgccaatgaggaagtcaggtttttctagcctatatcctctggaggataaatacccaaaatagtactgtttccaaagtaaccaaaatcaagaaaggagactccacaaaggaaacaagaatgaaaaagacaggcctagcccttttcaaaagctgagccttccctcccaggatccaaggtacttagggtttctcatacctgacaacctataaacgagaaagagtatcacttgtttgtccttccatttctcattttccagctttggtgcttatcaggttctccagaggtagcaaatttgtaagacatttcatctatttagattttcatttattcatccatcctttcagttactcagtgatgacttctatctgctgagccctgcactaatgatccaaaattcccaatcttcctgcctaggagagatagggagaggtagggaatatggcttctccattttctccttttcctttagtaaccaacctctactggaattaatcctttgagttcagctgggccttgagatccaacatgatttgttttaaaaatcaaggcaactattaatgtaaaaacaaaacaatacaagtattaggagaaaacatgagagaatttctgtacaactagatgtggggaaagcctttctaactataactcaaatccaaatgcaaaaaaaaaaagaaaaaaaaaagattgagaatttcaattacctgaaattttttaaaatttgcatagcaaaaaataccataagcaaaaataaaaaattaagtgcatgataggagaaaatatttataaaatatatcacagattaagctccaatcaccctaatatatattttaaaattcttggccaggcgcagtggctcacgcctgtacttcctagcactttgggaggctgaggtgggtggatcacaaggtcaggagttcaagaccagcctggccaagatggtgaaaccccatctctactaaaaatacaaaaatcagccaggcacggtggcaggcgcctgtaatcccagctactcaggaggctgaggcagagaattgcttgaacccgggaggcggaggttgcagtgagctgagatcacaccactgcactccagcctgagcaacagaacgagacttggtctaaaaaaaaaaaaaaaaaaattcttaaaacccatttttagaataagaaaaatagaaaaacaagtagttcacagatgatataggaattgcccttaaacatatgaaaatatgcttaattttacttataataagagaaaagcaaattaaaactacactaagaattataaccatattactctaacataagaggttatcaataggagaacctgggtgtggtgtacacaggaaccctttactatcttcacagcttttctgcaaaccgaaaactcttcttaacaaaaaagttgatccaaaaaaagtacattgagatactatttcttgcctatgagattgtcaaaagttgaaaaacttgacaatatactctattagcaaacagagtgtagagcaacagttcctctcaggcattgctagttagagtgcaaaagggtataacctgtgtaaagggaaatttggcattagttaacaaactatgtgtctatttccttttctatctttctacatacctatctatatatttacttaccagcaatgtcagttacagcattcaccctgaacatacaccttcaactgtatgaaaaaacgtggacataaaattattcactgtagtgttatttccagtaaaaaatactggaaagaatctaaatgccatccatagatacaatcaatagtagtcctttgtgtgaacaaccaatatacacatagaactactattcaactgtaataaggaatgaggaggatctttataaaattatatgaaataattgccaggataaaaaagcaaggtgaaagagtatacatagcatgctaacttctgtataaaaaggaagcgtatgtatatttgcttctttttataatgaagacatgaaggataaaccagaaactaatgaaaatattttcaaagagcgtgagtaaaaatggagctggaagggtagggatggagtgggactttcttgaacaatttttttttctagttttgacttgaaccaggtaagttttgacttgaaccaggtaagttttgacttgaaccatgtaaagttttacatattcgaaataaaaaatttaaaaaggatttataaagcaaaacctaaacttgcatacaggcaggacataaatggatctaatgatatatcacatcaacgtaaataatcacagaggaaaaaaataaattcaaataatttctgaagacagtattctgaatgtatatccttagtggaatattaggaaaaaaagaagtccaaataaatcttgaactttacttaatagattgattgtcaggaggggtattgatatagtaattctgaaactattttccgtgtactataggatagagcaaatgaatcgatacattaggatctcactgtggaataaaggagatacaaatatgaaatgagggaaagtgcggaagaatcctgtgatgttgaatttgaatggttgagttgtacatggtaacatacatgcatctacctatctgtctacttatctacctatctaatctatctaatctacctatcgcctagcggcaatggcaccccagtagcaatgaacccacctagcggccaaaactttctttctaaattccattctccagtaaagggagacagggcttgactgattcttgattggggtagggaaaatgtaaggtaaggttgatacatctttttttactccaggacatactcaaagactgatggagatatgtcaaaacgacataggaactagcatcaggggatcccactggctaaatgacagacaatttgagcctcacaaaagaataaggagctaagtatagttatatcattttgtggaacttcattgagctgtgtgcttataatttgtgtatttttttgtaggtatgctgtatttcaatatgaaatgtagtgtctttttttaagaaagctgtgatacaagcagcaaataagacatataatttactttagcagaaaggaagaccgtgctctatgaataaattgttctgattacactgatggtcatccatcctactatggaaacagaggtggagacctcttttggtaagaaacaacgtcagcccagaaatgtataataatacaaagagaaaaacatcattaggcacaaatcatcgatggacaatagaacccatgagtgaaaggttcttgggacacaaaatagttacccagtctcaaagtatcaccccacagatactaatttcaaggcaaaacaaaacacaaaacaaaaaaaaaccttaaaaatggagtgacctgaagaatatccaagatgaaacagcatcaccaaaactggcacaaacaaattatatgactctgctgtgatccactgtgaagcaggcaacattacctagatagtactttggcctacaatgaggaacaattggacagatccacattgtgtggtattccacaatcactgggtcggaatcttcaaaaatacagactcatgaaagagaaataaaaggcaggagaatattctagattaagagggtccaaagagacaaaataactaagtgaaatgtgtaatccttgattgtattctaaaaagaaaatggaaataaggaaaaagagacattacaaggtatgagggacattaatggaaacatttgaatatattagattacatatcaatgttaaatttcatgtggagagtgataacagtattatgattacatattcatcttaggaggtataaggtgaaatgtcagggggtaatatgatatctatgactgaaatgcaaatgattttttaaagtataataaatgagagaaaaaaagccaatgaacaattacaacaaaatgttaataactggatcctcaagggggaagagtaattgggatagactgtacaaaaattaatcaaagataactagcatattttgaatgctcactgttgtcaggccctatttagagaggtttgcaatactaactcatttaatccttgcaataactctatgtgattgataccacatatatccattttacagacaaaatggaaacctatagaagtaaaataacttgcccaggctagtaagtggagtagctggaatttgaagttaataaatttagagtcaaagtttattatcatatccacaatactactctgcccttcaaataaataagtctgtttagaggagcaaacacattaatcacaccaatcttatgattacatgcaactgatatctcctgtgtgcctaatgcagaattctggagggttcaattggttccaattagttctttttcctgtaccagaaaagaagatcagcaataactggaattctggggtggcatggagtgggggtgttaaattttacaaacacagcatccaaaaatagtatgttcagtcatgagtattatctttaaaatagagaatataaagaaagtctgaagatcaacatttaaatcaaagaaaaaagaacaaaagtacaggtgctttgaggtttagactatgctgaaaatgccattatagagcagtccatttcctcagtaggtagccccaaaagacccctgacacagtagaaattatatcattatacaattaatcagttttctttcacaatggcacaatggggtgccctctttaactcaacagagtaaccagctcaccaacagtatctagaaaagaggaaagtcacagaatggaaaaatagacacaaaaagctatggagaagagagactgaaacagacaaaggcggttgtactataaaagaaagcgagaaatggaaagggaaatgtcagcaatctaaggttaaaagagaaaagatcaggatataaaaagatgtagaagtctcttatgaaaaaaaaaaaaaaaaagggaggggaccagtgaagagatagaaatcatgaccagagtcgaagcttgaaaacgcagggcaacacacaaagagaagctgtaatagcagagccattcactcaatcattcatttcactcattcatttaatgcctaacatatgaagggtactttgtggagctttgagagacacaaaaatgactaagacaggacccctgccctcaaagagcccagctgttccaaatattctcattttggtatgctccaatttttaatgtaattttaattattgttgtcacaccttagctaatattttcatactcaacatgtacttccagaaattgcagcaactataccatctataaaagagggtaatcttggcagggagcggcggctcacacctgtaatcccagcactttgggaggctgagatgggtggatcacgaggtcaggagatcgagaccatcctgcccaacatggtgaaactccgtctctactaaaaatgcaaaaattagccaggcatggtggtgtgcacctgtattcccagttactcaggaggctgaggcaggagaatcgcttgaacccggaaggtggaggttgcagtgagccgagatcatgccactgcactccagtctgggcagcagagcgagactctgtctcgaaaaaaaaaaaaaaaaatgagggtaatcttaaatggatggcagctgccatacagaatgagttcattcgttgtggaacggaaacatgtttacatttctgatatgctgatagtatataatgcagtattgtgatgtggttctctgtatatatagatgctgtctatactttttttggatacagcacactccacatcattctattttatttttatcatcccattccagagaggaggcaaaggacaaggaagtctaaaggatgtggaaagacaaataaggaagttaaaaaacaggttttcattttctttacaatttcccagagggcttctatgacaaaaagctgtactgaacaacggaatgcgtatttgtcatagagtagctgagagtgaattctaggtaaacatacaagggagaggctcctagacagataccattgcctagtacctttcatttaaaagatacctagtgatatatgacttgggaaaaccagaaattgacctcccagcctgcctcagtatatggtctttgctcttaccaaggttggcttgctccctgaaaagacctgaaaattcaagtttgaaaaggtgtttcatatacctaatttagaacacacccctcctagatctataagagtaggtgagaagcatagaaatgaacacctattattttgaatgctcatcttctgattcctttaatgcactgtcccgccctttaccctctccccaaatctttgtggttcttttgggatttcaattgaggtgccccatctctccgccagagataggaatgtgactcaatctaaccaatcaaaatcttctgggggaagtgtatgaatctgcagttagagagaaggctttccgagatcttgggcacttaaattcacataagtctgaagctgcttagagatatttcttcccccaccacaaagactgtgactgaagaaaagatgaagaccacatggagaagaggaggactgtgaggggggtgagagcagaggcgaatttatcctgaagctactacatcttaagcttacaggtctttctctctttttttttttttttttcccagacggagtctcgctttgtcgcctaggctggagtgcagtggcgcaatcttggctcactgcaagctccgcctcccaggttcatgccattcttctgcctcagcctcccgagtagctgggactacaggcgcccaccaccacgcccggctaattttttgtattttttagcagagacggggtttcaccgtgttagccaggatggactccatctcctgacctcatgatccgccggccttggcctcccaaagtgctgggattacaggcatgagccaccatgcccggcccaggtctttctctagcgatgtgttcatatggtcatttataatcttcttatagagaaggctctccaaactgtatgagctttgggccacaaaatcctagattcacccctgggagagacagttgtgaagatacaataaggcacacatagccacccataacagaagccagtgtcaccccactggacctgcaattatgtgagccaatattcaccctttctttttatcttgggataatccaaatttggttttacccacttacaaagggaagaaaccggagattttaaagatagaaataaagtcatggctcgtaacttgctggcaggaaaaaatgagaaccaatgctgtttttgactttcagagtatctatcataagctatcattttgtttttgtccgcatttcagtatgtggtttaaaaggaagttccaacatcatatttgtaactagttataaggaaccggcagggaacagcctccagacatttttcaaatatatttttcctttaactggctataaaggacaataaggattaagttggcaccacaaaaagtcgcatttaatgatacccttttgtgtgttacccatttaccaaacatggatttttatttctgcattctatagaatacttattcgccactgagagttccatttaaattctttgcatgcacacacacacacacacacacacacacccttccaccaccactaccaccaccatcattttcatcatcatgtgatttcagaagagcagtcatgtctacagtaaaggtatttgagagctaaacaaagcctcctggctagagatcctggtatcttcctttaaacccagatcattcatggtatgggttccctgcagagcactggttgtggccccaccaagcactgccatttccagcactgtcagtttctttaaccttcaagagaacacagaagagtcattcaaagccagcaagtgaagagatgtcctggcagtctaatttcaaacaggcctcataccagagtcttttttatggtttttaaaagaagtattttatgctgctctgatgaaaacctctaacagtagtagcttctgtctgacaaataccatagagaatgaaacaataagtctgaagcaaagggagggggtaaaattatttttgtttcaatagccaacacacaatgaaaacaagaaactatagaggtttaaagaataaccgatatttattctggtaaagacttttctcatatcagcactttaccactgtaagatgctgacaataattatgtgaatgttgctataaaaaaattaaatctcccatctcatgggtttaaaggtgtttccgcctctgccttacacacacacacacatacacacacacacacacacgtacacacacatatttcaggtacctctgtcaggatctcccaactcaattatactgcatggaggaaaaatatgtatactactactactagaataagaataaactagtaaacaaacaaatagaatacaatgtaagctgcagtacatgtaatctgaaggcctgaagctcatgtgtgctaggtttttgattgagcagtggtgggggtaaacgtggcacagcagttatcagcctggactgtggaatccgatcataccgggaaatgaatcctggcttactcattgagtaacctggtaactgaacctccctgaggcccaggttattcatcaacaaactgatgacagttatcccatggggttattatagggattaagtgagaaaatgttatataaaggtgaggagtggcagaatatgccaccccaaaatatgccactttggcatgaggattattttgagctgaaggcagttgagaagaagcagatatgagagaagctctctgtcttccccctatttgccacaaaacaggatatagatttataaaggtgccctccccacctatcaggaaagaaaaagttaatcatcagagataactctagatattcactagccagaagagacaccagaggaatctatgtaacaagctttactaactagcccttccattagttcccccatatatttaccttctcacaatttgcagaaactcaaagtcctttcctttgtcttaccatttctctaaaaatttattgctcttttttaaaaagctatataaggtcacattttaatcacccctttgagtcactcatcactgggtacttccatgtgtatgtgcaagtacatgttaataaacttctgttttttcttatgttaatctgtcatttttcactctactttagagggccacagctggagaacctaggagggtagagggaaatagatttagtacaaagagcttagtgcagagcctgtttcacaatgaagcactctgtaggtgaaagcattgccatgattaatgattgccacaaagcatccatgttggttaaacagacaccatgcctaagggcatataatgactctgaggaaagctagacttgaagaaaacacgacttgcccagccaagtaccttggtcaaaacacatatttgtttgactctatagtgttgagacttgagtatctaatatacagatgaatgagccagtacagaatttgaaatttcaacaaaaaggcaagtataatctgcctgataataataagcaacttgtaaatctttgaatggatgggcttgcctgttttcacccatgctactcaaactgtgaaccacagaacagaacatcagtttcacctggggacttcatagaaatgctgagtcttaggtctcaccctagaccttctgtattccagaattataataagatctccagatgatttgtaggcatattaaagtctgaaaagcactgctgtggaccacaaaatttaatgtactgcttatcccactttgggtgtgtttctgtgatctttacaacttaataaaccacccccaaaagttagtgactttaaacaacaatttatttgtcctgcttcttcaatattggcagggctcagtgagacggctcatctctgctccatatggtgttgactggggtagttcaacacagactgcaagatgcaagctggcttcccttcattcacatgcccttggctgacctggctgggacagttgggggctggctgggcctctctccatgtctttgttgttcttcaggacctctttccaaatggagtggtctctctcctgcagcatgatcagacttctttaagtgatggcaccaggctccaagacagtgaagtcagccatcttaaagtctaaatctggaactggcactgtgcatttctgccattttctgttgatcgaattgagtcaaaaggcaaacaaatgtcaaggggagaaaaaagactttatttcttgacgggagaagaggtctgcacagacagtgtggaaggatttgttagcaacagtttttgcagacaagctaccacagagtatctgttacttttcactttcttcatctctctgttctcctgattggtcaaacagccacttcatttcaattacacaactatatgcgaggtcccattgggagcataaggaattttaagacatgatatctcccatcaaggagcttgttataatacaattggtaaaataaggaatacatatcttgaaattttaataacaataaaatactgtaataataaaatatttaagtagcagtgccagataataacagaaatgatgtcctaaggccatgaaccatttatttaattaatcgtgcacacaataaccatcctgagtgttcagaagagagaatggaaggggaggagaatggccatggaaggacggttgtgcagtgagtaagacttgcataggaaaatgagtaaggttttcaaaaaaaaaaaaggtccaatgaaatacacacaaaggatacaacagaatcaaggagccaagggaatggggtcatagggacacaaggccatgaatgagtatctgcatgttcttcaatgatgattatcaattcaatgttcctgaaagaatttcctgcctcataacgtccacctttacttctccctttagatatgttcataagctatttgtggaatccccaccagcaatataaccttgtattaataatgaagggtttttatgaaccttataaattttattataccttgtagagagggtgggggaacaaacaaacagaaatgtaggcattgccaaatggcaacttgtaaacttcactattcattgtgtaggaactaacacttttggtattgttaagtagccttgtaaatttcactctcccttagaaaataaaaatggaatgaaaggtgctgcttagaagaaacgtataaatttcaatctccactgcaggaaaataagctctgattacactacatagttcatacacctcaatgttccgaacacttgtttttttacagattcatgtataatgacttggttttccaacaacagagagtgaaatttacaagttgttatttaacttttttaggagtgtatttttcttccatgtcttttttttcttctttgcccctactcacaccagaaacctaatatgagcaatgggatttctgaatagtaccatacattaattccttcaataacaatgattaaaacattttaaacattgttctcagggcctcctgataccacatataaaagtggggaatgacacagcttttggccacacagttcaaaaaattgctctttaccttgttggggaagaagagggcttattaaaagtttataataagcagtattactagtatttaacttctatttgttgttgaaaagaactgagcctataatttcagaggcttccgagcattttcataaatatacccattagatattcaatagccagtggatttgaatgattttgccatttattcgaacagatagctgtcctggacaggaaggatagaagcattggaagaaagtgttagaactacatttccataaagtcatgacaagaaataaagaaagaaggggagtcaccacctcaatactagaagtgtcagcacaatgatatcctcataaaaggtgttctaaaagaaacttttaggtgttctaaaataaagttataaatgccataccaagaaatactgtcaaaacaaaagtcaagtacaatacagcccagaaagaaccaaatacatctttacatcagggagtaaaaatatacatagatataatatccacaattgtcttaatttatagcttttaaatagataatatacatacaaagtgaaaaattgaaaccacaccaaagtacgttgaaaaatgtcttcccactcatgctgttaatgatctctgtaccctcttcaacatatgcatatgtgaacatatacacacattttaaatttccatgactacaaataatggcatattctaacccatttttcacttaaaaatgtcatagagatggttctgtatagacccatttttgtgatggtctaattttattacaaagattataaagtatagatattccataatttatttacagattctcctattgcttggacacttaagctgtttttaatcatttgttgttaaatgcaatgccatggcgaatatttttgtacatagaattttgtgcacctgcatgactatagttctaaaataaattactagaaatggaactgctaggtcaaaaggtatatatgcattctattttgatagttagagccaaatagctttccaaagacaatataacaattcatgcttctattcatgataccaatacatcttgcattgaaggaattccaaaacaaccaaaagttcatcatttttctgccaactgatcctttctctcttaaaaagagtcggggtaaaaatcacccatttttgcttataaccataggcagttataatcattattgcccaagattcaaggccatttcattacccactgcatcaccatcctcactgtggtataattctaactggtcagagagacctttaatttgcagaccttctcagaagacagattatctgcattctgcagacatctgcagaaagccatccacaagtgcatatttcatggctgaatatttttacataacatcagctggaacccatcgttccagcattctcgccaagtgtcacaacctgctctattatatcaataagcagtttcaattagtcattttcttcccatggtgacgacagctataatagcatgcagtagtctgatgaagtttgtaatataaagtggagatgggagtattaaaaggaagagaatacagaattagaatcgcataaaaaaatccatctcccaaatagtcatttggggaaatgacaacatttttgaaacagtgttcaagaatgaatacaaaaatgcaattacttttgaaaagtcagataaataaatttgccatgggaacacattcttgccccagatagaaccctagtttttactggctaattagtcattaagcaccatctcaaaaacaactgtatatgaaagaatattgggtaaatagaaataaaacttaaggcttaacagaattgtaaaatgaaaataaatgccaacagagaatactactttgaaagcattggatagtagtaaataaattagaaggaatgacacagttgctctgccctcaaaatttatccctaatctgttactacttcctactttgtgtgctaagattaccaggctccaaaccatgcttgccttccctggcacacagccagagccttctgactggccacctgcctctcttcttgtccccttcagcctcttctttacacagcagctgaaatgattttctaaaaaatataaatcagatcgcatcatttccttcttttcagccctctactggttttgctcataattaaaatctaaaatctttgccatggctggcaaggccacatatggaatccatctaccacttctttctcctccctacactggcctctatcaagcacattcccaactcagaccctcaggtcttgctgcttccagctaaaaggttagacccccaaatattcagatgtttttcctccttcactttattcaggtatgtcctcaaatgtcacctcatcacaaaggattatttgaccaccctatctaaaaaataacccaaaactctttatcaaatgcatgcagatttactttccttatatcatttaactccactcgacattatatgatgtagttagatgtatatctgttcattctgtatatcccctactagaatgtaacttcaatgaagatgagaagaagcaaagataaaaaagtgcatcccaaccagacagaaaaacatactatgactgtgaactacacccattgatatggtttggttgtgtgcccacctaaatctcatcttgaattgtaactcttataattcccacatgtcaaaggcagggctaggtggagataattgaatcatgggggcacttccacccatactgttctcgtggtagtaattaagtttcacaatatttgatggttttataaatgggagttcccctgcgcaagctctcttgcctgcagccatgtaaggcatgcctttctcctcctttgccttgcaccatgattgtgaggcttccccagccaggtgaaactgtgagtccattaaacctctttttctttataaattagccagtctttactagcagtgtgagaactgactaatacacccatagttgagaaaacagcatctacctgactttggttaaattcattcaactcagcaaacatttactaaactcttattagataagaaattccagaaacataggtcccagtgtctatctgttatatagtttagagacaaaaacttgcatataatttgggaggcaagacatgaaatataaactactgaaatgacaactaaaaagagttaatgatcaaaagccaacatgagtagggcaggcaataagtgtcagagagttctgaggaggagagatttgtgtaggctgagagggtgaaggaatggttcaaaaagaaggctggagaagatctgggaaaggaaaccaggaggaagaaggcatttggggtgagagcacagcaggggcagacacatagattataccagtgttccccaaacatcaaagcatggaaccttggtgttacatggtccactgacaggacaaaccaaagaataataaagttatatctctttccatttgattttaatctttctaatacatgcaatgaaaaagtattaattcagcattaattgttaaacaccttagtaacacttgccaatctgaatggcattattttactttttattttttgtacttctctttaaacttttactccctatttatgataagggcttttatttatggaataacatataattttattcatatgtaaacttctatgggtaaaaaaaagggagttgctttaatggcagtcaatcatggactaaatatctgggtcactacctacccagacacaaagcagagtcaacctttaaagtaagcaaagggggctcagtggaaaagagaagaaagttaagctcttgtcaagatgatgcagggggcctcatgtcaggctaaggattctggaaaatattctgtaggactgtggtttcccaatttgcaacaaggtcaaattccttgaaaacacacgcgttatatttgagtgtggcatgcttcttattttcaagacagcaagaaatatggcaatcttcaattccattataccatttcattatacaaacttaaacacaaagtggaaagaagtaaatacaactttatactatatgtgaattacaaaagcacaatcacaaccacagtttttttttttttttaaagctgtctatatctattatgatatgggcaagaaacagatgactcacaaaatactcaaatagggtaatctgcagaaatgcttagaaagtgtattcatggtgtggagaaaccaaggattaatgcaatacccagggacaaggcgggagcctacttatagagttcacagagaactgcccaagcaaagagcaaagcagagagtgggtaggaaaggataaattgaagataaccaatatacaaacaaggctattttcacatatttcaaatacttaccaggtcttcgaatactttacctgtctaatcacgagctgtatattttttatagggaataagagtgcataggccaggcgcagtggctcatgcttgtaatcccagcactttgggaggccgagataggtagatcacaaggtcaggagatcgagaccatcctggccaacatggtgaaaccccatctctactaaaaatacaaaacttagctaggtgtggtggcatgtgcctgtagtcccagctactcaggaggctgagggaggagagtcgcttgaaccagggagacagaggttgcagtgagccgagattgcaccactgcactccagcctgggcgacagagcgagactccgtctcaaaaaaaaaaaaaaagagtgcatatagcatggacttaaacctcagcttgccattcacttctatgtgagtttcttaagctcaatgaatttaattttttcaataaaatgggagataataacagtatccactataaggctggtgtgagaagcaaatgaataaatgtatgtaaagcacttagcacagcatttgcctataataaatatgcatgctttgggaaaatgggggagggtcatgtgagctgccaaaatagtgaagagaaatttatgagagaaaagcttaagattgcagaaattatcaatttaaattgcattagcttagtatttcatatgagttgtccaaaacatcccatattattcaactattccatttcattgataaaatacttcaaaggcatacaaagaaggaaaatagtctagatcggtagaggcaggtggggttatagtggtggtgatcagtggtagtggcagggaatagacagtaaaggcctccttcagaaggtaatatttaaaataagaccaactgaaacataaaaggagttaactaagtgaggtgaaaagtgccccaagcagaggaaacccaacatgccaaggacctggggaagaggaaacctcctggattcaacatattccacgatcaacatgtggaagagtaaacaaggcgtggggagaactgcagctggagcggtagaaccttttcagtcatgtttaaagaatttaaattacatttatcccaagggtaatgagaagcctttgaaagactttcaagcaggaaaaaggcatgatcccatgatcggattatcatcattagaaaaccactactaaagagaacagggaggcattagagagttttgagttaaggactgaacaagaaaaataatgtttcaaatttcatttttattattttattgtttacaaaaattgtaaactgccgcagacgatttctctgagggctaactgtataagtataggttcatttggtaactcactcattccgtaagatatttattaagcacctaatgcatacaccggaactgtgcatagataggggacggaggagaaaactcacaaataagcagtctaaaaagtgctaagacttgaaaggcaaacgacacttctgagtggtgggtaaaattccaaaggtggaccaggcagtgtctttgctaaaacatttttcggtatggctgaaccataaaatgcatgggccgtattgaaccactcctttcacaagaatttactgagcactgactatatgctggtattgtatagctttggtgacatggtggtgtatgagaaatcacttaaaatataatagcaataacttttttattgtaaataaggctgggttgattatcaagagtgcatgagaaagaaaaacagagaagtgaagaacagtgccttcacttaaggagggttcgaatggcaataaaatacttttaattaaaacttctctgctgagaatagacagcctttgaaagcttgtgtaaacataaatgaactacatgtaaatatattcatgatattatagctttttaaataacattataacttttaaaatgtcaaatcctttgaatatgaaatgccatcccctctccccaaaaacatgaccaccatgaattatccagttgatcttaaatcaaaagccacttacttaaaagtgaaatgttcattccttacacttactagaaaaactgcttcaaatatgatcagaccttccctttgtcttcagagaattccgctgctgaaacagacccaacaagccagccaaggtccatctggggcagcttagggaaggggcaagacatgttccctgcccaacactatcttttccaacttagcccctgatcatgccaagacatcacagtgtaataatagtaatttaataatgtagtcggccaggctctgcccacagtagaaagcatgagaaaataaatgaggcttgaaagctaaacagagagaaacttctccaggcactgcctgcagcagggagatacctggtaatgaaatacccactgatctccattcattacacaggaggcaaaccttaaaagagagtctagaaaggtggatctctcaaaatagaaataaataaataagctcacctgccatggtggggtctctgaaaatgacttggaaggactgcctatagaatttttgtggggatgcagcaaagttttgtcagatgtcaagggaggtaattattcccgacttgcttgggcacatttgctggataaattggcctctttaccttcatctccccatgcgggcaccagataaagaaaccgtgtttaaactctacagtgttctctctggcttttaccatgaaaaagaaataaaaatgcatcctgggtgcttggcaaatcagcccagtgtcagatggggacccattatctttgaccttcacatttgtgccccttgggactcacagaaaatcctcaaaaactcttttgggtaaagatatatgatgtctaggaggtacccaccttcaggagaaagaaattgcctttgcaatataaaagttgcaaaagttgaagttagtgatttctttattttttatttccatttttgtctatctgctcaaatttttaaaatttacctacaaatgctggaagccttgtttactcaaccatgttatcaacatgttaagctatcagccatttctctcccttccctgctttcctctccaatcaccaagacaacactaacatttctccatcttaccttctttaaagaaaaattcttacagttaactgtctgccatctactaccacttccagaaccagtaatgaaatgtcagaggaggaacagttaattaaaattgtggaatcctactttgcatcctctcacagtcaatacatgtacaattagagatgcctttcagcatgtggtataactagtataagttaaactttgaataacacttgatcattaaaaataaaaaatcattaatgttaagcaaatacgcagtaaacatcttgcttcattggccataaaactcctttagctcagctcaactagtgtggtagatttaatattgggattcacttagatggtgctttttagtaagaaaccaaggaacatgtctacaatctgcaagtggtttatgggaataaaaactgtgcctaattatcccacatgggtttacctaagttgtcatttttttacaaaatttctcaagtttctccacaaacgtttagggaagaaatgacatagaatggtggttaagggttcagactctggagtcaaatgttgtgtgtgtttcatccctgcctctgctacttgctaaacatgacactgccataaccatttttcttcatttctcagagcctccatttccctgtaggtaatatgaagaaaacactattcattcacagggctactgtgaggatgaaatgagataatgtacacaaagcattttaaatagtgaccagaaccttgtaaagattaagtaaatgcaagctggtcctcctaattgataccttattcattcaataattatacttcctaaaagagtctggtaattatgtatttaaaacatattcacgaggtggagccaagatggccgaataggaacagctccagtctacagctcccagagtaagcaatgcagaagacgggtgatttctgcatttccaactgaggtaccaggttcatctcactgaggagtgtcggacagtgggtgcaggatagtgggtgcagcacactgagcatgagccaaagcagggcaaggcatcatctcacccgagaagcacaaggggtcagagaattccctttcctagtcaaagaaaggggtgacagacggcacctggaaaatcgggtcactcccaccctaatactgtgcttttccaatggtcttagcaaacggcacatcaggagattatatcctgcacctggctaggagggtcctacgcccatggagcctccctcattgctaggaaagcagcctgagatcaaagtgtaaggcggcagcgaggcttggggaggggcccctgccattgccgaggcttgagtaggtaaacaaagcggcctggaagctcgaactcggtggagcccaccacagctcaaggaggcctgcctgcctctgtagactccacctctgggggcagggcatagacaaacaaaaggcagcaaaaacctctgcagacttaaatgtccctgtctgacagctttgaagagagtagtgattctcccagcatgcagcttgagatctaagaacggacaaaatgcctcctcaagtgggtccctgacccccgagtagcctaactggcaggcaccccccagtaggggcagactgacacctcacacggccgggtactcttctgagacaaaacttccagaggaacaatcagtcaggaacatttgctgttcaccaatatccgctgttctgcagcctctgctggtgaaacacaggcaaacagggtctagagtgggcctgcagcaaactctaacagacctgcagctgagagtcctgactgttagaaggaaaactaacaaacagaaaggacatccacaccaaaaccccatctgtacgtcaccatcatcaaagaccaaaggtagataaaaccacaaagatggggaaaaaacagagcagaaaaactggaaactctaaaaatcagagcgcctctcctcctcgaaaggaacgcagctcctcacaagcaacggaacaaagctggacggagaatgactttgacgagttgagagaagaaggcttcagacgatcaaactactccgacctaaaggaggaagtttgaacccatggcaaagaagtaaaaaaccttgaaaaaaaaattagacgaatggctaactagaataaccaatgcagagaagtccttaaaggacctgatggagctgaaaaccacggcaccagaactacgtgacgaatacacaagtctcagtagccgattcgatcaactggaagaaagggtatcagtgatggaagatcaaatgaatgaaatgaagcaagaagggaagtttagagaaaaaagaataaaaagaaatgaacaaagcctacaagaaatatgggactatgtgaaaagaccaaatctacatctgactgatgtacctgaaagtgacagggagaatggaaccaacttgcaaaacactctgcaagatattatccaggagaacttccccaatctagcaaggacggccaacattcaaattcaggaaatacagagaacaccacaaagatactcctcgagaagagcaactccaagacacataattgtcagattcaacaaagttgaaatgaaggaaaaaatgttaatggcagccagagagaaaggtcgggttacccacaaagggaagcccattcagactaacagcagatctctcagcagaaaccctagaagccagaagagagtggaggccaatattcaacattcttaaagaaaagaattttcaacccagaatttcatatctagccaaactaagcttcataagtgaaggagaaataaaatacttaacagacaagcaaatgctgagagattttgtcaccaccaggcctgccttacaagagctcctgaaggaagcactaaacatggaaaggaacaactggtaccagccactgcagaaatataccaaattgtaaagcccatcgaggctaggaagaaactgcatcaactaatgagcaaaataaccagctaacatcataatgacaggatcaaattcacacataacaatattaaccttaaatgtaaatgggctaaatgctccagttaaaagacacagactggcaaattggataaagagtcaagacccatcagtgtgctgtattcagacccatctcacatgcagagacacacataggctcaaaataaatggatggaagaagatctaccaagcaaatggaaaacaaaaaaagcaggggttgcaatcctagtctctgataaacagactttaaaccaacaaagatcaaaagagacaaagaaggccattacataatggtaaagggatcaattcaacaagaaaagctaactaccctaaatatatatgcacccaatacaggagcacccagattcataaagcaagtccttagagacctacaaagagacttagactcccacacaataataatgggagactttaacaatccactgtcaacattagacagatcaacgagacagaaagttaacaaggatatccaggaattgaactcagctctgcaccaagtggacctaacagacatctacagaactctccaccccaaatcaacagaatatacattcttttcagcaccacaccacacctattccaaaattgactacatagttggaagtaaagcactcctcagcaaatgtaaaataacagaaattataacaaactatctctcagatcacagtgcaatcaaactagaactcaggattaagaaactcactcgaaaccacacaactacatggaaactgaacaacctgctcctgaatgactactgggtacgtcgcgaaatgaagacagaaataaagacgttctttgaaaccaatgagaacaaagacacaacataccagaatctgtgggacacattcaaagcagtgtgtagagggaaatttatagcactaaatgcccacaagagaaatcaggaaagatctaaaattgacactctaacatcacaattaaaagaactagagaagcaagagcaaacattcaaaagctagcagaaggcaagcaataactaacatcagagcagaactgaaggagatagagacacaaaaaacccttcaaaaaatcaatgaatccaggagctggttttttgaaaagatcaacaaaattgatagactgctagcaagactaataaagaagaagagagagaagaatcaaatagacgcaataaaaaatgataaaggggatatcaccactgatcccacagaaatacaaactaccatcacagaatactaaaaacacctctatgcaaataaactacaaaatctagctccctctccctctccctttcatctccgtctcccgctttccacggtgcccccctccctcgtctccgtctcccactttccacggtctccctctgttgccgaggctggactgtactgccacgatctcggctcactgcaacctccctgcctgattctcctgcctcagcctgccgagtgcctgggattgcaggcgtgcgctgctaagcctgactggtttttgtattttttggtggagacggggtttcgccgtgttggccgggctggtctccagctcctgacctccagtgatctgcccgcctcggcctcccgaggtgccgggattgcagacagagtctcgctcactcagtgctcaatgttgcccaggctggagtgcagtggcgtgaacctccacctcccagccgcctgccttggcctcccaaagtgctgagattgcagcctctgccccgccgccaccctgtctaggaagtgaggagcatctctgcccagccgccaatcatctgggatgtgaggagcccctctgcctggccacccagtctgggaagtgaggagcacctcttcctggccttcaccccgtgtaggaagtgaggagcgtctctgcctggccgcccatcatctgggatgtggggagcgcctctgcccggccgccccgtctgggatgtgaggagcgcctctgcccggccgccctgtctgggaggtgaggagtgtctctgcctggccgccaccccgtctgggaggtggggagcacccccgcccggcagccgccccgtctgtgaggtgggcgtgcccccacccggcagccgccccgcctgggaggtgaggagcccctctgcccggccgccaatccatctgggaggtgtacccaccagctcattgagaacaggccatgacgatgatggcggttttgctgaatagaaaagggggaaatgtggggaaaagaaagagagatcagattgttactgtgtctgtgtagaaagaagtagacataggagactccatttcgttttgtactaagaaaaattcttctgccttgggatgctgttaatctataacattactcccaacccagtgctctctgaaacatgtgctgtgtcaactcagggttaaatggattaagggaagtgcaagatgtgctttattaaacagatgcttgaaggcagtatgctcgttaagagtcatcaccactccctaatctcaagtacccagggacacaaacactgcagaaggccacagggtcctctgcctaggaaaaccagagacctttgttcacatgtttatctgctgaccttctctccactattgtcctatgaccctgcgaaatccccctctctgagaaacacccaagaatgatcaacaaatactaaaaaaattaaaaaaaaaaaaaagaaaagttcaaataaagtgtatgaaagaactttaaaaaaaaaaaagaaaaaaaaagtgcgaaaattagccaggcatggtggagtatgccttggggtcccagctactcaggaggctgaggctagaagatcacttgagcctgggaggcagaggctgcagcaagccatgattgtgctactgcactccagcctaggtgacagatggagactctgtctctaaataaataaataaataaataaataaatcctatttttaaatgctaaaaaaaaaaaagaaaatctagaagaaatggataaattcctcgacacatacaccctcccaagactaaaccaggaagaagttgaatctctgaatagaccaataacaggctctgaaattgaggcaacaattaatagcttaccaaccaaaaaaatccaggaccagatggattcacagccgaattctaccagaagtgcaaggaggagctggtaccattccttctgaaactattccaatcaatagaaaaagagggaatcctccctaactcattttatgaggccagcatcatcctgataccaaagcctggcagagacacaacaaaaaaagacaattttagaccaatatccctgatgaacatcgatgcagaaatcctcaataaaatactggcaaaccgaatccagcagcacatcaaaaagcttatccaccatgatcaagttggcttcattcctgggatgcaaggctggttcaacatacgcaaatcaataaacgtaatccaacatataaacagaaccaacgacaaaaccacatgattatctcaatagatgcagaaaagacctttgacaaaattcaacccttcatgctaaaaactctcaataaatgaggtattgatgggacatatctcaaaataataagagctatctatgacaaacccacagccaatatcatactgaatgggcaaaaactggaagcactccctttgaaaactggcacaagacagggatgccctctctcaccactcctattcaacatagtgttggaagttatggccagggcaattaggcaggagaaggaagtaaagggcattcaattaggaaaagaggaaatccaattgtccctgttcgcagatgacatgattgtgtatctagaaaaccccatcatctcagcccaaaatctccttaagctgataggcaacttcagcaaagtctcaggatacaaaatcaatgtgcaaaaatcacaagcattcttatataccaataaaagacaaacagagcgccaaatcatgagtgaactcccattcacaattgcttcaaagagaataaaatacctaggaatccaacttacaagggatgtgaaggacctcttcaaggagaactacaaaccactacttaatgaaataaaagacgatacaaacaaatggaagaacattccatgctcatgggtaggaagaatcaatattgtgaaaatggccatactgcccaaggcaatttatagattcaacgccatccccatcaagctaccaatgacttccttcacagaattggaaaaaactaccttaaagttcacatggaaccaaaaaagagcctgcattgccaagtcaatcctaagccaaaagaacaaagctggaggcatcatgctacctgacttcaaactatactacacaaggctacagtaatcaaaacagcatggtactggtaccaaaacagagatattgaccaatggaacagaacagagccctcagaaataatgccgcatatctacaactatctgatctttgacaaacctgagaaaaacaagcagtggggaaaggattccctatttaataaatggtgctggggaaacctggctagccatatgtagaaagctgaaactggatcccttccttataccttatacaaaaattaattcaagatggattaaagacttaaatgttagacctaaaaccataaaaaccctagaagaaaacctaggcaataccatttaggacataggcatgggcaaggacttcatgtctaaaacaccaaaagcaatggtaacaaaagacaaaattgacaaatgggatctaattaaaataaagagcttttgcacagcaaaagaaactaccatcagagtgaacaggcaacctacagaatgggagaaaatttttgcaatctactcatctgacaaaggactaatatccagaatctacaaagaatcaaacagatttacaagaaaaaacaaacaaccccatcaaaaagtgggtgaaggatatgaacagacacttctcaaaggaagacatttatgaagccaaaagacacatgaaaaaatgctgatcatcactggccatcagagacatgcaaatcaaaaccacaatgagataccatctcacaccagttagaatggcgatcattaaaaagtcaggaaacaacaggtgctggagaggatgtggagaaataggaacacttttacactgttggtgggactgtaaactagttcaaccattgtggaagtcagtgtggtgattcctcaaggatctagaactagaaataccatttgacccagccatcccattactgggtatatacccaaagattatgaatcatgctgctataaagacacatgcacacgtgtgtttattgcggcactatttacaatagcaaagacttggaaccgacccaaatgtccaacaatgatagactggattaagaaaatgtggcacatatacaccatggaatactatgcagccataaaaattgatgagttcatgtcctttgtagggacatggatgaagctggaaaccatcattctcagcaaactatcgcaaggagaaaaaaccaaacactgcatgttgtcactcatagctgggaattgaacaatgagaacacatggacacaggaaggggaacatcaaacaccggggcctgttgtggggtggggggagtggggagggatagcgttaggagatatacctaatgctaaatgatgagttaatgggtgcagcacaccaacatggcacatgtatacatatgtaacaaacctgcacgttgtgcacatgtaccctaaaacttacagtataatttaaaaaaataataaaaataaaacatattcacatatttacgtattcatgtatttaaaatatattcatttattttacactatgtgcaactcatttttctacttaagaattagagagatgacatttcggaggcccctaattccaaatgctgccgcctgtttttagtacagatctgtgttaagcaaaggaaaatgaagcggtcaaatcgcctcagaagcttccggcttccacccctgtttgtaaacgaaactccatattagtcaaactacactccccagggagcacctgtaaaagtccctgatttacagaagtatttactttagggtatggagtttgttttttcaggtttatctctgggagagcttggtgaagctgacagtccagcaattttattaaactgttcaatttcagcattttttaaagagcatatataaagaacaccggcagtagctatttaaatttcccagtggatgctagaaataataaaaggacacttaaatgaccatttttgagcagagccaacagcatgtgtcctaattatccaactatgtgaaaaattctgtggatttttaccagagcacaagggtgtgatatgcacaattcagaacactaacggctacctcactagggtgtagagaacttttcaagtctaaatataaggtcccagtctgccagggtaagtttttctgctactttccctcttgatgaacttgttagacatgataaatggacaacatggtaagaagttgatatggtccactgataagcctctgatgaagaacaagtaaataaaaaaccattgtgctaagtgctctccttcatttattctcacgatcacattctgaggtaggtattactatgcacattttacaggtcaggaaagcaaagctcacacaggataagtgccttatcctacagtttaagtatccaagctggtgttctgattttcctccactcacctcttcctatctcttctccacccacctcttcctatctcttctccacccttctctgccctgctggtggtctcttccttactgatctctacagactcatctcccgtgccctttggtttctatagggctaagacaatggcaggcagcattaagggatcagagaattggaggaaagagtctgggggtatctattccccatttcctctctcctcccctcacactgcacaactgagacttttgacaagtgcccacatttttctagctttgactataatttctgtcagtggccctttttccctaattcctagctagggctctcattggattcttgtaattctgttctctgtctttgctccttcagactttccatagttgcttcaccatcttttttggttcccttaaatctacccacacctctgtcaatcttctgttcattaaactctcttccaacctctcagttttggtgtcatccactttctgctggagaaaggagggtagcccctagcagttggtacctcctcctctctagcttccctttcatctacccacaaccaaccactcacccttcccttgtagccagtcacaccacaagcaagtctgtgactcagcaaactggctcccagaaacaaaccctaggagcataattgaagatgaacccaaagatacagttataagtatgctcgtggagaatttgtaattttttaaaaaatggtagttatctaagaggacttgattaatcaatgaagggacattcataaaatgaaaaattataaatgattaaaaataataccataacttatatttcatgacatgaacatattctcaatatattaacttcaaaagggaagatacaaagttgtgtgtagaataactcagtttttctttgtaaaaattttgtatacatggggagaaaatggtccaaaagagaccatccaatagaaatacagtacaaggcacataagtaattttagtgtcagtagttacgttttaaaaagttaaaagaaaccagtgaaattcatttagtgatatattttagtccaacatatgcaaaataatatttaatcatgtaagcaacagaaattaataatgtgatatattgaattcttcttttgcatatgaagtcttagaactccggtgtgtagttgacactcagagcacatgtcaactcagtcttgctacattttaaaagctcaagagccacatgaggatagtgactaccagattggacagctcaggtaagcctcaaaagcgggtgtgtagagtaggaagttgaatgttcttcactttcttattatttttctccttttttaccattaccatttactactgatgcatgtcacctctgcaattagaaaaacaaattatttttaaacactaagagcaaggcttttttcttctgtctctggaacactttttggctcatgtcctttgcaattcacagactacacacttactagtatagaaaggtgccctcctttcttcccctccctttacattttctttggatagctacctatcttcagccctcaggcataagagtaagaatcaaatgttgattttcttcagagtggctgctgagccagctcccactctccagtggtgtgacccggaatctatcaggcctcacaccactgttttagcagctctgaatggcttgtggaagggcatggaatggggccagaaactgcttaatttgaggttaattaaatagtgatgacaagccttaatctccaacttgtcatcagattgtaaacactgattgcagctgcagcaatctgcaataaacctattgagaggaatcttgaccagaatgaaataagtacgttggttacccagatgaggctgggagaggtgagatcagagaaatctaggcttttgcagtaccaggagaaatggagacctgaaaagagggaaattcatgggcgaatgtgtcaattctgattcctgtacagccctatcaaaaaaaagaaaaaaagaaaagaaaaaataactggatcccatgcacctggaaattggaaagaacaagggcagaaatataaaaccactaaactaaggacctggaaaaagctgaaatagctttacatctattagccattgatgaggtttccatgaaaaaatatgtctgagccactgcatgccctgaggccgctggacagatggttataccaccagagtgagctacagcagtggctttctagagtgcaggcaaggatgacagttacagtgtgttaggtctctactgtgtctcaagcacatcacatgtaacgtatatgataattctcaaaagtactttatgaggtagctattattttctccattttaaagaggagaatgctaaatctcaaaggagtatcctaccttgcttaagtacatgtaacaaatgggttgaacccagactgtctaatgccctaatgcaaattctaaatcacaagaatctctgcctccagctttgaggcaatgttgaagtgggaaaggggaaagaatagtcaagttcctgaagaagatgggaaaaaatgagtcaaaaatctccaaagaatagggaagcacaaagggctgaggtaacaaatgccagatgagtaaacatgttcataacactgcaccccggaaagtgcccctcctggctccattttcatggagaatgctttctcattcttcaagatccagcacaaggccaattttcacctcttctgtgaagccttccccaaacctcctagtgagagaggcactttaaaaaaatatgtgagatgcattgagagacagatggacaccataaaagctgaactcaatattacatgtgaagaaaatttacaaaaaaatcttaatctgagtgtcagaaaaattggagtagtgaaagaaccattacagttattgtcaaatagttaattaactattatgtaggtttaaatccatgtattcttccttaaaaccttttggaacaagataaatcattctcatccattcatttattcattccctagcactgtgataacactagagaaataacaatgaccaaaaacagacacaattccactctcgaggtacacatgtttaaaagggaaaacagagtaatgatacaaaaatcacacaaataaatggacaattatgacatgtgttccaaataagaggtaaatgagatgttattattttatccaggatacaggactggaatcattaaagagaatacacagggaaataagctgcagttcattatttggaaaaagtttcaaacaatccacacagaaatggccccacacatgagcctgctctcttctgggcattggatgtgtcccggctgaggcagggaagacaagggtgcatccgtcgataacttctcaagtctcttctgactctaagaaactgtgaccctatcattccaaacaaaatattttctcagataagaattagaattggctaggttgaatttccaggagacttaggaaatatgtacagagaataatcacttcctaaatagagaggggagtcaagcaaaactgagtcttctaaactgctcggtagcattctccttctcttcgcacatggacacacttctgctttatgcactgccctgacagcttcctgaggacagaggctgatggtcttgctcatcactgaatcatcaatgcgtggcacatattaaatatttgttaagtgagtaaatgaatatggtactaaaatgtgcatactgacagaaacttttttctgttgtggcccttgtaggtgaacttccttgaataattaatgaacatgaaagtcagtcaatcactcacctcctgattaatagtcagggtcccttgtccaaacagccacttagtccattaaaaattaataattttctacagaataaatatatgctgtacatggtacatcaagggttccacttttaatacgcaattaagtaatgcagaaagactaggaatctattaactaagaaagagctccatgaacttgccctccaagtcatcattcatttactatccatttctcttccaattttaaaaaattatttagccagaaaaaaagtagttctgaaaacagagtaaataacaacatgttgtcatattttggctaacatttgcaggccgacacaatgtgtgtttgttaaagatttgagatatgctattccttctgtgaaatgacgaatacattagggcagatcaatacaaaactgaagctctatatgtaaaatgttaagggtctattcattgaaaaattatgagccatgttatagaacttaggtcagagttaaattattgatctacattcatttttcccctttccatgtgactatcttttgattttttataacatacattattgcctatgtagaaaatgaatcctcttcttctagagctagtgtgtctggtgactgacaattttctaaaattaactgttgtgttggtagcatttagatttgtaaattgaactccccttgcataaacatttaaacattgaaaataaaatctgtaaactttggtagcatgaactcaaagggaaaagaggataattttcattttttaatacaaagaaagcaaagaaaaaaaggaaaggttatttttcttaacatcattctactactttatggttcttgatacatttcattgatgaggccaaattgtattcagttgactttttacaaatgactaaactgtattgctaagcaaagggatgtaatcaacactttgtgagctgaagtctcaattttcagacctaaagcttactcaagatgtataacctcaaattctgtaagcaggttagatgtcttgaaatacaaagactctcatcccctatcagcccccaaagtgacaaaggaatgtgtcttcaatgaagattttctctcatctgctgaaaagggaaaatgtgcaaatatttcaaagaaatgtagattccacagacccacattaattcatgaaaaaggaagctaatgtaagagttcttagtaggaatgatctttgatttggggctgtatttggtcagtaacttttgcctactaggagaatattttctctttaacgaagtagtatcagacacagagggctcttcattttctctaatggagatacaatcatttagattcgtgctccaaatgaggcagaaattacccctaatgtgtagtttgaacatttgtatcaaaatacagtgaaatgctgtttcagagtctgatgagaaaaatatgtgagctcacagaatgtctgcctctctcaggtgcagaagtggtctactgctttttttttcttttttcttttcttttcttttttttttttttgagatggagtctcactctgtcacccaggctggagtgcaatggtgaggtctccgctcactgcaacctccacctcctaggttcaagcaattctcctgcctcagcctcctgagtagctgggattacaggtgcacgccatcatgcccagctaatttttgtatttttagtagagatggggtttcaccacattgttcaggctggtcttcaactcctgaccttgtgatccgcctgccttagcctcccaaagtgctgggattacaggggtgagccaccacgcccggccctctgctacttttcttcacattgtcactgcaggaatcacctggctctagggggatatcccacagtctcacataaataccaatccctgtcgctggaacaagggggtcccagcctcacagaaggcctgagggactctgtttctctacaggtcagctccaaagcagagggccctttgcaccataaatcaatgtcatccacagaaaactccaggagaaagttaaataccagcagcaaacaatgtctcttgtgtagcagtctctcaccactgtttctgctaggtgacaaaagcagtgagaaaagcagaggaagcaagggctgaagacagaaaagtcaaagaattgcagaacttgagagttggaaaggggcagagtccaaataggaaaagacttaagcttcctactgtgttgtgctatgtagaatgctgtatgaggaagggcagcaggctttctccccagaagcccagctgaaagtcatccacactttacatggtcccctataccaggcttcagcccccttggccttggttttctcaacacacagtatggaatccatttctcatgagatggacttcattaaacacactcatgagaccaacatataaaaccagaatgtcaaagtagtagtctacgatttgcagtatagctgttgcacagatgtcagaaagaccaatacattcattcccttcctgtaaatgtcttccctgcaaaaccaaatcctaatcaggcagcaatctgacatgtaaggaatctgaacaagaggagttcatctgatgaactgaatgttaaacagcgtcaggggagatggagtcaccaatgggaaagaatacccaatgtcccttggctgcagctctctacatccattgccgtaacagaaatggccttgccaatagaaaaacaattctccaagtttctcacaggaggtcccgtcccctccaaagagagctacatgtgtattctttgtgtatttttatcattgagaaacataatttgaatgggaaagcctttctttcgttctaaaaaccctgcatcatttttctcattgcaggttaaaatatgttcattgtaaataatgaacatacggaaaagggtaaaagttattctatttcttccgcccagaaaactataggtggataatctttcagtctgtttctatgtatacatcttaggttgtccatataaaattatcattttgcagataaaaagcagtcaattaggtgcaattctacatggtccaatctcatatacatacgcacattacattaaagtcaaatgacaccttaacttctactttgttgcttttctttgaattaactagggctcatatacagttttccatgttactcggtaataccataattgattctcttgcacgcacttgtttaccaaaacttctcattatttccttagggaatattcacagacatagaagtgcttggttaaaggatttgcacacacacccattcatgcatatactgtctaaggttgctctcatcattaacagcagagttgagtagttgtgaccatactaccaaaaaacctgcaatatttaccctttagtcctttacagaaaaaggttgccaaccctgacctagaatccataattaactagatacagaatccagacatccattcaacaataggacacagacttcctatttttaaaaaattcaccgtgactacaagcagatctgcatttaaaatattttattcccattagtatttttaattggtccaaatgctctatgtgatataacttcactatcattagaatagtattaaagaatactattagaaaaatgtagctccattatttttactacagaaattattataaccgaagacataaatgcgaaccaaataaaacaaaataagttgtaaaaattcctttcttcaacaattgcataataatctataatacacatagatatacatgttcttaaatatttcatgtaaaaattggttactatttaataattaattttagaaacattaaaagaaatttaacttctgggtctttgatttgaaacagctaagaattttagactggtttccatttttaatcatgatcaagactcagaaacgtagctaagaaaaatcatattgtactttttattgaaaaggaatcacacagaccatgtctgaattattataaaggcttcattaattagattttaatctacatgactataccatatgctaaaaaaccatccaaacaaactctatgaaacggttttactgctattacttaaagagccatttaaaagaatttctacgggataaagactgggtgatttatcatagttttatgctcctttaatctgctccatcttcccattgtaaaataaatattggttttaaaataaatggttctgcccaggttttgatgagaaaaattgccctgtaaatcacaagctcacgtgtgccaaactctaagtccaatgttaactagcctattctgaagaaaaataagtcaattttatagaacaaaatctaaagaagacaattacttaagtgtattttcaaagctgcaatgtaattaatctgagatatgagcttctgtaccccaagttttttaattctcaaaataagaactagtggatatcaaactggtcctccaactggattttttaaaaatgggttctgtactatagtttttattatattctttccgaatccaatatacaagttatgtaactgaaaataaatacaatgagggttatatgataatgtctgagggttatatgatgacatctttatcaatcacttttttcatacacagagagccaaatcaatttaatagtcaggttcttagaatatttcatagtgttctgaaaaattgaccttacagtatacatattttcctataataagcatagtggttaaaatgctctggaagttatgaatggtttaaagcagtgcttcacaaactatttaggatgtaaaactagttgactatatttttcactccaatatgttgtgggttggtgatacttttataaaatacaataaaaattgcacttggatttagtggtagtgtcaaactgctatgacagtctctaaaccagcactgtccaacagaaatatcataggagccacatgtctgattttaagctttctagtagccacattaaaaatgtaaaaagaaacagttgaaattaattttaataatattttatgtagtccaatagatccacaaccttatttcaatatgtaatcagtatacaaatataatggagatatttaactttttaaaaaaattaagtcatcaaaatccagcatgtatattccacttacagcatgtccccattcagactggccacatttcaagtactcaacagtcacatgtagctagtggctgttgtgtgggaaagtgccattttaaaccattactcccaaactctgcacctccctcttcatgaactggtccacatacaacactttgagtagtactgtctaaactactgctcccttaaaaatggcaccttcatttctcttctataattttctactctgtgttttaaattgagggctccattccagataagtccaacacttaaagaaattaacaaactcatgattgcagctaactttatacatcctttcaggaaaggaatttgcatttataagggatggatacggaggtcccctctgctctcccttctctagaagcaatcactattctgaatgatattggtttctttctttcctatccatgtttttatactttttctactgactatgttcttaggatttaaataaagcaaagagaaaatttgtttgcacattgctgagatatatgaatttaatgcgtttagctcatacaaatcctgaccatattccatggcaaccactgaaaccgaatcacacacctttctacgtttgcaccctctgatcccctattcgtccttcataccacactgctttgatatatcattttctttctgctctgtatttagactctgttccaccttctagcctggataatttctacccattgagatcaaagcttaaatatcacttcttcaagtaacctttgttgatctgccctttgccctggtaaaattaggttccctgtcaaacactctcacttttcctatactgcacttaccaaaattgtaaatagtttctgttgttgttgttgtttttgagatggagtcttgcactgtcgcccagggtggtacaatggcacaattggctcgctgcaacctccacctcctggattcaggcaattctcctgcctcagcctcccgagtagctggattataggtgcccacagccatgcctggctaatttttgtattttttagtagagacaaggtttcaccatgttggccaggctgaagtagttattttttttactgatttgtttaatgtctctctcattcataaaaatatgttagcaccagcataattaaaagtatacagtaggtatccacaaatattaattgagtgaatgaatgaattttcattctcagaagccagacttaacctggtcattatgtttctcaatctctagtcatgacactagcttacaatgtgtatatcatggatatatatacatagggtatccctgttaattagaaggtatattttcaagagtatggccataaagaagttattcatggtatattcttttgaccttctattttcaattgtctctatatttagctcccatttttcatttctaatactgtttgtatttctctctctctctctctctttgttcttctctctttgtagttgatcaagtttgacaagtgagaatgtgctgttttagtctttaaaataatcattttttgctcggttgatcttctctactgtttctttgtattctatttcatttttggtaatatttttgtattattccttccctctactgtatttgggtttactctgctattttatttatacctttttaattgaatccttaattccctaacaatgtctccttccgtttctaacgtatacatttatgagtctataaatttccctctatatacctctttgtgtcccacaagacttaaagtatgtactaatttctatcatcatttttctttgactcacaaattattgacaggtacagttttgagtttccaaatgtataaagttttgaaaagtatcagtttctaatctcctgcttttttcctctgaaataaagaattagtaaatataatttttattcatcagcattaagactttctatgtgtgtatattatctgttagtggagtttgaagttctatatatgtctatttgtccaagctaaccggttatgtggtttaaatattctttatcttttctaagcttcttagcttgtttgatttatcagtgtctgagagaaaaatggttaaaactctcagattatgattatatgggttttcaatacttcttggtgactgtgtcaatttttactttctatatttttaaaaggatgctactaggtaatgtaggctcaggattaactcttcctggtgaattgttcttttatcattaaataataactctttatctgtaataatatttttgcttttaaagtatattttgtccgatattaatagtgtcaccagctttcatttgaatgatatttatatgatgtattatgtcaatttcatctattttctcttaatcttcccatgctattatccttaattgggttgttccttgtaaacagttaaagagagtatagctgttctctctatccaacttaagaatctttgcctgcagacagataggtttaatcatttgtatattggctttgattactgattatttggcctcatttcaactaattaatctacagcttcctaaaagtcagtaattatggcctctcactgaaccaagtactgcataccatagcaagcattgctgtatctatcttacactcataatttagctgttctcaataaataatttagacacattggcaaataatattctcttaaagcttcaagctcataagtacttatatatataacacagaaaatccccaactaagatggctaatccactactactcttatttctttacctataacatgaaaataagtgaatccacttgtcatctacctccaatgttgctgtactttcctcttcaacctcctcatttttaaaaatttctatcgggaacagctctcattctgtctcttctacctttcttcttccctatcccagtctctcacctgttaccttgacaattgaattagtatcttttctctccctgccttcatcctaccacctaacaatccaatgtttcctccagttaaatgagggtcgcatagtataagttaagaaatttgaactttaccctacagctcagtgtttctcaaactgaacccaaaggcacagtatcatagctccaaacattctatgagaatatgctttaggtttttatggttttattccaattaatgtcctgaagaatctaaatgacaacctgataattgagctatgctttccaaaagcagtgcctgagtttgtcttttttttttcctccatcaactctgttctgttctcagtatcactggaaccaaacaatcactttaaatgacagcttttaactttcagtgtgtcagtgagcacatctggctgctaggttggcatgtcctaatgctaaaattgtcccatgtctgctattgtgctcttcttgaagataatttgcaatggaaagatagtgtcatggaataagactttaatttattaagttatttaattaatggagactttgatatgacatcataaaaactcatagtgtggcagagtaatggtctattttaattgttatgggctaatgagaaaagaacaaaggcagaattaacatgtaaatgatgcgtttatatcaaatgaaagccaaatgatattatgggacagtgcaaaaggaagtttcccaatttttcaaatagagaaaagtggtgagaaaattgagtcatcatgtggctctgagtagtagaggcatgccaaattaagagtctttgccatagtagtcagcacactttattgatgaaacattaatttatcaaatatatgttaaatacttcatcaataaacagtgagtgttaaacactgttctaggcactaaggatacagaagtcataagatagtcaactctccagtgtcacggaagttatattctgacaataaaaagatgaacatgaatttataatacaacatcagggagtcgtaagtcttgtgaaggaaaacgaagcagggcaaagagatggaggatgatgagggaggaggaaagctacagtaggcaagatgatcaagggaggattctctgagaagatgacatttgagcagacacctaagtgcaacaggaggcaaaggcatacaaatatctcggggagaagatttccaaacaaaagcaagagcaaatacaaagatgttgagaagaacagcaagaaaaccaatgtcaacagactgcagggagaaaggagagtggtatgagactaggtaaaaagaagagggctgaatcttgaagagccttgaggtcatagcaaaaagcctgaatttaattctaaggatgatggggagttactacaggttttttgttttgctttgatagagtctcgctctgtcacccacactggagtgcagtggtacaatcttggctcactgcaacctctgcctcctgggttcgagtgattctccagcctcagccacctgagtagctgggattacaggcatccatcaccatgccccgcttattttttgtatatttagtagaggcagggttttgccatgttggccaagctggtctcaaactcctgacatcaagtgatccacccgcctcagcctccctattacagggtttatacagttcatgcagaataccagaaagggagatggggactgtggggatggatacaggtaggcttgtagatttgctagagaaaataaggtagtttcttctgattgtttctctttctccagtgaaataagaagtgagacaatcaactgattgagagagctggggatggccattggagagttgaggtacaggtgaagatataaaatagttttctcagaaagtagaagtattaggtaaacaatgcaggatcaccgtgtagaacagaggatccactgcagtcagcatagttgtgtgtcctccatccatccacactcaggcccaaagtaggtggaaagctgaatgagggtcatagttttgccagataagaatgacagagaaagatgagcaaaggagttcagtgtgcatgtaaagaagagaagaaccatagcatctgagctgagcaaggaggaaagtgaggatacaggaggatgacggattgtacataaatcctgtaagtcaacagattggaggccccacaggatcaaagaactgttggagtagagatgctaatgtcacctgaggcagcagccctgaaaagataggaagtggtggtcagagagtgggatgctgtgaaacatactttgaaggttagcatggcatttcataacaagggcactattggcatttggggaaaacaattcttcatcgtgcataacagtctcatgtactgaatgacatttagcatccttaacttctgccctctaaataccagtagcactccttacatttgcaattactccctaggagagtggtacttcctagattgtgaaccattggcctggggtatgactatgaggtagggagagatatttgcaagtgagaaactcagggacctgatagaccaggtatgagtattctctgtggatgtttttactgagaatgatgagtataaagacagggcgctggggggaacgtcttcaataaatacagaggagtaggctgtagaagagttttatggcatgtgctttaaaagcctctgcggaggaagagaaaaggaactgtctagaagtgacaatgaacaataccagaagacaccaactccactgtcagacactgagaaaaaaacagacacccctggagagggtgatggggaagcctccttaagagtttgccaagagtatcaagcagctatccaaaagaactttctgtgatgatggcaatgttgatatctacgccatcctataagatagacaataggcacatgtacttcttagcccttgaaacgaggccagtgtgtctgaggatgtgaattttttactttgatttgaacgaatttaaatgtaaacagtcagatgtggctactggctaacaaattggatggggcagaacagtaaaaggtgaaggaagcattcagaagacaaaattcttcttaatctctgagtcttgaggaaaagggcaagggcaggtatgagtctagggaagtttgtacatttgtagcaggaagaggtgaggagcatctaatagcacaatagcatcagcatttccaataagcaggattccaaaaattcattttaatttatttcagcctcctctcagactaaattctataccatattgttgtggaagacccttaaaaaaaaccctcaaatatttaaaatatcaccatcatgtaagaattatttcttctcctaagaagcatctggtattaatagactatgactatcgcgtgttttctaagatctaagtgtcccttccctccaaagactggctatctatatctaacaaaggaaaatgtaacatttgaaaattccctgttaaaagattttgttgtcatttggaaatcatatttcttgctgtttgcatttctattaaaaatataaagaaatttgttctttggtatcccaaatgaagtaaaagtattctaattggttgcattcacaagtctacaatttgcggcttaacaaaattatttttgaaaaggtcataacctgtacccacatgcccacccaaccacacacacagacatccagaatggtcttgtgatcatgtcttcagaagtttggctgcaaagttacaagcaacaactgtccatctgcacccaccaacctagtgaacaatgccagtctgggacccaaggactatttactcaacagaagaattccaacttcaggcaggggataggcgaagtccagataacatctagatatttcttgacattgcatttgattggaaataaaggaaaagtaaagcatttctggttagtttctgtttcttagtgtctctagttcccattttatttcaatcaaaatatcaaaatactctttagcccatagaggggacagagttcctagtttaataaaccctaaaatatataattaagataaagcctctgtagggttactcagcacaacactataattgctcagattccctagtggattctccagtcaatttctctgcatccttgaggcaaaatcttttccttaattgtcctcacttagaccaggtgctaggtgtccttcctagcctgcaggtcttacaggcccattcatccctaagggggtcttatatattaaccttgcttctgaactctaagcactggcaagtcaggcagaaggcccaaaggacctaacagcccataggtaactacaatgttggtaaggtggattctgccagatgccagccttggatccattttgggtccctacagatttatgcttctactataatgaatttcataatttctagtatgtgacccagggttgaactaagaagttattcttgctttcccctttagttttccctaatgggactttgatcaacatgaaaactaaaaatatcctggtgctagaccattaacactagttaactattccagactgtggccactgtcaaagacagccatcttgtaattgaattccactggggacaagaagactcaaaacagagtaggtgaatggattgcttaaagtccatctcagctactaaggagaatgaagagcagcagaaactgaattattaattcccaactctattcacaagccccctctggtggaggaagtattagtaatgaaacagctataacaataaccaaaatttttttaaaagagaaaaggcaatccacaacaaaacaatcagcccctgcagaaatgagagtcaagtgtagtgattagcaaatatgagctgcaacctgaaaaccacttacagatgaagcagtatgatgaatgatttaccaaaaggtcaacaccgctcttttgtcttcatcacccatcagttttccatcgccctcaatttgtctggcacataacagaaagcagggcataaaatattccccataaaaattaaccttactttgcaacattaaaaaaaaaaacttatagttgtatatagttgaagcgtaggggccagcttctcaattagtactcctagcatacagtagaaaaagcgttgacacttaaagccctattacaagaggtaatgttcttagcaagttccggaactctctgccctattcttgccttgctgacccactattctcaagcgaaggaaggggtcagtaatccccctaccaaataccacaccaatggtggcaggaggggagcatgtgacagcatttccccttttactctcctggaggccaaacttctttgcaatctctgcttttagctagcgtggatgccagcctttcaaccttgctatgcctgcaatactttctgacagatgagctatgagatgtaccaccttcccactcccatttgacaacctttgtacaaaaagaaacacaacgccaagggaaagtatatttttaggcatgagggattctgaaaatgaacatatctgcaaacttctagatccccttaaccagacctgaaaaagacattaatctattttaactaaactgattaaattgatttaatcagaaagcgggtcacttccctcctccctatcctgtcgctgaatttactaattgtttctccggctttgcccaatcaataagatattttgcatcttgcagatataatgtaagttatcagttattaaaaattcctcttcccggtctctggttaaagtgggtacctaaatatctgcttatttatttacgtcgttgttatttgcagatttcttttttaaaaaaagcagaattaaaatgaaagaaaaggtcaaaagagtttggaaaaaaagctatctacagggatgttcatcactgcatcatttataatagtaaaacttggaaatcttaaatttccaagcaaaagaagactgttcaaattaattatggtatagccataaagtggaatacagtcatgcatcacataatgaagttttgatcaatgacagaccacatatatgatatcgatcccataagattataatggagctaaaaaattcctactgcttagtgacgttgtagttgtcataaagtcattgtgcatgcattaccttttctatgtttagatatgcaactacttacctttgtgttacagttgcctatagtattcagtaaagtgatgctcacaagagtatgaaattgtctaatgacacagttttcattaagtgaggcatgactacactatgcagacattgaaaattaagtggtggaatatttaataacaaaaaaagatttgtggtactattaaggggggaaacacattgcaaaacagtagatactgtaatatcatatttattgagagctgttatctttgtataccattggtttgacaaacattcattggtcagccatcttccattcataacctcttctctccagcattccttgcacttgggaattgttctataaaataaaatattaaagaagaaggctgctaggtagggcttttttttctttttttttttttgagacggagtcttgctttgtcacccaggctggagtggagatggagtctgactctgtcgcccaggctggactgcagtggcacgatcttggctcattgcaacctccgcctcctgggttcaagtgattctcctgcctcagtctcccaagtagctgggattacaggcacgcaccaccacacctggctaatttttttttttttatttttagtacagatggggtttcaccatgttggccaggctggtctcgaactcctgacctcaagtgatccacccgcctcggccttccaaagtgctgagattacaggcgtgagccaccatgcccggcctaggtagggcttttcttcttgtctgattaaaaggagcggatttatctaacaggtctctttttgtatttatcctttatctttccaatctaaacataacgtctggaggaacagcagcttcattgtgaccatgaagacaaaaaaataacacgctaagaacagtagaagagaaatgccaaaacatcagctctagattatcctctaaagacttggagaaagtcactattggttggattttctttattttgcagctgaacacattcctgatacacaggagattctgtttttgttttttgcttatctgtggcttttatattttctaccatagtatgtactgttttatcataagaaaaaaatactggatacaagaaaaagggtcttttgtattcttcaagagaaatctagaggctgtgagttggagtctcaaatcatccaaggaacaaaagcacaggcaaagaagacatgccaataataaaattcttagagctgcttaacattattaatattttcattcccttcaacagaaactgtttacagctattagtattactgtttttcgagtcatggaacacttaagatctactatggtgtcaggtgctacttaaggcaccaagtatccaaacaataaggcagcccatgaccaaaaggaaccgtaacaagcaaacgaagaggaaaaacctagcagggtaaaacacactgcctaacattgctcagctggttaatggtgaagccaggactggaatgcaggtctcttgacacctaacgaccttcatcaccctatcatatgcttaacccacttaccatttagaagaaagaagtgcagcttgctaccagcacaacgctctcggagcaaacgggaaatgggttaagcattaatatctggctaaaagatgtaagaaaaactctggtgagagtatttaaggagaatgatctagatgggggtcaaaaaacatcagagacagaccttgttcttcattaactagtatttatagttatagcaggattgttttccctaaataaagggaaaggtctctttgagtggggcagaaaggattccactttttggctgggtgcagtggctgatgcctggagtcccagcactttgggaggccaaggcgagtggatcacctgaggtcaggagttcaagaccagcctggttaacatggtgaaaccccatctctactaaaaatacaaaaattagctgggcatggtggcgggcacctgtaatcccagctactcgggaggctgaggcaggagaattgcttaaacctgggaggcagaggttggtgagctgagatcatgccattgcactccagcctgggagacaagagcaaaactccgtcctccccaccccccccccaaaaaaaaaaaagagattccactttttatctatctataccacaccgaatcagtcgatcaatccactgaccacagattgtaatctcggccaaccactatagtggggaaagaaaacatagcagtgcaatcagctgttggataccacaggcaacttgacaagtcagtgacaacttggcctatttattcatcttttaaccgtttgttctggtgtctgtgtagtcacaatcaaagaatagtccctaggaatccatggagtttcattgaaatggagttagggctttggatcatatgcagaatctcagtactattccaggagaagggcagccacattgcctctgaatggccaaaacatagggtagtgaagagtgggagaatatgccagcccgaaatatgccactttagcctaaggattatgtggagctaaaggcacattaaaatacaaaacaaaacccagcaggtgcaagaagtgttctctaaccctcccctttttcttcctgaaaacatgaaacaaaacccccatatagaagacgtccagctataccagaaggaaagtctcattcttatcatcaaggatgggaaaatgagactaggaaaagtctgtacaaacagatcttgttaaaataattcttatcttcctttagcctttccacacagttgagttacttttccacaactgcctctctttgttcaacctaatataaaaccatctaggttttgccacttctttgagtcttcatttccttatgaggtatctcatgtcacataaaacttatattaaataaatgtgtgtgcttttctcccattaatctatcttatattcatttaagtcttaggcccagctgaaaagaaaaccctaaaagagtgtacaattttgcctcctctacagtatccatcttgaaagctgaaagttcactctcaatatgccttaagaataagaacaagtgggggcatgttttttagccatagttattcgtaacccaaacaaacaagtaaaggataatataagtgccaaaaatataaatgttgtctggattcacacatatcttatttgagtgactgtcattttatactgtcgtaatctgtttgcatgtctgtctttccactaaactatatgctccctaaacgcaaggacgatttcctttcatctttgctaagaatgtccaagccttcctccttccaaggctcgaactggattccaactataaaagtctataaaatatgacagctatttggaccgaaatccttcattccaaactatcctacttaaaaaaaaaagtcaactttttaacatttccaaaatatcctgaagggagggaaaaatcacacattaaattctgtcaagtaacatttacctcctcaagccctgactaatcggaaatgactggacttggcagctccttttatcacgtggtctatcagctaaatttagctcctgttgtgccaattgaaaaatgccaacatcccttcccatctcatacaacatcccaacccgccaatgactctagggtctctctggcaatctggtgtgaccactcctcatcagatcaaaatataaattacaaaccaaacttaaagtgtccaagtagccccatccagaagagcaatgatgaagttagaagagacgaagacgagaagggtgccagattcattactattgattccctgctggtctttcaatgtcacggaaagatgtccattatagttctatgaagagcatttggctcagtttaaactcttttgttttcagttcctttaaaaacaaaaatcaaccacgaaggataaacaactagaaattaatggagcccaaagggtttctgcagaatgagaagccttcatcactgcaccctaattatgtaaatctgctcctgcagagtccagtacatttatttattaagtctcaccactgccatcctggtaacccagagaagaagccaatctataatgactcaagccacatttcaaaatagactccaaaggacacatgatgtcatttgctaaaatgactcaatccagatggaaagcattctgacctatacataattgattgacctttgctatgctttccccagttatttatatactatcatatgcatgaatgtatatcagtggtatttacacttggcagctacttttaagaacacattattcaattgggatttgaagctttttacgaccatttcctgaccaaacattcataaatgacgaacaaggaaagatgttatcttaaaaataatgtttaataggctctggagagtttagagaagctttgctactctagttattttaaattacaggggacaagatctatgtacataaagctgagttcaaaccctgaaactgaggataccaaaggacattttatttactttccagtttggagctcaataatgatagtaaaatatgctgtacagaaggcatggaatgttttagatacatgtgagaagagcatcaactgtggtgaaggtagttagagacaataacaaattatcagaatctaaccatggatttcattttccaaaagaggttagctgcaaattggataatacccagataatcaagatagtttcaagatgatcatagaaggggaggcagatagattagggaaggcaaatatgaagcaagcatgtctttactcccattaggaatacccaaggcagacatccataactgattactgaattcttaaccacagagccctcacttggctcaaaatacttttccaatagtactccaggcaaacaccatcaaccaaacagacttgtcctaataacataaacagagaaagttgtatcttatttactgatcaaattaattctatttattgttaccatatactccaagattcaatctaaaactaaacaggtttttaaattcaaaatttaaagtcacatctctgaatcctaagaaaacgttaagtcaaatctagtagttttccatacttcatggtaggctagaatgacccttaatgtaaatgaaaagcaagcaggaaagctaaacaggagaagatgaaaatgcttatatgttcacataggaatattatatagcagtgaaaaggaaggaactacggccacatgcaaccacaggaataaatcttagaaacagaaatccaagtggaaatagcacatggagaagactacatacagcagtgctttccaagtagtgtgcctcagtaagtgggttacaagtgttcccaatccccttagttctggggtgaatagtacctggagtagccaaagtcttgtgtcaagccagagcatttatatcaggaggttctagaatattttcaagttctatgtatgccatgatggaagaagttaggaagcactgacatacaataattctttccagagattaaaccattataaaaccattttataatacttaaaaactaaaatgtatctgcttaggcatatatatacatatatatatatatatatatatatatatatatatatacacacacacacatatatacatgtgacaaatttatttcaaaatgataaaagaaaagcaaggaaaacatgaatggatacttcatccagtacatccattcattcagtataatggttactgttggaaacaataggcaggagatgagttaggtacaaaaacacttcagtagatggtaatgttacagttcttaaggtagatggtggttcatgggtgtttagtttattatactccaagcatattattttataaatacaacatgttatatactacttttctcaaaacatcaaggttaagaaggaaggaaactttttagctgattctgagtcaatttttcacagttgaatctcaatatggcaattcaagaatagatacaactacttttggaagactgaaactcagaggtcaagattttgtcctcatgcaactagaatagtccaaaggtttctaacagtcaactcatgtaccctatttaatgattacaagattttgttctaatccaaatagagtattaatgaaaaattgttgtaaacctaaagttacatttccctactgaaacaaaaacatcacaaaacccatatgtaagcctcttagttaagatccatttagttataaaaaacaaaacccaacctgaagtgttcaagtaaaaggattctggatgaggaattagaggtatcctacagcacataggatagcaagtacagccaggccttatgaagaaccagagccagggtgtaggcagcctttcagatccgaggttgaaacattctctctctcttgggctgcaggttcttgtgtctctacttctttctggaacctttactttattgtccctacctttagctgtgctttttctgctttggcatcgacatgaccaaatatttgtatctcttgtgatttaagtttaaaccaagtagtgccctgaagacaatttcaaaatgcccagaggggaaaaagaatctaattaacccaaccaaggtcaaaatctgtctacaccgggtttaatcagacacagctgtacataaggagttaccaattccaacaactacaggggccaggcaggtaattaaaagtatgatgctgaccaggtgtaaaaccagaagctggaagaaaagggtcttacaacaaagagaactcatgctgcctctccactttggatatgtaataatagaaatccagattttcattgaaatttcttgatttttaaaatacatctgtatacgttaggccacaggcttctactgtcagcgtcctacaaaaaatgaattgtgaatatttcagtttcggggggtcacactgggcaaacctgacttagataccagccctttgggtagaagagcaggtctcacagaagggctcatggtcaggcagtactgcaacaaagcctggattatgcactactttacacaccctccccatgaaatacacacatcagctaaacttctaaaaatatcttgttcaaaatcagatactaagccgggcagagataatcatcatgtagctttgtatgggttcatagtaaaaagcattaaaaaacaaagaaatcacacaaaagcaaactagagccagaaaaacacagcaccatcttcttcttttctttctttcttttttttttttttttttttttgagacagaatctcactttgttgctcaggctggagtgcagtggcgcgatctcagctcactgcaacctccgcctcccgggttcaagcgattctcctgcctcagcctcctgagtagctgggattacaggcacgtgccaccacacctggctaatttattgtagttttagtagagatggggtttcaccgtgttagccacgatggtcttgatctcctgaccttgtgatccacccgccttggcctcccaaagtgctgggattacaggcgtgagccatggcgccgggcccatcttcttttctgtccacagccaaaacatcctgccacaaaaggaccatttgttacaaaacaactgcatattcttttttcagttaactgaaggtaacacaggccctcctgtgtcaatttcttcaccatacaaaactgggagacacagaagtcatagcttaagtaagtgtcacttcctctcggaagcccagcctgagtccctgatcttgtataaggcaaatgtccctttacaaagcacctgtttcccttgctgtggtgcctaaccacagcacaactgatattgtatatgcacaactgtctatttatctcttccacataggtgagcttctggaaagcacagatactgtctaatcctccttctctgttcttaacacctgtttgttaaataaatacattctgtagtcagacatgtcaaaaattttattttttaatttttagcagctaattttaaaaatgctgaatttagactagattcctccttattcttttgtacgcacttaaaaattttcaacaaaacacttaaaatcttttactcagaaaagaactacacatatcactctgaattactacagactcaatatcacattgttgtggggctttcaagaatctgtgcttatatttaagctaaaaatccttcacagcacctcctgtcagtttgtagatacgcatagattttctcaatatacctgtattgatatagatataaatatacctggtatagaataaggcacggtaaaattctctacctagacataaaacccatatatttaaacttatgagaaatctggagaagtacagtatatacatgtccagcaagacttatgttccattttaaagaaatgagccttggcaaatttccctagcactgagaactgtttagcaagaattaatttttaaatgaaataagctaaaaataaaatagatgtagtattatttatacttaagtcttgttctttagcaattattaaaggttacactggtatgttttatcattggtaactggactcaagtttgaccaaatgtttctctttacccatgaaaaatagttgcaatgttccaattttgactgccattccaggtctttggtggcccttcatcaagtgcaatttggtagcctaaatgatatgggagggacagagcataatttcatggcagtaagtatagctgagacagaaaggttaaacaaggtccatgtctttggacacttgaccctaagttatgacagattaactttaaaagacaatgttttatcttgaacagaggggagttttgtcttctccttccagctaggtggaagtatttggcaaatgtcttctttggaaagaattatttagcaatggaattataatcggaattatttagcaatggaattataatcaatgtagtaaggacagaaaaagcaaactaaggacaaaggaataaatgaagaaatgacagccacacttgccaaggtgaattccattcagggaatttgccaaatgaaaaggatattaacattaacttaagcaggtttccttacttcaggaattgtctgtctttaatattcataatggtcctcatgaattttccaaaggatagagtatgcagcatttatgattatttaaaggctttataaatgtaactgctcttgggcatagtggtgctatcaggcagacctaggttgaaattctggctctgtcagcggctgtgatttcatgtgctaatttcttaactcttatgagcctcaattaccttgtctgaaaaatcagccctttcatttatatttcaacagaacttctgcccttgatgtccctttgaagttatttcccataattagtcacagatcatagcatcatcagctgcaatcatcttatctccattctattaacaaatttacatacattcttttgtatgttcaacaaacagcatatgccaagctgagctggcaactggacaaaaacatattatatgtggtttctgaacacccagagctcactatcttgttggggagaaaggcagtgaggaaatagtaatgcagagcagtgacaggtgcccataaggggttcgcctagtttggagaggagaaaacatttgagttgaaatctgaagagagaaaatgaagccactggagatgaagaaaacaaacttccatggggctgagggaacaagaatgtgcaaatgctctgtgggaggcagaaagaaagagattttgaggaggaaaaagggcagtgtagtttgcgtgcaaaaaccaggtgagcaagatgggagaatcaggagaggctttttctttttttttttttttttaatgtcaacactgtttggtgtttatttggtgagcctgagggcaattttcattctcatttctttttcttattgattatttccaaccctttcaacagtgaacatgcgttgcttttgcaattacaacaacaacaagaatccctatagacaaagcaaaaaatatatactttgtaatgtttttaaaaaacaaagattaaactacactaaaatataaggtgattatctctgaatgataagttttggggcagttttttttttaccctcatcactgctttccgaattccaaaggtaaaaagatactacttgaataagaagaaaaataaagagagttgtgtttcaagctttccctcttcccttcttcccaccctatctaacacttggaatatcccatgagggtctccaacgtcagcaggaactaagagccaagagtcgactgagagatgactttctttctctttcttttttgttgtgtggtgaagaaagaaatcataatctgacgtctaaagagcacttcactgttgctcttggttggactctaaatcacattgggaaaattaaaactacaatgagaaacatcttacaccagtcatgatgactattattttttcaattttatttttattacactttaagttctagggtacatgtgcacaacgtgcaggtttgttacatatgtatacatgtgccatgttagtgtgctgcacccattaactcatcatttacattaggtatatttcctaatgctatccgtccctcctccccccaccccacaacaggccccggtgtgtggccccggtgtgtgatgttctccatcctgtgtctatgtgttctcattgttcaattcccacctatgagtgagaacatgcagtgtttggttttctgtccttgcaatagtttgctcagaatggtttccagcttcatccatgtccctacaaaggacatgaactcatccatttttatggctgcatagtattccatgttgtatatgtgccacattttcttaatccagtctatcattgttggacatttgggttggttccaagtctttgctattgtaaatagtgccacaataaacacacgtgtgcatgtgtctttatagcagcatgatttataatccttttggtaaacacccagtaatgggatggctgggtcaaaaggtatttctagttctagatccttgaagaatcgccacactgtcttccacaatggttgaactagtttacagtcccaccaacagtgtaaaagttttcctattactccacatcctctccagcacctgttgtttcctgattttttaatgattgccattctaaatggtgtgagatggtatctcattgtggttttgatttgcatttctctgacggccagtgatgatgagcatgttttcctgtgtctattggctccataaatgtcttcttttgagaagtgtctgttcatatccttcgttcactttttgatggggttgtttgtttttttcttgtaaatttaagttctttgtagattctggatattagccctttgtcagatgcgtacattgtaaaaactttatcccattctgtaggttgcctgttcactctgatggtagtttcttttgctgtgcagaaactctttagtttaattagatcccatttgtcaattttggcttttgttgccattgcttttggtgttttagtcataaagcccttacccatgcctatatcctgaatggtattgcctaggttttcttctagggttttatggttttaggtctaacatttaagtctttaatccaccttgaattaatttttgtatagcgtgtaaggaagggatccagtttcagctttctacatatggctagccagttttcccagcaccacttattaaataggaaatcctttccccatttcttgtgtttgtcaggtttgtcaaagatcagattgttgtcgatgtgtggtattatttctgagggctctgttctgttccattggcctatctctctgtttttgtaccagtaccatgctgttttggttactgtagccttgtagtatagtttgaagtcaagtagcgtgatgcctctagctttgttcttttggcttaggattgacttggcaatgtgggctcttttttgcttccatgtgaactttaaggtagttttttccaattctgtgaaggaagtcattggtagcttgatggggatggcgttgaatctataaattgccttgggcagtatggccattttcacgatattgattcttcctacccatgagcgtggaatgttcttccatttgtttgtatcctcttttatttcattgagcagtggtttgtagttctccttgaagaggtccttcccatctcttgtaaattggattcctaggtattttattctctttgaagcaattgtgaatgggagttcactcatgatttggctctctgtttgtctgttattggtgtataagaatgcttgtgattttttgcacactgattttgtatcctgagactttgctgaagttgcttatcagcttaaggagattttgggctgagatgatggggatttctaaatgtacagtcatgtcatctgcaaacagggacaatttgacttcctcttttcctaattcaatacactttatttctttctcttgcctgattgccctggccagaatttccaacactatgttgaataggagtggtgaaagagggcatctctgtcttgtgccagttttcaaagtgaatgcttccagttttgccaattcagtatgatattggctgtgggtttgtcatagatagcttgcattattttcagacacgtcccatcactacctagtttattgggagtttttagcatgaagcattgttgaattttgtcaaaggccttttctgcatctactgagataatcatgtggtttttgtctttggttctgtttatatgatggattatgtttattgatttgcgtatgtgaaccagccttgcatcccagggatgaagccaacttgatcgtggtggataagctttttgatgtcctgctggatttgttttgccagtattttattgaggatttttgcatcgatgttcatcagggatattggtctaaaattctcttatttggttgtctcactgccaggctttgatatcaggacaatgctggccgcataaaatgagttagggaggatttcctctttttctcttgattggaatggtttcagaaggaatggtacccgctcctctttgtacctccggtagaattcggctgtgaatccatctggtcctggactttttttggttgctaggctattaattattgcctcaatttcagagcctgttattggtctattaagggattcaacttcgtcctggtttagtcttgggagagtgtatgtgtccgggaatttatccatttcttctagattttctagtttatttgcatagaggtgtttatagtattctctggtggtagtttatatttctgtgggatcagtggtgatatcccctttatcattttttattgcatctatttgattcttctctcttttcttctttattagtcttgctagtggtctatcaattttgttgatcttttcaaaaaaccagctcctggattcactgattttttgaagggttttttgtgtctctatctccttcagttctgctctgatcttagttacttcttgccttctgctagcctttgaatgtgtttgctcttgcttgtctagttcttttaattgtgatgttagggtgtcaattttagatctttcctgctttctcctgtgggcatttagtgctataaatttccctctacacactgctttaaatatgtcccagagattctggtatgttgtgtctttgttcttattggtttcaaagaacatctttttttctgccttcatttggttatgtgcccagtagtcattcaggagcaggttgttcagtttccatgcatttgagcggtttttgaatgagtttcttaatcctcagttcttgtttgattgcactgtggtctgagagacagtttattataatttctattcttttacatttgcaaaggagtgctttacttccgactatgtggtcagttttggaataagtgcgatgtggtgctgagaagaatgtatcttctgttgatttggggtggagagttctgtagatgtctattaggtccacctgctgcagagctgagttcaattcctggatatcattgttaactttctgtctcattgatctgtctaatgttgccagtggagtgttaaagtctcccattattatcgtgtgggagtctaagtctctttgtaggtctctaagggcttgctttatgaatctgggtgctcctgtattgggtgcatatatatttaggatagttagctcttcttgttgaattgatccctttaccattatgtaatggccttctttgtctcttttcatctttgttggtttaaagtctgttttgttagagactaggattgcaacccctgcttgtttttttttttccatttgcttggtagatcttcctccatccctttagtttgagcctatgtgtgtctctgcaggtgagatgggtctcctgaatacagcacactgatgggtcttgactctttatccaatttgccagtctgtgtcttttaattggagcatttagtccatttacatttaaggttaatattattatgtgtgaatttgatcctgtcattttgatgttagctggttatttcgcccattagttggtgcagtttcttcctagcatcaatggtgtttacaatttggcatgtttttgcagtggctgttactggttgttcctttccatgtttaatgcttccttcaggagctcttgtaaggcaggcctggtggtgacaaagtctctcagcatttgcttgtctgtaaaggattttatttctccttcacttctgaagcttagtttggctggatatgaaattctgggttgaaaattcttgtctttaagaatgttgaattggcccccattctcttctggcttgtagagtttctgccaagagatctgttgttagtctgatgggcttccctttgtgggtaacctgacctttctctctggctgctcttaacattttttccttcatttcaactttggtgaatctgacaattatgtgtcttggagttgctcttcttgaggagtatctttgtggttgtctctgtatttcctgaatttgaatgttggcctgccttgctaggtttgggaagttctcctggataatatcctgcagagtgttttccaacttggttccattctcctcatcactttcaggtacaccaagcagacgtagatttggtcttttcacatagtcccatatttcctggaggctttgttcatttctttttactcttttttctctaaacgtctcttccggcttcatttcattcatttgttcttcaatcactgatattctttcttccacttgatcgaattggctactgaagcttgtgcatgcatcacgtagttctcatgccatggttttcagctccatcaggtcatttaagttcttctctacactgattattctagttagcgattcgtctaatcttttttcaaggtttttagcttctttgcgatgggttcgaacatcctcctttagcttggagaagtttgttattctgatcttctgaagccttcttcactcaacttgtcaaagtcattctccatccagctttgttcccttgctggcgaggagctaggttcctttgtaggagaagaggcactctgatttttagaattttcagcttttctgctctggtttctccccatctttgtggttttatctatctttggtctttgatgatggtgacgtacacatggggttttggtgtggatgtcctttctgtttgttagttttccttctaacagtcaggaccctgagctgcaggtctgttggagtttgctggaggtccactccagaccctgtttgcctgtgtatcaccagcggaggctgcagaacagcaaatattgcagaatggcaaatgttgctgcctgatccttcctctgaaagctttgtctcagaggggtacctggctgtgtgaggtgtcagtcggcccctactgggaggtatctcccagttaggctacttgggtctcagggacccacttgaggaggcattctgtccgttctcagatctcaaactccgtgctgggagaaccactactctcttcaaagctgtcagatagggacgtttaagtctgcagaagtttctgctgcctttttttcagctatgccctgaccctagaggtggagtctacagaggcaggcaggcctccttgagctgcggtgggctccacccatttcgagcttctaggccgctttgtttacccactcaagcctcagcaattgcggacacccctcccccagcctcactgccaccttgtggttcgaactcagactgctgtgctagcagagagtgaagccccgtgggcatggaaccctccgagccaggcaccagatattatctcctggtgtgccctttgctaagacagttggaaaagcacagtattagtgtgggagtgtcccgattttccaggtaccgtctctcacggcttctcttgactaggaaagggaattccccaaccccttgcacttcccaggtgaggcgatgtcccgccctgctttggctcatgctccgtgggctgcacccactgtccgacaagccccagtgagatgaaccgggtacctcaattggaaatgcagaaatcacccatcttctgcactcctcacgctgggagctgtagaatggcgctgttcctattcagccatcttggaacctcctcccatgatgactataagggaggcttttaaatggtggaaatgaatggtttccaccaggacagtggcaagattcaattatcattttaaaaatctctgtcaagctacagtgtggaaaatggattggaaggagacaataatggctgcaagggtatcaattaagaggctattgtagcaaggatgataatttaaactgcaattggaacagaagatatggtaaaatgtgacaaatctgagagatatttaggttggtaattaattgggtaagagaactgtggtacattttacacataaagtcctaaggtgcagtatttgatttggtctataaattgtactccaaatcagctgatgcttttatagttagagagaattatctcagtagacgtaatacttctctttcaaaaactgtcatggttcttaatcatattccacaatggtcagtatggggatgtttatgcctcatggaatagagaaatcaaaaatttaaatctatatttgatgttaaatataaatagtatcttcttataaaaatacattaccattactcttagcttgatatattgtaaattgctttattcacctcctcagccatttttcatcagcagtagtatatgtgctccctgttcctggcagtgattcactggatgagaacataaatgtatttgtgggaatatgtatgaacgttgctctgggaacaaaagaaacagttctgttataccacattggtggtaatcattctttcccaaaatcattgcttgatcccttaaacaaacaaaacaatgtgaaataacaagcattgcaaatacctaagactttggtgtattgactgcctatctgtcaaatttgacaggaaggattaaccatggtttcaatatttacacttggattttgaaagactagataccaagttgatgactctttgaaaataatatagaaaagtatatataaatacataggtaaaaaggatgggacaaaagtgtcaatggttactgctgaaatatggttttggagtgcaagtataggggatttctgctattcattttatgcttatgcaatgtttaagttttaggagcaggtatcagtttctaagaaaaatcgaaaaaagagcagatatgaaaaacaagatcaataaaatagtttcactgtttaataatgccaggttagtgagaggcaacattcatcatggaaactaaatgcattacactagactttcactatttataattatttttctaggaccatgatcagactggcccacggtatataatctacaaattgactactgatattgtaagagggctcagccatattcaaataccatctattaaaaaaattaaatatgctaattcgccactacaatttaaaattcaactgtaggtaaataaaagtaaattgtgccaatatgcatgtggaattacttgcttctgatcaactaaaaaaaaattagtaagaaatctggtgaacatcgtattggtaaacaaaaacaatttttaaaggaaagtggcaagatccatgtccagtctgatccaaggtgttgccagaatggcagcccgagttgagagcagaaatgtgtttctcctcacacctttccaacttttaggctgtggtcacttcaaactaagaagcaaatcacatcttagcccatgtagtaatgaggttatccacactagaatgcataaacgtcaccttgtggcttgttaaaaacacagattcttgcccatcacaagattatattaaactgactagggtctctaatataatgatgaataaaaatggaaataataaacacatttatgatctcaacaagaaaattgttaatatttcaaattaagtatgaagtctgctgtaggactttttttttttttttcgagatggagtctcactctgtcactcaggctggagtgcagtggcatgatcttggctcactgcaagctcctggggttcaaacaattctcctgcttcagcctcccgtgtagctgggactacaggcacctgccaccacacccagctagtttttgtatttttattagagacaggatttcaccatagtggccaggctggtctcgaactcctgacctcatgatccacccgccttggcctcccaaagtgctgggaatacaggccgccctgcccggcccctgctgtagttttttaaaataaatatttatctgattaaggaagctcagctctattcccattttgctgagattttaccatgaatgaatgtgtttgtcaattttttccccttatctattgagatgatgatatggtttctcagttttactctattaatatggtaagttgcattgactgattttcaaataatcagcttgtattcctggaacaaacccaacttgataatgatatattattctttttatatatcactggatttgatttaccaatgttttggctaggatttttttttcatttatcttcatgaaaaaaattgaactgtggatttattttcatttaatacccctcatctttggggtcaaggttatgctggtctaatgatgtgagtttacatataactgatattgcttcttccttaaatgtttggaagaatttgctggtaaatttaaatgggctcttttttgtgggaagatttctaattatgaagctaatttctgtaatagatataggataattcagattccctaaaaatatatcaaatttagttgtatttttaaggaatttaaccatttcatttaaatgttcaaatttactggcataaaatcttactaatatcttttttagtgcttttttatttctgattattatttcaataatttctgctcttatctttattttcttctactttctttgcatttattctgtttcttttttagattcttgatactgattactagattactaattttcaggctttcttcttttctaagaatttaaggctataaatttccatataaaaactgctttagctgcaacatcaaagcttgatatgttatatcttcattatcagaaatatttttaatttttgttgtgattactttctttgaaacatagggaagaaaatattacctaatttccaaatattggaattctatcattatcattttattactgatttccaccttaatactactgtgaacagaagataaactctatggtttaaagcctttgacatttgttcagaagtgcttatgtctaggtatatattatatttactaaatctttaaaaatgtatatgcttatttggttgttgcagtgttctatacataagattaagtttgttacaagtggtgtttgaatcttctatatgtttactgacttttttgtttgttttgttttcagacagggtctccctctattgcccaggctggagtgcagtggcatgatcacagctcactgcaacctctgcctcccaggctcaagtgatcctcccacctcagccttctgaattttttggttttgtagagatggggtttcgccatgttttccaggctggtcttaaactcctacactgaagcgatctgcctgcctcggcctcccaaagtgttgggattacaggtgtgagctaccaggcccagccgtttactgacattttgtcttcatattctattaactacctgaagaggtatggtaaaatcccaactaaggctgaagatttgtatatttctctttttcagtgctgttatttgctttcaaatattttgagaccatgctatatgtacctatacatatagctatgtctgcttcttttggaatactgtgtgtttgcacaatgtttctctttttacaactttgaatctttatatggatttatatttagactgtacctcacatagttagcttatagttgtcttgttttaataatccagtctaataatctgtttttaaatagaagtatttagtgttttgtattaatataattaaggttatatttatattcttatcactatcttaatatattctttatttgtctcacagttttctgttcctaaattctctttttgtcttcaattaatcaaatatattttatattatccattttccccctctatcagcttggtaactgtacattctttaagtggttaccctggaaatgaaaatatgatttcttgacttattagaatctaccataattgatacttttatcctgtctggataaggatttcacattattttaacttcatttaatccactctcattctacctgttattgtttgttgcctttattttaattccacaaatattttatttttcaagctttttattatggataattcccaacatatacaaaaatagacttaataatctaatgaaacgttcatatttatcatcctgctttagcaatcattagctcatgaccaatcttgttccatctctatccccatccattttctctccaaatatattattttaaaacaaattccaaacatcatattacatttcttatgactatttctgtatgtatatccaaaagatgagtatgctttttataatatataactatgatgtcattatcacacatacgaaaaaataatgataatgggccaggcgcagtggcttacacctgtaatcccagcactttgggaggtcaaggcaggtggatcacttgaggtcaggagttcaagaccagtctgtccaacatggtaaaaccctatctctactaaaaaagtacaaaagttagccgagcatggtggtgtgtgcctgtagtcccagctactcaggagtctgaggcaggagaatcacttgaacccgggaggtttcagtgagcagcctgggtgacaagagtgagactctgtctcaataaataaataatgcataataccatcaaatactctggaaatactcaaatttccaaatgtctcaaatgtgataaccatttttataggtattttgaaatcaagagccaaataaattctgcatactgtgattggtttatttgtcctttaagcttaatttaacctattgattctccctcaatctttttttttttgcccccttgctatctatgcattggagaaaggggcttgttggaactgaagttttccacgctctgatgttttttcccccatgggtattgtattaaataaaatgcttcctagctgtaatttctgtttgtttgcagttagatctagaggcatgcagattcaagttcatttgttttgtttttggtaagattacctcatggctagtggtttatgttcttttctcttttcccataaatattcagggcctggatccgttaattcattaaaataaaaaaataagaatattacacttttaaaacatttattagcaggaatcctattatcaagagaaaattcccccatctatgtttacttagtcatacaagagatgtggaacaaatgcttgattttttacatttgtataccatttttcaaaacaacaaattggttcactaacatctttccatggtaaccaatcggttataattattcttaatgttatgaactcatggatataaaatatttgatgaatttgcatctgctgcagttactgtcaatgagtgcttaaattgttctatctttagttataggacttacactccactaaacattactttgattgttttaaacaatccatattcatagacacttacttatatatttatactttttggtgttcttcatgccctccttcatttacatgatttcaactgggactatttcctctgactgaggagctccttttaatagttttgatatagatatgctgataattaattatcttagttttaattttctaaaaatgtcctttttgaaggatgtgttcggtaggtataaaattctgaattggcaattactttcttttggcactttaaccatggcatcccattgttttcttggttccattgttttggtttaaaaattagctttatgtctcattggtgtgcctttgaaaatatatcttttttcctttggatgcttttaagatgcatttatttgtcttcaatttttaagcagttttactacaatatgcctccatattttatttggctttttttttttcttacacagtttcttgaatccatggcttgatgttattcattaattttggaaaattctttactgctattcttcaaataatacttatgccccatcttccctgaaatctcctcttgggcctccaattgcctgacacagacctttacactaaccaatatgtctcttataaaattttctttatttttgcattctcttttccactctgctttaatctggatattttcccttgatctattttccagatcatgaatcctctcttctgttgtgtcaactctattattaaacctatctacttagttttaaattacacttactgtaattttaactttcatgttgtacatttgattcctttcataggatctagatctctggtgaaattctctgtctcttcttgaacatattaatctcttatctgaaacagattatagctatagatcttatagctccaatttctcagtcacttttggatctgttacttttggttggttttctgtcttgattattggccatttgttcttgtttcctggcatgcctactactttctagtgaatgacagatacactttttatggaaattgtacaagttttgaatgatgttatctttctccaaagatgatttgattttcttctggcaggcagatagagtacaggaaaatcatcttaatccagttgaggctggtatatttccagtttgctcttaccctaggttgtagttcttcaggggcctcaaggaccttgagtatttccatggtcctacttctttgaaagccctgaactctgtgagacactgagactgctacaatatctgctttgccatttactcctgtatcagatattttcagctttatattttgttgtctctccctgggagtgtacaaaaaggcctcaagggaaaattccatgcagtatgttgaacttacatctctgtggctcctttcctctgggatcttgtttcctccagtcctttgttggtagccctgaactccactggtcaggaaagaatttaagctatttccactttagaaactaaaatcttaagttacgctccttgttgatgtattcatgcttttattttccctgatttttaatattttaaaagctggtcacattctcatcattttggtatgatcacaaagaaacatgtagtaatggaaaacaaagaagtattgaccttcactaggcaatcaaccctcagataatgtcaggaaatctgaagctttctcaagtaggagtatggaagagtggagaagggagatgtgttatttatcacagacaatactcagcacaattttattgctccttggggaatccaaagcttttaaagatgatattattatttggaaggcctccagagagcactaagtattaaaaatagcacctgcattctgctaagtcaaatcacctgtttattatccagggtgatgaaaatcatttaataaaatattacagacgcttgttcaaaatcatgcacacaattcataggctcagagacattaatgtctatgcctggctcactacatatttgttaaattgataactcaggtggacattagttaatattaccactttttaaaaattaatgatatcaagttatttgaaatagccagtagaaaacctctgcagtaacatttcccatttttcctcatacaaaatttacataaaacctttgctttgtaatagccactatcttttttctttagagaaccttctcctcctcctgcctttagaatataaatataagaatgtgactcaggtctggtcagtccctgttcatcccattggccagagttattggttcagaaatgagcatgtgatctacattattccattgagactcagtacttggattttatgaacactactggaaagagaattgctgctggttggtaaagggatagaatgaaagattcaatgtggttatcaccacgtaatgaagacctgcctaagactgaagccaaaactacttaaaacttctcagttacatgaatcaataaatgccctttgttgcctaagccagtttattaggactgggtttcagacctggaaccaagagttcttactaatatagctataccaaaaaagtgtgtagcagcaaccaagtctgtcaacaagagtgattaaccctcaggtttaagaacaaaactgaaaagacgcagtagcattaggaacatgtttttgtggtgataagatttattccagtccactgataatgttttactttcccacctacatttacaggatgcccaagacatgaggcctgaaatttatcaataatatcaaataacatagccccattcttgaagttccaaagttagagtattattggcatttttcacctattcctcacagagcttagttatttggggatgaagtaagttacagaagtttccaaaaaagaaggaaatctctatgtgtttcatgtttttaaaattctgtcttcggctttggcttaagttatggttactgatggtagctgtaagtaatattcccaggagaaaggctgcaaataaaatgagaattcctcagcatctttattgtccttcaagtggacacgaattcaagcaggtgcacatactgaggatcatacatttctactcatggcatttaattaggaggaaagtaaaatgtgcagggccagaactttaaatattagtttaataacctttatgcacctaatttctgaatgattttcttactctctggagaggcatctaatgtcagacagtggcattaaggtgaaattaaggtgagtcatggtaactgaaaagccatgaggcaggcacatgtcagaattattaattttaaaggatatatgaaatattttctcctctgaaaatatgcccagttaatgtatgctgaacttgaagtatggctttatttccctcattcacaactaatcactgtctccaggaggaacagactaaagagagaaagattacaaaagaagtatagccatttcaaaatccccaaacaaatgagaaatcaaaagaacaatgacaagcttgttggttatgtagagtaaaatttttagtgtgccaatcatggctgataccatgttttgaccatgtcaaaattcatcaaggcaggagttttcaaaccttttttgaatatgacccacagtgaaaagtatttctatatctatctgtaatatgactgtgtatgcatatacatttacaaaactcttaccaaattaaatgaactctcatattttctattctatataatttcactaaaagcaatccctaaattgtctcacaactcaccagtagcttacaagttgatataaaacatataatttgacatatattccacatcttaggctaagagaattacacatattcaaatcattaccaatgccaatttcagattaagactgttctgaaatgaaatcaaatcaactctttctacacagtggaaattcttagaccgtttattaacttcactaaatattttcataaagcatttgaagcaagatgctttcttcaggataacacctccaaacatactttgtatctttcgtttttctttttcttttttttttttttttttttttttttttgagacggagtttcactctgttgcccaagctggagtgcagtggtgggatcttggctcactgcaacctctacctcctgggttcaagtgattcttttgcctcagcctcccaagtagctggaattacaggcacatgctatcatgcctggctaatttttgtatttttagtagagacagggttttaccacgttggccaggctaatcttgcactcctgacctcaggtgatctgcccacctcggcctcccaaagtgctcagattccaggcgtgagccaccacacccggcctcagaacatactttgaaacaacccaatgcaagctcaccacctcaaatccagatccaaagacgacactatctttaaaacaaacaaacgaaaaaccatgtctctataaaaaggaatgaaacataatgtcacagggtgatattctaatgagacaaagaggtagtcccattatctgttttgttttacctggtggtatcaactgttgtttcatcactgtttctgtgaagaacatgttttcttaatgaacccttgagaaggacagtgatttgatgaatgaaagatgtgacacatgaaacaaaatattcctcattccacacctgtgtatataatatcatttggctctccaaattatcttaaagtttgaatctcatttcttccttcctcaatattttcttttaccatggaggcagggacagcaaagaaatgtttcctctccagatccactattaactgaaaattccagtgctctgaatacttgtttttttttttttatttttaaaaagggacctgaatttctattaaaggatttcctttattaactcctgctgaagaatttacatattggcaggttggaaagtaagccctgtaggaaagaaatcggacttgtttttcatcatcaacatgacggtctgatgatgggtgtatgagtttcctgttgacacccatgtcacatttactgaattactgttgagaccacagggtagacccagcttatacaattcttttgtcttctttctgcttcacagatcattcataatcacacacggggtaaaaaatgagggagcgaaaattgtgtaagctaattttcactgttgctggaagcggaagcaaatagttctcagagctgagagtgaacctgggtggtgaagagcagtcagcattaccggtggcaagttcagcattctgaccaaaatgagccactctgaaccctggtgttcagtcaatggcggtttcctcaaatttgtccttaaaagttgaaatgtatcatacttctgctcagccacccttaagaaacttgagtgtatgagtgtgtgtgaaatacaaataaaacctacacagctattgtctggattgaacaaacaagcaaatgtgctcagttttccaaacaattgcagatgctgtaataattcagaaaagtgtgtgctgagcagtgggggatgctggcatgctctgttagaatcattgtggctgggtgcggtggttcacgcctgtaatcccagcactttgggaggctgagatgggcaaatcacctgaggtcgggagttcgagaccaggctgaccaacatagagaaaccccatctctactaaaaatacaaaattagccaggtgtggtggcgcatgcctgtaatcccagctactcaggaggctggggcaggagaatcacttgaacccaggaggtagaggttgcagtgagccgagatctcgccattgcactccagcctggacaacgagagcgaaactccatctcaaaaacaaaaacaaaaagacagagtcattgctaaccatgttgcttagcacaattttggaaggaggcatgatgctggcacagaaaacccttgtcagaaattcctattccttaattttatgctctttctttcattcttttctcacttcattgtcatacaggcaagtgaaaaagagtggaaagagaagaggcggtgtcaaaggaaaagagaaaaaatacacctgactcctgttgtttatgattgtcttgtcagttaacacctgggcaatcatcaaccatgtactttccttgagccaggtccttaaagaacccaagatgaaggaagtagacagaagcagctttggggtggttagggtagtgcttctagaactttaacgtggctacagatttcttgggagtcttgttaaaatgtggattctgattctagagtggggcctcaaattctgcttcagttggtgatcttgttaaaatgccgtttccgattatggggtggagcctcagattctgcacttctactcttagggaaacccaagcctcagggttagtctttgagcctggggcagtggcctatcctgggcctttttctttacaggtatttcacttgactacttctccttttttcaggggcctgcagtaaagagaaataaagcatgacatagtctgaaaagcactggttctagaatcaaacaaacttgggttggaattccaactctgcaactgatttgcaatctgtgtggtcacaggtgagttttttgaatccctcttaaattcattttctccatctataaactgggtatgccattttttaactctcagggcagctacaaggaacaaatgagatcatgtgcatcatcaggtaggttcacattcattatgaaatgaatgactaaagagcctaaagcacaaccgttctatctacaggtaataaaaaggaaggtagggtgcaacaatgtttaaatacatctttatttttcttaataccatgactttggctcttccttagatctacagctatgggttgtgtagagttgtaaccacattaagccaagcatgtcttcccatttcgaatacttttctgactccagaaattcattctctgatcatgctttcagtaatgacaaaatccagaacagattgggtttttgaaaatatttcttgctatatcaaatgaggaaaatttgaaaatatttcttgctgtatcaaatgatgaaaatacatctgatgatttacttgccctcaattaattcagttcttaggcttgctcttctggacttctctggctcctgtttccaacaacagatttcccttcttctcaagctcccctcttcccagtctctctcctccaatctgaaattgggctccctttgctcccatagtaaataaggcaaaagtgtcccttcattcccatgtgatccagctggggaatctcagtttctctaaaggaatcaagaagatacttcagagttaaccagaggaattaaagaaaaaacagttaatgccagccttctccaaccttcccacatcagcagactgaacaaagcgctcaaaactcagggtttaataaagagggaaaaaggaggaggagctactttattgggtgtagtagagacaaagagggaaatagaagaaaattgtgaagtagtgacattagctgccatgtcctacctcctctggcagttctccagggcagacagggctggcagcggatgggtgttataactcctatggatcatgcctgacccttctgggcccgtcatgacttctgtttagatgacactaaagggtctcagggcagcatcagagcaggaaggatgtgccaaccacagaagtgccaactcatgacaagaatcattgctcattcagggattgctgcccctgccatcaccccctctgtcccaggatctgcattccgctgttctctctcctgcaagctgtgacagcagaagaggggcctccttcccattagctcatttccatctcggacttagtcaaaggaataaattattgtcagctcatctgtcttattagattgagccacatgatattgccatgttgttgctccaatactggcaatttcatgtgattcaacctcatctgctgtttagagaaaggaagtttcactgctatgaaaaactaaaccatttctgtggctgagctatgctgaccagaacagagttatctcaaattcatctactcaaaagctgcatattttaaactgaaatgcactgagcgtcttccttatccctactttccacatttctaagacaagataaattcagcaacattctttagaaaacattccatctccaacagcaactatcagtcaaacaacagggaatcattgtgcatttactctgtataaagcataagaaggataaaaaaaataaacacaacatcttttctgtccctaaggagtaactgacgtagctgaagaaagaagaggggaaaaacaccacaaaaaatgtaaagaatgaagcaacaatataaggaatgtcacaagacagaccatgatcatttgctaaatgagtggaatggaaaataagtacagtgagttgagaggcaggagcaatcacctagaatctgatgtgagccactttctatctaatttagctcatcaatcacctcaccctcccacctacttactgtgggaagttatcacagaaaatgaaaatctcctctctgcctactcataactcccagatgtcggttccagaaatgtatgcccagcaggtctcagaccactcccactcatttattgggtccatctcaggaaaagatgggggaatggggacatttacactggatgcttttctttctctaggtgaagtcagcatgacacaggaaaatgggagaaatctaaatgtgtgtgcctcaatataaactgtagccacctggtagcctagcacttttcctgacttcatgactccttttaattctgaatttcaacctttctgagcagttgccaatagtaaaaaaaatgacataaatttaagcatactacaaatacctgtttagatacaaatgaggtcacattaacacctcacagcccccctattttagcaattccctgcgtgctctcactcacacaatctcccatggtaccctgctcttcctctctgctgagggcctccctcttgaggacaatgcctagccatggaccctgtctctagtgtcctcctggagaagggtgtttcctttcccagggggtcatagccaagggctctgcaaggcagcagcagccctggctgccccagtacttctggcatgaaagccatgctgggatgttccatgcagaaatgcagataatacccttctgcccaacactgtcaccctctactgcctgggttgaataaaagtgaaagtttgctaaggtcccaaggcaacatctctgaccaggccttttctccttctcccctttcttccttccttttttttttttttttcttttttttttttgacagagtctcactctgtcacccaggctggagtgcagtagcgtgatcttagctcactgcaatctccacctcccaggttcaagcaattctcctgcctcagcctcccgagtagctgggactacaggtgcacgccaccactaccagctaatttttttaaaatatattttcgtagagatggggtttcactgtgttgcccaggctggtctcgaactcctgagctcaggcaatccacccgcctcggcctcccaaagtgctaggattacaggcgtaagccacggtgcccagccacttctttccttttttgagacagggtcttgctctgttgccagtactggagtacagtgatatgatcatagcacactgtagcttcaaactcctgggctctggtgagcctcccttctcagtctcctgagtagctgggactacaggtgtacaccaccatgtctggctattttttttttaagagatggggtcttgccatgttacccaggctggtctcaaactcctggactcaagtgattctcccaccttggcctcccaaaatgctgggatgaaagccattgtgctcagccctcaccctccacttctaatccataagaaagacgtgtcaattttacctacaaaacatccctcgagtcctccccttcactccatctcggcagataccctgttggttgcttattaattaccatcacctcttacctgggcctctaccacagcctcctaatgtcctgcttccactcttgcccttccagttcattctgcacaaagcagcaagagggatcttgtaaaaagactaaatggatcatgtcttcctagacttaaaacccttcagtgctttccctgctacactcagaataaagtcaaagcccttggccctggcctacggggccttccaggacttggccccagccttgctctacaggagactgtccagtgaaggttataaactcaaagtccactgcttcccatgagaagcctgggtcagaattctgggtcttctgtttaccatgtgaactgtggagctttgggccagcttcttagcttccctgcacttcagttcctacacatggaaagttacatatctcactggattattagaaataaagtgagatacaacgtatacagtgctaggaatattgccagtcaatagtaaatgcttcataaatataatcagcctggtctgctttcatttcttcgaacacatcttttccacttcagggccttccatttgttgtcctttctgctcagaatgctctccctcctccccgtttgtacagaaaggccttccctgactaacagatctcaatggggactctccctgtctcactctgttattctctgttgcaactcttcatttccttcgtatcacttgtatcctgtgataaactgccattattttctttctttggctattcactgcttattgtctttcccttccatgagactttaatctttataagtattaccattgaattccagtactagaacatcattttgactcagggatccttcaagagcttccatcactatttaaatttttacagtgaggaagtggatgaatcttactaatctctcatctcatggtctatttccatttggcttttacttaaagggtcctctttctgtggaggtcagaccaactctctggggcagggttggacaaaaaacaccatgattgactcagtctccccaactcccctgaaagtacatataagcttcttttcaaggactccttgccttcttggacagatatttaactaagtaacctctgatggctccttttatctcaatccgatttaccttctctcttgtgtgtgtgtgtgtgtgtgtgtgtgtgtaatgcacacacttactaagatgttggcttagcccagagtcctcagaaagcacagcctgaggcaaaatcttacataatcctaatttattggaatgtgccatccagggaaggaagagggagagaagaaggaaatgaggaagggacggagaacaagcagatagatacaagggtatatttctgagctggctgccactgttactcagcacaactgatgtcagatctccaggacccatcttctgaggcaggctgtgtgaatgacagctcctttggacaataagtcagggtaagaaggagatgaattccaggttgcacatacgtgggagctgagccatctagtgcatcacaggcctcagtggcaacatgggagccctgggggagatgacaggctgacttgagagaatgggagcagtcactgtaacagcctttggcccttggcagcaacaatgtcagcagcattagtgacctggctctgtaaccatgagagcagcacaaaccaggcaagcatacagatctggaggatggcctaaactaagtctcgtactgatgggtaggaaggtgatgactgtccaaatgtagtgtttgaggatggcaagcatgggacatataggctcaccactcctgaagcttgcactcatggcagacatctttgtactttgtactttgtctggctgagcccaagtacagcctcaaaacacttcttcatacagagctgtaatcagccactacatcacaacagtaatgcaaatgatgacagcataagataaaaaaaattgtaattcacacctgaaatgataaagacaaaaacagtataaagctaatgaaaatgatgaatttcagaaagtgaaaaatccaccaaagggaagcccttccagagcatcttccatctaacccagctccatagcccagaaatcagcgtctgtggatcttcttgatattgcaggaaaagagaatgccattcaaatgacagcttttccagaactggaattctatgtacaacctagcatcacagctctcatcattctgtatttgatgacagttttgtgggtttcatatcccaaaatgatacctgcctaattcacagagcaaagtttatttcatttaaagcagttctgatcaggggaaaatgtttcattgtggtgttataaggaattgatctgctaatgttcttcttaagctttgacattaattacagagaagatgcatcatcatttctactgacccttcattccacccccacctaccaatacacccacccaaatgttcagagctttgtatatgtgtcttaataatctgtcatccaatacttggcaagtgaaatgtgctatcatatggtaccaagaatgttcgcagctctggctaaaacttcactggatctgatatttaagccttagtggtgatctaacataggcagagaactgtgctaagaactgatagatgcagaagtgaataaaacactgcccctttcccttagagtagtaagttccaaactaaaggatagaacccaatagtgggtcttgacatcaacttaggaaattgtaacgagaaattttaaaagctacaatagaattgaatatagtagaacatatctcaaataataataaagggtatagtttcatgaaggggtgtgtgtgtgtgtgtgtgtgtgtgtgtgtgcatatacatgtatttctttctgtaggtgatctaacagtttgaaagcctaagttttccaaaggtgaaaaccatcattcaaacacataatgataaaaatttacgtatagagaatccctggagtcatgcagaatcaacattcagtatgcatacaggatggcagagattagtactaagggggcctgatattcaggcaatggtgagaatctagagtttgccttctaaagcccacattcctcatattactctctgctcagaaaccactgtatgtgcccccatcactacagaacgtaatccaagctcatgagtatggcattgaaggacctccaagcttatttcccactactcttcacctcctcccacaccttcttgatgccatactgttgctataatcatttttgccattttgaatgtgttctgtgtttgaatacgttctgtgtttttttacttctggacccttgcacaaactcttccttcatgctggaatgtctttccttccctatctgaccactaaagtaatatacttacagtggtcagcctttgttttgtctctccagcaagctatccgatcctccttctggtaataatattttctttcctttgagaaactccctgaaatttcatgggttctgtggtcaatcataatgccccactgcctatggccacaggagaagctctgtgacaaacatacagtgattggttgaaaaaaacaagcatgtgacctatggcagaacattatactctatctcatgtacagacgggtacaattccttctctgaattctaacagcagccctcaaaatacagtgagcataataattacctggaagacttgctaaaccacagattggttccacccccagagtttctgattggataaatgtaaattatggcctgagattttgcatttcaaataaattcccaggtgcgttagcttcctcctgttgctgtaacaaattaccacaaacttagtggcttaaaacaacataaatttatcttcttacagttctggtggtcagaagcccaaaacaggtcaaggtgttgacagggctgttccttctggaggctccagggtagaatccatttttttggttctctcagcttctagaggttgcctgcattccttggctcatggcccttctcttgcatcactccaacctcttactgctgtcctcagaactcctactactaacgcttacctcctgtctcccccttataacgacccttgtggttatattaggcctactgagataatgtagaataatctctcattctcaacccccttaacttgatcatatctgtgaagtcccttttgccataagaggtaacttaggcctgagtcctttcacctgaggattaggatgtggacaactttgaggggtcattattcagtctaccacaccaagtgatgctgatcctgatagtccagggtccacactttgaaaaccaatgaattactatcactatcaaagccagcctagtattttattctttagtctgtctgcctcccactagattaagaggttgcagaggctggaatagatcttggcctttttaaaaattgctttaattctatgtacattctcctttctgaatactggtaaatacatctttcagttaaactggaggaataggtaaacagtctgaaatgctgatagaaaagaaaactgtgaagataaaaccccaaagtggagaggtattggttaataggattatctggattccttactgccaacagtaaatctttctacctaattatgctcccaaatttcaaatttctctattgctgacaactatcgccattttgatgccccccagttatttctcatttttctcaaaccaaatttgtgtagctggccagcctatcctgagttctacctcatgggctctggatgtcagagatagcttcaccacacactcaagaactcaagccagaaatttcaccagcatcataggaatagccgctgacagttattcccccactgatatgtgcttggcaacgttctgagttctctgtgggcacttactcattaattcttaccattcttgtcttgtccatttaaaaaatatctcccatagtgctttacatgtagcatacatacactttataagtctacattgcttggttcattcagtagaccataagctccttgagggaagggatgggtcttattcatcatcttgttgccaggatgaaactatgtcacttgtacctcatattacatttgcagtaaaatgttagagagatgagaccatatgtgagcagttggaattaagtcagtcaagttgaagtggggtctaacatcaaattgccttgaaaagcaggcagaacttaaaacatgatataataggcatctcagagctagtgcaaaatcctaagcaagagcataaagctaatgttgggagcaggccccccaaaatctggccataaactggccccaaaactggccataaacaaaatctctgcagcactgtaacatgttcataatggccctaacacccaagctggaaggttgtgggtttagggaatgagggcaaggaacacctggcctgcccagggtggaaaatcacttaaaggcattcttaagccatgaacaatagcatgagcaatctgtgccttaaggacatactcctgctgcagttaactagcccaacctattcctttaattcggcccataagagatacttttagttaatttagtatctatagaaacaatgctaatgactggtttgctgttaataaatatgtggataaatctctgtttggggctctcagctctgaaggctgtgagacccctgatttcccacttcacacctctatatttctgtgtgtgtgtctttaattcctctagcactgctgggttagggtctccctgaccaagctggtcttggcaagctaaaatcattttatagagccaaatcagtaagtccccagtttagcttagaaacaatcagacaaggaccaaaggctttctaggaggtatgattctttgaagagacaagggagattgaaattgagtccataaaattctcttccatcttcctgattctaggtgttgaggtatctgtcctttgttcttggtgatttactatatctgattgcaacttagaattcaaacattaggctctgccttcttttccatccggattctaaaatcaatatctttactatgacgcttattcccaggattaatttatgaaattgtatgatgtgctttgaagactgaaggcttcttagagagagagggaatgtcaccttgtactatcaaaccagtatattaaacagttactgctttaaaaatcagatgtttgttggttgagatgctattaaatcttaacctacaaaaccagcacatgatcatttcaatggtacaaaggcaaactaaatatagcagatgacaattgctacaacataagagaaaaaatgtaatgtaatattttaaccatttagttatatgccacatgaaaataaattcttataaagaataagttttagcacttgccccatttgtgtgatagggtacctaccatgtgccaagggctgtgcaatactgtgatgaacaaaagaatccctacgtgatggagccatcaatctagtggacaggatggatatttaataattatgaataattactacataatcacaggacagaataaaatgaaggatttccaagagcaatgtgaacatagaaccaaatatggagcatatctgaggaaacaagaggctgtccagaggagaccatattccagctgagattttaagggcaaatgagagctgacgagcagcacagaaggggaaagaatcttccagcatttgatcggcatgatacataaaaggagagtagcagggcatgggctgggaacctggaggcctgttcaagactgttcagccttgacaaggtaaagggcaagaggtgatatatttgtttgagctgaatctctcagcattttgcatctcaagtctcctagttttaaacaactttctagagaggaggctgctctttatagaactgagtatatggaagacagccttgagaaccttaaattcaatgcactgtgtagaatataaccatgattctaaacgatacttgttaaaaggcttttttttttttttcaaatggccatggctttgttaaaaaaaaaaaaaaaaaaaaaaaaaaaaacaagataatttggtaactgagtagagacaggacaggtttttctactgaagtctttggtttatggatacacctatagtgttggaaggaagcatttgtattttaaggtatctttcctaggtttgttgctaagttcatggacagcatacccccatgaagatgacaacacagttcttctaagacattatttatttatgtatttattttttaggcagagtcttgctgaagtgccataggagtgatcacggttcactgcagcctcagcctccttggatcaagtgattctcctgtcgcagcctctcaagtatctgagaccacaggtgtgtaccaccacacttggctaaattttttttcttttttttttggagagacaggggtcttgctttgttgctcagtctggtcctgaactcctggcctcaagtgatcctcccacctcagcctctgaaagtcttttaagatatcatattacggaaactttaattaagctcttgctacatataagacactttgcttaggattcaatgtatatctttcatttaaccttcacaacaactctaggaggtaggcacaattattattctgcttatcaacgttgtcaactgaagttagaaaggttagtaaatctttgaagttcacacagcaagtcagcagtgaggctgttaatccctccccactgttaaccaggaaaactctacttctgttaaattctgatcattttttgctaaaggggttagcagtgcttttgactcttttatgtttccctttgatttaccatctaatggttattgctacagtgtttaataagcaatgcattatccctgggcagtggaagtaatatcattactcagagacggtaaacagaagtttgcatctgtgcactgcctggaggtggaagcatcaataaaagcctgaggtggaaggaagagatgaatgtgcaggcttgaatcagaggcaagggacgcaatttgatgtggggtaataagaaattctgcctaggctagcaaagaaacacaatcctttaccactcctagcctcaactgcactgttagatttctcctaacactgcttttctttgctccacagggtacaacagtcccagccccgcccatcacacccacaacccttatgtacgcccaagggtgcctggcatgcaagattctaagagcaatgggttgcaagtccctttgacaaagtttgcctggggaccaggaaatttaagtctacatccgaggaccaaagatatttaaattaaaaacttcctaccaaatccaacagcagctaagagagtggcgaatgcgatattacagaaattggtctgcagcctccaaatgccaaagtggcagcttgttatttatgataagataaggagcagctcgttactaaagatatccatgtcaaccccacgcattgagcagaacaaaggatcgttaatgattcctgggcttgtcatgttagaatggggtggcgatgataaaagagcatctatatatgctttccttgtgacatttcttatttttaaactccaatataaaaatatgtgttaattgttatgatttgtgtcacatgctatgctccagggctggacaggaaacagtgtccccattctagtatttttataataagcaataaacaaacaataaacaatgacaacaagaagagaaccactttccaggatcatatgattagttctgacatttgggaaattgcttcattgccagaagtcaattcccgcgattgcgagcatcttccacacataaaattaataatgtgcccagctcccctcctgccttcattttattatatgaaatttggacctcccacagcatgtaaagtcacatttttaaaataaaactttcttcctttataaaatatataaggaaatgtcttatagagttacacagacctttgaaaacatacatttttccattcctttgtttattcaggcaatacccgtttgagtacctactaagcgccaggtacttttctagagtgaatatgacaatgagggaaaacagacaattattaatattccaaatgaacaaaataagtttggtagtagtaagtgttgggaaaaaaataaagtaagtcaacgtgatagagagacaggtccttcctaatggggacgggggtggaggggcggtcagagagggactctctaggaaggtgacatttaagcaacaagttgaattacaagaaggaatcagccataaaaagatctggagaggagcattcctggcagaaggaatggcaaatgcaaaggcccagtgccggggacaagccgggcttgttcaagaacagatgaagttcaatgacccgagggcattgaggagggcccagtggatgcgggatgaggtcagggagtgggggcaggagcagatcaggtggggccttgcaggcctaatgaagacttagtattttatattaatgacaaggacagccaccgaaggttcaaatctcggaaatgatagattctatttgatattttaaaaattacagctgtctgggcgtcatgggggaagaaaatggacaaaattgtgttccactcaaagatagcatttcccttacagatcccaaggccctgtctttgtcagtacgggtagtgattaagaacatagtgctagtcagaaaacctaggtttgaatccttgctctgccatcaatatgccatgtgatcttagggactccatcaaacttactaaagtcttcacgtgaaaactataataataactcttcccagagtcttggtgaaaattaaatgagatataacacataatacagagtagtgttagtgcctagtacttgatacatataataatagctgttgttgttattattattattattattaaaattaggaagaagaaagagaagcataaggtaaagcactcagcaactactctgatcattcaggtgagaatacagacttatgggagacaggatggaggtttccatcagcatagagcatctctgtgctccaggcccttggacaaatgtcacctctttaatgtcctgaagacattaggtagaatctagaccaaaacagaattctggaaaaactggaaataattcagatgctcaccaacaggaacatgaatcttgatatcatggatgcaactcacaaatatgttgattgaggaaagctagacaggagagactacatgctgtgtaattccatttagatgaagttcaagaacaggtgaaactaactgctgttggtagatatcaaagcagtggtaacattataagggaccgtatttggaaaacatttggaaagagcacaagggagcctgccagggtgctgaaaagtgctctataacttgatctagatggcagttacatgatggatatacatatgtaaaaatatcatcaaaccatatacttaaattagcatactttataaacttttactgatgtatgtgttataccttaatttaaaaaaatatgtatttcaggggatcagaaagtcagctacataaataaacaaatggtgactgctctcttcaggaaaacgatgacctcaggactacttaggagccagttaatttccaaagctacttcccgtttctaagttaaacagctctgcacataatgtcagccacagcaatggcaaagaaccgcagggcaggtgatgaaaaagctcggcttagcagcaggacaatggggaagtgtgttaaactgggaccatgaccaacttcccaaaaccctctctggtgattgccagtgcctgcttaatgccttacctttcaattgtgctgaatttgtctgcattaaatgaaagttcgagggggcaggatcacttcttttttgttttagaaatatagctcaagtacctgtgtgctctataaagaataaaaataataacaggaggccgtggaacaactgaagtatggaacatgtatttagaaagtactttctggcatttcaataaaggaaattcagagggcttccagcataagaacaggatccgaatggattcattttcctgatagagtgacccaacccacaatgcaaagtcattaagtcccatcgcgtggcattaaaaaatgcttttaagctaagatcagccgaaaatgtgcccagggcagatttttatggccatatcatcacaacctgaaattcaaattggtgaactagctagaaatacatgctcactagaatggttcagagtttttctgcatctatctcagtgaaaaatgttagcaaaggaaaccttattttcctggaaaaacactatcaaataataaaacaattcaggaccagttttcacaaagtaataacaggccatacataattgattgcctttagtcttcgtctctgggtattacaaatcacagttactagcgcatcgaacaagctttcattccggattcagactgtccgtcttggcactgcctgaaacggcttgagcacctttattgcacactttactgcattgttcttcagttgcttcttcagtgaagttctgctatacccaacaatgttataccctccttctttctgtgtgtttactgactgtccctgatggtaggcaaaaagtaacttctagaagggaactgatttagacttatgatctcacctcaggcttgcaaggcaatacacaccacccagggagataaaacatattcctatgaaatcatatcctaactctctccattaaaactctagaactgcactaaaagcaggaaagatatactaaaattataccaattctttggcttaccaaacatcaggcagctgcatccataaaaaaaaggaataaataattcattccaaaactcttttttgcacatctcaaggctcataacattggtttgtaggaggaggtctgaacgagggcctagaaattctgagttatgccttggctataacaggaacctgatccctctatcttactctccctttgtatgtacggctaatgatatacacctgggctgccagtgacagtagccatgagccacgtgcctattgagcacctgaaatgtgagtagtctgaaatgagatgtgctgtgagtataaaatacacacaggatttcagagatttactaccaaaagaagaatataaaatatgattctttaataatgttcaaatattaattacatgctgtacatgccgaaatgataatattttaaagatattgggttaaataaaatatactatttaaatttatgttacttcttccattgaacttttttaatgtggttattaaacatttttttaagttatgtatgtggctcacatgtatttcatttggatgacaatgatctagatattctgaattgctatgaaagctaagattctctccttgtggaaatgggtaattacaagcctaacagttacgcatgtcttaaaggatggagaacgtgggggaagaggaagcaatcaagtcaccaagtgtattacatatttagttatacttcaattttcctaagcacattacaaaaagaatggaaagaaggaagaaaaacatgcacagtccttcaccctcctgagacagaaatgagactgaaaatggactttgaaatcaaaccatttcagattagaattctgcctctaacctcagtttctccatttgtaaaatggaagataagcatactcaccttttagagaattaaataagatcatgccgatcaagtacttaaagcaacattgggcacggttgggaataaagatcttggcaccggagatgttgaacctggagcggaagggacattgagaccaaaatgtccattgggcaatgggaatctgagcctggagaccaataaaaagatggatagatgcaagtgtcctagcaagcaagccgcacaggtgagaaaacactaaaaccaggaagggagctggtgtcacataagcagctcacacttcatggaaacatcacagctgcagctgagctccagccagtcgttcccatgaaggaataataatggtacagtgttgccaggttttccaattttctaagagaatctagaaatccagctttttaaatgtttagaaattttaaaaaatttagtttaatttaaaaagcactcattattccagagagaacccacgggaaaatagtttaataccagccaggcgcggtggctcacgcctgtaatcccagcactttgggaggccgaggcgggcggatcacgaggtcaggagatcgagaccatcctggctaacacggtgaaaccctgtctctactaagaaatagaaaaaattagccgggcgtggtggcaggcgcctgagtcccagctactcgggaggctgaggcatgagaatggcgtgaacccgggaggcggagcttgcagtgagccgagatcgtgccactgcactccagcctgggggacagagcgagactctgtctcaaaataataataataataataatagtttaataactctgctgctgcctcaaaggtcaacaaggtaacttgttagatttctaccatatgaaagttaacggggatctcagatgaaattcccacaagcccccaaacagttgagctgccaaagatgaagagggagatttacctcttcctcctcccagctcttcatgctgtaggaacacagttgctgcgactacaggtgtcccagcggtctttccctctccccagaccgtgacctggatgttatgcagaatgtttcaaagagagctgcaaaagcacaaggactttttacaggagacacgtgacataaaccaaggtgctactccggctattatccattgcccgctttaggtctctctggaatattgtctgtttccatttcaggcactctcagctactacccattttggttaataaattatcatattgtgtaaatgtatacaatctgtaagcctggaagaactgtctggaaaaaggatttttaaaatatcacactaaaaaaataaatactagtggcctctctgtatctattgtaaggagtaaaaggatttacacctgaaaaattaaaattacagtagctactctttcctcaagtggttcttagcaaatgcattttaaagaggatgactttccagtgaacactttaattttaatttaaccttcccagaaaatgaagtgctttgtgtagattcttttggttttatttaaggcataaaaattagttctgaactgtgataattgtgggcttaggaatgtaatcattccaagcaccacttctcacttgcttataagccctacaggtcttgagttgctgtttattgctaattcgaagttggcaagttatttaactgtgaagctgaacttgaagtcagagtgtgacgagatggtgggaggtagattgttttgttttgctttcaacaggttatccaaagcccggatgcaaaatgcggtgcaagacacggttctagatatgtgctcctctaactcttaatcttaattaaaatgggatgatgaaatgttctaaaggtggaataaaatattacattaatctataactctatcttgtcaaaccaaccacagataggatacaggttcctatcatccacccttatgattttgttcttaattgtggcattttgttgttgctgtgaggactcaacctaaatactattgcttctatttgattgtttaaaggaaaataatgtaacaagctttggtcatgaaaaatcgtaatgtccataatacagtagatgcagcatttctaaacattttagaattacgtgtttgaatccacgaccacatactcacatacatataatcaacattaaccaaagggtcatatggcgatttttttcctttataataaagagatcctctgaaacattttaagataaatgaattcctgcttaagtatgggtgcatttgaagtgagaatgctttgaataaagttatcattttcacacaccactatgcctgaaagttatgagcattcagacagaaatcattgaagaaaacttaataaaaatatgtttggcatatgccgtatttagtgtgatcaatagtgtttagtaattcaagaaatgaattaaaatttcaccctcattttgccactcctaaatttccatttgaaaaacaataagagaaattattaactccctgaatatttctaatgggcttctcagcattattgagtaaaactaactccacattgcaggcctgtgtgctgactcaggtttccaaggtttctctgggaactctttggtctgttgttgctgttctttattctttattgaaaggcatttcctagtgcatttcctaattttaggcacctggctagactttggggatgaaacaatacatgtggcagaatccctgcccttgggtgccttaccctctccttcatacagcatctaatggatccaaaaccagggagaaggtgcacctcacagccacaggctgcaacagagaaaggtaaagtgctggtactacctggtttgtgtttgtctgtctgtctctttcttttcttctttttagtaggtgtcaatattttacataaagatctaaatttctgacttctcttaaaaaaaaaatcagaagatcttagcatactggaccagaaagactacttggcaacatctggctgaagctgtggggtgggagtgttgaggggggtgtggatggtgcacttttcctagtcatctctggatcaaaactggctctagtttgccagtgttcccaccactccctatagttttatactcactcatatccattacctgctttgtcctcgtattacagtatttacattactgacctgcaagaagtaactagcagtcagaaagcctgatactagcccttggtctgctgcttattaaatatatgacctagcatgaattcgtgaattgcataatgccttggagcctcagttttctcttaaaaaagattaaagacaaaacaaaacaaaacacgccttctctggcactgcaattgcaaatctccaaaaagaaatctatggaggggtttccaaacctggaaagcattaggccaaggaataatattattgtaattttgttttcagaagaaatatctagaaaatcagaaataacagcctatatctgattatacctataaagatcacaaagcactctcaactgaattaaatctcatgtgacctctgagataaatatcactttagccattttgatgatgaagaaactcaggctgaaaaggaccaagggatttgccccaacaccaaatgctgacatttttaaaaagtcaactttcaagatagttcccataattttaacacctatgaagacactattaacaactgacatcacatgatgaaacaataaccagtaagatgagccatcactttccaaggatatactctggatagagagtagcagcttctttgagctttcgtttgtttgcttgttattcaagagcaacattttttaaagggtattacatgttgtaatataaaggaaatattttaagtaaatatttgtaataggtactcatttggacttctaataaactagtagggttaaagcttttgaggacgcactttctcattaaatgtttgtcaacattacattattttcttagagattgtcatcagcaagtaacttctatgagaaacaaatgtccttaattttattaaagtctacttttattaatcccctccctacccctaattgagctaatttgaaccatagtgccattcagaaagaaatatgagaattcatctggctcattgtcacatacattttttccacaaagaacctaatagagttaaaagcttgatttaaacatgaattaaaggtttatcatttacctttaggaacaaactctccataggaatagtaagctcttttaatgcatttacattttattaggcttacagacattcaatttattggtgtctttaggtacacatttactgcatacagtcaaatatataacaccttcatagtaactttttttaaaaagagaaggtagacttatttaagttttttcatggttcaccataattcaggtagcgaagtctaaatgaacaagcagagggcagatgagtgactttaagtgcacaggagatctccacatagtaatttagagacaccgtgggaaataaataaggagatacgtgaaagagtaaccagctcttggcaggacatgtatatgactgagtaacatgcaaactactgtttatacattgcaatcagctggcagccaagcaaaaagcttatagatgagtaaggacactgccacagccatgtttttgttctgaacctcctgattaaacaaataaactcagactagagagccacatggagaatacaatgctagggatacaatacaatagaatacaatacacttagcatgcagggtctaaatattaacagcaactgcagaagatatcactgcagatttgagtaaactttctgaaacaataatctacaaaaccagctgtgtttggtgatggctcttcataaaaacaaacagttgcaagaaatctaacaggattccaagctacagttcttagcttatagatttcaaacactggagagaaatgcataacatcccagctttttattctccaaagtgaagattttgaaagcaaataggattactatctagtatggtcatcataacattttttaaaaagacattattattctggaataggaagtatatgatctccttacaatgaacaattccatgtagaaaaagatagaatatctgcaaagcacttttgaggtaggttaaggtcctgggaaacagattcctcatgcatttagcttgaagaaaggtttaaaaggaattctttagggatcaacacctgcagaaggaaagggaaatagaggaggaagcaggtgagctgaaggagaagtcccaatggtagcttgtggggaataatgaagatggggtgccttagcgcattctggcagttgtaaaaaatatcataaacaacagaaatttatttatgatagttctggagactgggaagcccatcaaggtaccatcagatttgatgtctggtgagggcccacttctggttcacagatgatggcttctgtctgtcctcacacagtggagggactagcaagctccctggggcctcttttgtataggcactaatcccatccatgagggtggaaccatcacaacttaatcacctcccaaaggccccactttgagggttaggatttcaacatagaaatgttgggggtacacaaacattgagaccatagcatggaatgtcctgagtgagggtgagaagggaggggcctttttaccctccagtgatcagtcactggaagcaggccacctcatgaaggaggtatgcctttgggagagggttgtctatgggcagcaccacagcaagtagggtgataagcccttagctcctaaaggaggacctgagcagtgcattacagagtccatgcgacacttctgttccaggctagataaaatatttttaagctctggctgtaaggacagtcacctttaagcttttaatcttagacaaccatcataatacaagggctatttgagacacaatggtaagacattaaaaggtcaaagcatataatgctcttactgtccatcagataacatctccaggaaaatcagtcctgctgctctttgataccaaatggcttcttaggtatcagatctgctggcttgttctgaaaaaaggtagagtgaactcatttttctctactccttccctctaaataccctggaagttattcaacgggaagtgataaagaactctaaaacctggaaaaaaaaggagatagaaactgactaggggccttagcacttgagggacaacaacctggtgagttccgtggggtttcctttttatttccaatataccctatgccgggttccagagacggctgcaaccccaaaacagcaacagggagagcctgctccctctggtcaaatgaccagtaaagaagtccagtagagacctagtggggaagccccagccccagcccctactctaccactagggcagcgatgggcagtgaggccctaggccatcccaaccatatatctgacaaagaattactatctacagtatataaataattctcaaagctcaacagaaaaaaaaaacaataaacagttagaaaatgggcagaaaatatgaagagacagctcaccaaagagcatatacaggtagtaagcacacaaaaaaatattcgacatcattagccataagagaaatgcaatttaaaaccacaaaaatattgttacatatctatcagaatggctaaaataaaaaagcagtgataacatcaaatgctggtgaggatgcagagacactagatcactcagacattgctgatgggaatgtaaaatggtacagctattctagaaaatagttcagctgttcattttaaaacaaaaaataaatttgctatattacccagaagtggcactctcgggcacttgtcacagagaaacgaaaactcatattcacacagaaatttaaacatgaatgttcgtagcagctttatttgtaatacccaagaaatgaaaattatccaaatatccttcaatggataatggtcaaacaaactgtgatataacataacacggaatatttcttagcaatacaaaggaatgaactattgatacacacctggatgaatatcaaggaaattatgctaagtaaaaattaaagccaatctcaagaagatacatactatatgattactttaatatagcattcatgaaatatgataatcatagagatcaagaatagagtagtggtggctagttgttcagaatggggtagggaataggtgttgactctacaggggtagcatgagggagtctctgatgatgggacagtgaagtatcttgatagtggttgtggtttcatgaagctacacttatgataaaattgcgtagagctacacatgcacacatatacacacacaaatgagtacctgcataactggtcaatctaaataagctctatggatatgcattgtactaatgccaatttcttggtttttatattgtcctctagttaggcaagatattaacattggggaaaactggaaaaagggtacacaggccctccctctacatttctttgtttgtttctgtgtatctactgttatttcaaattttaaaatttactttaattgacaaataatacttgtatatatttagggggtgcaatgtgatgttttgatatatgcatacaatgtagaatgattaaatcaaggtaattaacatatctatcatctcataatttatttgtggtgagacatttgaaatttatactcagcaattttaaaatatgtgatacatttttatttactatagtcacaatgctgtgcaatagatctcaaaaacttattcctcctgactaactgcaaatttgtaccctggtttttgcttttatttttgagacaaggtcttgctctgtcacacaagctggagtgcagtggcccaagcacagtttactgcagcccaatctcctgggttcaagcagttctcccacctcagcctcccgagtagctgggactacacgcatgtgccaacatgccaggccagtcttttactttttgtagagacaggttctcactatgttgccctagctggtttcaaactcctgggctcaagtgatcctcccacctcggcctcccaaagtgctgtgagccacaggcatgagccacaggcattagccactgcacctggccactttataccctttgatcaacatctccccattccctctccctatcccccagcctctagtgaccaccattccactcactacttctatgacaaaaattaaagtttgtttcttttttttttaattaggcccgttgattgctcagggtaagaaatcgtaataaaattctaggtatttcttcctttgcaatgtgccagcatctgcatctatcactggaaagtggattgcaaacccatctcagatgcccacacctccattaacctctcctactcccggcccaatttcctgctccataccccttctgatagttgcttgcctggaatcccttcaatggcttagcaaactctatggcagttcctgggttgcacttcaacactttcttgaccctggcccacctctgttgtaatccctttctcaaggtctggtgcaattaagaatgctgctgaaagggtttttgttgtagttcgtgcctatcaaacacagactattctgattacttgtggcattttgcagtgatataaaattaaaactaaagcacaggagaagaatcttaggtttttatataaataatttattgtctataaattctcccaagaggaatctatgtcagtctacagaaagtgtctctccattgagacccataccatttgcctgtaaattcagcacactgatagccatttgcaatctgcaaaagaaaagccatctatctaaaggggcacgccacactgttattcctttgtaatattaagaaatttatcctaatttaaaagataactgaattcttattcttttacaaattagactttaaaacacagccactgaattgaccaagcactaccaagcttttatcctacttttatttaaatgtactgaaacattagtgatgaaagctttcatttaaagaattctgatgattctaatattcacttataatgtccatttagctaccacattgtgtttatgccccttaaaagctgaagctatgactgctctagtactgagttctccagtgcttatcattaattaaaaggtaaaacacgattaccagggtatctgcaatcaagctttcaatgtaagaaatatcaatatccagtacttgagaacattttggaaccaattttaataggtaaaaaagtccaaagagaagaaaaaatgttctttattatttcaaattaaaaccagatcagtatatcttactgaaaagttgcaattgcccatgccttccaggcatctgcctagtttttctcttatagcagatgctaaagaagagaaatctggcatgtccatttctgtaatatttacagatataacacatcagcaatacatcagtttggttttttatggaagctaacctcaagaagcaaaacatgctctgtgagtgtacttgtgtacttacttcagatcatccttatgcttgggggtgggcagacagattattaaataatgactgtactgagtgtctactaagcacagtggtgtacttgtgttgagggcaccgagacgaatagaagaatccctaccctaaaggagtgcaaaatctagtatcggagccacatgaatattgtgcaagtgaaagaaggtgagcacagattatgtccatggtgaaacaaaagttctgaatatctgttgagactgataaaaatagatcctgctaatgttaatggcaaaaatggcctgagtgtctttagctccccaatcaactctaccagtatccacccaagccaccccaaataaagtgtttgcccagtgtacatatgcagtttcaaaaaagttgcccggtttctcctcttctgtattggtaggaattgagcaggacacagatggcccactgaaattagaataatttgaggaaggtttaataaagggactatttataaaactttgggtagtatgtaggaaaaccataagggacattcaacactctggaactgttatcatcacacgacataaagggagaaggggaaggagcactgaccagaacttggaaagagaaagtctggtggagaggtcaacctcgagaagagctatctgctttgatagaggaacatagccagctcaaagggaccccacagggagtgatccaaggcaactaataccttgacctcactctccttccattttccagtctcctgcttgggtccccccattggccagaaggcaaaaaaacccactgatgaagcatacaggtcagcaggtggaaaaggatagcatccctgattcctggtattaagaaaatcaatcagccgccaaccgcagagaactgctgtgaaaattaaatgatgtaaagcacattatgcactcaaacatacctcaaacatagtaagtaaatgagaaatgtaagttgttaaatatataatatgggatatttttcattatacaattcaatatagcaattatctatgcctcccaccattttctccccacatgagaggtacagcagagagggagaagaaccaatgtttcctgggtggctagtatgattgcagcagagtgctaagcatttgctatatatcccatcttatttcattctccctagaaagaatgtgataggaattattaagctcttaggaaaggtgagtaaatgaagctcagatatgttgcctataattattgcttataattaggatctcagatctgtcaaattcctaagctaatgacttctccattattttatgtagatgggctacctgtccatattagataattttatttttatcacgttgaggggaattagagaaaaacttgctaaaagctaagcatctaacttagggcttgccacagaagagatagtcagtaactgctatatatgatgatgaggaggagcaggatgataatgattgtgatggtgatggtgatggtactggtgatggtgatggtgatggtgacaatgataattatggcagcggtgacaaatgatggtggtaatagtgatgataagaaccaccctactttaacctaggagcaaagaacttctgcaacagacacgaagaattccttaaataaggtttcagtatatagttgaagtagtggaactgataaatatttgttaatcctggtccctcaatccaagaagaagctttttcagagcaggctgtgtggtgcatggctgggccactatgaatttcggtttccctgtgtgtgaaacgcaataattatatatgtggtgcctagagctgatgtgaagaatgaaaggaatgcatttagaacacttggaacagcctggagcacagcgaacactaggtcaagatagccacttactgtcggggaggttagttccaacatggctgggctctcagcaagtcttcttttgaggaaaggacccagaagtggaaatggcccctctccttactagctgtgtcctcacccactccactcatctacacagtttagaatctgagggtgaaagaaggaagagcaggcaagggaaggcagcagtggaaaacagctcttgggtggtaagtagggagcaggaagagcagttaccaccatgcttaaaacaaggtttttaaaaaaaaaaaattgcctgaagtcacatttgaaaataaagagcttggtaaacatgctgatggcaaagagaacttgtaaaacagtttcacttgaaaaaggccaaggttaatggtataatttcaattttgaaccttcttttaatatggattagtgctctcaaatatgggatttgacattaagatgccaaaagaagactcagaaggtaacctcaagcagtattttttaaggaaatttcttccttttatcatttgaacgcagctgaacaaaaacgttattaaaaattattctgtcataaaaacagcaacatcaatgaccataacaaatgctaaaaagcaaaattatccatgaaattaaaaatatttcacgaatccaaggtgagaaatattttagggatgacacttggcacttgagatttatgtaatgagacattaccaacttttatgtataaaatttcctttctgaaaaaaaagtatgaaaaatcaaaagaaggcaccaaaaaagtcccccactgatttggaaaacatattcttttttttttttttttacaattaactgcatttggagaactgcatcacacttttaaataaaatatacataacacattttctctttatagaaaaacctttacaaacccttaagtttgctgaattactgctgaaaaagtatttttgaaataaaatatacagaatgaataaagcatctttactccattcttcggaaattatctagatacaaatatatacatggctaagttcaaaaacttacatagtagaaagtttaataatttgatctataatattaagctgttgatactttcgattggaaagaaggaggggaaatagtgaaagaaaaattaaccacagaatatattctttgcagtttgagatataaaatgttttatcatttacattaatgtgcataacattttaatattaattgttgcctctttcatcttgctgtcttattttttaaaagcttatcatagaaaagtctctatatgaaattgttcatccaaacagataaaaagttggaattataactgggccaatgaaatgttgttgttttgtattttattgctttgcttcttctttagtaatcatctttgcagtctgtctaaacaattctctgtgcactgacatttgcaataatgtgtttacatcacaaagttagaccctgtcattcgatggaacaagaggctgtattttgtagcccccagacactctgcataacttactccctctttggcctgagagtgtaatcgttttttcatctgccatgtttaattacctttacaggcattaacaacagtttactagaaatcgatggaggagcaataaattcattaggttcagtggaggtaagaagtttcatattctttttctcaggtgaatacctatttgagaactactaacttcatcttccataaacctaaaaaatataatatatgattttcatctgtctaccagttcttaatctcctaccaaagatggagtcacaacacaaaatcaggagtcaatagttacaatgctttctcactctgacacaaaattgtgtaacttgaaggaaacgtgggttcccttatgcatgcaaatgccctatgcgactacagaatgtgttccctacacttcagaagctgttgatgttccactcagatctctgtaggatcccttttaccagtttggtgtcccattcctccctacaggtgttgctgcccatcttctccaaagaattgcccttgagtgaccagagcaacacccagaggttctggggagatatatcactaaattcggcccccacccagggtccatagctaaagactgaatggtgggaagggaaggtacaaaagtctacactcctgtctcaaggcagaactgaccctgtagtatgtttcatgctcccaagactccccatgtgatcaggttaatttcacctgaaaccacaaccttggtagcttcttccacttccttatactaattccctcactcccttcctggtttctcccaagagccctctcttactaatcacctgcacacccatctccagttctagggaattcaaccaaagaccctgtagaagcaaacattacagaacagacaggcatacaaatggttttccagtttttgcaggtaatcaatatctcagccattttaaaaggtactgtccacagtgttttataagcacaagttggggatggaggggaatcacatgcctgttatgtaattgtgtgaaaagaagttcctaagatctacaaagtcacatcatttgcagaagtcactaactgattcctgctccagggaaggctgcagttggcaagggctgcccttcttggcaggtgtcaggcagggctctgcactacaattctccctgcattgggagaacaaaaggagtctggggctaggaagaaaaaaaaaaatgacaagcgaagcattaaactacaaacagctctttgaagcctccctgatagaggtggttgtgtttgtgcaacagttattgggttgagtctaataatgaaaggacagatcaccacttactctgtgatgtcagtaatgaaagctatcaaaactaagcctgagtgggcctgactgtcaccctgtaaatctaacgtggacagcttaatgagggagggacattatcttttctcacactccaattttactcacataagaaatgtggcccacattggcaattaacttgagagattaattaaatccaataacaagttcagttccctccatagtgcattctgatatcatgtgaaggcaccaacatgctatgggcacttagcacatgttaaaaaataatggaactaatttgggctttttgtgtgtgtgtgtgtgcggaaaactggcagctaaccgcctcagtaaattaattccacaaactgatacagctactcgatagttcacacagtcttatttccaaactctgctttattatcctgaaactcccaagaaacattgcccaataattgtgtttcttccctcagcaattttactcaccagtagtatttaacatattttattgggccctctgaagaataaggaggcagccattcagacaaaacataaactctgccccagcttaagaagcaatagactgggtcccattgtgtctctttcaaaacaacggctgacactgacaaggaacaggaagagcagcaggggtgcaggcatgagcttcacttagcgtcagaaggccacgtgatatatgttctggttctctttcttttgggttccctaattcgtccttagttcctgtttttgtgttttcttctctgaaacggtaaagtgctttcctccactaccatatatgaaatttgatcttaagaaataggagtcttcaaatttgaccaattggccaaatggttattaaactgatgccttagtgaaagtcaatgaaattgttttttaactggttgctgtaaaatcatattcctataatacagatcaaattcatatactagagttattatatagatactacataataataatgcctactcctgccccactgctcccaaatcaacctactcaaagaagtgcttcctaacaatctcactaccaaggactccttttattatgatttgagaatggagtacatgtttgaaaatatttcatctatccaagattaacgattaattcatttcctttttggtattattaagaaaaatacatatcctgtctgatggaacttctaataaataaataatgaaattacaacatgaaggtaacctaatctttgacaaaaatgggaaatataatatttgggtagcctttcatagttactgtggttacaaataccctttaggaaataacgaaaagagcttgaaggtttcttttctattttggagagaattctatgacaaggtgatattttagacctaccctaatagtcactagtgcagaagatttacattaacaatctttcatacagccagaagtttcatctacctaagtggcaccttgaaactagaaagagatggtaaataacaacaagcctcaatgttctaagaataatcacatcacctgaagcatggtatctctgcgcatatcttcaattattaccaaaaatgtctatgctataaatatacttgatgacaaagcattcctacacttgattaccaaaaaaaaaaaaagtaaatggtaaacaactgattgaatttattggatctggggtgatcttatatttgtatcaaactgtaaatacatttaactcaactgatccaatattagcccattagtccatattttccacttagggtattattgcagacctactgataatcataatggctaacaatattaagctcttacaaaatgctttacatgcattcattcatttatgtgactcaacaatcccatgtaataagtactattaccattgtcattttacagatgacaaaactaatgtttagaaaggttaagtaacatgcacagccacacagcatctgggtttatctgctgcttggtaaatctggactaaacaaccaacagggatcaggcttgatattctgttccacctgatggccaaggaagatactgtgcaaatgcctgcacatttgtccttagactacaagctttctttcagtcctgtcagcattgacactgccaatattttaagaaatgtatttaaagtcccttctgatatttcttatatcaccagctaaactgcacacaaaataagttaattggttctaaggtttacctaaatatttctcattgtagcagaattgtggaaggagaagtagataatatcaagagttgactgttccatgttttatagaaagtaagagtcagaaaaaatataacctaaataattccattgaactctcagtatatgtaggagtaatggcataatgatatattgttgttataattataggtaaaagataaattcttggaaaataattttaattcacattctctaacatgagaaatttctcttcacttaaggtaaacttcgaatgtttcctttctttccacaaggtggaaatcttgaagtaatgggctactgaaaaaccagagaaattatatgcactgacttacttattcattcttaattttagattataaaagttttcttgtgtagcttagagaattttccaaatcctttataactgtggttgtggaattccacaatgttgaacctgaatagattcctatttatgacaagttacaaatttcattgtagaaacgtaggtgcaaaagacatagattccaaagatttaccactttcagtatcaaataatttacctttcatttttagcttgctctcacataaaaattgatccaaaatgctgttttaggaagaaaccagccctcataaattcttgatgaatccagatcaccaatatgaatatcagttattgaaatcctcagaacatatatgaaggggattaacactaatcatcaacacactaaatggccctaacttaggctgttacgtaccttcattcttctgctttatacagtctataactgtataaagtcttccaactggagttcatggaatcagatattcttaaaagaatacatttcaagatcctcaacttttttcctaaaattgatatgtctgaaaatgtatctgcagtaagggtatcatggggatgacaatttctgtttaaagatctcgccttttcatctgcaaacaattgtcaaagaatacattgctcctgagaaaaaagtcccatgagagcaaagcaaaatgggaatctgtaaaaaatacaatggcgatggtgtcttatttctctcaggagcagactcactgcaaacctcctcaccatatcagccaatctatttcagactgagaactcagaagtgaaatgacaggcatgggaaggaccacaaggaagtttaattgaatgtgaaaacccaagttgaaagaaagtaggcctgacctagctgattgattcagcaaataagtttttcaaaataaactataaagtggacatttttcataaagctaatgagttaaatctgcagttccaaggcttggaggaaatacactactcaaagaatgtactaagcaagagaatcttgtccaaaaattaaaaatcatatttgcagaggtatactgaaatttggaatatttcagttttcccacctctgagtctatcagattcaatatggcacctctaagagaaagaggaataggtataattaatgggcatttgagaagctttggtaagcctttggtgtacttcccaggaaaaagagaaattgaatatcttgagtgactgagcaacaaattctttttcaagacagtttttctctcaataaaattgaagtagaactaattgagttgtcagaggatgaatcataaaaaaaaatttgatgagaaattactatatgatttttggcataaaactggcaagaagttttaaaaaattcaatgacataaaaatacctccaatctcatctgcttatgtatgtgagaaagatttctcaatgcttatatctagaaaactgaaaaattgggattgtgctaaatcctgttttgttttgaaacaaataatatttgacttgatataggaatgaattaaaaaatcaaaaaaagccctgacaatctcattattaggtgaggtttcaataattttaacttttatatttaataattgttaatatataaaaaatataagaaatacatattttttgttttgatcaatcttgtgctaataatagtgataaaagctcaatccagatgtaatttttgaaatgtagaggattataaattcaaaatttttttaaaaaatttaatgttctgagactatatgatgatgcataaaatatttcaagcatattacattgataaaattctgtgagacaaatgaatgaaatatgacttatagagaaaggaatggtgcacaattttcaatgaataaagaatttgtttttatattgttaaattgacaatagtgagactcaactcattatagtatttagattccaaacggatatacttaaaaaatatttaacaatttttaaatgtcaataataagccagaaattatattctttgcaactctttaaacttataacaaattggaagcctatagtttttccagaagtctttcaaggttcagggagcaaaaaaagaaagaagaaaaaaaggagctttctgctttgtttctcctgccttgttattatttctggaattagaagatatgctttcctggccccactttcagatttgctctttgatccactctccccttagaaattggatttctgaatagctaaggtctccagatcactgaattgtggatatgataaactttccaaacaaatatgattctaattatttgctttaccctaagactcattacagcgttctttcaaataacaatcttctccagtgcttttgaaatatggttctataattataaaaattcaccttgcattctatttacaggcttttcattttatttaggtccaaaatacaaatgcattgctttgattctgtagcagatttttgagagtaatccctttttaagtgtctttacaaatatgttatctagtccaacaaggcaaaaaaggaaaatagaaaagaagggagagagaaaaaagaggaggtgatgaaatgccatcatgatatcagagaaggaggtggataatttaaagcagcaaggccctttcaaatagaagatggctaaattttatcactaattcacaataggattagaacatgaattaaatttcatttgaaaacaaagatacctattgctttatatagtccctgcctcaacagcaataccagcctgatttctttcacagttttctttctgagacaagaaataccctaataaaacaaagggaaaaatatatttcccagtgtctaatgatctttataagtcctttgacctttccatggacctcagttttcttatctgtaaaataagaaagttgatttaaaccagttatttgaggaggggcaagagacggggcaaggagggcagatgagaagaatcacaggaagggatgaatttttcgacagaatacccacactctgcatgactttccagattcctactcaagctgcaccactatccctatggatgctgagaactccagctgtgggaatttgtgttctctccttggaagaggacaaatggccggaaacaccatgcataactttaaagatcccttccagcaatgagataccatgattcttcggctatgactagaaaacatattgttactcatgtatttcttctctcctttcctttgtctctggcaagcatcactatttgctccttgctgcctagaacagtatgaggtatatatgcctggggtgtgaaaggagagatggagggagggacatatttacagcagctatgatgctcaagagctatattaatctgtagctctgtattttcatgacttcacaactccctaagcttaaaaatatatatacgtacatccggctgggcgcagtggctcatgcctgcaatcccagcactttgggaggccgagacgggcagatcatgaggtcaggagattgagaccatcctggctaacatggagaaaccccgtctctactaaaaatacaaaaaaattagccaggcgtggtggtgggcacctgtagtcccagctacttgggaggctgaggcatgagaatggcgtgaacccaggaggcggagcttgcagtgagccaagatcgcaccactgcactccagcctgggtgacagagcgagactctgcctcaaaaaaaaaaaaaaaaaaaaaaaaaaaaatatatatatatatatatgtatacacatccttatatatgtatatatatgtatatatatgcatgtatatatgtgtatatctatacatacatccatatacatatatatatgtgtacacacacatccatatatatgacattttaaaagatcctcttttctctcatcttgaagtgtgttaaaaggtatgcgtaaaaaggagctacaaaacaatgaggttactagataaggtacttttcctgaatcaaagaagctcctagacaaaatggggcctgacttggtggtcagctgtcagagtgaaacttaatttaacagtaacaatagacaaagtatgtcagactaagtgcttcatcgacaatctgaacaattttcaataaaatggccttgatgtcagttagggcagacaaccccaggtagagaaagactactcgggaaaaaaaattaagaaaaccttctgcagattcgaagggggatttttttttatccctctgaccagcctctctgtatgtaactttcagtggttcttgccttcaagaggttttcccaccacagtgaggggctgagggagatgtttgtgtccctggatctagtgacttgttttcatggctctgaagcccacagtcactcccatttagaaaatattctatatccttttggattacgcttgatctctttttatctaattaattacatctcaggaaccaagaagtaattacattaagaacttggaggcatgccttcaggaatgtcactatggctttctgtttgtttgttttaaagcaaatcagcactctggaacttggttcagattagcaattttatgcattcagctggatacaatgcaactcctggttattagaataagaaataaggtgaagaacatgaaggaatgtggttcaatctctctctctctttcccttcctttctattccactttagtatagcaattacaggcctctgagtttgggtttagcatcgtgatggtaggcaggtatttacttttttacttgagggtcaagtgggatgaaaagcaaggaaaaaaagccaggacagtccaaggactggcacatgtcaaagcacagaggaacaatacagatcttcagaggaactttttttcttttacttcctttttaaaaaactttgtcagtgtagtaagtggtgaagactatttgctaaagtgttcaacaacataactgctctgagatttctccttcactaggctactctcttaggcctctgtgaacatctgtgccatgtgtacaggccacttcctaacaggcccaaagaggatgtgttttcataaaagttgtaaacacatttaagaaattatctgaagctcataagccacctgatttcctaggcaaggcctctcatcacattaaccatattttacgtaatgagcagatgggcagaataaaaccagagggaggagaagtggaggaaaaggacagtaatgagtgatgaaatggaaatcacgtgattaatggaacatagattttaaaaagtaatgaagagtttatccctagggtagaaaacagggaacaacaaaaataagtaccacgttgtcaaaacagtaaaataagagagtagaacaaagaaacagagcaagacaaagaaatgctggttttaggataggccttattttaaagacacaggggattttggaacttaccattttgcagctatttgtttaaacaaaaataaatttatgttgcctggtgtcctaaaagttacttatgacaacggtcattaatagataagagcctgcagctatccgggtacaccaacaccagcctttgtgtttgttcaacatttctttctgtgggaaatgtaatttgtagcataagagttcacaagaaccctcagctccatggctccatcactaatgaaacaagtcctggattttcatagcaaccatcaagcataaatttggctccccagagcatgtgaactttatgtgtgaattacttatgtgtgtgcacaaactaaaggcaaattcatgtgaagcatacaggcaatttacaaactctatctgttctgaaagtctgcacagtaacaggaacacagacagaaataacaaaatgggtgtatatgtccaggtttctccacaaaagatgacctgtatacttgcaagggcaaaatatcacaaaaacaaccctaatgcaagagtagtaatgagagcaactaaaaataaaatacagaggctgggcctggtggctcacacctgtaatcccagcactttgggaggccgaggtgagcagatcgcctgaggtcaggagttcaagaccagcctggccaaaatggtgaaacaccgtctctaacaaaaacacacaaaaaattagcaaggtatgctggcaggtgcctgtaatcccagctacttgggaagctaaagcaggagaatcacttgaacctaagaagtggaggtgcagcaagctgagattgcgccactgcactccagcctgggcgacaagagtggaacttcgtctcaaaataaacaaataatagaaataaaatagaagataatgactgtgtgtgtgcactttcattattttgaatgttagtgctcaaaggaaagcaaatttagttagaaaacaagctgatagaaaaacagtttcagagattcttaagagaacttcaggacacatttaagaaccatgaaggctggtaacacaagttttgaaaaaattaggccttgtttcaggacaattttgtttttcccatttctaggaatccgatgtatcattcacacaatttgtattcccattagccttgattagggacatatctgtgctcacattagactccctgaatacagggaccaaaattcattcaatgttgccacttgggtgtctaatatgctgcaaaaatctctaggaaagatataaatgaacaaataaatgatatgctgagataacattgtgaagaatttggcaatgaggaggggcattatcttcttccataaagacattgatttattctttaatatcactcagaatcacaagaaataatcagctgatacagaaatggaacagctgtctcacacagaagtggctaaagagaaaaaatttccacaaaatactggaaaagatggtaacaaatcaaatttcaaagttgggcagccctaccaaaaagagaaaaagaagatacgagaggagtcaatagtgacagcactactgaaattcaaaaataggacttgaggtctaagacaaactgataaaaattaaaataatggcaattactcattgaacatttactatgtgccaggtactatatatgcatgatctaatttaatctttataataatccatttaggtaagtacttctatcatccttattatacagatagtcaaacacgatgataaaaagtaagtaactttctcaaagtcacccacctagtaagtgatggaaccagtactttaaaacatgtctgtctgactccttaatcaatgcaacactaagatacatgtgactaatcaaggaaaaagaaagagttttgatttttgtttctttttccaatttagaaaagatgaaggagaattctagaaccttcacttctgagcaaatagcaaaccaacttgctgttgggaatttaagtgtcatgcacattaccatttacattagtttgaaaaagaagtaaatgtccaacttttagtttctctaaacagttattctagttttcctaagtttgaccccaaaagggatttgactgtgaaacaaaactctctgtagttctcagatatggttagacagtcagatgcccacaagtaacagcctgtgcagaacatcaacacagtatatcaccccagcaaggaaagttcaaaggaaagatttctaaggctactgagataaaatggaatagaatctttccagtatatttctctttgctatcaaaccaaattagaaaagactaatttatactaaattataaatcacagcatttctaatttaatcactgtctgtttttttaatttttgttcttgttttagttttgcatttctttcacccatgggatagatacacattctcacttaagcccctgttgaaactatttccattgtcccctagatcctcattctactttaatgtgtctatcttcagtaaaacacaactgataaacctgaaagataataaactggacagactagcactgagattctaaatgagataaaccggcagtcatcctgacagtaatggaataaataaagcatgaataattacattaaaagacaatttctgatttaaactttgcttttcctgtttttacacagtagaaaaaattaggctgtctggccttccttaggagaaatctttcttagaaggaatgtgtgcttatttttaaatctatcataacaactgatatatcagcaacaatgtacccatatttacctcatatttatatgtatgtcttctctattataagcaatatgttatgaaatatattagagattagttcaaagagttgagattggttataaagaattatattagtcgggtttaaaacgtatttggaaagttcccagtataaaatagtttagttgtgttattttcctcttgatgtcttgaatgttgcaaggtactattctatggctggtaggggcatgcaacaggtgggagtaaggaaggaaacagcaagccaataataagttttgaaaataagcccaatcattaagtatatgttgagtctcttcattaccgtgaataggaagtctaatagattgccatatgcagaaacagagaaaatgctgttttagtggcacctaatgaggttccaaaaatgcagtaacttgtagattctttcacattcatactctgtgtaatataacgctatatagcacacttagctctctttataccttgatattttaatgcaaacacagattcttttctctatggctttaaacattacacaggaacaagctcccatgaacctctttcacattcctactcagagctctctgtgaaaagctgtcatttcttgttctattcaagtcagactacctagtctccaggcacaatggtaaaaggaatgtcaaggtaacatcttcatttattcatatgattttctctttttttttaattatactttaagttctgggatacatgtgtagaacgtgcgggtttgttacataggtatacacatgccatagtggtttgctgcacccaccaacctgtcatctacattaggtatttctcctaatgctatccctcccctagccccacaaaccctgacaggccctttgggtataacctagtaatgggacggctgggtcaagtggtatttcttgttctagatctttgaggaattgccacacagtcttccacaatggttgaactattttacactcccaccaacagtgtaagagctttcctacttctccacatcctctccagcacctgttgtttcatgactttttaatgatcgccattctaactggtgtgagatggtatctcattgtagttctgatttgcatttctctaatgaccagtgatgatgagtttttcttcatatttttgttggccacataaatgtcttcttttgagaagtgtttgttcatatccttcacccactttttatggggttgtttgtttttttcttgtaaatttttttaaggtctttgtagattctggatcttagcactttgtctgatggatagattgcaaagattttctcccattctgtaggttgcctgttcactttgatttcttttcaaggaagcactaaatatgaaaaggaaaaactggtataccatccactgcaaaaacataacaaattataaagaccatcaacactatgaaaaaactgcatcacctaatgggaaaaataagtagctagcatcataatgacaggatcaaattcacacataacaatattaaccttaaatgtaaacaggctaaatgccccaattgaaagatgcagactggcaaattggataaacagtcatgacccgtgggtgtgctgtatcggtgcgctatattcaggagacccatcttatgtgcaaagacacacaaaggctcaaaataaagggatggtagaatatttaccaagtaaatgtaaagcaaaaaaagcaggagttgcaatactagtctctgataaaacagacttttaaccaacaaagatcaaaaaagacaaagtagggcattacataatggtaaagggatcaatgcaacaagaagagctaactatcctaaatatatatgcacccaatacaggagaatccagattcatatagcaagttcttagagacctacaaagagacttagactaccacagaataatactgggagactttaacaccccactgtcaatattagatcaacgagagagaaaactaacaagaatattcaggacttgaactcagctctggaccaagcagacctaacagacatctacagaactctccaccccaaatcaacagaatatacattcttctcagcaccacatcgcacttattctaaaattgaccacataagtggaagtaaaacactcctcagcaaatgaaaaagaacagaaatcaggccgggcgcggtggctcacgcctgtaatcccagcactttgggaggccgaggcgggcggatcacgaggtcaggagatcgagaccatcccagctaaaacggtgaaaccccgtctctactaaaaatacaaaaaattagccgggcgtagcggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaaagaacagaaatcataacaaactgtctctcagaccaaagtgcaatcaaattagaactcaggattaagaaactccctaaaaaccgcacaactacatggaaactgaacaatgggctcctgaatgactgctggttaaataatgaaattaaggcagaaataagtaagttttttgaaaccaataagaacaaagacacaatgtaccagaatctctgggacacagctaaagcagtatttagagggaaatgtatagcactaaatgctcacaagagaaagcaggaaagatctaaaatcgacaccctaacctcacaattaagagaactagaaaagcaagagcaaacaaattcaaaagctagcagaagacaagaaataactaagatcagggcaaatttgaaggagatagagacacgaaaaacccttaaaaaaatcaacgaatccagtagctgggtttttgaaaagattaacaaaatagatagactgctagccagactaataaagaagaaaagagagaagaatcaaatagacacaacaaaaaatgataaaggggatatcacaactgatcccacagaaataaaagcaccatcagagaatacataaacacctctacacaaataaactagaaaatatagaagaaatggataaattcctggacacatacaccctcccaagactaaaccaggaagaagtcgaatccctgaagagaccaataacaagttctgtaattgaggcagtaattaatagcctaccaaccaaacaaagcccaggaccagatggatccacagctgaattctaccagaggtaaaagaggagctggtaccattccttctgaaactattccaaacaataaatagaaaaagagggactcctccctgactcattttatgaggccagcatcatcctgataccaaaacctgacagagaaacaaaaaaagaaaatttcaggccaatatccctgatgaacatcaatgagaaaatcttcaataaaatactggcaaactgaatacagcagcacatcaaaaagcttatccaccacgatcaagttggcttaatccctgggatgcaaggatggttcaatatacacaaatcaataaacataatccctcacataaacagaaccaatgacaaaaaccacatgattaactcaatagatgcagaaaaggccttcaataaaattcaacactccttcatgctaaaaacgctcaataaactaggtattgatggaacagatctcaaaataataagagctatttatgacaaacctacagccaatatcccaccaaatgagcaaaagctggaagcattccctttgaaaaccagcacaagacaaggatgccctctcaccactgctattcaacatagtgttggaagttctggccagggcgatcaggcaagagaaagaaataaagcatattcaaataggaagagaggaagtcaaattgtctctgtttgcagatgaaatgagtgcatatctagaaaaccccatcgtctcagcccaaaatctccttaagctgataagcaacttcagcaaagtctcaggatacaaaatcaatgtgcaaaaatcacaagcattcctacacaccaataatagacaaacagagagccaaattatgagtgaactcccattcacaattgctacaaacagaataaaatacccaggaatacaacttacaagggatgtgaaggacctcttcaaggagaactacaaaccactgctcaaggaaataagagaggacacaaaaaaatggaaaagcattccatgctcatggataggaaaaatcaatattgtgaaaatggccatactgcccaaagtaatttatagattcaatgccatccccatcaagctaccattgactttattcagaattagaaaaaactacttcaaacttcaaatgaaaccaaaaaagagctcatatagtcaagataatcctaagcaaaaagaaggcatcacactacctgaggcatcccgctacctgatctcaaacgatactacaagattacagtaaccaaaacagcatgatactggtaccaaaacagatatatagaccaatgaaacagaacagaggcctgagaaataacaccagacatctacaaccatctgatctttgacaaacctgacaaaagcaagcaatggggaaaggagtccctatttaataaatggtgttgggaaaactggctagccaaatgcagaaaactgaaactggatcccttccttactccttatacaaaaattaactcaagatagattaaagacttaaacataagacctaaaaccataaaaaccctagaagaaaacctaggcaataccattcaggacataggcatgggcaaagacttcatgactaaaacaccaaaagcaatggcaacaaaagccaaaattgacaaatgggatctaattaaattattcatactattttcatgttggacagtattataaaagccaatcaaattggagaaataacatagtatattttacaaaatgtaaatttgtgatgcaagcagaagagcttctgctactcatgagagttatattcttgttacccaagaatataacttcgcatcttttcaaaacaacctacacagagtaactcttaaaaatctgctagtgagggggaaaaggagggagaaagcaaagcttcaaaggactttctaaagaaattataatactaagacttttatatgacattcaaccctgttttccccccttctcccccaacaaaataacctagccaaacaatagagaggcaacgtttaaatacaaactttcttccactcaacactagaaaactggtaagattaggtcttcaaagaggctgagctaagaattctcctaagctttaaatttcctgcaaaggctgagttttatttcttaagggaagagcttctgtttggcttttctttttctttttaagaaaaaaattctatataattataggtttattgttacatttgtatgtatgagcaaagtacaggcaaagaaagaaaaacattgtcaagaagctggttatgactaaatatataaagatggaatagtctaacaatgccagttgaataaatactgtaacaaaactgtaatttaaatgaagctaccaaaatatttcaaaagacaacgcattttatgattttaaagtttatcttcaaaatgaaatatgatcatagctattaacaatatgctgtaaaataaaatatgctaaacattgcttctgttagtaaccactagtttctcaggaaacattctttatagagcaactctgattaatgtacaagtgacagcttttttttttctgagcactaaccttacagtataccattgttttcaagacagtgtttataaaagctgtaaagatacgttttagacattaccttgtctatatctatgaactgtcagcaaaaaatatccctttttcaccttctctccactctccatttccagttagacattgtgttttcatccctatatagcttgcctaccttaaacagaaaaatgaccaacatattcttatgtgcaaaatctgaaaacatttctttcagaataatatgacctgttagacatccgaagatcaagacagggataaagatttattaggccaaaccacacaggacttatatgttatgggctgtaggacagagcgtattaaattatttccctgatcacacaactgaatgtaaaaggctaaacgtttcactgattgtggtcaaatatgattgttgctgcagtagagtaaaggccccaaaagtacccttagttaggtcagtgaccaaatgtcactctatatgattttgttcttcacgggcaatgtctccaaagtgctaaatgtgtgaaactccagcttgaaccaaggaatgaattttagtttgctcttaccctttgaatggataagcacattgaacatgaaaatcttctctcttccttatcaacaaggcactaacagaattcagatttacagatcagacacagaaatatggaaaatattcttaatgttagatcaaatacggaattatccaataaataaatattgagtttacaaaccatctaaactttgactctcctacttcccatctaccaaggaagggagaaaagtaagaaatggaagttaagctcaaattactcaggtactgtttgttaatatatctggtgactatcttatgtgagggaaaaactggaataataggaaaaggtttggtgattctacgtagcttttgtgactgtagttctagctcctaagttttactttccaaatagctaagggctgctgttctcaaaagagctaccctttctaaattcaggaaataacaatggaaagaaataattgttaaataaaagtatatgttgatgtttaccctattatatattattttcattttatatgttatatgcacaaaaatttattggtacatatttctaaatgttaaaatcttggttctctgggtgataggatcatacatcatttttatctttacatctatacttttgtgcattttctgctgttctgcaacaagcatgaaatgattttatgctcagggagaagaaaaaagccatctcccaccactacgcccacttcaagaagaagaatgaagagtaaaagaggagaaatatggtaaaggagtcagctttgtactctctgtctgctgttttttgcttcctctcatttctgctttccttagcagaagccaagagtgtttggggggcctaggtctgaggccagctccacctctgaccagtgtacctccaattctctccgagccttggtttcctcttctatagaacgacaataataatggtactcacaagaagtcaagaagaaacaggataatgcatgtaaagctgttaccatggcgcctggctcaaagagaatacccaccaacattgctgcactttttttcgccagccttacctgatcatagaaatcttaagatttataaaatactttaaagcaaacttgtccaacctgcagcccacaggctgcacacagctcaggacagcttagaatgcagcccaacacaaaatcctaaactctcttaaaacattatgagaccttttttttgcaatttttttttaagctcatcagttgccgttagtgtattttatgtgtggcccaagacaattcttccaatgtggcccagggaagccaaaagattggacgccgctgctaaagcttacaatgagctttaacaaacagtaatttaatttttaaactgatagtaaaaagcagagctagaattcaaacctcaccttcccacatcctagctctgataaccaaacaccacttttgagttggattgaaacagttgcctactggagctgcctccctgaggcttacctgcaattggtaaatttcagtaactttgcataccagctgttaaacacagacattattttaaattattatagaattatacaaattaaaatataaaagttacaattaaataaaaatattttaaataaataaatatatgaagctcgtcatgtccttatacttttttcttttttttgagatggagtctggctctgttgcccaggctacagtgcagtggcgcaatcttggctcacggcaacctctgcctcctgtgttcaagtgattctcctacctcagccttccaagtagctgggattacaggcgcctgccaccatacctggcaaatttttgtagttttagtagagacagggttttgccatgttggccaggctggtctcgaactcctgacctcaggtgatccacccacctcagcctcccaaagtgctgggattacaggcttgtgccagcgcacccggcccttatacttttattatctatactctttaagcttatttgcacctattgtatttgtagagtggaaacactacataatagagtgctacatgtatctcttcctaattcacttgcagtaaattcacattggtagcttgaaatcagccaaactggcaaatgccacaaatcaagactcaatatcatttcgttgacttgagagtgatggagaatatgcagattaacttaaagtgtgccatatctgtggctgttatattctgaataacacacacacacaaatggagaacccattcttccagtattataaactatcatacaatatgtatgacagaaagatgattattcatcagttgcaaacatagactggctatggatataagaatttggcaaaaatcaaccaaagcagtgtgtgagaatctactggctatccaggatttacaatcaagagtagtgattattttattcatatttataaattacatgttacatgtcctttatatcagtaaaattaataataaacacacatgcaagcatgcacattagggcatgcatgcacacacatacacatatttttccttgagagccagctgttaaacatttaccagcataccactaaattgaccattattttaaactaagaggaacctagaagctcttaagcagagccctaggctcatcttcaaatcactaaggttgggttataaatggttttagcttcaggtaaggctaccaaattagatcattgtatttaaatatactatgttggcaattcctatcctgcacaatgatgaagtaggctcatagcttcaagttccaccattattacagaaaaatttattctatggaaacgcaacttagggaaagtcaagatagctttctacaattcacaaaaactatggagacatacaaagaagtaagatatggctccttcctgcctccaagacagttgagcagggaggacaaacacataaacctataatataaaaggcacagcactgatagatacaacgtgctatgggatgacaagggagagatcccatgagtttacacttcaggtcctggttaatggcaccagtctcacctgcctcaaaagaagcaagggcaaggaggcaggttccagggagaaggagaaacctataaagtatggcataataggaagaaggattctagaatcaggcagcctgtgctcaaacccagactctttcactaactgtgtgaacacgtccaagttacttggcctctctaagcctctgcttcttaatctaaaaaaggagaatagtaactcctgacccagagcactgtagtgaggatcaaataagacaacatctgtgaaacacttaccccagtgccccataattcaaaagtgctcactcaatgaacattacctactactgtgatggttgttgatagccttgagagttgaaatggctgactttggggactaggagggtgcaggaactagacagagggattccaggcagaaggaagaaaataagcaccccccaccaacaaaaaaaaaaagaaaaaaaaaaacagagattacatacaggggcccacttagtagtcctgaggtagtagaatattcctggaggtctaggtcaggcacagctacagcaaataaagactgaggctagaccaaggctcttccagaatggttcaaatatacactcattcctcatgctcttctgagaaaaacgaaacaaaatcaggcttttaagatgataccctttttcttctgacaggtactgtaaattgtgtctctgatatattttgaagagcctataagggaatgataaatcaggcaatattacatatattcatcagtaccttaattgttgttaaatactaacaacacctaaaattgatctgtaccaagatttactgctctgacaaaaaaccacctggaaaagagcacatgataattaagaacgaccaagggtttgaagcaatctaacgcgtatgaacaagatttaaactcctccccgagggaataactaggtgatgtttattctgtagatgaacaatgtgattataacaatggaagattgatgagatttttttactgtgggaatctgatttagccggctagctcagataataggaggatgcaaaactaagccatccagtaccacttaaaaattctttgtgagggacacatcttcagtgacctgaaaaaaatggactgcaagtcaggcaggcatattaggcagctacaaactgtcatacaaaaaaacagcatttaccaaaaagtttctaaatgcaccacaactgagttcaaccaaattagagagaaaaggtaggaagagaattacattcttatcagaagcaaaggaatttttttttcttttggtggtcttttgggcctaccaactgttatttgagtctaacaggttattcttagtaatccctcttgtccaggaaaagaggaactgcttggtctattttaataaacacacaaactaaaagcaaggcaatattagtcttccagagccttgctatgaaaagtgtaaagagctatcacctaggagcttgttagaacctcaggctcttgggctccaccctagacctgaatcaaaatctacatttttgtttgtttgtttgtttgtttgagacagggactcactctgtggcccaggctggggtgcagtggtactatctcagctaactgcaacctttgcgtcccagactcaggtgatcctcctacctcagcctcccgattagctgggactacaggcatgtaccaccacgcctggctaatttttctatttttagtagagacagggtttcttcatgttgcctaggctggtcttgaactcctggcctcaagccatccacccacctcagcctcccaaattgctgggattacaggcgtgagccaccatgcctggccagaatctgcatttttaacaagaaccccaggtaattcctttaaagtattagaagcaatgctctaaagagacattcattcgttcattcaatacgtttgcgagatctgcagtgtcatttatggtatgtagccactagccaaatgtgactattaacatttcagttagttaaaattaaataaaattaaaattcaaggatttatttgcactaaccacatttaagttctcaattagcacatgtggctaatgtctgccatatacattttaatcatcacagaaacttctattggacacatcactgaacaaagaagacaaagatctttgtactcacaaagtttagattctagtggtgggaaagcagatacaataaacataagtgactcagttaaatggtatgttggacggacagttcaaggctaaggacaaaaattaaaaaacaaagcagccttagagggatcaggaggatggaaagacaggaattttaaatatggcaggtctggtagtttcaatgaaaaagttacattaaaggagaggcaggccgtgagctgcccgggatgggggcaggggggtagtttcaaagggtaaagcctgtgcaaaagccctagggcaggtctgtttccataacagcaagggtcccatgtggctgcaggagagtaaggggagaaggcaagtaaaatggtaggagaacagaggagtatggatcctgggtatggaaagggcttccttatccattgtcaaagatttgagcacttacatgaaacgaaataaggggtccttgcagtgttttgagcagacaggtaacatgcttcaacccgatctcaaaagttattctcgttcagcaaaaaatgactataagtaaaagttattattattttttaattcaaggtcatgttcagatgtagaaagatactatctgcagtggcaaaatgactttgtttacaagttttggtaaccatgagaagcttgttaatgatacacaaacaagttattaaaatttatcactgtaaaattcagatactttttcaaaatcctctatgaatatgcagagtcacaaggtcttacaggttaccacccagaaccagtagccatctttgctataaaacttttcagcaaatcctgaggaatgcaaaatcagagttgcccaattgcccaaaaggtggaactctgcttgagtgtctcaacctgaaaatttgttgattactttatagagagaaagagatgaaaatctgttaaatagtttcaattttttcttttttaccccaactcatgtaaattgaattcatctactctaacatcccagttaaatgtcaaagctttgggaatcaaggtagggatttttatttatttttcaaagttcagttcccagaaacaatgacacattttacccacaagtgagaatgttgttatcttgtaggtaatccagctactgttctatgaactgtaggtcactgtagcctgtctacaaaatgccatcatcagcttcaaggcctgtgttcactaagacagccacatggaagttatactgaacaggcaaccctaaaatgactgagcgccatcgcctgagatttattccctgaggaccaccaccaactgtgatccagccagaattctggcaggaaaataaagtaagttcaccttctgtaagttaaatcaaatgaacaataaatcaaggcatgttgggtcattgggaactaactgctcagatgctcatggccggtgagtgaatcaactggcatcattttaaagcatctgggcatagcatttttgagctatagaacataagaggagattttagcaaccaaattattaccaacgtcagtgattggagtccagaactggagctgctttgatagttcattcgtgtattccttcattcattcaacaaatatgtgttgaggaactcctacaggtaaataatattctgtctgctaaaaatacagaactttacatacagtaaacttgtccacatgaaacttaaagtttcagttttaacctcctcatggctccctcttggagccaggaaccttccagagctaggagacctcaagaggtctttcatggatgggaaggattcagagactgttttagagtgataaggaacataaggtgtactaccagaaggtgaatcttcacagggtaagaggtgtatgtaagcagtaagttttatattctctatcctgaagccagagcacctaagagcttctttcatttccctcatccacccacagaagtcacccctaagaactgaagcattcttcatcccacctcatttctggcacagcaaaaccagaaggagcagggaaaacacattcccagaggccagacatattaagatactggaagtaagcaaaggggctaatagacctaaacaatcagctttggggaaaagaagatcctctctgttgcaaacagagctaaaaggaacagcctagaacagagcctacaagccaaagacagtatattagccaggcttctccagagaagcagaaccaatgggataaatgtagatatacagaaagagatttattgtgagggattggcccatgccattatggaggctgagaagacccactatctgccatctgcaagctggaggcccaggaaagcaggaggtatagttccagcccaagcccaggggcctgtgaaccaggagagtcaatagtgtaagtccctttggatcaaaggcccaagatacaggagctctgatatctgaggacagaagaagatggatatacctgctcaaacagagacagtgaatttgccatttctgcacgttttgttctattcacgtcctcaagagattgggtgatgctcagtcgccttgatgagggtgacttttacttagtctgctgattcacatgctaatctcttccagaaacaccctcgcagacacacccaggaataatgagcatatctcttagcccagtcaagttgacacaaaattaaccatcacttgtgtcctgccacgtatttttgttaacaaagctttactggaacacagccagttatttgtttacatattgtctatggctgcttttgatataaattctactgtccaatatagtagccactggccacataaaatgtgccttatccaaattcagacatggtgtaagggtaaaatacacaccagacctcaaagactgagtaggaaaaaaactgtaaaatacctcatcaataattttttatattgattacagggaaaaaactaatatttttaatatttttggctaagtgaaatatattattagaattaatctcatctgtttctttttactccttgtaatgtggctactacaaaatgtaaaattacatatggggcttacatctgtggttcacagtatatttctattggacagcctggcacagaaggaaagactccagtatgtatacagaccctggagacaagttgaatagaaaaactctgttcttactctaccttccactttatgtctgtttttaatactccaaccccaggtctttcttttaataattatcctaaattaacaaacacacaaatctgaaattcttgcaggtcactattgctgaaaattcaacagaagaaaatctgtgtatatcagaatttcacacaaagatgggtcagtggctgggctgcatagtggatatttgctgcctaccaacattctttctactatagcaagactctaagcaaactccacaaaggagacactctgaagtttcatgatctacatagatgctcaactaaggtaccaagtcatttaatgaagaaataataatctcttcagcaaattgtgctggaacaactgaataaccacacatgccaagaataaagctggaccccttcctcacaccatatataaaaattaacccaaaatggagcaatgatctaaatataagtgctaaactgtaaaactctttgaagaaagcataggggtaaaatcattaccctcacatttggcaatgaattcttatatatgacaccaaaagcacaagcaacaaaagaaaaaatagataagtggtacctcctcaaaattagaaaccttggtacatcaaagacattatcaaaaaaatgaaaagacaatctacagagtgagagaacatatttgtaaatcatatatttgacaagggtctagtatccagaatatacagtataagaaattcttacaactcaacaacaataaaaacaaacaaacaaaaacaacaaaaaaaccaggtaatgggtagaggactttaacagacatttctccagaaaaaacatgcaaatagccaacaagcacctgaaaagatgctcatcattagtcattagggaaatgcaaatgaaaaccacaatgacatgctacttcacacctaataggatggctattattttctttaatggaaaataacaaatgttggtaaagatatagagaaactggaactctccaacaatgctggtgggaatatacagtgacttagccactgtggaaaatagttttgtagtttctcaaaaatttagatatggaattaccatgtaccccagaaatctcactggtaggtatatatccaaaaggattgaaaacaggttctaaaacaggtacctgtgcatacatgttcatagcagcactatacacaatagccaaaaggtggaaacagcccacttgtccatcaacacccatcaatgaatcaaaggataagcaaattgtaatatatccatacaatgcaatattattcagccctaagaaaggaataaacttctgatacatcttataacctgggtgaaccttgaaaacatgccaagtgaaagaaacaagacacaaaagatcatatattgtatcattccatttacataaaatatccagaataggtaaatccacatagatagaatacagattggtggctgacaagggtttggggaaatgaggagaagctgcattgaaatgaggagttttattttagaaggatggaaatgttttggaactggatagagatgatgattgcacggcactgtcagtgagttaaacgccactggattgctcactttaaaatggattttttgttatatgactcttatcttaataaatttttaaatcatatattttttgcatttcacatgtcacaattctgatcttttaaatgtaaaatacattttacattacttaactatttctagtcctcacttctcctccaaaaaaattacattacagttgacactagattttgttaaactacccaaaatttactttgcatatatccctcttgtgcacaagttagtcagaattagtttctgttgtttgcaatcacataactttaattgatatggtaccttagtatgtcagtcagggagcctgaggtctaattctaggtctgcatctaattagctggtaatctcgggagaaattatttaaattagcttggctttagctttctcatatgtaaactgaaaggattagactaaattattcctgagggtttaaaattccataaatgacataacatctccttttaaaatattatccaagaagaagtaattgtcagatagtgatgatgtgacattttttccagtaaaaagtaaatttggaaggtaggccctgcttttactctagttagtccctccacctcactcttctggctcctcagtaatgtttagcatgcatattccaatagataaaatccctcaaaggtgttcagtttcatttctctgatgtgaaagggcaaatcaaatgaaatggttagagacaatgctcaaaatttaaagctgtatctaagtttcccaactcgattaggccattcttacattgctatgaagaactacctgagactgggtaatttataaagaggtttaattggctcacagttctggaggctgtacgagcatggcactggcatctgctcggcttctggggaggcctcagggagctttgactcatggcagaaggcgaaatagtagcaggcacttcacatggggaaagcaggggcagaacagagtgtggtaggttccacacacctttgaacagccagatctccaaaactcactcactattgtggggatagcaccaagggactgatgctaagctattcatgagggatcagccccccctgatctaatcaccccctaccaggccccacctccaacactggggattaccattcaacatgagatttgaggagacaaaacatccaaactatatcactaaccgagtgttcagattgtagtatagaaactatccaagggcacttcaaatgttcctcttatcattgaaggggctgaacaataatttgacccaaaagcttggcattctgcttttactagactaggctggtattataatgacctttccttttgaaaaacaatagtggtttctatctgttgtcttgtaaagatgagttttatattattaagaataataaaagattaaaaaatgttttaagcatttcatccagaagctacaaagcattatgttggggaagtttgaggagtttattaggtcaatctaggctctaatatactcagattattgatttaaaccggtgagcacaataaatcacactggtcatggaggtggcaccagctgaaagtgagaacacagatcaattacccgagagttctgggctttctcactgacttgccattaaaaaattaccttcgtggtttcacctcaaagatcagtctgctttgttttttttttttgtttgtttgtttttttgagatggagtctcgctctttcgcctaggccggagtgcagtggcactatctccgctcactgcaagctccgcctcccgagttcacgccactctactgcctcagcctctcgagtacttgggactacaggcacccgccactgcacccggctaattttttgtatttttagtagagacagggtttcaccgtgttagccaggatggtctcgatctcctgacctcgtgatccatccgtctcggtctcccaaagtgctcggattacaggcgtgagccaccgtgcccggcccagtctgctttttttatgcaaactttgaccgcttagaaaagcgctacaagactggagtggttatgcttggctctggtgtcagagtgcttggattctagctaaaatccacccagggagtgtcgcttaaccttattttctctccgtttcctcaactgtaaagcaagaaaaataatagtgtttcccaaagcctggcacatataccactgggagtataccagatgatattagatggtacatgagtggttttcttcttctgttaacaattatgtgtttaattcccagcatattaaaatatatataattagcacatcaaatgctatggtttgaatgtgtcacccaaagtccatgtgttggaaacttaattcccagtgcaacagaggtgggtccttcaaggggcaattaggtcacgagggctctggcctcatgaatgaattaattatgttatcagagaagtgggttagttatcaccagaatggattcctgataaaacgaatgagttaggcctttttccctcactcatgtgtgcatgtcttttatccttctgccattggatgactcatcaagtaggcctttgccaaatgcagacccttgatcttagatgtcccagcctctaggaccatgagacaaatacatttctattcattataagttacccagtctcacatattctattatagcagcacaaaagggactaaaacaccacactaaaattattgcgtaggacaaatctaagtcaaggaaaagaagtgcgctccaaacagtcctagtcagtcagggaaagttctttacagaaaaagtctagttgacaaatggaaaataattaacagaattagaaatcatgatttttgcaattacttaatgacataattgatttaagtaacaatcatcaattgaagaaacaatcacatgaaaaattaatatggaactttaaaatggaatagtcagtctgttacctgccaaaaccaatgatgaatctcagcttcaataaaacaggttctgaatagtggatgcttcctaataaacgtagtaaagacaccctctgcaaagcattcttgccaaaaacatttacgttaaatcaaatttagagacagcatcccttaagaaaaaataagagtggtgaaggaacacattaaagaagagcatatgaaaccagaatgtgtgacttcctacagaacaaaagatcctgcttctataacaagtctacagtgggaatggaggcaggatttctctaggttaagagacttaaggaacatatgtaatataatgtttgaatttgtttgaatatgaaaataaggaaaaacagtaaatgacattttcaagtcagttggggaagtttcaatgtggagctggattagacaataccaaataattactgtttatattgcttgatataataatggcattgtgcttaagtacaaaaatgcccatatttgttacagctgcattctgaaatacatcagagtaaagtgaagtgatgtctgcaatttgctttaaaatacttcagaagagaaaaagaaaggaggggagggaaaaagacaatatgaagaaaatgtagtaaaaatcttgatgattattgaatctaggtatacaacctgcttgataatttgcaggacccagagcaaaataaaaatgcagggtctcttataactgcttaagaatttcaaaacagtgacagaagaaccaaataaccacattaaaccaaatgtgggccttcataagccatgggctctgaacaactctcaggctgcatgcacatgaagcctgctctatgtgttagataatatggaaattaattgcactattcactctacttggtgcatatttggaaaacttccataataatttaaaggggatcacttaaaaatatatatatataaagtaaagattatatgaggaaatagcaaaaatcaggaaggctacaattggccgcaatttccaagatactgatgtaatcatgaaagacactcaatgtggtgcctgacacacagcaaatgctcaggttagctcctactactgttgctaccaccagcactaccattttgacaaagactacccttgtatctagtaagaaacatgaacgttttatagagattactacaacaacattttacagaaaggttactttagacatcgtgaaatccttactgggagatctacttatatacagaaagtcttacaattcttaccaatatttctgattgtattttgctcccttgtgccctatattctttaaaacttgcgagggatttccatcaatgacagactggataaagaaaatgtggcacatatacaccatagaatactacacagccataaaaaaggatgacttcatgtcctttgcagggacatggatgaagctggaaaccatcattctcagcaaactaacacaagaacagaaaaccaaacaccacatgttctctctcataagtgggagttgaacaatgagaacacatggacacagggaggggaacatcacataccggggcctatttgaggggtaggagtctgcgggggttagcattaggagaaatacctaatgcagatgacgggttgatgggtgtagcacccaccatggcacatgtatacctatgtaacaaacctgcacattctgcacacatatcctggaacttaaagtataaaaaaacaaacaaacaaaaaaacttgtaagggatatcaactgtgggccacaacagcacttagaacagaatattattactaacttgaagattcttctgaaagccagactcctctttgtaattcaagtgacatcacttacagtagcaaagaaagagcatcagaatgaaataagtccttgtgggtctcaatcatggtgaataatactgtggtttttcttgaatgagaaagggcatttgcaaacctcaaaggggtttaacgaaaccttactctcccctttaaatgtccaaattaagcttctttggaataaaaccttctcaaaagaaagcaaatgtaaaagttagattattgtatatgacctaaaacatttgctgaatcacaataaacacataccagcatctactatagcctgttacctaaatcaagtttcacagacccagagaattcctccgccttattttgttttttaaacattggattgaaagtactattgaggatcagcatgatcagtgcaaaccttattttgcacaaagagcaatttaggaaaaatggataaggtgataggccaccaatttatttgtctatccagaatgataatggttttattaaatcccttaaagaaagatgaatttttataagctagactatctaatttgttaaatagcacatcaatctgaatattgtcactgttttttaaaatactctaatgttaatattttggcatgtttgaattgaggcaacacagagttttctaatcgttaatctttaacttgatgaagggatctacacagaatgaagcagactacacacggcccaagggtagtggagatgtgtgtggtatctgttgcttctattaaacatttgcacatgaagcatgggtatatgctagcagaagaacactttcagacatcccatccctattcagttatccttcaaatcatatggcaacaacacaataagagccacttataccttattcccccgatggaaactctttgcctcttcagagagcccataaccagctgagggcccaggcctgactggtaacccctcagggagggagcatgtccataaatcagcaatatagcagagatggggcttcttatccttggcagccattttccctgcctccccttcctcccctaggacatcccctctctgccctggtatgcatcttggacactggatgtctcaactcagtttagaacttactaaaacaaggtttaataacctcatattaaaattttcaagactggctgggcacggtggctcacacctgtaatcccagcactttaggaggctgaggcaggcagatcacgaggtcaagagatcgaccccatcctggccaacatgcggaaaccctgcctctactaaaaatacaaaaattagctaggtgtggtggcacgcctctagtcccagctactcaggaggctgaggcaggacaatcacttgaacctgggaggcagaagttgcggtgagctgagatcacgccactgcactgcagcctggtgacagagcctggctccatctaaaaaaaaaaaaaaatttacaagactaccgagaatccgcacctcctaagaaatggagatcaagtctgtgcgagtcatcattcctcttgggtctcttgatttatctatcaattagcaacactatttgaccttctacctatgtgtgatcatggatattaatcagcccttctttttactgatataattcctactttttcagaaatctgacaaactcacaattgctgatatctaccctttcctccttacgaagatagaaatgcccatctataatttatagacaggtatgattccacaatttaaaaaataaagcaaaaaaaaaaaaaatccgctcaactcaaggcttatacatcactgattccctcaatgcccttacttggaaagcagtaattcttttgagctaataaaatgcatgttatgaaccagaacaataccttaaagatataacaaaagtaattatgataataatgaaaaaagtgagaatttcaaaatctttgtgtagttcttgaaagtatagtgcagtataatgtgagaactgaaggctgtttaccaaaaattcatatatctctccttctaaatatttattatttttgaacagacccgcttgtgtggccaggtgactttagccagtggcatatgtgccaattctgttaagtattttaagaaatggttttaccttctttctctttctctcccttccaccgtctggatgtagatagcactacggacctagggaaaggcagaaacacaagatgggagacatatgaaatatcccaggaagaaaactcttttgcagaagcactgataccagactcttacgtaaatgaaaaaaaacttccatttagtttaagccattattacattttggagtctataatgctaaagcagctagtatcaccctggttaattaatgaagtaaattaaatggttaaaagcatataacctacctgggacatcttgtagggcagtaagatggaagttaaaggacaacaggattgaaacttaaagtgttcaaagatgaaatcataagcagtatggaacctcggaggtaagttggggtataaaagaaacaaaactggccatgagctgattatttttaaaacagaatatgggtatatgagaattgatcacatattctctctagttctgtatatatttgacattttacacaataaaaatttaaacaggcagggtgcagtggctcacacctgtgatcccagcattttgggaagctgaggtgggcggatcactcgaggtcagccgttcgagaccagcctggccaacatggtgaaaccctgtctctactaaaaatacaaaaaattagctaggtgtggtcgtgggtacctgtaatgccagctacttgggaggctgaggcaggagaattgcttgaactcaggaggcagaggttgcagtgagccaagatggtgccactgcactccagcctgggtgacaaagtgagcatctgactcaaaaaaaaaaaaaattaaacacttttttttaaaaagtaaggatacctggagttcccactggcctaggaagggaatatctgagcatcaaaaaggttaagaacagaaacaaattaaaacatacaaaattttttttagaacaacagggagaggttccaagatggccgaataggaacaactcctgtctacagctcccagcttgagtgacgcagaagacaggtgatttctgcatttccaactgaggtaccgggttcatctcactggggcttgttggacagtgggtgcaccccatggagtgtgagccaaagcagggcaggcattgcctcacccaggcagtgcaaggggtcagggaattccgtttcctagccaagggaagctgtgacaaatggtacctggaaaatcataacaaccccaccctaatacagcacttttccaactgtcttagcaaatggcacaccaggagattatatcccgcgcctagctcggagggtcccacgcctagctcggagggtcccacgcccacggagccttgctctctgttagcacagcagtctgagatcgaactgcaaagcagcagtgaggctgggggaggggcatccatcattgctgaggcttgagtaggaaaacaaagaggcccagaaactcaaactgggtggagcccaccgcagctcaaggaggcctgcctgcctgcctctgtagtctccacctctgggggcagggcacagctgaacaaaaggcagcagaaacttctgcagacttaaacgtccctgtctgacagctttgaagagagcagtggttctcccaccatggagtttgacatctgagaatggacagactgcctcttcaagtgggtccctgagacccaagtagcctaactgggagatacctcccagtaggggccgactgacacctcacacagccaagtacccctctgagacaaagctttcagaggaaggatcaggcagcaacatttgccattctgcaatatttgctgttctgcagcctccacaggtgatacccaggcaaacagggtctggagtggacctccagcaaactccaaaagacctgcagctgaggatcctaactgttggaaggaaaactaacaaacagaaaggacatccacaccaaaaccccatctggacgtcaccatcatcaaagaccaaaggtacataaaaccacaaagatggggagaaaccagagtagaaaagctgaaaattctaaaaatcagagcgcctcttctcctcgaaaggaacgcagctgctcgccagcaagggaacaaagctggatggagaatgaatttgacgagttgagagaaggcttcagacgattgttagtaacaaacttctccaagctaaaggaggatgttcgaacccatcacaaagaagctaaaaaccttgaaaaaagattacatgaatggctaactagaataaccagtgtagagaagtccttaaatgacctggtggagctgaaaaccatggctcaagaactacatgacacatgcacaagtttcggtagccaattcgatcaagtggaagaaagggtatcactgattgaagaccaaatgaatgaaatgaagtgagaagagaagtttagagaaaaaagagtaaaaagagatgaacaaagcctccaagtaatacgggactatgtgaaaagaccaaatctacatctgattggtgtacctgaaagtgatgaggagaatggaaccaagttggaaaacactctgcaggatattatccaggagaacttccccaatctagcaatgcaggccaaaattcaaattcaggaaatacagagacgccacaaagatactcctcgagaagagcaaatccaagacacataattgtcagattcaccaaagttgaaatgaaggaaaaaatattaagggcagccagagagaaaggtccggttacccacaaagggaagcacatcagactaacagcggatctctcagcagaaactctagaagccagaagagagtggaggccaatatccagcattcttaaagaaaagaattttcaacccagaatttcataactagccaaactaatcttcacaagtgaaggagaaataaaatcctttacagacaagccaatactgagagatttagccaccaccaggcctgccttacaagagctcctgaaggaagcactaaacatggaaaggaacaaccagtaccagccactgcaaaaacatgccacactataaagaccatcaatactaggaagaaactgcatcaactaagaagccaaataaccagctaacatcaaaatgacaggattaaatacacacataacaatattaaccttaaatgtaaatgggctaaatgctccaattaaaagacacagactggcaaattgggtaaagagtcaagactcatcagtgtgctctattcaggagacccatctaacatgcagagacacacacaggctcaaaataaagggatggaggaagatctaccaagcaaaaggaaaacaaacaaacaaaaaaggcagggcttgcaatcctagtctctgataaaacagactttaaaccaacaaagatcaaagagacaaagaaggccgttacataatggtaaagggatcaattcaacaagaagagctaactatcctaaatatatatgcacccaatataggagcacccagattcataaagcaagaccttagagacttaaaaagagacttagactcccacacaataataatgggaggctttaataccccactgtcaacattagacagatcaacaaggcagaaagttaacaaggatatccaggaatagaactcagctctgaaccaagtggacctaatagacatctacagaactctccaccccaaatcaacaaaatatactttcttctcagcaccacatcgtacttattccaaaactgaccacatagttggaagtaaagcactcctcagcaaatgtaaaagaacagaaattataacaaactgtctctcagaccacagtgcaagcaaactagaaatcataatcaagaaactcactcaaaaccactcaactacatggaaactgaacaacctgctcctaaatgactactgggcacataacgaaatgaaggcagaaataaagatgttctttgaaaccaacgagaacaaagacgcaacatactagaatctctgggacacattcaaagtagtgtgtagagggaaatttatagcactaaatgcccacaagagaaaacaggaaaaacctaaagttgacaccctaacattacaattaaaagaactagagaagcaagggcaaagaaattcaaaagccaacagaaggcaagaaatgactaagatcagagcagaactgaaggagatagagacgcaaaaaacccttcaaaaaatcaatgaatccaggagatggtttttagaaaagatcaacaaaattgatagactgctagcaagactggtaaagaagaaaagagagaagaatcaaatagacacaataaaaaatgataaaagggatatcaccaccgatcccacagaaatacaaactaccatcagagagtactataaacacctctatgcaaataaactagaaactctagaagaaatggataaattcctagacacatacaccctcccaagactaaaccaaaaagaagttgaatctctgaatagaccaataacaggctctgaaattgaggcaataattcatagcctagcaaccaaaaaaagtccaggacccagatggattcacagccgaattctaccagaggtacaaagaggacctggtaccgttgcttctgaaactattccaatcaatagagaaagagggaatcatccctaactcattttatgaggccagcatcatcctgatagcaaagcctggcagagacacaacacaaaaaagagacttttagaccaatacccctgatgaacttcgatgcaaaaatccttcataaaatactggcaaactgaatccagcagcacatcaaaaagcttatccaccacgatcaagttggcttcatccctgggatgcaaggatggttcaacatatgcaaatcaaaaaacgtaatccatcatataaacagaaccaaagacaaaaaccacatgattatctgactagacgcagaaaaagccttcgaaaaaatttgacaggccttcatgctaaaaactctcaataaactaggtattgatgggatgtatctcaaaataataagagctatttatgacaaacccacagccaatatcataccgaatgggcaaaagctagaagcattccctttgaaacctggcacaagacagggatgccctctttcaccaatcctgttggaagttctggccagggcaatcagacaatagaaagaaataaagggtattcaattaggaaaagagtaagtccaattgttgctgttggcagatgacatgattgtatatttagaaaaccccatcgtctcagcccaaaatctccttaagctgataggcaacttcagcaaagtctcaggatacaaaatcaatgtgcaaaaatcacaagcattcctatacagcaataacagacaaacagagagccaaatcatgagtgaactcccattctcaattgcttcaaagagaataaaatgcctaggaatgcaacttacaaaagatgtgaagaacctcttcaaggagaactacaaaccactgctcaacgaaataaaagaggacacaaccaaatggaagaacattctatgctcatggataggaagaatcaatatcatgaaaatggttatactgcccaaggtaatttatagattcaatgccatccccatcaagctaccaatgactttcttcataggattggaaaaaactactttaaagttcatatggaaccaaaaaagagcccacattgctaagtcaatcctaagccaaaagaacaaagctggagccatcacgctacctgacttcaaactataccacaaggctacccaaacagcatgatactggtaccaaaacagagatatagaccaatggaacagaacagagccctcagaaataataccacacatctacaaccatctgatctttgacaaacatgaaaaaacaagcaatggggaaaggattccctatttaataaatggtgctgggaaaactggctagccatatgtagaaagctgaaactggatcccttccttacaccttatacaaaagttaattcaagatggattaaagacttaaatgttagacctaaaaccataaaaaccctagaagaaaacctaggcaataccattcaggacataggcatgggcaaggacttcatgtctaaaacaccaaaagcaatggcaacaaaagccaaaattgacaaatgggatctaattaaactcaagagcttctgcacagcaaaagaaaccaccatcagagtgaacaggcaacctacagaatgggagaaaatttttgcaatctacccatctgacaaagggcaaatatccagaaatcttccaagaacttaaacaaatttacaagaaaaaaatcaaacaaccccatcaaaaagtgggtgaaggatatgaacagacagttctcaaaagaagacatttatgcagccaacagacacatgaaaaaatgctcatcatcactggccatcagagaaatgcaaatcaaaaccacaatgagataccatctcacatcagttagaatgacaatcattaaaaagtcaggaaacaacaggtgctggagaggatgtggagaaataggaacacttttacactgctggtgggactgtaaactagtgcaaccattgtggaagacagtgtggcaattcctcaaggatctagaactagaaataccatttgacccagccatcctattactgggtatatacccaaaggattataaatcatgctgctacaaagacacatgcatacgtatgtttattgcggcacgattcacaatagcaaagacctggaagcaacccaaatgtccaacaatagactggattaagaaaatgtggcacatatacaccatggaatactatgcagccataaaaaatgatgagttcatgtcctttgtagggacatggatgaagctggaaacaatcattttcagcaaactatcacaaggacagaaaaccaaaaaccgcatgttctcactcataggtaggaattgaacaatgtgatcacttggacacaaggcaggggacatcacacaccagggcctgttgtggggttgggggagtggggagggataccattaggagatatacctaatgctaaatgatgagttaatgggtgcagcacatcaacatggtacatgtatacatatgtaacaaacctgcacattgggcacatgtaccgtagaacttaaagcataattaaaatatatgtatatatatttttaaaatccataacttcataatgacacatgcatgaaaactcattagacgttaatgaatgaatgcctaataacttctagttggtaaccaatgttaccaaatagaagttattaggcattcattcattaattaaaaattaaaatatgataaacaattaatttcctgcctatgtgaactgtatatcagagtaaccaaatggttgataagaaaaagtttttttatagatctccatgaataaatgcaggagaaatgacacaactagaaaactgctattttgcatcccctaatgatataagacctatatccagatataggaaactactatgagtggacataaaaccatcagtgtaagcatgatagggaacttggtaacagaacagtctgacaatacctgaatgaactaactcatgttatcttcactaaaaggacatatatcattatttccttcatgctgtgatgaaataggacatacatagcaccatctatgaagtattcttgcctaaaaaatctctataaaatctagccaagactccagactaaataccaggttatagtggtgattgggttcaggacatgctttcctaaaatatgacaccttggtatttaagaaaacagcagaagcgggaaggtcactctcaccttctgccgttctctcctgaagcaggtcatgaaccaatggaaggatttttttgagcgtcccctggagcaggtcataagaccattttagaggtgccctccttatacatggaggaaaggaacatccttacctctgaagacacagggacacagagaagaagctgaacaaacaggccttgctaagttccctcccccagtttattaccattagatcacactcccaatcatatgtccaatcatacttcacctcttcccactcttcatcaaacctagcataaaaagtacacggtttaaccatttctttgggccttcatttccttatgaaggctcccatgtcacatgaaacttatattaaataaatcggtttgcttttctcttgtaaatctatcttttgttatagcggcttccatcataaaactaggatgggaataaaaggtatttcttttcccatacagagaaataaattaaacactgccacaaaaaagcgaacagccatcttcaaaatatagagcaaatgatccagtttctctcacaaatcaaagttattgagaggaaggggataagaggactaattaaaaaaaaggagacaagcaacataacaattcaatgcaatgtgtgaatctcttttagattctgacttgaacaaaaccatcaacaaaagaacaattagggaaatgcaaatatggactggatattagaaaatattaaggaattattattaatttcattaaatgtgatgatggcatggaatttaaataaaggaggtaaggcccttatcagttagagatatctactgaagaattttcaggtgacaagatatgatatccagcatatgctttaatgcgctcaagcaaaagaaaagaaagaacgaaaaaataaaatggggacagaggaagtaagattggcaagatattgataattattaaagctggatgatgcacgcatgggtgttcattatgctattagttctacatttgtgtatatttgaaattttccaagatacagttttttaaggcacaagataggagtcagacattggttggaccagccctttcacttccagctgggagaaactgggcagatcactacagcctgcacattgccctcctttgtgtcatcaagtgcacagatatttcttctaagaatgctccaatactattccttggattttcttccgagccatagacacctattttgtgagttttgatgcttccctttcaatactcatacacgtgcagacaaacaacagttgtcccaactgctacctatctgaagtgattataagtgactatcaattatgacatatatcccaatttcaaagattaaaatgtgaaaaaaatgtgcgttaaaaaaatctatgaagaaagagacctggagatgaagttataataaaaatgtctatgacaatgagattttctgaatacctacaaggcatctcctgctttggctccataagtaccactatctctgtttgtttgtttgtttgtttgtttgtttgtttgtttttgagacagggtctcaatccctcgtccagactggagtgcagtggcaggcactccccaggctcagatgatccttccacctcagcctcccaaatagctgggactacaggcatgcgccaccacacctggctaatttttgtatttttggtacagacgaggcttcaccatgttgcccaggctgatctcgaactctagcctcaagccatctgctcacctcagcctcccaaagttctgggattacaggcctgagacaccacccctggcttcttgggttattttgactgacatatctcactggctaaaatacttccatttttctagaagctacggcaactaccactgggttggcaaatgacaggccctggaaatgtttctgatagatgtttgttgcatgaataataaatatgcaaattttaagccaaaaaagaaatataacacatgcaaagagatgtggggagtctcgtgcccttctgtataaagttctggaagctaattttggaaactctatcaagaagttgtgtgtgactatttttccaaagtagagtcaaaattcatgaggcagggcaaaagttacactgcatctaatgatgagtaagaatgcacatctgttccctggagctgctctctatacacatattctagtaatttccacacaccatcagaagatagaagatggagaaaaccagtaaagatataatctttgagaaaagacttttgttggagcctaaacataaacttttccttcaagtccatgtcctgagagaggtttgtaaatgtgtgacctaaatgaggctaccactgaattttgtttcccaatatccctcagagaggctataaggcatatacaaattctacttaaaagcaaatcatggtaaacatttattaaattttattacgcaccaagtaccacactcgtgttcttcccaggactgccaaagttggctgaaccctgatgcagtaactctgcagatgtacctataacatctcaactaatcctagcagcaaccctgcaaagaacagtaccaccttacttatattttcaggatagagagtatgacctttagaaagacttgctaactggcccaagttcgacagccggtaaatagcatatccaggactcacacccacggctatgaaaaatcggtgcttgcggcttgtgtttttcacctaaatacacaagtgttacatgaatgaactgtgatggaggatcagcattgttcctgccaaccacacccacctgcagtctagcgcagatcaatacttttacaaagtgcaatgaaaatgaatcactggggaataaaggcattcaaagtaaaagtcaaaagttgttattggagtcaacagacaaatttatgctgttattgcccacgagtttctaaatccttactctcaatttatatgcttattttgttgcatactggcaccaggacaaggaccaccctttgagtagtgctgcactacactttattgttagatccatgcttagaatgaacacatttataataaggttccaagatccctccacctattgagaggctggtaattcttttagatgttaattaatctatttttttttaaatgaagatgacttttagcattttcttctttcctataaagattcatcaagatatcagacataggttccaaagtcaacaaaaataaagaacttgtgaaattttctgctgctgtatgatacaactgctgtggtattttgataaatattaacagaaaatgtgaaactttgaaatatgtttccttaccaagggaacaatgaataataatgaaaccagggaatgaggactagaagcaccaggtgcccccgcctcccatccactgcagggaaggactctcttccaaatccaccctgaaaagtgagtggctgttgggaaactaaaaaatgtacttaagagatctcaaatatatggtgacacatggaattcttcaacctgccatgcctcttgagaagttctcaggtaaataacaagaatgatgcccacaatacattcacatacataaaaaaaatgtcctggaaagaaaaagaggatgggagaagaagttaatgattcttggggctttttaaaaaaattgtgttcggctgggtgtggtggctcacacctgtaatcccaacactttgggaggccgaggcaggtggatcacctgaggtcaggaatttgagaccagcctgaccaccatggagaaaccccatctctaccaaaaatacaaaattagccgggtgtggtggcgcatggctgtaatcccagctactcaagaggctgaggcaggagaatcacttgaacccaggaggcagaggttgcagtgagcctagatcgtgccattgcattccagcaacctgggcaacaagagcaaaactccgtctcaagaaaaaaaaaattgtgtttaaagtttcaagttaattttttttaagtcaccatagctcatatggccttggtatgagttgatgggtcaaacccatagcttctctggctactcaggaaattagtaaaggagggcaaggaaaggcacaatatggaagagagaaattactagacaagaatcagcaatctggagcgaacccaatctaaaggaaacaattagaaactggcacaggtcccaaatcaataagcagaggtgactgtgggcagtgagcataatggctgggtaatgaaaactaaaatgcaggtaagcaagcgctgggaaaggagcagctgatgacagggtcatctgtccagaggcttgaagagacctgtctgaacaggctctcacagcccagctagtccctgatgtcacagcctgtgtgaataaacagcactggtgtggtatccccaaacttcataagaaatgaagtcttcatggctcaccttgtcaaggccagagaacaatcccaacaggaaaaacacttcttacagattatgcagtggattcaaagagcactggaactgtatttcccattagctctaatggaggttgtgctaataaattccccagctctgggctgaacaggtgtaattcagtaatgtagctataattgagtgatgtcaactcaatataatttgtaatgtttttgtaacaaattatctctttttttttccagaaaaaaaggcatctgtgattccatatgataaattactttaaaagggtgacatacagtgctaatgataaagatctttaattgatagaaatgttaatagtagcatcagctaagaattatctttgctgattctttatacacagtaacattttaaacataacaagctttcgtttttgaccaaccaatgtttttgatttgtgactcatggttttcagatatttctgtatttcatcaatataactattctactagagaggttctgtataaaccctgcaatttagccattcccttccctgcacagttcccaagccagatctagacatttctacctctgtgcctaagagaacactggtctcctggtctggatggacagctgtctcctcctcttccatgtacctaagaatgacctgttggcccagtcaaaaccctccttctatgaagctttccagacctatagccaggattactctttcacaccctatacccctgggacactttggggtccctctattacattcttacttttcagacccccttgtacatgctattcctctgctgctctccctggttagggcccactcatccttggggtttcagttcaacgttatacctcaaggagaaccttccctgctttggaacagggcacattacacgtgcatttgcatacctctgcattcctttcctttgttgcactaaccacagttgttgttagtatcttttgtttgtttgtttgtttgtttttcaggaaaaaaaggcatctgtgatgcgtctcttttccactagggctaggctttagacaaggtctgtgttgagttttcctaaatctagtagcaaggacatgatgctccatatctgaagaaagaatgcatggatgaatgaatgaacaaacactatctctgtctgtctctccctacctctatctgtcctctccactaaacttgaactcaaaggtaatacagtgctcattgtagccacaataatgcctaattagggtctcgtccataatagagatgagaaaaactcagttgaaataaatttaatttctcctactgtagtgttaacatcaggttagtcatagagaattcagttcccaaagcttatagtgtttttcaccatatgctatccactgaccctcatcaagctccaaccacgtgctagcccctctgcaagatactgtggaagagaagtgaatgatatttagaaccaagtactctacagtttctgggtgattcccatgtataaccacatttctgcattcatgccagatactgggggaattcaaggttaatcaaacacagatggtgtcctcaaggagctcaggatctgggagaagagataaaagtgaagaaaaaatatcatgaggtggaatccatgagtgacataaaaggagtcccaatacagattctaggtgttctaatgagggacagagagaatgtaggcttaagtgggggtattttttttaagttttatttttaatttttgtggatacatagtgtatatatttatgggttgcatgagatattttgatataggcatgcaatgtgtaataatcacatcagggtacggtctccatcatctcaagcatttatcctttgtgttacaaataattaaactcttttagttattatcctaaaatgcacagataaattgtttttcactctagtcaccctgttgtgttagaaaatactaagtcttatttattctttcttactattttttgtatccattaatctttcagtggggacagtttttaaaatgagtctttacctgttgggtgggatggctcacgcctgtaatcccagctctcagggaggcagaggcgggaggatagcttgagcccaggagtttcagacctgcctgggcaatatagcaagacaccatgctccacaaaaagggaaaaaaatgagtctttacccaggtgaagattgggattagggacccagccaaaaggaagcgaggttgaagagcaagagtgtttattccttggttcaatagatctttgtcacctactgtgtgaggcataaataaacctaagtccattctcaatgcagcttacattctaattgtggagacaggtgaaagcaaacaaacaacaatgccaggttataatgagtgctctgaaaaaacagggcagagtaagaagcgaagctgatgagagtgctaccccagacaaggtggtcaggggaggccttcccatgtcaatgacactgaacaatgacttgaatgaagcgaaagagtgagccatgtaacacgccttgggaagtgcattcccaacagagaacagcaatcctctccacagaggaaggacagatgacccacacctttttcaaactggggtctctgagcatgttcttagggatctgaatgttcttgatgagactttttatttttggttttatttagataatactcacttaaaatagttcaagtgtattctgcatcagctacatagcacctaaaatacgggtaccagcacaaaagttttgtgactcctttatgtttgcatttataattgtggtggtatcaggtattgctgttttagctgtcacaagcaaaagataaaaaaaacaaacttactacttaaataatgtgtttgtgcctcatgatctcagagtaggggtggagtacatatgaattgtcccagtaatagcagctggaagtgttagggaaattgagtcatcacacagcctaggctaacacaaacatgacaagctgtgtagaacctttgacataacagacatcccgtattgatgtttccagagatgattctgtttaaacaaataatatcattcatcttgttaatgcaatattcctcatttgaatttagttttgtcattttgattgcatgtaatttgtaaacgtgttatggtttcatatttgtctaagaaccacacaaagaaattcatacctacttttgtattttcatgtggttcaataatccaataacaaaaacattaagttaacattgggggttcataagacttttttttcccttggaatggcatccatatgttactcaaggttggtcacagtgaaagctggtggtggaaaaggcctttgttttccagaaccatgaccaggtgatagctctggatggtttccaatgaaacacacagtaagtacaggaaagaagggagatgaatatctttggtaggaaaaaaaaaatcacaaatcagatatacctaatgactgtaacttttattattctctgaacaccaaggaacgtaaaggccataaattatgttacatgttggttaattctccttcagaacacccaggccattggaacattaaatgtggaaagtatgtggcgggggagagagggtgaagaagctataatgaaaggttcactgcactcgggtggcagattaaacacagagccagatgaggagtcaagcgtcactaaaaatgcaaaacaaatccagctaaattatttcacctgcaaggaaaagtttttctcacaacacaacactgttctatgccaacaaatgtaaacaagagctaagacgactatctgaaaagctcaggcagttggtgaggaaggctccttgggtcacagaaccctccaaaacttctcactgtagcagctgagagctggcatctgaaatcaaactgggtagagttcaagaatcacctctaacagagattagctctgagacctagcaagttctttaatatcacagaaaaaaaaaagacaaaacaacacctacattacaaagttgttgaaaggattcactgagataatcctcatagaccacttagaacactgcctggcacgtaataagttctccataaacgtgagccatgagttttatgatgctataggtctatgattatataagcatgagtctccacatatggcacaacaaactgctctactcaactctacagccctggatgatgtctccacattttacatattccatgatagtttccaataatttatatacatgtaaagtatatttgagatggtcggtaagataacatcattctcattcattcccctccccaatatagttcctaaggaggaaagatatgaatagtgctatggtttggatttgtgtccacgcctaaatctcatgtcaaattgtaatcttcagtgttggaggaggggcctggtgggatgtgactgaatcatggaggcagacttcctccttgctgttctcgcaataatgagtgagatctggttgtttaaaagtgtgcagcacttccccctttagtctctttctcctgctcccaccatgtaagaggtgcctccttcctcttcaccttctacctgaggcctctccagccatgcttcctctacagcctgtggaatgtgagtcaattaaacctcttttctttataaatttctcagtttcaggtagttctttatagcaatgcaagaacggactaatgcagatgggtctacagaaagagcataacccaacaaccttacatggtaggtaccattattgtccctattttacaaataaacaatgtccagagaagaggatggacttgctcaaggtcatacagctcataaatgatgcagccaggatttgaggtcaagtagtcccagtctagaatctaccttcttaatcaccacaagactctactcctccaaacaagtgtccttcctctgtgtccagtaaagaggaactctgggaactgctggtcacataattgtttattcctccaggttccccaatgtctggccctagaaaatgaggatgtttcactcccaactaagcatttccctaagctactatttgttatgctgttagctaagatagaaagtcaattttaaaatcgtccatttgaacagttatagtaactttcgtaaatggtaaatgaaacaatttgaaaacactgtccaacattttacacagtatcccatcgaccacagctaactaaagtaattcacatgtgaattttattctcaaaaaaagtgtatgctttgcttttgacagataatgaaagccatttaattcaatgtggctttttttctttgctttttcctttttttttttttttttttttttgccagaaagcagtgagataaattgaatacccataaactgaagaaaatctgttaatttggggtgtctggttacacctattcttgtgcttttttaaaagagagtctgccaaagtttattctcttcttaaattacctcatctgagcagtattttcatttgtaaataatggccacatattctctttaaagtaggaggaaatggagaccttaagtgtttcaaggaaacttcaggtccctcaaacctccttcaaagaaaacaactgatgattgtctttgaggcaaggagacactagtcatcaggccatcaagggcagggaacaacctgaacactttgcagctctgcactacaggtcctcaacgtcgttcttgcattagcccattcttgcattgctataaagttcattcaatgccatctggttataacaccgacagaaaataaattgattcccagtggggcccctgtctatgtagggtctgaacattctccccatgcttgcatgagttttctctgggcagtcaagttttctcccacatcccaaagatgagcatggtaggtgaaccggcatgtctacatggtccccatcttagtgagtatgagtgtgtgtgtgtaggtgtgtaggtgagtgggtcctgcaatgggatgatgtcctgtccagggtgagttcccaccttgcaccctgagctgctgggacatgctgcagccatccgagaccctcaactggaatataaataattatcttacctgtttttattactctttcttaaatgtgtatatagttcgcatagatttcaatgtaaaatattcaaagtgttttggtctatttagaagtttgatggtatagttgtgaccagaaatatgccataggaacttaactcttatttatatcaattagtctatggtgaaattggttatatgttgctttgctttatgtcccagtttccaggaacctatcaatgacattaagtaaggacttactgtactttactatagctgaacaggctgccacccaaaaccataatgagctactatgacgacagtcaatcaggagacatatctgtgtttcagagaagaaagccagcagctttctgggaaaaagcacagagggaaactcccctaagctggagctatttcctagcagtaacttgctgctgcagtttagccctgtcatctgtgtgtactcctcattaagtaccacattatgggccatcatatcttctccagctgcaagtaaaggcaatgtcctggaattgccctatggcccaaatgtgtgactaatgactgagactttggcttcttgcttgatgtttggccttcagtattacatgaacctgctctgaaagacacaacactgtcacagatgtatgcggacagattaagctccagatggaaggctgtcaatgtcaatcagtcactgttcttacagcctggctggcttttcatctaagcaaccacagagcatgatcctgcagcactcagttccttagctcaattaagtcttaggattggaggtcaagttaccctggtttcctaagcattctctaccaaatgattgtttttgcctcactcctactgattcatttatagtagcttcttttgatgcattcatccttgagcatgtcttcccatttccaagtgacttgtttcactattctgcagaatgttccagccctttgatgaactatatataattgtcgaatcagctgtcccacaaagagataaaatctgaattaaatacaggacttgttgtcaggagagaacagataaggtgaagaattagaagactagctgggaagaagtgagatgattgaagtttatgaaacattttcccccctcctttgagtctcccaatctgctagtttcagtcggttggttttgtgttcctgttgtgatatatgtttagttcaaggctgtggactttgtgccttggttacaggtaagtgcctctgtgtttctcatctttatctatccagtcacttgtctcctctcaaagtttcactttttaaatatatatatgttatttaatatcaaaagaatatcttcacctttcataaattgctaaccctagactctggatgcctagggtaaatttttaattctattttatttattttaattaaatttaaattaaaatttgttttaattaaatttaaattaaatatctaattctacttttatttatttatttaattctatttttaagtctatggacttgcttgaacacacagctcagcaatgatgcaggcaggattcaagtccaggcaaatcatggctctagagcttgtgttcttaacttccacatgacattgtccctcgggaggaatattgtaactccctacgtttccattccaaactctcaaatataaaatgataattacaaggtacacgttattgcaaaacatgtataaaagcatataaatcaaagattacattttgcctcctcttctttttcccatccctctaccctcatatccacacaatttcattccctgagggagcctatattaataatttggcatgtacatttttgcatacagacatatatttttctaagtttctataatacatactgttctgtcacatgtttgacatcttttcatgtcaattcatagagatgcttgttaatggctgcagagtaatttcaatgtatagacatataatactatatataatactatattgaacctctttagctacttggtcaaatatatctacagaatacgttactagacatttcaaggaatttctatgtcaaaatatttcaaatagttaatagttccaaacttcccaatccaagtataatatttttatttatatccacaacagggtatccccctgattttgcccatagtgcttattatcctaaccaactgattgatatttttagtttaattatttaaaaaatgaggttataatgaggtccctaagagtcccttaacctaatttactaggatctactttatctggagagtaaaataaagcaactacccaatctcaaaatatccttttgcccctcccaaatgactcttctggaatcatttatatgctgacctccatataatttattggatttatacgatcttatatctctagattgagttacaaatggatgaatctcttgaaacctagaccaaaaaataagaatagaataaaaaaagagtttttggtatggaaactgtgactctccaacgtcagtagagacattgagaatggtttcccatgtccccaggcataaactaaaatatccactgcttttggacagtataaatgcagaatatgcccccagatgaatagaaatgagcaaatcttgagtgcagaactgaatttcttggagctgtattggttacctggagccatgaattaagtggatctgattctatctcttaaaggaacagaaaaaaaattattccaggtgattactgctcctcaagcatgtggtcactcaaaggaccttcttctagctccacgggatacatagttgctattcatcagctctgctcactgaagatgctgtgctacgcattccaaatggcgccttggaggactaactgatatcattaacacagactcgtagagatgtcatcattttcttcttcatcatcttcgtcaagattagttttaagtgttgggagtccgaggtgggtggatcacgaggtcaggagatcgagaccatcctggctaatatggtgaaacctggtctctactaaaaatacaaaaaattagccgggtgtggtgggtgcctgtagtcccagctactcgggaggctgaggcaggagaatggtgtaaacccgggaggcagagcttgcaatgagctgagaccgcgccactgcactccagcctgagcgacagagcgagactctgtctcaaaaaaaaaaaagattagttttaagtgaaccatgtactagttctcaaatcaaccacatcgggtaggttccattattatttaattctgcagatgtgaatacaaggccacaagttcgtaagtgatactgccggggctcaaaccacttatgtattatgtcaaaagccatgctcttaaccattgcactatactcccttctacaggcataaaattttaaaaatatataccagaagagcaaaacaatcccaagtatgggaaggatgaaagagaagggtggcagttggcacagtggagcataatgggccagtctgactgtaagactcctgtttcataatgtctgcatgtcactaaaaaggatctagaccaaggttcacaaacacaaatgaatatgggggccaggacgttaacatacatgagtaaagaggaccaagtgcatgacagaaagagtggtgaagaacgtggtaaactgaaacacatgcctcaagggaagaaggcaatactctcatgtgtgtatgtggttcaaatgttgccaaatctatgaatttttttaacagaagaaaaaaaatccaattttaatgcaaaatgtttctatttccaaattatgatttcaatgtcatgtttaaaaacactttgacgatgacttagttccctctgacctccacacataagcattaacatggacagaagtatagcagcagtgtgaggtgcttttccagcagccatcagtccttcatccttgctaacataccttgatctttctcaggtacctgcaggtggtagtgtgtccagggaagataggccttactctcagcataagaggctgaaacgtactggtctcagccagtgaaggtaactgaatacttcattgacattgactggtctgggatgggatgcatgtgtgactcagttctagccaaagagaaatcgaaagatatctgctaagagactttaaggaaagattttctttcctgaaatggaaagagagagagaggcccaccacgagatggccctttttgctcccttccctcctatcctgtgttgaatgctaatccaggacactgtggtgttgaaagctctggcagccattttgtggcatgaggtaacaagtctaaggattaaggccaatacaccgccaatggtggaatgaaagcatgaaaggagcttggatccttgtttagcagccaaatcaacactgagactacttaatttgaggtttcttatataggaaacagtaaatctccttgtgatttatggtactattagttgggtgttctgttacttcatactgaatacattctaatgaaggatctcactttcaaccttacttcagagttctagctttttgtttacagcatccttcatgcaggaaaacttcaagtttacacagagtgtgcaactagatgtgagataaggctctgccacttgagaacgcccacacgctgcttcaaaaatttaaattatgctgttagcttttcaagatggatgaaatccttcataggatcatatagcaaggactaaattgctctcacagttgccaggcaactgtgtatatgctgcctagagacaaaaattcatgacccttgactccccaaaggagagtctttacccacaactgatatgcatgtgcccaagtctaacacttccatccagcaaaggtcatggtgtacatctgggctatccaacatcccaagctcattatactgccaacttatatcattcttgatcacaccataaattatgatttctgcatgcaaatccaaatgacagagcagagagtgtcctggggcataattccctgtcctttggcctgtcttattatatagactgattgggtaccatccaggcaaacaaaaaaaagacacatgaagattcctattagcctgaagaatcactgtcaggtaaacagagttttgtaaacagcttccaatattcaaggaaagtttgagttttcacagtgagtaatgtgatcaactttaataatgtctcaaggggcttctatctcacgagtcattttcaacacacacacacacacacacacacacatacacacacaggctaagatgtgctcatcattctattagaaaggaaatctcaaaatgcaaatatagatggtgtgttcacatttacatttcataatgatctaagtgttttgtttttgcatgtgaatttcataatactttaaatcatagaatcatggaatataaaaatcaaaagtgaccctgagatcaagaaggtccaatccaagagaaattaaatggcacagctgcttaggggtgaacactgaatccaagttgctggactctcagtctactgcgcttccccaaaactaacatgcttgtccctcaggcagtcaacccttaatcattgtgatgataaacatcagggacaacttaatttcaacttgacaataaatcaaactctccatgtagccattagttgctgtactagtcagaaaaaggttaagttgaatgtgaaccactctttcactacctcccacctcaaaaaaaaaaaaaaatgaacggaagcttgaatatacaagcttttattctctcatttaacaagtttggagatcagtagtctagtgctgacatggcagttctacagacccattacagacctagatgccttcaacttactgtatctccattcctagagggtgactgtcttagtctgctttgtgccgctataacaggacctgagactaggtaatttataaacaacagagatttattagcttacaattctggagtctgggaagcccaagatcaagggcccacatcttgtgaaagacttcttgctgtgttacacatgtaataaggcaccacatgatgagaaacagcacgcaaaggagcaagaagtgactaaactcacttggataacaaacccactcttgcaatagtgaacccattaacataataatgacattaatttattcacgggggtagatcccccatgccctaatcacctcttaaacaacccacttctcaacactgttgcattgaggaattaagtttccaaaacataaactctgggggacacattcaaaacacagcattcatcttcttaacatagccaaaaaggccgggcatggtggctcacacctataacctcagcactttgggaggccaaggtgggtggatcatctgaggtcaggagtttgaaaccagtctgaccaacatagtgaaaccccatctctactaaaaatacaaaaaattagccttgcgtagtgacatacacctgtagtcccagctactcaggaagctgaggcaggagaattgcttgaacctaggaggcaaaggttgcagtgagcagagattgtgccatttgactccagcctgggcaagaagagcaaagctctgtctcaaaaaaacaaaaacaaacaaacaagaaaacagcaaaaagtattaatgagccgttatgtctgcaccccagttggcagcaaggaggaagctgtaatgcatcttctctttaagaattctcctagttagtgtacccctgaaagcaaagcctaagacaaggaccaagggcataggtttgggtagattatttggatggtgatctcagaaaatttgaaagaaagagatgagacagtaaacactggaaggaaaaaggaaacagcatgtgttatcaacacctggggtgctatgtgaggagctgtgtggaatgtacccacaactgtccatctgatagaaggctgtggcaacccaccaattggttaagcattgcctgtagtgctgttacttccccggctatgcttgtgcgtgggctgggaagccttcttttggttttgagtaaggcctaaaccagaatagtagatgtacagcacagcagaacttgaggaccctggcagcacatgacagcatctgccacagctgcaatgaaattaggtggggatagggaatgtggcactgtgcacctgctacaagaaaatgtccagaaagttgctcataaagtttcttattatctctatgcatcaggagtccccaagacaatccttagactcaatgattcactaaaagactcccagaacccagaaaaactatgtactcatggtgatggtttgttacagagaaaggacacagattaaaatcagcaaagtaaaaaggtatataggaaagaatccaggagaaaacaggcacaagtttacagtgtcctctaccagtaaaatcacacagctggttcttaattgtcccagcaactatgtatgacaacatgtataaagtattgccaacccaagaagctcacctgagccttggtgtccatgatttttattgggggtcagccacatagacatggacttcccacacgaatgaccttaattacccagtctccagtccccccagaggtcaaattgatacaacatagcccagggcttcaggtgaacagaaacagcattcaccaacaatcacattgtcagtataaactatctggcaagacccacagtttcaggtattcaaaggcacttttctcagttagggtgcttcaaaagctccaaggttatctctttggagatggtcaagggccagtcttttatttggtatctgcagaatttgaacaccccaagccttgagttaaccctttactgaacaacctgtttggtcagaacttagtcaaatggccataaccacctgcaacaaaagtaagaaatgcagtctttgttctgggcagctatattcctactcaatatttgggaattctattattgtataatggtggttctcaaacttcagcacatcagaatcacctggagaattcattaaaatagactgcacaaccccctcctcagagtttctgattaagtaagtgtagggtgaggcctgagaatttgcatttcagtaatttaccaggtgtattactatccgaataaagccagaacaaatttacacaaactttgggcttaaaacaacacaaattcattatcttactattctgtgggtcagaagtctgacacaactcgcaccaagctcaaatcaaggtgtaagcagactcctttctgcagtctctaaggaagaatgtttccttgctcattccggttgttggcagaatgcagttctgaagtcctgtttccttattgcctgtcagctgaagatcattctgaatttctaaaggccttccacatttgttaggaggttgacccctccttccatcatcaagtcagcaatgaggggttgggttcttttcatgctttgaatctcacctgcctcctctatcgccatatctttctgattgcagcctgaaaaggttctctgatttttagagctcatttgactagactgggcccacccaggtattcaggagaatccccccatctcatggtctgtaatcttagtcacatatgcaaagtctgttttgccaggtaagatagtatattcacaggttctggagattagggtgtagatatctttggggggagggcgcatgattctacctaccacaccagtcagttcactctgattctgtggttagggaacacactttgagaaccaccaatatagaaaataagagaaccagaagactcttccacaatgtagccttattttacattgttggaaagtcaatgaaagcttttaacaaactggttgactgcagctttacctcttcagtgggcccctttcctactcaaaaagtaatgagaaaaaggcagcaagggggaccagagaatagagaaacaaaaactgaaatcactccctgactagattaatcagctcttgcatactctggccatttatcagatatattcagtgaaattcttggttgagagaaagagggagaaaacacaagccaatcctgaatcaaaattaatagagaattctactagaattcaacaggtttttcttttttattttttaatggcaagatccctgaaggcctttaaaatacgaatgtctgctttaaatctccaagaaggagggcagagttcttgaaaatgatagccatggtttttttcgtggcacatataatggaattgggctgcctggaaaaatgcttgagtaaaggttgctccacaaggggaaaggtggtaactcaatgcaccttcactttctaggttggtgcttctcaatttggctgcatattgaaatcatcttaggagctttaaaaagcgctgatgtctaggtcacacaccccagtgattctgaagcaattgctctggggcatgtcttgggcattgtgcttttcccccaacatctcgcagatgattctaacgtgtagccatgattaaggactgttatggtaggtgataaccctgttttcctgagtctattagcatatgtagttactaaccagagtcagtaaactaggtattgttctctgtattttaattcctgcccaaccaaattaaggaagtaatttcaaaaattaaaagagaagagataatctagagtggcaggcagtactaaccaactccacattcaagaatagcatcctttcttaaccagcattgcgtgattttaaactcttcgtatccccagaatttagcacagtgccccacacatagtatatgttcaggaagaactgtggtaaatgataaagaattatgaacaaagtcctcttcaaaatgaagattgcaggagaatcaagcttcagtcagatctaagtgcacactactctagtgagataagccaatcagataagcaggatggggaaccaccattttggttttgttgttgttgtcattgttgtttttgagacagagtctcacctaggctggaatgcagtggtgcgatctcggctcactgcaatctccgcctgcaggttcagctgattctcctgcttcagccttctgagtagcacgcctggctggctaatttgtgtatatttttagtagagacggggtttcaccatgttggccaggctggtctcaaactcctgacctcaaatgatccactcaactcggcttcccaaagtgctgagattacaggcatgagccgtcgttcctgaccaggaaccaccattttgattggcatggtaccaggtacacagaatttagccaataaactatttgatgtgtgaaagaatgaataaattttggcattaaaaggcaggcttcggtatgtcagagcaagaggtaattggatgaggaccagaggatggagcccagagcaggaaatgaagctcagagaagaggtagatgttcaacgtactgtgtctcctcctccagttttgagtaggtcactgaaaacacttggcatggcagtgaaaatcactcaaaagacccccgtggaaatggacagacttgtgtggaaatttgcagatcttggctgcttctaattcatttgtctttctaacctattagaatccaattcagtctctttggctctacccaggataatgcaaaactgaattgtacacataagcttcctgccttctgctccttctcttcataaccaatatgttgctaaacaacaatttctaattgccccttcccaggacaccttttgagagcatctctctttgtaccccctgaaatacataatactaattttctttgacatgctatatattttgaggatccatgcatccctaacaagtgcccagtcttacgatggtgcagcccctcatccagtgttctatcatttaattcatgatgctgtttatcttggctgcaagagagtgaattattggcatattcagacagtctcataccacctctcgtcctctccattatcataaaagttaaaattatttatttatgaaccaaataacttgtctgaatattttaacaatgcacgagcacttatggaggtttttatttcaatttgggtagagatacaaagtcaaatatgatttcagtacaagttgtgatggtttttctcaatatcttatatggggttccatttttgccttgtacaattaatacaagaagcataatgaactcagcaatccccttgagaaataacaaataggtataagcaataatttatctgtggaatgcagggccttgatacataacttccatatctactccaaaagaaaaagaaaagaaaaaaaattcctagctaagagccatgaagaaagagtccaaacactctcacacattgttgttggaaaggtagactatacaacatacttggattgcaatctggcaatatgctttgaatgttcacaattttaaaacatatatttcctgacccattatttcaaagactgtatcctgatcctgatgaaataataaaagatgtgcctaaagatatatcatgtgtggatgctcatttacagtgttacttcccataaagagaaatagggagaaacaaataagaaacctttctaatatattttgttatctataaaatggattgctatgcagtcattaaaaataatgttcctaaaaattagtttataggaaaatgtataaaaatgtacatgacataaagttaagtggaacagcaagatataaaacagtctatgcagcctatttccaatatgtttataataagtatttccatatatatttctacgttggcatattattctacacagaaaatgatcagtacatatttttgagtgtataagcagggtgtgtgtgtttacaaagacaaagatgaaataccccaaaatattaatagtggttatggctagatagtgaagttatgggggatatttattctttgccttatgttatcctacattttctaaatagtctcaatgcaaatgttgtttttataacttattactgatttgtgagctaaacagacccattgacattttccctggaatattctagtgacacaatcactctcctgttagatagtcccacccctcatgccccctcatttggtctcttccaagatccaggactttagagccagaaacatttggattcaaatcccagctctttactttctagctctatgaccatgggtaaggtcattctctctgggtgttctggacctttgggatagagttgttgggagagttaaatgaggagtgttgcattcctatccgatagttatttctccctccccttcctttctaataggatctgactttgtgattttattcaggtattgactgcccacaacctatacccagggacaagaggctggggcctactcagacctaaggcttgaagcttaactagactaggacaagcatggtaacttcattccccttgcaagggatcacttcagggtatggtttgaaattctggccaatcaccaagtgggacaattgttggaggccagggtcgttctgaaaaagttttcttcacatttaagaaaacaaaggacacccagaaggatgagtattcattgccgtttctggccttcagacactgaggatttctggatgcactatagccaaacttggaccattagaggacaagcctgcaaagaaaagtaacacctgaaagaggggagaaataaaagacagaaaaaaaccttgatacttgataatgttgttgctgaattctggcatggccctattttttttatttatatttaaaatttttgtttaaatcagttgaactaggatttctattacttttatctgaaaggatcgtaagtgatacaaaaagcaaaagtgccaagctcatgacagagagcagagttcaacaaataaaaaataaaaaaaagtcttttctttctctcaccttccaaatacatatttagtatacacagtatatacttgtttatggcttgtaaatgtagttaatagagaaagtaacaagaaagaaaggggtaaatgcaccttttcctcctcttaaaacatgcacaacaggacccaatttctctaatttttttataaaggcccccaaaaactatggacaaagacaaagttttccaaggaaagacatgtgctgtaatggattatatcttgctaaaaattcgaggccttctaaaaaaaacaaaatcttgaacaacaaagacctcttccaatccctcctccctgtaggtcttgaacaactagccagaggccctgcttttgtaagaggttccctagatagatcaggatggatggagtgtatgctgttagatcaaaagaaatcatttgctacttgtatgcatggactaccttaactgtgagtcttaatcaagtaatggagactgacaggcttcttggcctataggggccctatagtaataaagtgtgcacttttctaaaaatggtattcataagagtcaagtgactggacaattactttgtttgattccacatcccaggctgaacaacctcctcttcccatattcttctgcgtctgatcctgatggagaagaataagccagcctgagctatgcttagatattttaaattttagtgaaaaataaaatatatgttttaaagcctggaatattatttgtgatttgggtctaaggtctaaaaaatatggacaagtgggaattcaaaaatcaccctaccagcactgcaaagaattcgtgagtattcaagctttaggagttgggtttgtgcattttccttttataactattgctagccatcccagaatgttgcactcagtaagaagggctaacagtgtcctgctggccctattcctatgtgtcatcttgcggcatttccagttaatggcatgactgtaatgactagcaatttaaataatagaggctgaagcagaggcagctataaggacacaatgcagaaattgccacagtttatcaacatcactggcacccagctcttcattacctccttgaatagggtcaaagtagttaaaatgatgctgtaaatacatgactaaaacaaagcagcggtttattcttgatttggcattgggtatttataacaaacaagttgcatttcccaggcatgggttattagacacgagaatgtaattgatattaaccaactttcaggctccagtaactttttccactgcatgtcagtttaattttttttaaagcataagcagcacatgccaaatggaaaacaagaggaagaacacaaaaaaccccttaagccttcagtactaagtgaaaaacaactaacccatttatcttatagaatccttcagagttttgctataaactcactcggaagagaatatcacagtcttctctttttgagagggtattcgagtgatttttagaaatgagacatctctaactgtaatcttgttttttgttcagaactaaaagagtatgcaagaatatctaaaaatacaaattgtgcacctactgcattacggcagaggttgaacactggtgacccatgagccaaatctgacccattgctctgtttcatttggaccatacagtaatggttgactttgtgttttaacattttaaaattattttcaacatttgtaaatcgagagatttcacagaaaatgctggaagctctgaccctaccggcaccacactcctacaagataacaaatggctggggctgagttgaggctgctcttatcctttgcctcaattgtatcactcctacagtctccttgtctctgaggcctaatgtcaattacctctcttcttcttaatagtattgttatttttcctaagtaatgatcaaagacaaatattcattttggtgagccttgatcataaatggggaaaataaagatgggttaagaggactgagtgttttagaaaatgaaaaggctgtaattccttatagaagtaaataatttcttacttaaccccctttaccccataacagaatcctcccagctggcatccaagagcattgagtgtgtgaacctttgtgaaaagcatcaagttaaacgttctgtgtaaaggataccagacacatggaaaagccaagctaggttcagtctcagacaaaagctgtcaagctgagaaagggaaaagaaagcactgcacttgtaagaaaaacaacaaatggcaagcacggaattgacggctagaaagaacaaagcaggtttcaatgttctaccaaaaaatgtcttagcccctggctaaactccttttgggaaaaataggcacaacaggaagatgccttcacttcccaaagtcatccagacattctcagtgggagcttctgcatcaaccttgtgtcgcatctggagctgcagaccctcactgcccattggtttaacaatctctctcctcctgcaagaagagggtggtggcaggggggagtactataagggatgtttgttttattaaaaagaataaacatacatgcacatacacacctacccagaaaatactatttcatggcatctacacttatagggaattcactcagaaacagctttttagtaacacaaagaattaaaatcattagcacccaacaagtcagaaatgatggaagattaggaagaccattgcatagaaacaaaattaaaaaaagataaaaccctttatagaaccagaaaaggtgaggagaacacaaacaatccttttcactgagattgagaacccagaaaaaccttttgatataactagggaaagttaagtagagtcaggaaaggaataagtgtgtattaatttcccactgtgtagaaagcactccatatacattttaatacattttgataataaataataaataatactttatatttttgttcatttatccattaaataagtattcgttcactgccttctatgtgtcagacatctctagggatataaacatttaaagacatggttttcctattaccaagttttgagtctaacaaggaactagacaaacactctaatgaaaataataatgattataaatacaaacagcaataatacaatagcttaataacagctgtcctttactgagtgcttccaatgtggtaagaattgtgttgagcactttacattattattcgtttaatccctcataagtgccctatgaccaagttactaatatcttcattttacagagaagggaagtaagctatagactaaatgattacctaaggttataaaggtagcagatgaaagatctgagatttaaacactacctgttctctgcacaccaggccaacagataatctgcgatatcaacccctaccagctacgatggaggcatgccaaaaacaagcgatgcagaggggagacccttaaacccttttgaatttgcaaagcacttccccatagagaaaataagcctccagaattcatcagccccaagaggtggtactggtagaaaatataatagtctttcataatagcttaggtcagggtgtgaaagacagagctataagggctggtaaaagaacgaaagctttccaatccagagacaaaaggaaaagtgagatccatccatgacatgtctcttgaggactcttttaggaccaagatggtgaatgctgaacggaccatgcatgcctcagtctgtcaaattgtatgtttctaaggacaaataggctacaaaactttcaccctatttttatatgggaagtctgttgaaaagaatacaatacataaaagatgaattacttattgagtctttaatatgtctctagcacagaaataaacatcttgtgtatattgtttctaatttccacaataccatgagctagaaatatacagaatagaagaacagtgggatcagagaggttaagtgatttatccaagaccacacaggtgttaagaggtagaggaatggtttgaacttgcaacaatgtgactccaaaatcaatacattttccttacactgaaatacaaagtatcaggccaaatctctctgcaaatattcatcctgtttcttttggttcttcattcatttaattaaaaacaagtttattatgcacatacaaggaacatagtattcatccttgtgcatctgacaagtaagtcaaggagacaggtgtgtaaatacctaaccaaacttacaggcaggatgaatgaggctaaatgtgtttattatttaaataaactccatgaagtcagatacttcagtttgttgatcattgccacatacctgaaacacaatcttgaaccaacaaacatttgtttgatggaaggataaatgaagaaaatcccacttaaggaagtacaaacttaaggtagaattaattctgcctaagataaatcaacgaaagcccccaagtgcagtgtcattgaattggacttggaagaatgtatgaagtatatactagtgagaaatgaagtgacaggagctatggctcagggtaaacacaggaatggaagcatagaagcccacaaaatatttgggtaatagagttcaagcatacttagagcacaggaaaggcgagaaattagagtgagaactaaagtcaaaaaggtaatttggcaccactttgcacaaagccttcaagtcaattattaaaaaaaacaaacaaacaaacaaacaaaaaaaaacagccatgccagtagaatgcagtaatctgacagcttttagcaaagtgggaatgtatcacccctacttcctccccactgatcttagaagaatcctaagtgtttacacctagtttgtaagatcccaagaaactctccagtggtctaattcccaccactcagctaagaactctcagctcaaaagatactggcatctggaaagcctttttcaaagtccctaagtctgagttccttacatcccacacttcacccatctcatagtgtgtttttcttatctctctccaccatcactggcttccatgtgagcaggcactatctttgttgattcctagcatgttgcaaacagcccggcacatagcaactactcaataaatatcctggaaataattattacattagtgaattgaatgattgatgcactgactgactgttgaagaaatagagtcaaggagagccataggaggctgccacaatagcccacggaaaacacctctttataaaggtccagatgtatttctttaagtaggcactttgctaactggggagagcggtggttagttaaagcagacagcaaagcagaaaaaggcagggccagcgggcagttgctggggagaccacaattccatgggactatagccattagcatgcaacactgggtaatctgattttcatgacagacagatttattatgacttctaaatatataaatcccaggttatgctttccagctaacctaacaacttgatatatgtgtctgacatcccgtcttaaaatcagattccagcttctaattaatttttattcacccatcgctctaacaagagaggcaggaagtctcagggggataaacaatagacagggtattagtcgttcctactctgtggcacattttccactgagtctctggagttttctttttctttgctaccaaaaaaggggggccttacccattctctctgtggcttctaggaagaacgagtggaaaacattacacaggcacccgatagtcattatttctattaagcaaccaatgcttcatccatcacttccacctccccattccctgctttcatctacccatgcagaaattggaatgacatcatggtctagtcagtttaaagactgatcattgcttatgtattactatacatcttgctttctccaataatattatcagcaaatagttcttgaagctgaattgcaagtgccacaatgacctgactttaaaccaataatagtgatcataaaggctaaaagtaccacctaccgctttttatataatctgaacaatattaataattcactcacattcagatactttattaacaatgaaaagtgatacagctgtacccaggaaaagttttgtaatccactgatttctttaatgagcattctatgaatctgtgttttttaaatataattttcatatatgaatacaatttaaagaacattttcttctatgtcctttttccaaaacatgaaagtcaatatgggtaccacagaccaggttagaaaaaaaaagatggtcacattcaactttttaagttttttaatatttagttctcactatgtgctagagattgttctcaaaatgttaaatgcattaaatcctcctcaaaactctatcaggtatcataatttatccttgtgacatgtttaaaaagttgtttgcagtcacaaaagctagcaagttgtacaactgagatttcaattgaggctgatggctgaggctttaccaccttggtcttaatatactgcctggagatttaattactaaataactaatagtataagtagccagttgtgtttgccaaacccataaagccaaactacacaatcatcttcactttgaggacactatagtgtttctggctttttgcaagcagatttaaaaaatttggataccagtctgtttacctgccataatatggaatataaactaggaggagaaacacattcagcaaagaactttgtttgatggacttcacgaatcaaaaaaaatgtcatttttctgttcataataaataaatagtaaaaataggataataccaaaaaatatgcaaaatcttctcctccctatttattacaagtatatactttctaaatctctagtgtctatgtaatttatttgatggtatgaaagatgtatttcacatgtacatgcacaggcacacatgcgtgtgcacacacacacatacacatgcaacctatgtataccagaattactctgtgctcaatttatcttcagttaagcactgaaaacaaaatagaaccaaaaaaatggattcataaagtgacaaaaagaagttcattcacttgcccttcaggtacataccatactcatatgaacaaacttatatattctccctacaaaatcacacttaaatatgtgatttaaagtattttttgctaagtatttttatttctttccccaaaattatttgtgaaaatggaacatgtcctatatatcaataaatgtcatttaaaataaataaatttttaaattaaaattatcatcaaactcttaaagtatttcattttttaaaaataaatttacactggaatagaagtcaaacaaacatttaaaagcacacagaaagcattcatattacaactaatctaaatggctgatttggtaagttttagagccttttaataaaaccatatttttactcaagtactatttagttagagctttatcaaaatacttaattacaaaataagatctaagatgttcaggtaaaactatgcacaatataatcaaatccttagcatgaagccattcaagttgtcatttagagatctgttttctgagcctactccagttttaaaatagtttcctcagtaacatcaaatctgcccttcctcccctttgccctcagaattattagagcataatgtaattcttttaccagccttaggaaaacactattggaatgcatgagccaaaatgcagagatgaaacggaactgaaaaaaaaagttttttaaaaatggaaaatcaattactatttttaataagtagaaatagcttttgtgctaagaaaagaaaaattgcccagagacaaaatagatgttcgatattatagtgcactaatgagtacatttacatgtaattttctgaaatttatgtccaagactaactgcaaatagaatttagtatcaataggagtttacaaaacccattcatttttcctctaatcatattgaatatttaaggtgcttgattagactcaattatttttctttcggtgccaaaaaagagccctgacagctttgaaagagatggattagtggggcatttcccaccaatggggaaacattcctggctcccacagcaggaaaaaaaaaaacaatgagaaagttcatgccaattcacatgcatgccactgaatgaaatctgcagagaactcagagaaggtcagcttgtcaaaggatcacggcaaaaagcggaagaggcagatacccaaacttagtaggactttgtggcctcccagctcacaagcctgcttcttcatttcaaggcggcctggagagaagcatctgacaaagatctatctcccactgcccagaaaagattaaaagaatatgggccctagcaaatctcctagtacttggaattgagaaatagaaagggaaatgtagctaatttgcagtagccctgcttccttgttcagatttcccgaagcataataaaatagagaggctgtgtctccagggttccacttccagctgtgccccacaacttggaaaaaacaagaagggacatgttacctactcacaccaacctgcctctcctgctgcccctcctgctgccattctttcaattcattctaagggaggttgtcagccctctctgaaatgctttaaaaagaagctatattcctaactggtcaaggagatttaggtgaattcctggctgaaagcagaatgaggaaaaaactgttccctcaaagtgcccaatctttgatgcattatgttctactgtctgctaaaaccatcatcgtagccttttaattaaattttcaaattctggtttgatggtccatgttaaactcaatttggtcaattcagggcaccatccacccagatattcctccctctgagacttctggtagaatccttccttgcctcttcctaatttccagtctctgcctctgtcatcatgtgacgttctcccctcatctgtctgtatcactgtgtcttttctcctcttctatgaggacaccattcacattgcattaaggttccatcttaactccagtatgacctcatcttaactaattacatctgtaatgacagtatttccaaataaggtcacattctgaggcaatgagagttcaaacttcaaatatctttttgggggcacacaagtaaacctattctgtgcagggcacacaattcgacctactaacactcccatattaaatcaatcaccaagtcgtgagcagacacctaatacctctcaaatctgtcaacttctttctatacccaccactaccctgaatcccatacaattgtctcacctgggtaattgtaacagcttcctttaggaagctcccctcatttttgcattgctccaatagattctccaaaaaaaaaaagtgcttattgaaatgtaactgatatagagaaaagtgcataaatcagaatgaatttttacagggcacacatacccacttaaacactacccaaatcaagaaatataatattatcatcatcctagaagcacatttcatatcccttcccaattaatttcctcctgctccagcccaaaggaaaccattatcctgacctctaacaacattgattagttttacatggtttgggattttatatgaatggtaacattcagcacatgcttttgtatctgtcttctgctgttagaatgatccttgctgttgcaactagaagtaattgattcattttctttactttataaatatttcattatgtgaatatacccttttacttattcattctaatgttgatgaccattcagattgagttccatttggaaaagctattaaaaataatggagctacgaacattctcacatttttagcgtatatctagtagaagtgaaaggtcacagggcctacaattgtttttcactaaatattgccagttttctaaagtaattatattaattttcaatcccacaccactgtatgatagttccagttgcttcatacccttgccaacacttagtattatcaatcttctttcattttagtcattcagatgagtgtccaatggtagctcattgtctctaataactaattatgataagagctttgtaatatgctgtgtagccatgtgactatcctcttttgtaaagggcttgttcaaattcattgcccttttttccaatgggctatttttctcccatccaagtactaatcaggcccatccctacttagctcccaagatcagacaagattggatgcattcagggtggtatggccgtagactacctctttttcttactgatgtgtagatgatatttatatgatctgaatactagtcctttgccagagatattgtaattatcatctcccattctgtggcttgccttttctctcagctagtgatgtctttagttcataaactttccattttgatgtactctaatatatttatcttttcattttttgctattgttttaaaaatagttttattgagatataactcacataccatccaattcaccaatcaagtgtatgtgactcaaagttttttagtatatccacagagttgtgtaacaatcactacaatccaattttagaacattctaatcaccccagaaagaaacgttggcccggcgcgttggctcacgcctataatcccagcactttgggaggccgaggcgggcggatcacgaggtcaggagatcgagaccatcctggctaccacggtgaaaccccgtctctactaaaaatacaaaaaattagccgggcgaagtggcgggcgcctgtagtcccagctactcgggaggctgaggcaggagaatggcgtgaacctgggaggaggagcttgcagtgagccgagatcgcgccactgcactccagcctgggcgacagcgagactccgtctcaaaaacaaaaagaaaaagaaaccttatacctactagctgccactccctattcctcccaacaccttcaccctcactaaactctaaccaaccactcatccactctctgtctttattgatttgccttttctgggtatttcttatcaatggaattatatgatatgtgttttttttattttgtttttgtgactggcttctttcactttgcatgatgttttcaaggttcatccatgttgcagcatatatgagtacttctctacttgtttgtctaataatattccattgtacggatataccacatttatttatccattcatcagttgatggtcatttgggttgtttccactttggggctattagatgaaatgatgcttggatagtgttttttcatgtcctgtttaagaaatatttggctatcccaaaatcatgaagacattctatgatgttatattctagatgctttattgatttagctctcacactcagatcagcaatccaactggaatttatttctgtttatgatgtgaggttcatttttccctgccctgatacccaaatgattcagcactatttaatgaaaagatcgccctttcttcattgctccacagtgtcatctttctcaaaattcaagtgtccctacatgagtggctctatttctgtacactccattctgttccattaatctattgctatttgcttatccttgtgcaataccacattatagtaattattgtagatttataatgaatttatgaagagctgatagatagtatatgtcctccaactttgttctgattccccttcagaattatcttgcctattctttgccttttgcataatggtgttttgattagaattgcatgaaatttagagatcaatttggagagaatagacctcttgaccctattgagtcaccaattcatggatatattgtgtcctttcatatattaggtcatctttaatttctttcagtaatattctgtacctttctctgtagaggtctaatacatcttttgttagatatattcctatgtttttaatatttcaagctattttaagtggtaactttttaaatacatttattgaggtaaaatttacatagcatgaaattcatctatttagatgtacagtttgatgagttttgaatacatttatatagttatacaaccatcacctctacatagttttagaacacttctatcaatccaaactgttacctcatgccctttgcagttaatccccactccccacaccaggcagcaactgatttgctttccatctctgtagttttgccctttctaaaaattgaatcatacactatagattcttttgtgtctggattctttcacttcacataatacttttgaagcatatccaggttatttcaggtatgggctgttcattcctttacaatgttgagtagtattcccttgtataaatatactaattattgcttacccatttaccaattgatagatacctagattgcttctataatagcttgggaccattacaaacaacattgctataaatgtagacatacatttcatttctccacaagttttcatttcaagaccttgaagtggaattgctaagtcttatggtaagtacatgtttaaccttttcaaaaagtgccaaattgttttccaaagtagctgtaccattcacattcctaatagctttatttaaaggttacagtttctccatatcttcaccagcacttcttattgccttttttactttagccatcctagtgggtataaattggtatttcaatgtggtatataataatatttcatactattcctctcctttaaatttgcattttcctggtgatgataagcatttttcatgtgattatttgccattaatgtatatgctttggtttgttttcttattaccgacataagaattctttatatattcttgatattaaatgctttatcagatatgatttgcaaatatctcatcccattctgtggtttgtctttttattttcttaatagtgtccttaaataactcacgttttaaaatgttatgaagttcaatttatcagtgtttttttcttttaggaaatcttgattttggtgttatatctaagaaatatttgactaatataaagtcataaaacctttcctgtatgttttcatctagaagttttatagttttaaagcttatattttggtctgtaatccattccaagttaactttgtatacagtacaggctaatttttggataaagacatgcaattgttccacctcaccttctttggaaaaacaatttgttcatagtttataaccctttttatatgttgctggattcattttaaatggtatctttttaaaatttcattttgtaattctttgttctggtacgtagaaatacaattgatgttttatactgactttgtatctagcatccttgctaaattcatttgttaaatttacataattatatgttctgcaaataaaagaattttattgtttcctttcaaatgctcatatcttttttttctgtctctctacattcaccaggacttccagtacaatgctgaacagcagtggtgagaacagtcacccttttctcagacctaatcttagggcaaggctctcaatgtttcacttaagtatgatatttgctgtagtttttaaaaaatatatagagagtctttattaaggatgtttacttatagtcctagtttgttaaaagttcttatcaggattagatgttgaattttatcatatggcttttctccttttctgttattacatcatttgatttttgaacattaccttaccactcatatctataataaatacaactttgtcatgacatatattgtttttctatattgttcagtctgctattgctttgtttaggatttttgcattcttgagacctccaaaatctcttccccatctctttagctgctgctttctattggacttttaagcttttcaggtctttgtcatttacaaatcaacaaatgcttcaaaaagaaaaagaatgagaatgttgaagtcacttcaatgcacctcctccctccagggttctgacccctcaagtcctggatgccttggtagcccttcaataccttcaaacaaatatcttctctttattttggctggcttttctagttattctcttggtggattattagctaccctatcattaccagaagcagaaattcatcctataactaaataaagtcatcatataaactaaatcatattattcttcctccttgaatttgctaatgtgctgataaaaactccatattctgtactatgtcctataagattctagtgatacagacatagcctttccctccatcatctcctaccactcactcccttgttcactcctctcccaccatatgtatctactttctgttcttctaatcccattgggttaattcccaaatcagtgcttttgcatttgttcttccctctccctggaacaccctgtccctgatcttcacatgcctgcctcacttttgtcaatccatctcagtttcaatgtcacctcttcaaagaggccttctcaagacaatttatctaatcttgtgtctctcctgcctgattccccacaaacaatattctatacatgaaagaaatgataatgaaattaagccaacagaaatagagtttgaactttccaaaagccacaatgttatctctatcccacttccacatccaacataaagagaacaacaaactaagaatatgtaacacctttggggaccacttttgtatattattatacagatcttaagagtatataatctttctctggagtgtgacaaacctaaatcaccgctacatcactttccagatgtataacttccagcaaggttctcagcctcaacttcctaaactataaaatggggataatggtagaatccattcgataatattgttgtaattataaaataaatgttattttgtatgcaaagtgcttaatacagtgctgagtcataaaaagtgttccataaacaagagctattgtgatgactgacaatgatgctcatgatgataatgatgacaaaaacaataaggctctggagcatctggtaaaatgctaagtaattcaatcaaacacacacagatgtacacacacacatacgcacaaaattacatgttgtaattcatttccaccaagtagatacagcctttatcacttgcattggtagatttggtagagacttcatttctttgatttctgtactaggtaagtttggtggcaagaaatataggccagccctagcaagtctattcaaaaataagaaaaatgaaaagaatactacagtatctcacaaaattgaaaggagaatgaaaacccaagctttgtgaagaaggaaatcaaggtagcttcagagaactgagaggccggatcttagagacctccctctagagcactgctatttgaatgactaaaataccattaataactactttttgctttcaattcaaaattcaaaattcttagaagagagaatctgattggcataatcagatacctagccctagatcactcatctctgccctcaagttaaaaagtcaaacattatggtctcagctgctgggagcccacctctgtggatcaggggacactgcccagaaaagagttttgttttagaactggaaggtcatcccaagaaatattactataatagaagggactctgtctaagatgggctctctctaaaagaagtcattttgttctactatttgcccatccagaatagcagtgaccaagttatgcaccattagctgcttgggagggagctaattacaaattaaatataattgaatcagtgagtctgctttcaagtcctctaaatagaataacaacatgctaccttgtacagccaatttagcaaatcgaagctgaatcccttgctttctatgaagataaagagcctttgtgaaatttttaaagtatagatgtaaacttcaaaaaattttgcaaggcaagtcatcaaaatctgggagaaaatatattggaaactgtgctccaacaggagccaatgaaggaaccttatgagggagtataaaatattaatattcaccaatgccaagaaaattttcatattatgcaggtatccaaaatgggactactatctttgatttcacaattcctttctacttctctaacacgaatttttagtgacccaaaatgctgggaagaactacaaaatacagtgaatgcattctacttgaacattatcttatgctgttgtacctaccaaaaagacaccatgaaaactgcaagtatggctgcgctggaaaaaaccgaaataagtagtcatctgtgaagtactgcaagtgtgggaaatggttgagagtcatggacattggggaatatcaacaaaagaggaagaaaaagaagattaggatggaggtagaaatgattcccatggaattactgacatcagtatatattcccttagcctattattacatcagtgtctcctactgggaatatttactgaaccagtggtactcagactttttttgagcagggaaaaaaatttattcaacatttggaaaactggcatagggcatccaaagtggggtgagaaggctcttgtgtcagactaccaggtccattcccagctcaatatatacatactgtggtaagatatccgtaacgtaaaatttactattttaaccatttttaagtgtacagttttgtggcattaagtacattcacaatgttgtggaacaactacctgtatctaggtctaaaacatttcatcacctccaagggaaatcctatacccattaagcatacattccccgattccttcttcctccagtgcctggcagctactcatctgctttcaatctctatggatttgcccattcaggcatttcatataaatggaatcttctaataggtgaccttttttgtaatggcttattgtacttagcatgtttttaatgctcatccatgttgtagcatgtatacttcagtaaaaaaaaattgaatacaattgtaaatatttgtttgaaacacataaaagaaatagttaaagggattgagcctatttacagaagacttgaactctggggcaaggagagatgaaaagggggactaggatagcagttgtcatttcaaagactcattgtgtgtaaagagactaagttttattctattcagccccaaattatccccccataaccaaagagtagaaactataagaagagagatttcaatttgacataagaaaaatctttcaacagtgttatccaaagacagaatagactgtttttataaataatgagttccacttatctgtaggtattcaagtataaatggaatattcccttcgcagaaatctttagagaagcaagcatcagataagattgatctgaatcagtggttcctaaaagccaatcaacaagcgcatgccaatacatgatgaagttttcattcactcgtggtgaaatgccaaaatcaaagaggtttttataaagctaaatatatatttaattattttaattccaagattatgcctttcatccttttagtatcaaaatagccccccaaaatagtgaatgatagttttcttcattcatgcccttttttggggcaaaacttcaaggtgacaaagtaaagtcagccctttgttttaggggggaaattgtaccagtctcaaagtgtgagaatcatttgaataggtgattcttaagacattttcaaaattccaagaacccatgtttatgaccaaggattgttatgaaagttgcttttgttgttcattttatccatatttcaactgtgtatgcaaggagtggagcacctcccaagaggattttccccaaggcttctgcctttgtagggatggtctgaaatgatatagaatttgaacggatttctagtctcacagggatttatattacatgaaaaaagagagagctttgctttagagatgtttatccaaattcaccacggagtcaatgggccaaattccaaatgccatgggcctcccagtgggtgtcaattttactgggcggctgtgtttgggagaaaaagtacatatgcatgtgtggctgtgaatgtgtgtgtgtagagataaagagagaaggatatgaacaaatagatagaggcatcaacaatcacaagagggaaagggatgatatatgtttagaattatatctaaggactgtctaaagataaacaaaaataacgtttttccccttttttgtcacccttgttaaaatcaataggaaaaatttgaaggtaccaagttattttattgtcaggcaccaaaagagtaaaaattgatgacatcactccatacaaaacccccagagctttctgattctgctgtttatgctttctcctgcaacatctccatttggatcctgctggaaacacttttctttctgtcactcacaatctgtcaagacagcattatcttctgtggtttaaaaacagaaactccatttaacttcgtggttgataaagacatctcgttcacatcccttaactaacaataattattctaatttaccacataaagacaagaaaaaatatgcacttaacattttgcagctggttttgtatcaaggaacacatggaagagaaatggtcccactcttgcgataaaaaaataaggtattaagtaaaaaatagacctaacatgaatgtatgcttttggtacatcctccctacatgccaatcagtgaagcaattaggagtttgggctctcaaaacatacttggattccaatcctggatttgcctcttattaatctaagaaggcaagacacgtaaccttcctaagtcttcttcatctgtaaaatgggagcatatatcaatatctacctcataagattaaattagataatcaatctatgtcagctgctgttactattgttgtcctcctcctactcgtcctcatcatcaccactattaacatcaaatcaacgtattagttaaggttctttggggtcaagcaacgcagatcatcctgcctaacgttagcaaaatagaaaagagatctactgcaagtatacagaatagtgcctaaaaatcaaagtaaaactaaatgaagcttagaaccaacaggaggctgggggcagtggttcacacctgtaatcttagcactttgggaggccgaggcagagggatcacttgagcccaggagtttgagacgagcctggacaccatggcaaaacccagtctctacaaaaatttagctgggcgtagtggcacccacctgtagtcccagttactagggaggttgagatgggagaattgtttgagtctgggaggttgaggctacagtgacccatgatcatgccactgtgctccagcctgggcaacagagagaccttgtctaaaaaaaaaaaaaaaaaaaaaaaaaaagaagcaacaggagtcaggctcccaggaattcatggtcagttagttcttcaggctactatcagcaggaagaatcagcaacaaccattttccatccttgggtcaatgtactcaagattcagaatctctgaaaaaaaaagagtggtggggtgggggtaggggggtggggtttgggacttgggcactgccttggtcacatgaccactgcttggcctggggaaggcaaggtgtttgacagctccaataatactgtgtttggtggagaaggctattccccaagggaaaaatctactttataactcaaagaagaggagtacagatactgagcaggtacatataccaagaactatttttcttacaccattacatcccaacgacccactacgtcaagctcaattaagcctgcaccctcttctccatcatccttcctatttggtaattactcttttaatacatgtttttaattttgaagttgttgttaaaactcaatttgagaaaagcaaaaaggccccagagctctaaagtatatatgtcccttaaaaatatatatatatatatactgcttgctgacaataaattattttgttaaaaaacttccgtattagaatttccagaaaatttattgtctttatgttcaagttatttagtagtaatctgtgctattaagaagcacataaagcacccattgaaaaagttatctgaagatgatttagagaaatagtttgttctcttagaaagaaatctcttttatgttttaagttcaataagatgatatttatgctcataaattagggtcaaaggcaacattttgttttggtaatttttttgtggatgatgatgttttagtgagaaaggattgacaataaaagcaagaatgtaagaataataaaaataaataataacgaaatacatgacctacaatttcattaaaattttcttccagcttactagctgaacaaatcccaaacaatgaaaatatacagagtctgattaatttgaagccctaaacaactctgtagctcagtgaaaacatttctcataaagcccagggccctgagggcacacagagctaagacaaatcccagtgtggtccacccttagcagctgtgtgactctaagcaacttactaatctgccaaaatacccaggtctcgcctcatctgtaaatgaagtaaacaacgtggtgggatgttttgaggacttgatataatgcatggaagggtcttgacactttttctggcaaacaatgagcacacaacgataaacgtttataattctatgtatggagagagagagagagagactgagaaagcatacaaaagagcaagaaagcagtagttctcaacagggagtgatttttgctcaccagaggacatttggcaaggtctggagacatctgtgattgtcaaaacctggagggtagagggtgcttctggcatccagtgggtagaggccaggcatgctgcttacagggaagctcttacaatacagatgacaagcccccacaacagaattatccaagccaaaatgccaataatgccaaggttgagaaacagaaagagattgagaaagagaaagcaatgtgatgtaatgcagaacctgtaacagatttggaaggaaaggtacattcaaagccgggataggaaagtagatcagagcagatttgaaattagattgacaggcatctgccacatgtaagctattgaggaagtgctctgagcctgaggattctcatttgaacaacgggcataatatgtaacatcacctacctcaaaaagttgttagcaggcatgatattcacccctgaccaaatcattacagatgcccactgcgtataaccagtaggacttcaccagtgtgtatacccactgtcaaccctaagagttaggtacacgtaataaataaatggttactagtcttgttatatattagaccaacagccaggtttgaagtttgactctgctacactggaaatacttgaaagggtttgttaatatcagcaagaattagtgccctcataaggaagtaaacagcaactagactccaagttcaaatgagttttccctgtaggttaggtgtcctcaacttgggatccttaaaacctctgaaattaaaaagaaaaaattacacatatgcacatatatacatgtatgaatgcaaccaagtgtgtgtgtgtgtgtgtgtgtatttttctctgaagaggggtccaaaaatggtgacgcatcactgggttagaggtatacagttttcaatataaagtaataaccaggatgcagtagagtttctgaagatatcattgtaatgtgaaggagacagtatttggaaatagttatgaactcagatctgggagtttgaattctgcctctgccacttactgtctgtgcaaccttgcataactgacagaacaataacttctttgcatctcacatgcaaaggtggaatgctcataatatccacctaagaagaatcttagagcaataaaattagacaattcccatatggtattcagcacagtactcaacacatagtatagaagtccctggttatccgcaggacagatgcttcaagatccccagtggatgcctgaaaccaaacagtactatgtttctcctacacatgcatacctatgaaaaagtttaatttataaattaggcagagtaagatattgacaatgatagctaatgataaaatagagcaattataacactatgccagcattactactcttgtgctggggccattattaagtaaaacaagggttccttgaacacaagcaccatgataccatgacagttgatctgataactgagataatgattaagtgatgaatggacagggagcatctacagtgcatatgctggacaaagggatgattcacttcctcacaatggagcgagacagcatgagattccatcatgctacttaggacggtgtgcaatttaaaatttatacattgtttatttctggaattttatagttaatatttttggaccacagttgaccatggttaactgaaaccacagaaagcaaaaccgtgaataaggggagaccactgtatgtgaggactaagaattagatactgcaatggaagtatttgcaaagactattatattcagatggtggtgaaggtttgagccttctctaactacgtatggcacacactatcagaaaaatggcagggattcatcaattaatctatccatttactactagttcagccagaggatccactaattctgagacatgccttgtataataatatctatacaatgttgaaaagtggacagaagtagctgtgaatctggtcacaaaacctctttttatacaagaaagcctcattcaaactttctcctctgacacatttcccagggccccctctgggatttccacaaacatgatgttgtgcttgactgtgcattactatggaacaattctaagcctgtctcacctacatataagatacagactccgcaagggccttttcaatctccttcattcctctcagaacctgtgcaaacaggattttatgcacaggtaacccaaataaagcagggttgccttgagacttgcatctgcccaataacatatccacgaagaatgactctgtaggcatttgccagtgcattgcacagcagcacagcctaaaattcttcctcacccatccattgccccaaccttaaagcatctgttttaaaaaaaaaaattcatctttccctatctctcattctaacctatccccacccaggatgccctcagtgccattctgctttttcgctgccaccacatttactgtgctcatgacacctgtcccctctcttcagggtatcactcctgcaaggcagagagcctggcctgaatacctttcttctggaagcagccctctagaattctgggtaacagatttgctatcttgttctatagagaagttcattacaagaaatgcctccattcctggctcaacgctcacttaaccttcttctagaggccacaggcagatgatcttccaagtttctcttaccctagaatagtagtgaagaaaaaaggacctcatctgcactctacctgacttgcagggcaaagtcagtattaatcagaggtgccctttttgctactgacagacaaagtagatgcactcataaccaagagcttttcaccaaaccctcagggctttaaatctttctcaaacaaactgcaatttgcaaagaaacaccctaaatgatgctgtgcaaggaagttacagcaggcacagaaggatggagtaacatttcaccatctgcttgtgataataataatgcctctaccttgcaaagtgtctaattgattgtgtgacacaggcacaaagttcctgccacaatttcaccaacaaaagttattcctaaattgtaccctcacagagggagagtgctaaggtcagtggtcctaaggaccaattttgagcatatgaactttctggtggcagaatgataagagtcctgggacacagttaggcaagattgaaccaactcaccctataatagttgtttcaagcaatgtccagccggggacacagagaacagagaggtaggggatggatctagggcagtgttttccacttgtggaatggaaaatgccttaaggtaatatggatgaacaactgtctgggtttcctgtggaggaagcctgggctgctttactctctagggtgttgagccagaaggctttattctggtacagccacctcattgatagtgaggtagcaatgcctgacaaaagtagatgttcatgctttgtgctagaagagcatagacttagccagatgccatctttttctaaattggcagcactcaggcctcaactgaaggggttgggaaaagtgagctggaaaaaagaggccgggagcggcagctcacacctgtaatcccagcactttgggaggccaaggcaggtgcaacacctgaggtcaggagttcaagaccagcctggccaacatggtgaaaccccgtctctactacaaaaattacagccagctacgccgaaggctgaggcaggagaatcgatcaaacctgggagggggaggctgctgtgaactgagattgcaccaatgcacttcagcctaggcaacagagtgagactcaatctcaaaaaaaaaaaaaaaaaaaaagacgggggcgattccaagatggccgaataggaacagctccagtctgtacctcccagcgtgagcgatgcagaagatggatgatttctgcatttccaactgaggtatcgggttcatctcactggggcatgtcagacagtgggtgcaggacagtgggtgcagtccactgagcgagagccgaagcagggcaaggcatcgcctcacccgggaagcgcaaacatgtaccacatgttctttatccagtctatcattgatggacatttagattgattccatgtctttgctattgtaaatactgctgcaatgaatatacacatgcatgtgtctttataatagaatgatttatattcctttgggtatataaatacccagtaatgggattgctgggttgaatggtagttctgcttttaggtctttaaggaatcgtcacactgtcttccacaatggttgaactaatttacactcccaccaacagtgcataagcattcctttttttccacaccctgaccagcatctgctactttttgactttttaataatagccattttgactggtgtgagactgtatctcattgtggttttgatttgcatttctctaatgatcagtgatgttgagcttttttttcagatttttgttggccacatgtatgtcttcttttgaaaagtgtttgttcatgtcctttgcccactttttaatggggttgtttttctcttgtaaatttgtttaagttccttatatatgctggatattagatctttgttagatgcatagtttgcaaaaattttctcccattctgtaggttgtctattcactctgttggtagtttcctttactgtgcagaagctccttagtttaattagatctcatttgtcaatttttgcttttgttgcaattacttttagcatgtttgtcattaaatctttgcctgttcctatgtccttaatggtattgcctagttgatttccagggtttttatagtttggggttttacatttaagtctttaagctatctcgagttaatttttgtatatgatataaggaaggggttcagttttaatcttctgcatatggctagcagcttaacccagtaccatttattgaatagggaatcctttccccattgcttgtttttgtcaggtttatcgaagatcagatggttgtaggtgtacagccttatttctgggttctctaatctgttccattgggctatgtgtttgtctttgtaccagagccatgctgttttggtcactgtagcctcgtagtacagtttgaaattgggtagcatgatgcctccagttttgttcttttagcttgggattgccttggctcttgggctcttttctgcttccatatgaattttaaaatagtttgtttctagttccgtgaagaatctcaatggtagattaataggaataacactgaatttctataaactgttaagggccatatggccatttgcatgatatttattcttcctatccatgagcatggaatgtttttccatttgtctgtgtcatctctgatttctttgagcagaattttgtagttccccttgtggagatctttcacctccctagtttgctggattcctaggtattttattcttctgtggcaattatgaatgtgactatgttactgatttggctctcggcttgactattgttggtatataggaatgtttgtgatttttgcacatggattttgcatcctgagactttgctgaagttgtttataagcttaagaagcttttaggctgagacgatggggttttctagatataagattatgtcacctgcatttgaatgcactttatttctttatcttgcctgattgccctggccaggacttctaacactatgttgaatggatgtggtgagagagggcatcgttgtcttatgctgattttcagtgggaatgcttccagctttgcccatttagtatgatgttggctgtctgtttgccataggtggctcttattattttgaggtatgttcctccaataaggagtttagtgagagttttttaacataaatgggtattaaattttatcaaaagccttttctacatctattgagataatcatgcagtttttgtctttagttatgtttatgtgatgaataacatttatggatttgcatatgttgaactaactttgcatcccagggataaaggttacttaatcacagggagtaagctttttgatgtgttgctggattcggtttgctagcattaggtcaaagatttttgcatcaatattcatcaaggatattggcctgcagtttttttttgttgtatctctgtcaggttttgatatcaggatgctgctggcctcatagaatgagttagggaggagtccctcctcaattttttggaatagcttcagcaggaatgctaccagctcttctctgtacatctggtaaaatttagctgtgaatccatctggtcctgggctttttttggttggtaggctatttattattgtctaaatttcagagctccctattggtctgttctaggtttcagtttcttcctgattcagtcttgggtgggtgaacgtgtctaggaatttattcatttcttctagattttctagcttatctgcatagaggtgtttataatatactctgatagttatttgtatttcggtggggtcagtgataatatcctccttgtgatttctgattgtgcttatttgaatcttctctcttttcttctttattagtctagctagtggtctattttattattaataattctttcaaaaaacagctctggattccttgatctttttttatccaagtaattgaacaattctacaagtattaaattttacaccaggaatgtatgaaggttcccgaatccttgctgatgcttgttattgttgtctggtttagtgggtgtgaagtggtgtcatattgtggttttgatttctatttccctaatgacagataacgctgagcatcttttcttttttttattatattttaagttctagggtacatgtgcacaatgtgcaggtttgatacataggtatacatgtgccatgttggtttgctgcacccatcaactcatcatgtacattaggtatttctcctaatgctatccctctcccagccccacaccccccgacaggacccagtgtgtgatgttccctgccctgtgtccaaatgatctcattgttcaattcccacctatgagtgagaacatgcggtgtccggttttctgtccttgtaatagtttgctgagaatgacggtttccagcttcatccatgtccctacaaaggacatgaaattatccttttttatggctgcatagtattccatggtgtatatgtgccacattttccttatccagtctatcattgatgggcatttgggttggttcgaagtctttgctattgtgaatagtgctgcaatacacatacatgtgcatatgtctttatagtagcatgatttataatcctttgggtatatacccagtaatgggattgctgggtcaaatggtaattctagttctagataattgaggaattgccacactgtcttccacattggttgaactaatttacactcccaccaatagtgtaaaagcatttctatttctccacatcctttccagcatctgttgttcctgactttttaataattgccattctaactggcataagatcgtatctcatcgtggttttgatttgcatttttctaacgaccagtgatgatgagcattttttcatgtgtctgctgactgcatagatgtcttcttttgagaagtgtctgttcatatcctttgcccactttttgatgggtttgtttggcttttcctgtaaatttgtttgagttctttgtagattctggatattagccctttgtcagatgaatagattgcaaaaaatttcccccattctacaggttgctggtttactctgaaggtagtttcttttgctgtgcagaagcactttagtttaattagatcgcatttgtcagttttggcttttgttgccattgcttttggtgttttagtcatgaaactctttgcccatgcctatgacctgaatactatcgcctaggttttcttctagggtttttatggttttaggtctaacatttaagtctttaatccatcttgaattaatttttgtataaggtgtaaggaagggatccagtttcagctttctacatatggctagccagttttcccagcaccatttattaaatagggaatcctttccccatttcttgattttgtcaggtgtgtcaaagatcagatggttgtagatgtgtggtgttatttctggggctctgttctattccgttggtctatctctctgttttggtgccagtaccgtgatgttttggttactgcagtcttgtagtatagtttgaagtcaggtagcaggatgcctccagctttgttcttttgcttaggattgtcttggcaatgcaggctcttttttggttccatatgaactttagttttttccaattctatgaagaaagtcactggtagcttgatggggatggcattgaatctataaattactttgggcaggatgggcattttaatggtattgattcttcctatccatgagcatggaatattcttccatttgtttgtgtcctcttttattttgttgagcagtggttggtagttctccttgaagaggtaattcacatcccttgtaagttggattcctaggtattttattctcttcatagcaattgtgaatgggagttcacttatgatttagctctctgtttgtctgataatggtgtgtaggaatgcttgtgatttttgcgcattgattttctatcctgagactttgctgaagttgcttatcagcttaaggagattttgagctgagacaatggggttttctaaacatacaatcatgtcatctgcaaacagggacaactggacttcctcatttcctaatcaaataccctttatttctttatcttgccttattgccctggccagaacttccaacactatattgaataggagtggtgagagagggcatccttgtcttgtgccagttttcaaagggaatgcttccagtttttatccattcagtatgatattggctgcgggtttgtcataaatagttcttattattttgagatacgttccattaatacctagtttattcagagtttttagcatgaagggctgttgaattttgtcaaagaccttttctgcatctactgagataatcatgtggtttttgtctttggttctgtttatgtgatggattacgtttattgatttgcgtatgttgaaccagccttacatcctagggtgaagccgacttgatcatggtggataggctttttgatgtgttgatggatttggtttgccagtattttattgaggatttctgcatcgatgttcattagggatattggtctaaaattctctttttttgttgtgtctcttccaggctttggtatcaggatgatgttggcctcataaaatgagttagggaggattccctctttttctattgaatggaatagttgcagaaggaatggtaccagctcctctttgtatctctggtagaatttggctgtgaatctttctagtcctggacttttttggttggtaggctattcattattgccttaatttcagagcctgttattggtgtatttggagattcaactttttcctggtttagtcttgggagggtgtatgtgtccaggaatttatccatttcttctagattttctagtttatttgcatagaggtgtttatagtactctctgatggtagtttgtatttctgtgggatcagtggtgatatcccctttatcattttttattgcatctatttgattctcctctcttttcttctttattagtcttgctagtggtctatcaattttgttgatcttttcaaaaaaccagctcctggattcattgattttttgaagggctttttgtgtctctatctctttcagttctgctctgatcttcgttatttcttgccttctgccagcttttgaatgtgtttgctcttgcttctctagttcttttaattgtgatgttagagtgtcaattttatatctttcctgctttgtgttgtgggcatttagtgctataaatttcactctacacactgctttaaatgtgtcccagagattctgctacattgtgtctttgttctcattggtttcaaagaacatctttatttctgccttcatttcattatttacccagtagtcattcaggagctggttgttcagtttccatgtggttgtgcggctttcagtgagtttcttaatcctgagttctaatttgattgcactgtggtctgagagacagtttgctgtgattccttttcttttacctttgctgaggagtgctttacttccaactttgtggtcaattttagaatacatgcaatgtggtgctgagaagaatgtatattctgttgatttggagtggagagttctgtagatgtctattaggtctgcttgttgcagagctgagttcaggtcctggatatccttgttaaccttccatctcattgatctgtctaatattgacagtggggtgttaaagtctcccagtcttattgtgtgggagtctatgtctctttgtaggtctctgaggacttgctttatgaatctgggtgctcctgtattgggtgcatatatatttaggagagttagctcttcttgttgaattgattcctttgccattatgtaatggctttctttgtctcttttgatctttgttggtttaaagtctgttttatcagagactaggatttcaacccctgcttttttttcttttttttttttctttccatttgtttggtagatcttcctccatccctttattttaagcctatgtgtgtctttgcacatgagatgggtctcctgaatacagcacactgatgagtcttggctctttatccaattttcccgtctgtgtcttttaattggggcatttagtccatttacatttaaggttagtattgataattgtggatttgatcctgtcatcatgatgttagctggttattttgcagacttgtttatgtggttgttttatagtgtcactggtctgtatacttcaccatgtttttgtagtggctggtagccatccattcttcccgtatttagtgcttccttcaggagatcttgtaaggcaggtctgctggtagtgaattctctcagcatttgcttgtctgaaaaggatcttatttctccttcgtttatgaagcttagtttggctggatatgaaattctggattagaatttcttttctttaaaactgttgaacattggcccccagtctcttctggcttgtagggtttctgctaagaggtctgctgttactctgatgaacttccctttgtaggtgagctgacctttctctctagctgcctttaacattttttctgtcatttcaaccatggagaatctgacgattatgtgttttggggatgatcttcttgtgaagtatcttactggggttctctgtatttcctaaatttcaatgttggcctgtctagctaagttggggacattctcatgaatgatatcctgaaatatgttttccaaattggttccattctccccatctctttcagagataccaaagaatcacagatttggtctcttcacataatcccatatttctcagaggttttgttcattctttctcattcttttttctctattatctgactgtcttgtttcagaaagccagtcttcaaactctgaaattgtttcctctgcttggtctattctactattaatacttgtgattgcattatgaaattactatagtgtatttttcagctctatgaggtcaattacattcttttctatattgactattttttctgtcacctactgaattgttttatcatgatttttagcttccttgtattgagtttcaatgtactcctgtagctcaatgattttcattcctatccgtattttgaactctgtttctgttatttcagccatctcaacctggttcagaacccttactggagaagtgatgtgattgtctggagaaaagaaggcactctggttttttgagttttcaggattcttgtgctgattctctctcatctttgtgggcttatctacctttaatctttgaggttgctgacctttggatgctttttttttcttttaacctctttgatgaccttgagggtttcattgtggtacaagatggatttgccccactggcttcgtttctggaaaattttagggggccaacactcagcttccaactcatggactgtgtgctgtaactctggggtacttgtattgttttaattttaaaacaggaaatggcattgctttattttcactaagtctattattactttctatttatggtcagtaatgctgctcttacattcatggtgagagtctgcaaattctgtttgatatgtgaatataagtaaataaaagtgagtgacttttttaaattaaaataataataataaaaaaaaagtggtctgcatatttggcccaaagcaaaaaagtctgggatcaactctccctgaaccccagctcttcccatcccaaccacctatttttcctcaaaagcctggatttgggtgtgaaggtttttagattctcctttcttctttacccttatactcacttgggatccttcacaaccagcctatcaacataatttgggaaaagttatttgtgcagaaaaggtctggttctttcctactggagaattgcagaataaacaaaacaaatgaatcaattcaaagacgctttcagcctccagcaactgttgcatttttacaatggtaaaaggcagccaaacctctcatttgcccagaagttctttctttttccaatggttttaaatggctctaaagagaatgatccaacttagcagataaaaggccaagcctcctgtatagagaggtcttaatgttttcttttcagctttggaaccccctgattattagcattgtatccttggacaagtcactgagagcctgaatttctacacttgacaaacaaggacctacttcacaagggagataatgagcatcaggcacttagttgagggtcaggcacatataagggctttaaagagctattacaattattattattttgtttgtttgttttaatatatgtatacattgtgaaatgattgccacaatcaaattaattatcatgtccattactgcccagttatgatttgtgtgtgtggtgagaacacttaagatctattctcttagcaatttcaagtgtacaatgcattattattattaactgtagttaccatgctataaaatagatctccagaacttcctccgctctaattaaaactgtatgttttaccagcatctccctattcccccacctcctcccagcccttggcaacaaccatcattctactctctgcttctatgagcttggcttttttaattaattaattttttaatagacaaataaaaattgtatatatttatcaggtacaacatattttaaaatatgtatgcattgttaaatggctacattgagtgaattaacatatgcattcatcacatctttttgtttgtttgtttgtttgttttttgagatggagtctcgctctgtcgcccaggctggagtgaagtggcgcatgtcagctcactgcaacctccacctcctgggtccaagtgattcttctgcctcagccttctgaatagctgggactaccggcatgagccaccacgcctggctaatttttgtatttttagtagagatagggtttcatcatatcggacaggctggtctcaaactcctgaccttgtgatctgcccacctcggcctcccaaagtgctgggattacaggcatgaaccaccatgcctggcccatcacatcattttttatagtgagaacacttaaaatttattctgtagtgcttttcaagaaaataatacatggttattaaccatagtcattatgttgtacaatagatctctttaattcattcctcccataactgaaattttgtatcctttgaccaacaattctccaactgcccaccctccgcgccaactcctggtaaccaccattttattctctgcctctatgagtttgactgtttaaaatttcgcatgtaagtgagatcatgcagtatttgtctttctgtgcctggcttatttcacttagtataatgtcctccagtttcaccagtttgtctccaataacaggattcccttcttttattaaggctgaataattttccagggtgtatgtatatcacattttctttatccatcatatattgatggacacttaggttgattctgaatcttagctattatgaataatgctacaataaacatgggagtgcagatatccttagaagacttattttatttcctttggataactacacactagtgggattctggaatcatatggtggttctaattttttgaggaagttcatactgttttctataatggctgtactaatgtacattctcaccaacagtgtacatgggttgctttttctctacagctcagcaacacttattatcttttgtctttctgataatagcctgataaagaaaaacttcagccaaattaaatttaaaggagtttaattgagcaatgaacagtttgtgaatcgggcagccttctgagccagagcaggctcagagactccagtgcagctgcgtggtagaagaagatttatggacagaaaaaggaaagtgatgtacagaaaatggaagtaaaatacagaaacagctggattggttgcagctgggcgcttgccttatttgaacagagttcaaacagttggctacatttgattggccaaaagtcagtgattggcacaagggtaggctatggtttgtttatacctccgcttgttatagttcacgatgtacggaaaaacctttaggctgaacttaaaatatgtaaggaggcagcttaggctaaacttgatctaacaaaccattctaacaagtgtgaggtgacattttattgtgacttgaatttatagtcccctgataattagggatattaagcatttttttcatatacttggccattcatatctcttcttttgagaaatctcttattattatcatcttcattatcactctaattattaataatgttcactaacccatacagctacagtgatttttgttacaacaggagctttctgctttcaaaaaaaagtgctgctaccttaagtaatcatttatcctaactctaggctgcaacttactattattattattcattcaacattcactcaacacttacttcctagagccactgtttgggcactggggaaatagcactgaacaacacagagcaaagtctttgccctgtggctcacattctggtgaagcagagaaacagtacacataataaatgaatgttaattacagtatgtttggcagtgatgaatgctagagaaaaaatagcctatgacctggcaaaggcattacccattaaggtaaaggacctatctcctagagcacttgagttttgtatcacataattcatcaaggcctttagatattacagtctgatctttgggccagtggtctccctgtgtcacaaggcaagcgggcctcaagaaagtaaaaaaggaaaatatttcctctatttgctattgccaaaacttcctccaagagggaaaggataggacaaaaagtattttgtgtgggtgtggcagccatagctaggctatcaaatactatgcacatatgatatgccactctcagtccctataatggcagatatgattaaggtttcctctttcctgctgagcccagaaccagcttcacaaactttttcagcacagttctctgggcaagcaactttagtgattaaagttagcctaaaagactaaatctatgtgccatcatagagtgcaaagttaggtttaaatgtaaatatatctagcaaaggtatcatactgacttaaaatcacactaagtcctaaatgactggtcttcttccaagtgaacattttattggaggtagggaatggctaagaagaaatgctgttaagtgtatagaggggaggggcagaaggcatgtatgaagaaaaggacaggttttataatcccacccacatttgtatctgaacatgtgtgtatggcaaacacacctgatagcaataacttaagcataccctaagaataaccctgtatggcagatgcacttgaatgtggttaggtgtcccaagctaagaatccaagaatggccaacccagagagttgttcctaatctataaggaacatctgagcccctggcctgtccaatggaacatggctgtatagggaatcaaggccctttgtttggggttaagtgaaggttgccaggtagagactgtcacagggagagtgctaagtaaatatgccatataaactgcatgttttttgcaagttgcctggttctcctgtccagcccactgccactggactctctcccctgtatgtaagcccccagtaaaagcccatgtcacgtttcctgtctctgggtctcttcttcagcctcttgaacctggtgccatccccactgaagttgataggtgttcagcacaacagtgtcattaggaatttctacaatgtcataagcaatgtcataaggcatttctacacactctcacttgaaggaaccacctccattagtgtaccttagtctttcacacaaacacatacctgagcccacaaataaagtgctcaaaaatagtggctctcttcttctagttgttcaggccaaacaccttggagtccaccaccaaatccttttaggacaaccttcaaaagattaacagccacttcttgccatccaaccataccatccatgataatccaaccatttcttgccagctctaccctgacctccaaaatcaagccaccaccaagtcttggcaagaagggctacaataattccccaacagtctcagcttctgcctgtgatcctggactgtctatctctacttaggagcctgctaaaacctaagtcaggtaacatccctcctctggccaaaaacctctagtaccttcctatctcacccagagtaaagtcccacaaggtccctcacgctcttgttcccaactgtctctcaggccgcttttctcttgccctgctttgtactcttccttccagcccacaggcctccatgctttcctcaaacaggcctgctatgtttccatcccaagaccttttcccttgctgctgcctttgcctgggagacttttactccaaggtgccatatggcttcttccttactccagtcacatcttcaatgtggccatgagaggccctgctagatcacttgatctaaggcagcacacaagccagcccccacctccaccctctccctctaattctccttaccttgtttgataattcctcatggcatttatcactttctaacccaatatccttccttcctttcctccctccattccttttttccttcttttcgtcactatctgtcttccaatagaaaataagctccatttgcataggggcatggtctgttctactcattcttctgcctagaataggatctggcccagagcaggctgaccaactctttactaaaaactcatccgtcactgagaactagcaccacaccacagaaggaagaaggctctgcatctacaaaatacagctgctttgtttgagtgctttgagctctgtctcctgtaactgggtgacaaaggtctaaacacataatgatagtgctggtgtgatagaaagtgaaagttctttactcttgaaaaaaagctagattttatcaagtgctggatttgctcagtggcatttaggttttaccgctataaaacaatattcctatttcttaagttcttgctaggaaaacaagtaactttgatttttcagtctgaaactctccagcgccccttaactatggcccccgaaacaaacattttatactgaatttttgataacacacaatttattaaaatgcagctattacattagtgcagaataagctatatacattctaagatttagcatgctgtcaaaaggtttcctcattggaactgatagctacccctaaagcagagatggtcttgagcatatcatttacccactttaagcctcggtgcctttaatctgtaaaatgaatggctacaccaggctctctctagcatttattccaaatgatacattcaggcaggcaggcatgggatccagtggaaaagacttgggatttggagcttgagatctggctctgtcacttacaagccacactgaatctcattttttttcatctataaaacattaatcactggaaataactaccttgtctataccaccttttggtatcttaggacatacatttggaggatcaccaagacagggctgtgaggacatctatttggtttcccaggatgagcagagtacctgacacatcacaggcactcacgtgcatttgctgcgtggaggaaagaatatatggacaaataaaaaaacacttccacacctccccagctgttgtaaggacttactaaagcaatgcatgttgaaagagctttttaaattctaaagtaatacaaatgataataattactgtgatagatctatttcacatttgcccagttcagccttggttgtcatactaatttaataccaacatgactggaactggaaagaaactaatattgattgaggtcttactatatcctaagcagatacatatgtacgtatgtgcacgtatataatttgagtcttctacctttttaaccaggtgggtgtcttaatgtagttataagttctagccagcagaagtcagaaactgagtcaaaactgaactcacaaatcagtcaacagttacttagcactcagtacttgccagcctctatgcgtggtgctttgcaggcatgggcacattcagtttttcaacagcctttgaggtaaccacagatacccctttttatagatcaggaaacacagactcagagcagttaagtaacttgcttcaagttaacagctaggaggtggcggggccaaaatttcactgtctgacttcaaagtccatgcccttaagcagtatatattatgcagtacattcatgtaagcttatcactgaaggtatgcggaataattcgggtgcttttatttttgttcaataaaaagctgctttagcactctatcaccactgccttaatttttttttttttttctaaaatgaaaatctgtgcctgggaatatgggtataactaaaaatgggacaggagaccacccccagaaagacaggcggccccagtttcaagttcttatttctcacattggcccttctggtgtgtcccagctgtattgtcataacctatagggaagttccgcagtcaggaaggccaatgacaatatatttcccctgacaacaccctggtccctttctgagttattcaatgacaattgaaatgtcttttcaatattttcttttccttttcagggcaaacatgtccacttgagtcattatgatcatcagctgttctgatttgcaagcagttcctaattgagtaggactagtgaatgctgtgagatatgaaatatcttgctgctaaattgcacacaggctgaaggcaataagaatttgtttagctatgcatagcgctttatattcagggaccagtggttatggagacactaaaaccagtcatcattaggacaatcctatcttggctaccagagaatgaagatccccacacagagctacctgaacagactaacggtcaagaggctgatgaggcattaatgagaccatgaatcaaaatttaccaaacaaacagtgcctccaaggcttctagttgtttctgtttgactttatcttggaactaactatggaacaagatggctgtgtttagatgtcttcattcatggcctatctttgaacactgtgtgtgtttatttgtttgtttgtttgtttgagacagagtctttctctcttatctgggctggagtgcagtggtatgatcatggcttactgctgccttgacttcccaagctcaagagatcctcccatctcagcaccccaagtaactgggactacaggcgtgcaccaccaagactgactaatgtttttatttttaatttttgtagagatggggtctcactgtgttgcccaggctgctctcaaactcctgggctcaagtgatcttgccacctgggcatcccaaagtgctggaattataggtatgagccaccatgtctggcatctttgaacaattcttccaagcaactattttgacttcatttctttctaggaaaaataaataaacaagatcatagagttatattatacaatataaaatccaaatactgacaaaagtcaaccatattagtcactttccactaaataaagttgtgtctatggttctttctctgggaaaatttaccatgtagtaactatcatttacttagtatgtgctaagcaccatgctgagagctttgttcctaactcttagttaggttaccttagaaagccccccacacctgggttatttcctagttctatgttctaggtacctctctgtcattaagcttaccacaaactcatttgtttatttgacatctctcttgaattgaactgtaagagtcactagagccaggaccatgtctatctttgcccccattgtaaccccagcctctaacataacacatgatatacagcggatgctcgataaacatttgaggaataaatgaaggaagcaagtcgaagaaacatccctgggttgctatcgctgtaagcagtagaagttgcatttgaattcagactccaaagcctgtgttcctcacctgcagcacacggtctctgtctgagctgaatagtctgttgcatcaaaacacatcaaacaggaaataaacaagagcaactattattaccacggtcccatacagccactagagagcaaaaggggtttctctatgactattgaggtatattaaggactcattacagaataaacactactgggcacaaaagcatatgagaaaagttttaggagtacaatgaaatcatgcccaatctttcctcagggtccctttccattctctatttatattgtttccagtttattattattataactgaacatttaggacccaagggatgttggccagtggagctacagaattctcagtcctctgaggaacctagcaactagtgttttcttacctggctcttaggagcaaaaggagaaaacaaatgtgcatccctgagctgttgtctagcatataaaaaagatgctattattaataacattttgtcttattaacatttgtcctactgtgatttattggcagccagaagcccaagctttaggattagtcagacctgaattgagccacttagttcttgtagggcctccaccaagttatgtaacctcaacctctttcttcatgcataaaataggattagtaatactatctacttcacataagtgcttggcatagaatctggcacagaggggaaaaaaaaacaatcattggtgcttattttcatcagcttcctcctaattattatttagtcagctgtgagtaaaaagaacctagcgttggccatggaacctggaaatatgacctttgaccctgtcctgttaatgcaattgtagtgagtgaatttttttttacgtgttcccatccccgagcagtccctccctctctcaaggacccggtggacttcctggtcttggcaaagtatgcaacacacatttacctttatcctgccagggaagtgaaggtttgagaccattaagctgggggcttcccacctacagtagctccccaatgcttccagtacaaagtttaaactccttagcttgccactcaatacccaacatcatttgatccaagcaactttgagcttgacatcagggccaaaagatgctttttccacttaagaacagaaattcagtccagtagactagtggaggatatgctaatattttacttccctttccatccggaacagataatatggtaaatcatctgttcatttagtcagaaataactgttgttctaggtgttggggctataactgtgaaaaagaagacttgattttatggaatccacagcctagtgaaagaaagagacaataattaaatggtgccattgtgtataatcagtggataattataattggaaataagtgaaaagcaagataaccatccttggactggaagagaaaatgccaaaagcccagaggagggctaagagttcaccatgtgaaggaggtatcactgtgtctagagagagcctggcatagaatggatctgaaagcctgataagaggcaggagcgccaagagtaaaggccaagcacaaggaggctggagcaataggtagagcccaactgtccagtgggaggaaggggaggaaatgatgggagataggcaaggaggggtgacagcaggaaggaaggaaaatgaacaaatgccagatatattcagcagataaaatagaaataagctgctgataaaatggatgacagggaagggaagtcctgagggtgtggcaggtagccagaatgactctgagatttgtggagtgtggaaataaaaggatggaagtgccatttattaattttattcttaaagataccttgagacagttgagaggatatgatgagacaactgcatgtatacagttgtgcataaggttcagagaaacactccggctggccattgcagcttgtaggaaagtatagggcctgggaagaagagtattgaaaaaagaaaaaggtgacacgctgttcatatgagagatgcaagaatgaagcaatagtggcattccacaagccaggactgagaccgtctcccaaacagccagatgactctgaacctcaaaccaacttgcagtcaccttagaattttattagctgcaccagatggcttacataatatcattaactcctccaccctcactacctaaaaatgctagaagataaaagggacggctgaggaaaatcctggaattttcttacagaaacaacatttacaacaggtaactagcccatcagtttctctagtatttctcagacatttccagttaagtctctagaatgacaaaagcaaatgatcctcgggtcttggtggtgccatcttaagtttccctctgtaaatgtaaatgatttttaaagcctcgtctagtactttaaaaattcatgcaaattttgcatgttactgcataatatcattatgctgcttttaatacgtacacacacttttaattctcccaaatactgaagcaaaaatgatgtgccacaaatgtgcctccattattagcctgtgactttgggaatgcccttgtccacagctttgcatgcagggttgaactcattaactaagttgagaaccatgaaattaatcagaaatggactagggaagtttttccttagagcagaagactagagtcatgacctctaaaaatcactcttcgttcctacaaattctaaaataagtggtaataataacattaatattaaaatcacactaagtggattttaaattcattctctcacactagaggtagttactatggtacatagtatgagagaggtatcaatttaaagataaagatgaggatacaaacacagaaagttaaagtatctttcaaagcaccataatttgaagccagacagttctagtccaagccaaactactattgtcctctctgctacatattagcagcaaactcatcttactactcttgctgatggcttatatttggtgataatcaagaacaatactgaaaagcatgcttcaaaaatagaaaaaaagcttcatcttccccaaacataattttatttaactgaaaaatatcagtgtgcaaattgaacatttttggtacataaagtcaagtgttactaattaagtaaatgagtgatgaatcataatatcaacccagtcattaaacaaaattataatgaaattacatttaccaactagtttacagtacaaaaaatataatgagccaactttaaagaaagcttccaataattttattaaggccttccaataattttatttagttaaggattctgttgtattatcttaaaagattaatacaaatagaaaatggaagagtaaactgtgcaatgacttctgtccctctcaacctttctctagagtcacatcttttaagcaacatgagacatgatttaattcacccaagagaggtcaccttgcttgccgggcaggtgccttctgtttaaattcagtttactcaatcaaatgtaccacggaatagaaaatggggcatattcctgtcctgaaattcttcctatgttaactaaaatcaccttacttttgtagcaaatgagccatgagatacggtgccagaaattgatttggaagagtaagtacacagtctgaaaacagtgtctgtatgttttgtaataaaaaggctctggatggccctagatgccaaagagaggctataaaaggacaaaggaatgcaaacaggggcagaactatacaaaaagattaaatgcatcaccactaaaagcgatacttactcttctataaacatatacatttactgattgctaatttttatctgacgagtggttttgaggtggcctcagtgcaatgtcatctcccctgagcttgtgtcttggacctagctagagtagatcattactccccaatacagctcccattattttcttcctagcactttaaaaaggctctaattattttctctttagttttccacttgctaattgcctatgttccctttgtcattaccagtgcctagctcagtgtctggcccatagtgagaagatactataatatatttaccgaacgaatgaacaaagctgcgagtggcaaacaggatggggcactcttttgagttcatttatacaaatcagattctatttcattttattaaatacttttatttactcattgtcttctgaaattactctgggttctcattaataaggagaaactgattctatcttcaggaaggaggggaaaaaacactttcagtcacttgttccaaaggtctttcaaaataatgttgtagtataatttggtttgaaagcaaggtccaacattttattacctccaaatttattcagaaaagctgaaggcccgtgataaggctcattaagtcgctgaaaggcctatcttcacgtgcctttcacacaaaaggtctcaacttaatgccaggtaattactgttcattttcccctggttatctctatttcctgaagattcccagagtagttggcctcagtggacactacccgcagtctgagatgtgagcagagcaagaaggacccatgttcactggaggatctttttggagctgtaacgaaagacaatcctaacactggggtctagaatttaaacttagatcatctacaagttaccctctatccagaattaaagccaagagggaaaagtttctggcatacaaactggtttgtatttccatttcaaagacatcatttttcatagcacctggacctcattccacacctgtagggttacagatgtgggccctggctccagattacctgggctcaaccctcaacttcatcactttccactttgtaactttgagcatgtaacttagattgtcagtgtgtcagttcccttatttgtgaaatagggctcattgtacctactggagtgttgttgtaagaattgaatgtaaagtagaaggaactttatctcacacatggtaagttctccataaagttatttatttattaatattaattagcattatcatgatcgtctctgatatcccatttgcaagcaggacttatccctgttatttataactttgatcctagtcccactggacccatcatggcattgagggagatcaaatttcactatttgtgaaacaagccaacagaaggtgaatgatgatcagggaagacattttactgggcaccatcatttcagttttgcacggaagagtggtatagccccttagaggtcactgaagtcaccatccccaagcatacacctgtttttatatttaatcaattgatggctgcaatttactaatctgcactgcagtgatcctacaatagccttccctcacagtgggctctcctcacttcagccaggtcattcataagagcttagcttcatagatactgtgatagtaattttttttttttcgagatggagtctagctctgtcgcccaggctggagtgcactggtgtgatctcagctcactgcaacctccacctcccagggtcaagcgattccctgcttcagcctcctgagcagctgggattacagccaccatgcccagctaattttttttgtatttttagtagagacggggtttcaacatgttggccaggcttgtcttgaactcctaacctcaagtgatctgcccacattagtctcccaaagtgctgggattacaggcacaagccaccgtgcccagcctgttatagttaattttactgtcaacttgactgagctaagagattcccaggtagctggtaaaacattgcttctgggtgtgtctgtgaaacaccctgtgagggtgtttttggaagagattagtatttgaacctcagtagattgagtaaagataactgtcctcacaaatgcatgtggccatcatccaatccactgagggcgcaaataaaacaaaaggcagaggaagggtgaatttgctctctcttatggagcagggacatcagccttctcccgcccttgggctgggacttacaccttcagttctctggttttcaggctttcagactttaactagaactcacatcatcaggtctcctggttttcagcccttcagactcaggctgagactataccgccagcttttctgaatctccagcttgcagacggcagatcatgggacttctccacctccataatcaaatgagttaattcctcataataaatctctttttattgattctttttctctggataaccttgattaacacaacctctgagttacaagagataattaaatatagcagctgagagcatgagctcaaaacttgaatgacctgggttcaattcttcactgtcactagtgaaccagggcatgttactttatacactaaggctaagttcaccatctagatatagggttaatagagtggtaacaaatccaaaggactaaggactatgataaggattatataagatcactatgggtgactctgtaaaactcttagcatgttgtcacttatataacaaacattcaataaacattagctactatatttagacatgtcttgggcatgtatgttccagaaatctttttatattagatggtcactacagaaaggcaatctatatgccaagcttttcaatgaagcaaacattatatttgaatactgagtcttaacctcaaaaggttacagaacaattttcattcaagaacaaatcagaaatcacaggttggagtgtacatcatcccttggcagtctcagcaagctaaccctacctaaagtgtcagaagacttttctcgtttacagaaatgcctttagaaatccccaaccaaccactggtaggtccccaagcttcagtcttcaaaggtggcacttttgcaggctaaaaaatccaaaaaccagaatgtctcttctcctccaaaggatcacaactcctccccagcaagggaacaaaactggaccaagaatgagtttgacgaattgacagaagtaggcttcagaaggtgggtaatgacaaactcctctgagctaaaggagcatgttctaatccaatgcaaggaagctaagaaacttgaaaaaaggttagaggaattgctaactagaataaccagtttagagaaaaacataaatgacctgatggagctgaaaaacacagcatgagaacttcgtaaagcatacacaagtatcatagtcaaatcaatcaagcagaagaaagggtatcagagattgaagatcaacttaatgaaataaagtgtgaagacaagattagagaaaaaagaatgaaaagggaggaacaaagcctccaaggaatatggaactatgtgaaaagaccaaacctacaactgattggtgtacctgaaagtgacaggagaatggaaccaagttgaaaaacactcttcaggatattatccaggagaacttcctcaacctagcaaggcaggtcaacattcaaattcaggaaatacagagaacgccacaaatatattcctcgagaagagcaaacccaagacacataatcgtcagattcaccaaagttgaaatgaaagaaaaatgttaagggcagtcagagagaaaggtcgggttatccacaaagggaagcccatcagaccaacagcagatctttctgcagaaaccctacaagccagaagagaatgggggccaacatttaacattcttaaagaattttctacccagaatttcatatccagccaaactatgtttcataagcacaggagaaataaaatcctttatggacaagcaaatgctgagaaatgttgtcaccaccaggcctaccttacaagagctcctgaaggaagcactaaatatggaaaggaaaaactgttaccaggagctactgcaaaaacataccaaattgtaaagaccattgacactatgaagaatccgcatcaactaacgggcaaaataaccagcttgcatcataaagacaggatcaaattcacacacaacaatattaaacttaactgtaaacaggctaaatgccacaattaaaagacacagactggcaaattggaaaaacagttaagactcagaggtgtgagacccatctcacatgcaaagagacacataggctcaaaataaacgtatggaggaatatttaccaagcaaatggaaagcaaaaaaaagcaggggttgcaatcctagtctctgataaaacagactttaaaccaacaaagattaaaaaagacaaagaagggcattacataatggtaaagggatcgatgcaacaagaaaagctaactatgacactgaccaagacaatcctaagccaaaagaacaaagctggaggcatcacgctacctgacttcaaactatactacaaggctacagtaaccaaaacagcatggtactggtaccaaaacagagatatagaccaatggaacagaacagagccctcagaaataataccacacatctacaaccatcagatctttgacaaccctgacaaaaacaagcaatggggaaaggattctctatttaataaatggtgttggaaaaactggctagccatatgcagcaaactgaaactggaccccttccttacaccttatacaaaaattaactcaagatggattacagacttaaatgttagacctaaaaccatagaaaccctagaagaaaacctaggcaataccattcaggacataaacatgggcaaagacttcatgactaaaacactaaaagcaatggcaacaaaagccaaaattgacaattgggatccaattaaactaaagagcttctgcacagcaaaagaaactacgatcagagtgaacaggcaacctacagaatgggagaaagtttttgcaatctatccatctgacaatgggctaatatccagaatctacaaagaacttaaacaaatttacaagaagaaaacaaccccatcaaaaagtgggcgaaggatatgaacagtcacttctcaaaagaagacatttatgtggacaacaaacatatgaaaaaaaacctcatcatcactcgtcattagaaaaatgcaaaccaaaaccacaatgagataccatctcacaccagttagaatggctatcattaaaaagtcaggaaacaacaaatgctggagaggatgtggagaaataggaatgcttttacactgttcgtgggagtgtaaattagttcaaccattgtggaagacagtgtggcgattcctcaaggatctagaaccagaaataccatctgacccagcaatcccattactgggtatatacccaaaggattataaatcattctactataaagacatatgcacatgtatgttcaattgcagctgttcacaatagcaagacttggaaccaacccaaacgcccattaatgatagactggataaagaaaatgtggcacatatacaccatggaatacgatgcagccataaaaaaggatgagtttatgtcctttgcagggacatggatgaagctaaaaaccatcattctcagcaaactaacacaggaacagaaaaccaaacactgcaaattttcactcataagtgggaattgaacaatgagaacacatggacacagggaggggaacatcacacactggggcctttcagtggctggggcgctagggtaaggatagcattaggagaaatacctaatgtagatgacaggttgatgggtgcagcaaaccaccatggcacatgtatacctatgtaacaaacctgcacattctgcacatgtatcccagagcttaaagtataataaaaaaaaaggagaagaacaaaaaaaggtggcattttttcaaaaattgtattaagtgataagatgttaacataaaaattattaagatgaccaaaatacattagaagaagcagaaatcaaaggtaggcatgcagtagggtctctttaacctacttcttcttgttctatcccccacattatgcttgctctgttaatggcaacatttactcccttagtgtagtaataaatgttcagcaactgggtggtgggggtgttctaattgtagtgtttgccaattttcatggtgtaaatacatactctcaccatggctggcttcaagataccaacatgatatcactgaaaagggagttgggaagagaagcttataatcagctcttacaaatacgtacaacatggatactcttgagcccaggaaaagaaaaggtatgtgaataacatagtatcaaaagcatctagtctcttcttgagccatcagcccattcttgtcaggttcactattgggagcatggagaaatatatgaactgaaagcaaaagttatgaaggcaggggatagaaaatagtatcattaccactgaagagaaagaattgtattttttcctgtacgataggcaacatggcacacagacataacaagtctgggttgaggacggctattagagcaaaacgtgttttagaatcagaattttatattttaaaaccaattggcatgattcttgcatatgtatcatgagtgtatgattgcctatgcatgagttcagtattaagaaatagccaaaactctctgtggtgtaggacttccatcacaccaaccaggcagagaggctttctttgaatgcccgaactctgctcattctccatcatcctccattaacggagggcagttaatgcacatatctgcctgtgtggtggtaaatgcttaacaacggctggtggtgggatgggggtgttctaattgtagtgtttgtcagttttcatggtgtaaatattaatacatattctcatggtggctggtttcaggctaccaacatgatatcactgattagggagttgggaagagaagcttataatcagctcttaaaaataagtacaagctagctccaaaaatgtctatactatgtttccaagagatgaaaacctcatggacaaatactctttcgcgatatatatggttgctgtaaagtaatttttatatggttcattgtgagagtttaagtattacttcttttaagtactagaaatggaaatataatctctaatcccttttctaactgaatgaaatgttaacttcgatcatccatctgtgcagttactcttctagtaaatgtgattttttaaactttctctcctcttttcagggctacatctgctagtgttttccatttgccagctcccaacatgtccccaattacttcttttttattttatagcctccatgctgatgtttcatcagttacaactgctgggttccactgagcattaacagtctgcagtgcctctaggaggttacataattcactaagtataccaaatcattttttctccaaagaatattatttaatgtaaatacagtgtgaggttaatgtagtacaaaagaaaggtttttcccttagaatcatcaaaaaactgaaaaaaatgattcacggaagaatggtttacacgcaggaacaagaaatcacttgtatttaaggattatttcaactggcacttttttactaaacacaaagcaaaaaattaatacatttgagtacatgaacaagtttgtgttttacctattgaatcaaaatatttttaccacaagagaaggaagctaaaactaccttatgttaggcatatgcatacttgaaaacttatgatagaatagatatttgaaatcattttagtcaatagcaaagcaaaaggaaggatcaagaaaaagttctttgttttgtttttaactcaatttttcttataaatacctaattgttctccataaaaagttcataaataacctgatggatgatctgaaaatttccaggcaggtagcaggaactctctagaagtaaatgtcccagaaactttgcaaatcaaatcactcaattcttaatagatggcttaaaactgggtattacattgcaaagttttatgaaaatcatctggcaaacaactgtcttttcttcaagatgtaaacaatgaaacaattaggtttaaactgtctaaaactatgtgctcaagtgtccccttttacatcagagtctaagtgggacaatgatggagcagttagaattttctcaggtagtcagatggggaaacaggaaaaggatgggaggaggagtaatcattcaaggaaatttttttaaatgacagtatcaatattgaatatttctggagtatcaatcattatagtatgcccttgacatatagaatcttctccagtccatatacactgtgaagtaggtattacctatccaattttatagataggtaacaggatggtgagttgctgctcagggtattaagtaagtgaccaagatccagtgcttagctaagtcttgtcttcaacagtgtggagctggggctgggttgggacctctgtggtccaaagccccagccacttgacttcatactgcagcttctggttggtatctatggcatctatgagtctgacagctatattttcactcattttcagtcaaatatttatcaggcatctacttgagccagacaccatcctaggcagcagggcccaataggaaacaagacagaaaacaaaagtaaaaaaaaaacttgtcttcatgcctttggggtcttctttgtagttgagagagaaagacaattgtattagtccattttcatactgctataaataaatgcctgacactgggtaatttataaagaaaagaggtttaattgactcacagttccacatggttggggaggcctcaggaaaattacagtcatggcggaaggggaagaggcacatcttacatggtggcaggctagagagagcaggtaagggcagggaaaactgccttataaaaccatcagatcttgtgagaactcactccctatcaggaaaatggcatgggggaaccactcccatgatccaatcccctcccaactggtatctccctcaacacatggggattataaggattacaattcaagatcagatttaggtgggaacacagagccgaaccatatcaacaataaaacaaaataaactagtaaagtatttagcatgttagctggtgataggtgctgtagagaaaacaaagcccggaaggagcgtggggagagtaccagggtgggtggtggaggaggttccaacttgaatggtgtgggcctcatggaaatcttgtaaaaaccccaagaagatgagagagcaagccctactgtacaagttcctggaagtaaagcacatagggctgagggaaatgaagggcagagcaaccctaaaaggctagaagaaaagtagagagcctggagtggaatgaccaagaaaaaagcaggaggaagggaggtcagagaaccacaagcgcggtggcagatgatgcagggccttgtaagccaccatcatagttgccatctcttctccaaggcaagtgagcaggttgtgaaccaaggagggatctctccccaacttacgctgtaacagaatcatttgacttcggtactgagaatcaaccaaaagatgtgaagaaagaccccttatgagcctgccacaataatccaagtgacaggtgacagtagcttgggcccaagccatagtggtggaggtgatgaggcatggttggatgctggatgtaagactagacactgccatggctatgcagtttgttctgccactcagttgtttggcatgacacaaactcacaggaggaattttatataaaagatcgatacaggtgagataagatctccaattcttaaacagcagagaaaatcaaatgttaattggcaaataaaatgccaagaagatgtgcttgaaataattaaaataggcaaaggattgatcacctaaaaatagaagcagaaaacaaaccccccctgacagttttcatctctcacagttaaatattaagctttcctcttaagagtaacttggccaggtgtgatggctcacacctgtaatcccagcactttgggaggccgaggtgggtagatcacctgaggtcaggagttcgagaccagcctgaccaatatggtgaaaccccatctctactaaagatacaaaaaatatttttttttgtattacagggtgtggcctgtaatcccagatactcaggaggctgagacaggagaatcacttgaaaccaggaggcggagactgcagtgagtcgagatcatgccactgcactccagtctgggcaacagagcaagactctgtctgaaaaaaaaagaagaagaagaactttgtatttcctactttgctctacacatctacacatagaaggtattttaaatatttatggtttgttgattttaaaagaggctttgttaaaacgaaagtattaaacgggtaaaaaatagaaccaagtctgtgtgacaatacactagatttcaaattctcttttgcaagtatttattgaacactttctacagacaaggtacaatgccagatattagggatctgaagagaaaaatcagtaaacaaagttatttagtgcaaggacaacataaacaataatgaaaaaagaaagagataaactccagctgaaaacataaagaccacataggacctgtttgttaaatataagattcacagaatacagtgcaaggccagggaataaatgaaaaacctacaactttgatgacttattgtaggaccaggcatattacttaacatccccgatcctctatttcttcaattacaaatgaaatataaaagtatctcttaaaacatgtcagcagggtcaaattatataacttagaagataatagggattcaatatagcttagcattcttccctaattttttttaatctaacctgcaattacaatataggcgacaacattttcagagctgaaatgcgcttccgtcagctacacagtcttcatgatgatgtcccatccacaggggttatatgtgggcccgtcctagtttggtgttctctttgtgtgccaaagaaatgattatcccccaaaagcagcagccatcatttgagacctctctagttcgttgatttcaaactctgttactactgggatttaaactaaagctttaagattgaaaagaataataaatacagcaggctctcaaaagggaaacacttatcttgtgaaaaaacaaggttgtttttttttttcttaattctcaatgttcattctggaagattcaaggttatctactacctgtttttcttcctctccaatgctcaactcgaaagttgttcaaaaggttcactggcatacataagcctggaccctatacatgcttcctacgtgaaatatgttcttacttaggaaaaatgccaagctccagtaactgtgacctacataaattctaaggtgcaacgtaaggagggcaagcaaggcattactgaattgtatatgtcacgccatacaagctgatgtgcagctccctcaaagtctcaaaggcctcaataattgtaaataaacaatgtccttgagtccaaaaagactatgacatcccacaatcaaagtattaacttggaaagcattgcctactttgtattttctagaaatgtttcatgtgttcatcaacagcatgccagtcccaatgtaagacacaaacacagagacattcagtccatatgacataaggttgaaatcatcctaattgtcgacatgagaaaatgagaaagcaatttgtggcatctaaatacatgcataatttttatcccgtctggtttttgctctggttctgtgcaacctgaaataaggagagtgtgcaactgcttggtgacagattgcacagggatggaggactgtaaatggatgaatagttggaacatggttgaactcaggaatgaatgaaccagactctcctgatgaaatggctccactctggagatggagcccaggagagatgctgaattcactttttcacaccccagggatcaatttggttaataacctctctgctgccttaaaatcacttgggaacacctgaacaaaatacaaattcaaagcaagatcttcgaagcttagagaaactgaattgaatcaggaggtgaaaatcttgaacattgactatttcagctactatacacctatgtccatccaatttcatcaagatgctgaaaaagtacttagggtaataagtatgaaaaatgttacacttcttggaaaaccagtgcttaaatgttcagtaaatgataccttgtttctgaatttccctagcagcactgaattcttaatcattcacttatccatttaatcattcaaaagaaatttatatcttcactttttctcctgattgcatggtaatacctgcttactgtaaaatattcaaatgagatagtatcacatcaaggagaaagtataagtctctagaaattccagaaaatgtgtatttgttaaccactacattctaggctgtgtgctagaggtgccacagagttggcaaagtaaatctgaaaacattcctgtcctcaaaaagaccagagtctagtaagagagatgataacaataaaagtactaaaatatagtacaagaagtaatgcaagtcataaaaaaggtctgaataaatgctataggaggtccaagaaaaagaaacgtctgctacctaagaatgtccagggaaaacttcctttgcaaaaagaacctgtttctgccatttccttgaccatacaactccacgtgttgtgttacttatgagtcctctgctcagtgccgaaaagatttccctatactaagatctcagtgcttcgtttaacttgtacaaaattcccaaatccacattcttacaatttccccaaagattcagcaattctgaattccggtacacctcctaacagggtaaacataaagaaatcatttgatcattagttacttaccattatcattgttcacagaaattggggaaatggaaaactataagactggaaaaagataaatgttcccccaggccctctcaaaaaaataaaaattttggacaaaataaagaagctctaggttaggaagaaggataagaggcacacgaacacaggagcatgccacacacatttaacactcaatacacaagagctaaagagaaggctgtgtagggtcaaagtgagtttgaaatacataaaagctgaggctatataaaaatctgcatttacgataactcttctaggcagggaggttgttgagtacagacgaaaagaaccaggagaccagtggtgacagaggattctgtctttgagaagctgggagaactggaataagacacttaaccctttgggtttcatgattctcattattaaaataaaataatgatcctaggcctgtatgaaattcaaatgagataatatatttgaaagcattttacaaaacagttcataatgtattttataaaacacatagggttaaagtagttggccaaagttctaatgaaagattagttgactcaggacataaatctgaattttccaaatgaccaatcccaaattgttacctctactatcccttagaagtaaaaaaggatttaaacaactcaacaggtaaaaataatacttcctccacaataaataccatatcatattcccctttgttcctccagcatctacacagtgctttgcacagagtgagtactcagtactctagaagcaaaactcatctttctcctactctaccttcctatctcttagcaactactaattttctgctgcatttttagtggacatcagcatcagtaagttgccatcccaaggaacaaagtcaaattggcaaaaaggtggatgggctagcatccatctttggttgttatcaaaatattctccttcctcagcacactcaagtgaaggccataagtggactgtctgggccgaaagtctccccatacttccaccactcttgtatcattaaacattcttcgcagccttggtcaggagaggactgcgtggatgggcactggacatgcaaagtggcccaggtacatagcagtcttgtcaagcttggagagtagtggcccactcttggccccaggccactgccatttgcctgtcatttgtaagagcacagaccagaacatgagcccagtctgctgtgcacctcacagcaacatcctgacaattctgaaactcaaaaaaggtttcgttgtttattgggtataagccaggcaggactgaaaaggaattctttaaaggttagtggtgcaatactggataagagctttacacatcccagtcttccttccttggtgtcagaacgggattaacaggaagactggccaacagatgcccagggtaccaatctaagagggtactaaaatagccccagaaaactaacacaatgaagaaaacagcatttatcagaactttcttcaagaagggaactgggtttcattgtaagaaatacttcgataaaacaattgaggtagaatagggatgatatgctttgaaaaaactaaaaacaaggccaatataatgctttcatgtagggtggttccaacaatcaaagggctttcattttgctaagctgagtatggaggccaggacactgtaatctgttgtcatcttcctccacaagcagcactactcaaatctgttacttcacttgattgctgaaggaatactgaattagtctgcatgggccacccacatgtcttagttgagccctacatgagatcaccagttctcagaaaaggtctggctgttctgtttcagttccccagtttccatttcttgtctcccttaccttattcatccatagacaattcaattacaaatatttactgaacacctgctgtatttcaagccctgggaaggaagagatgagcacaacataatcttggtgccagataaacacatgtcctagacagacaactaagttaatataaggcaaatggatgggagctctatgagagaaacatacaaatgcaaacatggggatgccgataaggagtgagggaatgccttatggaaaatgtgacatttacatagggcctcttaggattaggaggagctgacaagtgcaaaagaaggatagagaaacccaagggtgttgaatgaagggcacagtgacttgagcaaactgtaaagagtccacagtgaccacagcacaggcaacatggttaagagtgcagaagatgaggctactgataaatgtcagagccaaaatttgaaaagtctttgaagccattccagaacgttaagatcttactctggaagcacaagggagctatcgatggttttaagccagaagtaaaagaaaaaaaaatgtggtagatttgtgttcagtgaaagaactctggcagaaattgaaaactaatggatagaaatggggtgtagggagtagaagcagaaattgcagtggcccaggatgagaacagaatatagaaaacaggcatttcacaggcaaaaatcaatggtagttggcgactatagtgcatagtgatgaagaggaaagagttcctgtctcctaattcattcatattcatcctttacatctcagatcaaatgccactttctaaaggaagacgtctcaaaccccaagaataaattaggtccttctggacatgctcacaaagcacattggacttttcctccacagcattgacctcagtttataatgctatatttctgtaataaataaaattaatctctgtatctgctaccagattgtgaacctcttgagggtacaaccatgtctgttttgtggttcctgtattcctagtatctagcttttagtaggaactcaaaaactatattttggaagcaataagggaaggcacttaaggatcacataaagacttctatactgcaatgccaggtagctggtgatcccattaactaagacagaacatagaaaaagaggaaaaggggaaaatagggagaagaaaatgaattccagaataaacaaggtaaattggaaaaatcttcaagaattccagatggagatttcaaatagcttgaaactcagcagtcaatccagagattatagatttaggaatcatctatgtagtggaagagaggagagtcactgctttactcgggttaagtatatgactccagaagaaaagaggctcaaagatggagccctgaagaaagccagaggtagaatccaagcaaactaaataatacagcaaaaatactgggaaagaaagtctgagagccaggagaacaaccatgagagggttgtattttaagaggtcaaggagccaggcacagtggctcatgcctgtaataatgccagcactttgggaggccgagataggtggattaactgaggtcaggagttcaagaccagcctagctaacacggtgaaaccccatctctactaaaagtacaaaaatttagccaggcgtggtggcaggcacctgtaatcccagctactcaggaggctgaggcaggagaattgctttgaactcgggaggcggaggttgcagtgagctgagatcgcgccactgcactccagcctgggcgacagagtgagactctgtctcacacacacacatacacacacacacacacacacacacacacacaaagaggtcaagggaggtagagctcaagaaagagaaagtgcttagtggggcccaatattaccaagggtagggggttggctcataagcctcagaaagtggtgggcactgggattcaggcagtgtctatttctaaagcaagagatcccaaactcccaaagaaaagctgaaaacagtgatgaaaacagcaggtgtgcacagaaggaaactaaaaaacatgcaagaaaataattattcattcaataagtatttgttgagcttctactatggtccaagcattctatattggaagtatagcagtaaacaggatataatggtctgtgggcccacaggatttaagagcagataggatcaagatcaaagaaaaagagtctgacttcaaaaagctatgagacatctcttcaaaggaaggagaaatgatctggggctaaagattatatgggcagagtcctagaagtatcaagaagacagaaaattttagggttgtcatgagttgggttgccctgaaggcaaaacctgagacaaggacttaggtgcaggagtttatgtgagagatgactccaggaagcagagatgaggaaatagggtgtaaaaagggaagagcaaaagccaactaagggtacattatcaagtttaccacttgccaaaccagcaagaggctggtttggccagaacctccagagaagtacacagcttgcctccagaactgttcacctgaatcgcaaaggccggagcacttattcacatgttcaaatgcccagtggctgagagtagcctctgagggcatttattcccacagacgtccaggctcctcttcagcccaggccatgcagactcccagcataagagatgcccttggggaagaaagcagaaaagcagaaaagtaggggctagaggtgggaagctgacttggacaaaactggtcaccacagttgttgctgaaatcagagataatttcacagagggactgtgaaaatggccacaggggcatctgccacaaaggtagtgttggtgagaactaggtggaaatggctaatcattcagcccaggctagttaaggagaaaaaaaaagaatgctaagagaaagtggcttgggaagttttctaaggtctaagctttctttcaatgatttttggcctctgcataaaaatatgaacttagggacttactaatagctcaaagttaagatcatagagaaggcgttgtactcctctaggtcaagggcatattaaccactgatatttattgagcacttactatgtgccaggcactttatagtcatcatcaaataaatcatccctgcaactgtatatactcattagtattgttgttcccattttataaaggaaggaactgaggcttagagagtttttaaagcttttaagatctatgaggtaacaacctatttcattttaagtgtatgtcaataacccacacttgcatccttgtgttcgaacacacacacacacacatacacacacacacacatacacacagtaaaatcagatatgaggaatttctggttttactagagaatttagtttatttatcttccctgtctatttcttcattacatggataatgaagcacttctagactctttaatgaatacatttatttaaattttaaaaaatttataccaattgatcaatgtgttttcatcaaatacgtggactagaaatacagaaaataaagatgtttagatatagaaaactgagcaaaaaccagctacaaaataccaccaaaagcacagagctagttgaagtcaaaaaaagcatcataaagggaaaaactaaaagcatctaaatacagaacaaaaggcaaatctgattgaaaacttgtctgcatctttaatttggaggctcatgatcatgctggaggtaggaggcaaaatttaatttaaggagaattttggccaaccatcgctattttctttaacacaagaacaaggagggagagggaatgaggtagacaacatccacggaggaccaggtgaaggaaaagcagagagtgatcatatcccatatccccagacacttggattagcctcagggaggctggttaggcaatgccaccaccaccaccgtcaccacgcccccacccccctcacccgacccacccgccactcccagaataaagctggtttgtaattagtttaggctgtagaggcttgtatcattaaaataatgaccactgggcatttgccacaaccaagataatgtttcataatcaaattaacttggctcaaaaacttgatttggaacctgtttatggttagtcatcaaacagctttcggggtgcttgaagcataagatatgcaaaaaactaggtaagtagtgcatgaacacagaatcagaggaaaatgtggctatgttttagtcacagagtacttacaatgggggttggaggtaggaggacagtgactatacaagaaaaggatttgaaattgaccctcaaagaactgaatatctttttaaataaaatgacaatattaaaaccacatgcttaaaatacgtacggctaagtgcttcagcagagactgggataccagatcctgagttcctcaaaggcaggagtgtccaagtcattcacttttgcttcaccggagcctaacacattgcctggagcagtgttggtactcaggaaaaccttctgtcgaatgaaggactatcatgctgttataataattaggagaggacaacatagaaacatggaaaacctttttaatctactggaaagtgaaaatgatatgtcaatggattgcaaccatgtgcaaaaacaggtgtgtttgaggacaactagaagataaggtggcaaaaatgaaaacactggtgtcaggtgttaggattctgcatgtattgttgttgtttctaaaactgcatttaatgttgtcagaatataatctttgtaatttcagaatctagagatgcttccatgttggagggagggaaggaactggatactcaatgaactgatagcttacaggcaaaggttcaaactccattgcttagcactgcagactctttgtggcacagtccccaagaactccagttttatatcatatccctgctccttccttcttccccatcacactgaatagtttgccttttctaaaacgtatcataggtttcactctttttttttttttttttttttttggtacacactcttctcactatttgtaatgcccttgtttccgtcccttcttcatatggctaaatcctacccattcttcaaaacacaactcaaatatttcccctctgagaagctgacctgattccccacaccctatcccagtctcaatttttggccacgtctctaagtttctatagcaacttatgcgcttacctctttcagagccctgtctcactatgctgcaatcactggtgtacttgcctttctcctctactagcctggatgctacctacagataatgtaaagatacctggggctacaaaggccagtggatgacccactgtcttttttaccaaactgtgacagtgtggtcacttagtcaagactcttttggttgcaagtaacagacatccattgaaactgctttgagcacaaaagggaaatttatttataaggacatagagatacttctcagagcccaaggttagaaagtgcagacactgaggtctggatcctggagctagaaagcctacagaatcaaggcagctactctcttagtcaatcagtcttactctctccccatacccacctctctccctgcagcctcacacagtcttttaatctgcatatctccagaggcctgttgtattcctctctctttctttctccctctctcttgctccgaaagacagttatacagtggctacaagtatgagctcatactacctgtgttcatgcctggctctgccattaaccaactatatgaccttggataaattacttaaccgctctgtgactcagtttcctcttctacaaaatgggaataagaagaggtcccacctcataggagtattacaaggattattgaattaatctaagacatggcttcccactgctcccaagtttacacatctacctagtctatctacaaatatgtcttagtccaagaccacacttctgagaaagacaacctggctggtccagcttgagtcagctgtggatctttgatctactgagccacagcctgggagccaagttaaaaacctgatcaccagggcccatccttgaagataaagtgacagttcttagagaaaggggccatgggctgagcagacaccagaaacaaaaacctgctacagccactaactaaccatgcagccatgcttgtgggcctgcctaggattacagctgggccttttcacctcatggccctgagcaaggctcgtatttaaaacacacagctgcctgtcagactgcaatgacacctaagggagctccacacactggcacttaataaaggcttaatggtgatgatggtggcgctgacaaaaatgacggtggcacaacaggccatgctattgcttcccagcagttctctgctgggccccgtggcttgaagttgaaatcagcacatccttctaactcggctaatgtggcttggctctggggccaaccctcatcagatcccatccaactgctagttaggtagatttataccccactaaatccattgtcacacaagggcttcctcctcactgccagagtgtaaagaacatagacacagcatccaataaccaaaggaggaaaggcctccaaagaaaattaaccatttgacttcaaaatgttatgctgctgctctagaatttccaaccaaatgaaatcagctgaaggtcctgcatctttaaataataaaaaaataaagaagaaccacagctgtgggcccttactagcccataaataaagccccgtatgcaactctatatcaaactttttttttttttttttgagacagagtctcactctgtcaccaaggctggagtgcagtggtgcgatctcggctcactgcaacctccgcctcctgggttcacgccattctcctgcctcagcctcctgagtagctgggactataggcatgtgccaccatgcctggctaattttttgtatttttagtagagacgggatttcactgtgttagccaggatggtctccatctcctgacctcgtgatctgcccgcctcggcctcctaaagatcaaacttattttttattgcagtataatctctttaacaaaaaacaagaattgtagaccagtacatctttgctatgaactgaatgtctgtgtcccctcaaaattcatatgcagaaatcctaacccccaatgtgatggaattaggaagtgggaccttgtttttagagatgggacatcaattccaggaccagtatcaagatctcacatcattctctttcacaaaaatagtctgcctttgaatttttagctctcggtgataagtaaactacacttattgtagttttttgcttgcctcaaatcctttgtagaagtaggctggaaaataaataaataaatagaatttcctctatgaatttgaatagcagagtatgcatgtaatagacgcttcaataaattttgctgtagcatgaagaccaatctcattttcaaatggtgaatcttggctcatgtatatgtggtactataatcttacaagtagggtttgcggtacacatcactttaaggaatgctggtactttaagtgaatttgaatagcaagagcggtctaaaatcagtcaccatcactgagcacagtcatttgaaagcctgaaattcacttttagaaaattcatcagaaaaaaagattcaaaaactggcaacgttcactcacagatcaaagacaacctaagtatttaactcatcatcatctatgaggataacgacttttaacagctgtccatgcaagagaaagcaaaaaaaaaaaaaaaataagaaacaatgagaggcattaaagcataaaggtcaagagcactttgggggcagccagccctaggtcaagaagtcctgactgtgtcatttaccagctctgtagctttgggcaagttgcctaaacactctgaacttattcagtcttccataaaacatttaaataatagtgatacctatcttattggatttctatacttaataaacaatgaatatgatgatgacgatgatgtctgcttttactatgaggaaaatgcattcagtaacaaatataaggaaaaaaatatagaataagtaaggagactctttagctatccttatccactaagaatacctaagagtttgtagtaactggcaagggtgtatatataaccagcactgaacatatcatcctttttgctattagagagtatgcaaaagaggaaatataaagaacggctttgctttgatcataatcaaagggcgtgggtaatctccttgagggcaggaactatctgggtcctattaacctagcacagacagtatcaagtagcaagcatacagtcaaagcaccaaatgaatgcaagaatgcctggatacaccctgaatatgactacaatcaaagcccgaagctcttggtaggtttcactggcctctttccttatatctagaagaacgtcctaccttcctggtcatagccaccactgaaataatgaaaacaaaataacaaaataatattttaaacatacatagcataccagttcattaaaaatagactagggagtattttacattgagacactagggagcatcattactttgaaatgtcactttctgctttaattagtatgctctaatgataagtatatgccattcttatctaatgaaagtcttgaatacatacggaatctggttcacagtcctcgctgggaggtacacggatgtacaaagaagaaacagaatgcatgtgttgatgtcaactagtttgcttacctttattaacataattgccaaagtttcaagttttacaatttgaggatacatatgttcaacacacccagaacacttggcacagtcatctgatcacctttcacatttctcaagacagcctaagctgttttagggagatgtgaagtttccggtgatttctttcaagccgactctcgggggtatcactcagaacaggaccacctgcttggtggcatctttttaataaagacagcaataggtctgcttgctcacagggaaatttataaggctgtctttgcttccttccacctattgtggtgctttatccaagtagaatgtactcagtcttcggagcttcaaagacactgataatggacttcttttcaaagagaagtcttagtcatccgctcctttcattcaacagtcagaataagaaaggcccagagggatacagacaaatacctctgagctgcctgttgtggcaatatcagataaagaaattctgtagcccagagagatatttgatccgttcatttgaaagtcaatactaaacatccttcccagccactccacccaagcaatgagaatgtgtctcagaaacaggacacagaaactatctcttacgatgtagcttccacttcttttttctagcctgagtgggttgggttgaggaaggagagaaagaaagaaatcaagaaccaatgttctctgctttgtgtttccctgattcagtgaaaaacggaggtcatttatagcttcttcaattggctgacccagaggaggctccagctttctcaggattgtaatggcaatgacatttctcaaaatcagttaccaagttcgtaccagttcccagcaatagaatacttggttactcagggcttctttctttgggaaatctgcatcaccgggatgactgcagttcacccaggccctacaatgggttctcatttactactcaagtttcatgcagatcatctcattcacacaagcctacaggaccaatctgcctcccagagccatggctctgcaccttcacaattgcaaagcaatttctcagggggagtcaaagcttcacttgctttttacagaaatggctcatggagatattatcttaaaatgctttctcttaaaaaaaattttttttttatctgagaattgcatgctgtgctgaaataggatggtggtgggttctgattatatcttttttccaattttggtttcactcttaagtatagaaaatatcaggttgctctctcctctgattcccttttctcccagggactaaaactttagtctgctgagtcaaaagtaagctttggtattaaattccatcttttatcttttttctcccaatatctaagaacaatgtgattatgcatcattttgtactacagaagtgctgctgagaactgcatgcaaaataaatcaagtcaatgatgtatttgaatgtgactctaatcactgaggtgggaaaaagataccagggttctactttagactgctaacctgctgtgatcaccttacctcctcttttaaatgagtgggctggaagtgctccagctcatgtctaaaatttagtgtgcttcgctacctcatggcataacaataggatggaaaaccatgcaaccattaaaagtgatcattacaaaaatgacatagaaaaagaaaaaataattgttataatatttaataaaaaattattccacaaattatctgtacattaacatttttcattaggacctcttaagccatgccattatcaaaaggggcaattcaaacatatcaagagtatctgttaatatttaaaattaggctgttagcctgtaatgaacatattttaggggaaaagctagaagtctgacacatagaaagaaagaaagggaaaatattaacctacaaaatcctttaaaaaggtagacttaaagctttttttcactatcttagtgaagatcgttaatatgtaccttacagtgtattttaaaattgtgtttctttaccagggaatttttttttatctttagtaaatttcagatttgtttcttacctgcatggaatgttacccttcccttaccacaatatgacaaaattaataatagccttacaaattgtgaagatacaagtttgagggaaaagataccaactgctttttaaattacaataatacatgatatcaccatttcattttatttaaaagaaatgttttacaacagaaatcatccaaccaattaacagggaaaaataagatggtgacataatccttaggaaggattactgggaaagaaaaaaacagtcatgagtacaacttggtataagtttctaatgtttatgtatagtgtatgtttatatgtatgtataatacattataatatacatagcatataatatttagagtgcatgcatattatgtgttttgtgttacgtgattgtttttgagagatagttgcttacactattggaaaaccactggtcatttggcatttctaaacagttatggtgctgcagaggaaagcttttgaccagcctttgactagccttggtcttgtcgttatttagcattcagatgtgtcaagaaaattaatacctaaaaaaaattttctggctgggcacagtggctcacgcctgtaatcccaacgctctgggaggccgaggcgggtggatcacctgaggtcaggagttcaagaccagcctcaccaataaggtgaaaccccatctctactaaaaatacaaaaattagccgggcatggtggcaggcgcctgtagtcccaactactcgggagactgagacaggagaattgcttgaacccaggaggcagaggttgcagtgtgctgagattgtgccactacactccagattgggtgacagagcaagactctgtctaaaacaaacaaacaaacaaacaaaactgcagatctgtttttggagttttaaagtgaaaaattgcattcttttgtctctagtagtgtaatattgacagtccaggcaattattgtcatgctaacataataaatgaattacctttactattctattgccaatgtgcttttttatagctttatttagatacatttacaaaccataaaattcacccatttaaactgtacgattcattcatttttagtatattcagagttgtgcaaccaagaacacaatcaattttataacatttcctcatcccaaaaagaaagcccatgtgcattagcagtcactccaatttccccgctacccctgcagccctattaatccactaatctactatgcatatggatttgtctctgttggaaatgtcacataaatggaatcatacagtatgtgtccttttgcgactagcttctttcacttaacataatgttttcaaggttcattcacattgtagcatgtttcagcacttcattactaattatggccaagtaacattccattataggaatatgccatttttgtttatccattcattgtagatagatatttgaactgtttccactttttggcaattatgaataatgctactatgaacattcatgtacaagtttttgtgtggatatgtttttaattctcttgggtacatacctaggaaggtatagaattgctgggttatatggtaactctatatttaacattttgaagaactgtcaaactttttccccaagtggttgcaccatcctacaatcccaccaaaacatatgagggttttaatttctccttatcctcaccaacgcttgttattgtcttttctattttagccattctagtgtgcatgaagtggtatctcactgtggttttggtttgatctaatttgacttccctagtaatgagtgatactaagcatctcttcgtgtgctattaaccatttgtatatcttctttgggaaaatgcctattcagatactttgcacatttttaaattgtgttatttgttgttttacagttgagttgcagaagttcttaatatagtctagatactagtccatcaacagatgcaaaattttctcccatctttgggtatatctttttacttttgtgatggtgtcatttgacacacaaaagttttaagttttaacaaagtctaaattatctattttttaaattttgtcacctgtgcttttggtattgtatctaagaaacctaactcaagatgacaaagattaattcatatggttttgccaagggattttatactgttaccttttaaatttaggtctatgatccatattgagctaattgttgtgtatggtgtgaggtacaagtcctaattcattctttgcatgtagacatccccagttgtcctaacaacatttattgaaaagactaatatttctcctattgaattgtcttggttctttagttaaaaatcaattgaccataaatgcgagggtttatgtctattctattgatctaccttttttgttagtaccacacagccttaattgctatagctttgtagtaagttttgaaactagtaagtgtgagtcttcaaacttctttcttctttttcaagattgttttggctattctggatatttgcagttccacatgcaatttaggatcagcttgtcactttctggggaaaaaaataaaaaaacagctgggatttttaaagggattccattaaatacatagatcattttggccagtattgcaatcttaaaaatgttaagttttctgatccaataacatggcatatctttccatttatttattctttaatatctttcaactactttctagttttcacatcttatacttctgttaagtttattcttagatattttattttttggctgctattataaataagattattttcttaatctcttttccagactgttcattgctagtatatagaaataagatttatttttgtatattgatcttgtatcttgccacattgctgaactcgtttagtagttccaatagttttttagtgaatttgccagtgcacttttaacttaaacttttaaattattttgtccccatcatacttataaacatcagtgtatgctactactgtaccacaattatccacaatattgagcaattaaatcctgtctgccctaagctctcattcagtcccttcaattaacccttcaggctgatgatcactctccacaggaaaggagaaagcacgacataaaacaaattacttctttcttaatcctttctatttctagtggttagtaaaaccatacagagtagtaaaatgaaacatatgctgagctactgaaactcttctgcctagcattaccttgctaaaatgaaatcaagcaaaatggaaccaaaagtggattttgacatttcatattttgctgaatactgttagggctctggcaatcactgtctcttacatacaaattaacagcctaccatctgtcaagtgttgggataatcacagggtttagtgcacaatatggttattagaatatgacctgacaaaaaggaaaagaacacaacctaatttggactataaaatctatgatctcacttgcaaacgacagtttgacaagctattattctgcattttggcttctacagtaaaagcagttttatgcatacgtaattctgttatacaggcaacagcccatagaagattgctttaaactacagaatctgcttggtcatacaatattttttaactaattcttagacaaatatttgcaccatgaataagtaggaatgtaatgatctgagccttcacatttccaagtgaagcaccaatcattaggcaaaaaatgtctttgtgatattgctgccagcagttccatagaattcctcagggtatatgcaaagaaactactgtaggaacttattaaaactattcacatggacatacatcaaagtcaaaaagttgacagttttgaaaagtgtaatatatgaaacactttggtgtggaatttacttcatccccaacagtgacatctgctaatgagcatcattaatattgcccacttttatttatccaaatgcctcatgggtgatatctttatgtacattcctctgtagcaccttttgtttccacccagtggaaataaatcccatactgacagctgcctctaataaagatgcttccaacaaaactcttctggttacagagagaacacagagtaccaagttctttttgttgttgttttctacctctcaaaacagtgcagaaatgagtattgttcctgaaggttatttaagggtacacccagtgtgtctaaaatacatgcctaagacagaaatgtattaattaagtctcaaggcaaaacgttctgttgaggcgacaaaacaaaacagatttttaatattagcagttatattacctagggagcttaggcgagataataactatataatacattaggcaactcacactgcaaattatgttgctttgttttagactacacgtttttccattattttcatacttgtttcctttgacggtagaaaaaaatgatgtatttttctgtcatgttggctcactataaggtgagtcagagtgccaaggttcttctgcaaggaatcttgggatccaattttaatatgctgcaatatgaattttaagaacagtgtgtgatgaattgtcaggctgcatgatatccccaaatttcccagtattgagaccttcatggctattccccgaagataacaaaaaaaattcgatcaagatttatagaagacttataaatgtatgaaaatataaaaaaataatagttacatccatgggtttaaaatgattcccctacagtggcaaccctgtatgaaaatacaatatgagatcagggagcagaaaaataaatgaagtaaagatttagggagaatcatggcaacttattcatttacaggaaagccagttcctttttcacccttggaaaaaactacaaacaaattccaagttctttctagctacaattgacattatcatttggccagtatattcatgataaatgttctaatgtgaaggcgatccatcataaatgtaatttcaaaaatgaacttcttattttaacttcagaaagaattattctaggattcaaaagtccagttaaatacatatagaaagaaggatagaagggagaaaagtttaaaaaaaaaaacaaaaaactatgcccagacaaaagactggaagaaagttatttatgtgatgagactatcgatgatttattttcttttaatttttattaatgttcgaaacaaacacacatcatcttttaatgaaaaagaaattctatatgaattattttctctctatggtatatttagagggataacttatatatagtaaaatacacaaatcttaagtatatggctccatggcatttcatatgtataaacccaagaatcttccacctaaaacaaagtatgcagttatttccagaaaattacctcctgatcctttctagcaatagtctcctagctccctatttttctggcttctagtatcattgattccttttgtcagctattgaattttacacaaatggaagcatacagtatgcattcttttgtttgtggcttcttttggcaacataatgctttcaagatgcatccatattgtatatatttgttgtttgttcctttttgttggtgagtaccacctcattgtatgactatgtcacaatttgtttacaatgatgtctaaggatagacatttggattttctcaagtgcttggctattataaataaaacttccatgaacattcttgtatatgtctttttcatgagcatatgcaataatttctcttgaattaatacaagggaaaatatacgacatacagtttttaactttaaggcaaggtctaatatttccttttatggttattttattttaacagtatatttaaaaattcataacttattggtttcaatctaaggaaaatgtaatgaacaaaattcagagcataaatttgtaaaatctcatactcctagatgaagagttcaaaagaagagaaagaagttatatgccccagtggggactgcttcttctggatcttcatgccacaatggaaagattctcaaaggcataaagttttccatagaaacactctcaatctgttagttttaacaattaaaacttacgtttaactgaaagtatagtagagaaagaaaactaattgatgaaactaaaagtaaacctctcaaataattaagaggcaaatatttcagggctgaaaggtcatcaccagtcacagaaaacattcagagaagtgagaaaccattgaaattggaccagtggatggcagagtaatagatggtatttccatgacatctaccccatgccaggggaaaagaagagaagggtttactttgggtacaatgacaaggacaaccttctgatatgttgctaaggatcatgcctagggtgactataaataatttattatccaaaatgagacacttctgagactgaagcagggtaataaaattaaataaaagtaataaataaaaattaataagtttaataaataaaaattgttttatttatattattaaaaataatttaattttttaaatatccacctgttgactgaaaaattggttttattttactggttgacagttgaaatacagtcctattctaaaatgatttcccaaagtaaaattatttttatttttaaaaaatgcttaactgggccaggtgccatgactcacacctgtaatcccatcattttgggaggcacagatgggaggatggcttgagcccaggagtttgagaccagcctcagcaacatagtgagatccagtctctacaaaaaatacaaaaatattagccatatgtggtggtgcgcacctgtagcctcagctactcgggaggctgatgggggaggattgcttgagcccaggagttagaggctgcaatgggccatgattgtgccactgcactgcagcctgagaccctatctcaaaaaaatgtatatataaaaaaatgctaaactggacaagatgcagagaaaactggtaaaaactagggctatcctgagcaaactcagatgcatgggtacactagtcaagtgtcacctccaaccctctccagttaatttaccaaggtacctataaatggagcctaaggcactgcccctgtccttttcttcattcaacaagtaattgttgaaaatcttccatatgtttggcactgtcccaggcagagagatataatgataaatgagtccaactttccttggactcatggaaccttcaaactgtcagagaagacagccaaagaacaagttactaaaagtgtgctaaatgtgaaggaagatacagagcccactgagaggcttttacatggtagtgatcaatggggtttgtattgtcccctagagagatttttttttggaaatgtgaggagcggtggggagctctctatgttccttcttttttaagagatggagtctccctatattgcccaggctggtctggtctccacctcctcttgagctcaagtgatcctcccacctcagcctcccaaagtgctaggattacaggtgtgagccaccatgcccagccatttaactcatattttctgaggggcaacaaggccaccaaatgttcttatgtaggacaggcccacatgatgaaaaatgatcctgtatccctcataactttcaaatgttccaccagacattcacttaggtaaagaaaaaaaatattattgtctattttacataatagcttaaagtatcttttgcacattttaattttcactgaatttttcagaaatgcaactagcatttaaactgaaggaataatgtattttgttttgttcaacactttaccagttgttcactatttcagaaaatcccaccaccgacagcaatggggcttttggtacccagtctaccaatataacacaactgtattagtttgcattcttatctgtcaaatgcaaatacgtaagagagaaataggcctagcaccaaatattattaaattggccatgggacatgaaagtcaaggataccaccaaattgcattcatggaaagcattttttttatatttcattttactgccacagtacatacctttaaaaaaaatctgtagcacaatgatgagaaatctacactgtgaaaattactgattaaaattatttacttactttggatttgcttcttgtttctcagtcttacagtgaaactgtccctagaggtctcccacacaacttctttatggcttcttatattactgcttctttttccaatccattccctattccctgtggcctaccgaagtgctttttaagaactagagaccaaatgtatgcatcaacataagacatgatttcaagatgagaggtattcttcctgtgattcttcaacaccactcagtcccttttcataatatagggaatgactctgcagctacccttttaagtaagtcccactcatttccaggaatggcatacttgcctatgttctctacctcaaaactgcattatttatcttagcatgttagctctacttcaactaaggttatttccctctttttctcatcatgtatattactattaatatgtatccaaaggttagcttttattctagtatccctcaaacctctcatctttcatttcttgtactcatttcacagaatggcttgtgatattcttttcttttcttttttttttttttttgagatggagtctcactctgccacccaggctggagtgcagtgacgtgatcttggctcattgcaacctctccctcctgggttcaagtgattctcctgctttagccatagctgggattacaggcacatgcggccaagcttggctgatttttgtattttcagtagagacgggttttcaccatgttggccaggctggtctcgagctcctgagctcaactgtgaggagaaaataaaacccgcccacctaggcctcccaaagtactgggattataggcataaaccaccactctcggcctgatattcttttcttaaatccaatttcactcatatcaagtagatataagcatttgattaattcattatgtcttcaagtagagttgtgcccaagcctttacattggaatacttagcttattgtaagccacttcccttttctttcttctttatattgtagttaaccatcataccatttttttaagtatatgggtgggtaggtaatttctataaagttcaaaagagggcagttaatctgataggattaaacagttgactggaatctaatttggggcagagactctttaggctgaaacttaacgaatgggtaagagttagctaagtgaagggaaagtagatcagggagatagaaaaagaggccaaacccttgaaggcagaagaatcctcagagataacagagcagagagcttcagctagagaactggttgccaaaaagtggtaagtgaacccctggaagcacacagctgaacttttgctgataaaaaggctaactttttaattttaatagattcaagtgttttgaaatacatattagaagaacagtagtttccatttaaggtggcaaaacaatttccttgtacaattaacttaaatattagcaaaaataagctttttttaatagtaagtgttggtacaaataggacatgaatatggtaaatacatggcttctgaatgactgaagttggggtgctctgacctattagcatggaggttggagaaagaggtagagctagagatgagatgagaaagcaagggcttggtcaggcaaagtcctacaaaccactgtaattattcaggtctttgtcttaaaagcaatgaaaagccacgaaaggacttcaaacagaggaatgagaagatcatagctgtgttttataagatcagtatggcatctaatgagaaatggattggaggtaggaaagatggctgtgggtagacgagttagccaacttttccaaatgtttaattcaaagacaatggtggggctgggtgcggtggctcacacctgtaatcccagcactttgggaggctgagatgggaggatcacaagatcaggagatcgagaccatcctggctaacacggtgaaatcccatctctactaaaaatacaaaaaatcagccgggcgtggtgacacgcacctgtagtctcaactactcaggaggctgaggcaggtgaattgcttgaacctgggaggcggaggctgcagtgagccaagatcacgctactgtactccagcctgggtgccagagcaagactccatctcaaaaaaaaaaaaaaaaaaagacaatagtggtccaagttcaagtgatagcagcagagatgaagaaaggaagaggaaattgagagataacatctcctgaaatccaagttgccataaattgaaaaatagttggcttaatgatagcttggctgataacatgaagaaatagatgctaagtgagcatatcaattgtaagatattgcttcagaaacattaaaatatggaaaatccatgcttctttaaatagaggaaatacaatttttaaagggtagaaaagagtgtgtagacactaaacaaatgactgatgatagtgaacccccagttggaaaaagtcaaaattgccagatttctttggcctcaaactgctaaacatctaatgtcttgggctttattcactttttgtctttgagtgacatgacagatcattttggtgatatagatggagctcaaattgacaaggttactggagaaagtaaaatcaaaaatcctttctcaggtaaagatatacctgagtaaggaatgctgaccttctaatatcagaggcctaaaacttgtaagtggaagtttgcttacagaagacaatgttcacagcattctgaaagtcatggccaggttgttgctgttattatgaaaatggtgatttatagccaatgtccatagcctaggcctcgaggtatgtttacaatttacagtaagaggggcccagccttaaattattgttagcaagtcttgatattattttgtaaaaaatgaaatatgtaaacacatacatatcaccttttaattttatttcttaggggacaagggaaaaaacacagtttgcaactatgtatatctcctcacatcaaagtttaactcctcaagatgaatacattctgtgcctctgctcccaacttgaagaaatttcaactgctctattctttccacaactgcccattgtcttaaaaaaccccaaatcgctggcattttaaaaattaaatacagtatattttctagaaagaaaaaataattaccaggctcgcacgtggcagattcctctagccatgcaagcctggatattcatgaaagccatttctcacttggctcagggaaacctcccagaatgataggaccatttacactaaatgaaccgaacatattactggagtaacaattgacattaagtatattacagctgccaggggcagtatcaggaagaatccctggatgacagaaaacatgataatgtagaaggaagaacctgcagaatcagaaaggggggaaaaacccctcataaaacaattttaaaaatatataaagaggaaatcatatttaaaggaaaaacagagaaattttgttattttttttccttctgcctgcagtagccttctggtattagacctgcaatgcatttgctaccccctaaaatattctcaacactaacaagatcagaggaaatgatttattccaccccctctcctgctacttctgaacggcagcgcgtgtccttggggacatgggatttctgcattgctttcggccatctgatattgcagctctgcagccttccctggaatgagccagaaaaatcaaaataattacattaatgctgggaatcaaagtttattgactctcccttgaggtggaaaaccaaaatgctggttacaaaagttgccagcttatttaatgataccactgcctcctccctgttcttgtcaaaacagcttttgaaagcattttcaaataaagccctcagatgcgctccaattcaatagcttatctattcccttttaaataaaagctagttcacatcatctcaccccctcaaagggaggacccgacaggccctcttcccctgccaaggcactgccaaaggcaatactcccaggcaatatccctgccatcatttccgctctcttcaggaaggttctgcctcattgaatattcttccaagccagtaagagaatctcatgcctccccaaggcagcaatctacatttattataacattcatggctgctaatgaaacttggagcagctggtttctttcactttccaacaattctttggatattcaaagtcccctcataagagaggggaacttatgagcacacccatttcatggatgagcccgcagacacagagattcaatgtggtgctgacctttgtaactttcacaggactttgctacagccctaaaaaaacagatgctaaataataattgattgaattaaactgaaggaggtagattaatttttttaattaaactgaatcaaatagaacagaaataaacaaactctagccctctccatgcctagtcaacacctactattctttcttgtttcttttttttcctttttattataaaagttttcaaataaaatgagagaccagtataatgaagctccaagtacctatccacccaggttgaacaatgatcaagattttcccacatttgcttcattcatcttctcctttttttcttcttcgttgaaatattttaaagcaagactaagacagcatgctacttcattcctacttttgtcagtgattatgctgtgcagaaaagagttaccatagaaggcctgaggttgctatttttagaatttaaaaaagtttgcaggtaggtaggtaatatctacagacttcactttatgatgataaaagagacataagagaaatagacctgcttgcaaagttgactcttggctggcatctgggaacatggatttgggaaggttgccatcattcccagaactgataagagtggctcactgtgcccgaactgtttgttcaaataatgaaatgctaaatgcctgctttccttctgggagtctaaaatgttggtatgtgctagccagagagtatctacgtgaccagcccccaataacagccttgggtgctgatgccctaacaagcttctctgttggacaacatttcacatgtgttgtcacaactcattgctgaaggaattaggcatgtcctatgtgactccactcaaagaggtctctcagaaccttgcatcaagtttcctctgaagttcaccccatacgctttttccctttgctgattttgctttttatcctgctgtaataaatcatggctgcaagtacaactatatgttgagtcctgtgagtattcctagcaaatcattgaacctggtaatggtcttggaacccctaactcatatacctaccattttttaagtctacttaaacctcactttttcacagaaacattggtgaccttggggagatgccaaactaagggaggccccggttatccattctcacagcaccctgaacttcctcttcataacatttatcgaaacggtccctaaataatgttgaaatcatttgtttgtggtctatctctccaccaagaacccaaagtccctgagacaggaattttgtctgtttggtttgccatgtatacctagcatggtacacatggtatacatttaaaattttaaatagattcaagaaaataccatacccctcctccaagtttaagaggtaaagtttatataatttcccttgcattacactcattcattcaccaaataccactcacttatggtataatctatactgtgtcccagttcagtttaatatccacttcattaacatctttctgtaattagcaacatcatgccaatgcttcaccttttaggtgagacaaagcatgactctgcaagggggctttcctcttgacactggtgactaattcatctatttgcatcacattataggaccctctttccaccttacaatcctctagagattctcctgcaaatacagactcttgagatgattcttacatgcctactaaagtttggaaaaccactgttttgggtcactcaaaaaatgaaaaggcagctataattaaagaaaacctcatggatatgattcttcacctgaatttttaaaaagataaataaaccacagactaaacataaattttgctaagcatattcaactactgaaaataccatacgacaacagagagaataaacatatattcctttaaagaaaagaagtgagttgtccatatgttgtaagggatacatctatatatatatacagattgtcttgcacatttaatgtgtgcgcagaaatgggtcaagtagattatttttttcatggtggatgaaagtaagatgtgatgagacacacttgaatggggattggcaagatttttaaagattataagctttgcgttttcatataatctaccatcctgcaaattcacttctgagtatatattaatacccaagagaaacttgagcacatatgtcaaactccatcagtgaaaggccaccaggaacaccctggtagtcaaagttaagtggttcaccttactgtagcaaaggagaaagtaccccagaggaaccttgggagcatcttagtaaaggggaattatcagtggcttcctctagggtttggggaattgaaacaaactgaagtttgcccagaagcagcagtcactctgagaaagacagtgatagtcagaagaaaggggtgtttagtcatttgtagggtcacagaatggctttgtttatgccttgttctgagtattgtttatgttctagttgccagtagagccatgttttactttctcacatatgtaccaggaaatgtgtataagaacattcatagcagcaccattcatagaagaaaatttaaaaatttaactaaatggctattgataggagtacatataaaacttaaaaaggacagggaatgatgaacatgaggttagtagttggttacctcttacgaagaggtagagatgggataaaagggggcacaaatttgtaagttattggtaatatttacttgttgggtttatgcctgttatattatgaaataaatattataaaataaaacagaatttaccatggatgacagtgagtcatgaaccaaacttataattaatctacctctgtgacctgaggtccacattattttaaaacaaacaaaaaataacaataatcattcatatttacgtttccttctcagccatacattttcttttctacttagcattttccactgtgacacagtaggtgccagttgtgtttatacagaagctacaataaacaagactttttattaaatgcaaatgtcaccacgcagtagaatcaactattgactttgtgcaacctctcatcaacagaaccatcaatacgtctagcaaggcacaggatttattgtctatgcacacctttcagagggcttcctgaaacacaactagcttccataattggtaaccaaataaaaccgcaggccaccagaagcagaatataactctctctaggaagctgtaaattaaagggagatttgtctaactaaatgtacagtgctgcactcacatgggcatttcatctcttgctctttaatggaggcagtccttgtacccctacttcacattacgaatatggtttcatctctgacagaaaggccagagcacctggcagagtcctcacatgctccctccttttaccttttccattgcattaattaattagaactgtctttatattcagtgacatttgattttgaggacatttttacaaaataacaacaccaggtccaagttcactacagcaataggatctacaagaacccaaagaatgaatgctttttagcaaatgagaacacaaagtcacatgatctttatttttaaaaagctcataaactatgtcaggcaggggaatcacattgccagacaccataaaacaacatataattaaactctagcagtccattagaagacctagtgacaagcccttctccactgctgcaacaaaggtgggatgatttacatgtagactgggaaaagtcccatgatattagaccaaaatccagcactgctgctaatttttttagactgaaatgtgattgcccaatattaaattgttaccattagtggggaaaaaatagcttattctaacaaatacttaatttctctctagctttggtgcagtcctgacttgtagtttattctaataaataatttaaaaataattttggtcacctcccatatgatccaaagtaatgctatttgagatcaataggactaacattttctatctggtatccatggagttttttatccaatgagagagaacattcaggaacttagcctgtctcatggctgaaaataggtagaatatgttaggtgtgcgtttgatacaatctgtaaataaaaggcaaattataaaagttcccctccctgcagagacgaagtcccacaatagggtgcacaagctgcatttcaacccccacccacacctcagatatgcatcttcattcagtgcacagaagactcaactgtaggggcggcctggatacacatgccatgtttcttccttgcccacttggtgtcttcacatccccttccccttaaaataatcccattagttgaaaagttcctggatacaaggagcagccatcaaagtccatggatggatttcaaggggatgaattcatttaacattattaaatgtttactttgctaattctcaatacttgtacacaatataagacatgatttcttctgtctataatatgaagtctgtgattagagtaatatttcaatttttggtttgtttgttttgacttggaattagcagtaggataccaacttaagtcaaatttactagttctcattttccctaattcagcatttgttttcatctatagaattccttttcttaagtcaggctctttggggtcatcagccccctgaaatcatgtgcaaaatgggatgcctatgtgcacatgcctctttctgtgaggatcggtacctgagaactttgatgccaagttaaaaagactgtgccttgagtttttgacactagggaatgaaggaaagtatgagataaagaatatacaacatctgccacaactactgcatattttctttctatatcacattcaacagtttattacaatcaccaggcttttcattcccataaagcaatgttcagacttcaaatgtgctaataatttagctggagaatttgagaaaactacacattcctctccaacacccccacccccacctccttagccccaagaatcagatttcatcactctggaagagaactcagatatctgcactttttacaagtgcctcatgtgattctgaggcaatggtgagagacccaagctttgaaaaacgtgccatgatctaccatcaagtaggaatcatgtacataagttcttccattagaggaaaaaataaatgtatttgtttctttgtaaagataggacgttggaaattttcacttagattactctgtaagcgacaaggaaattagaaagctcgttttttacaataatcactgttacttgacagttcctgcagcatgttaagatggctgttattgatgacacttattaccttttcccatgcaataaaacacaggaacatacagtggaagagataagtatattttaaaacaacagaaggaagaaaaataatggtagtcatgtcctctcattatttgtgtagactgactaccatggggaacagtgaaatgccttttttaaagttacactgtggctttaaattgggttaactcagtgaggatagccatgaaacaagtggctatagagatgtaaagaatgggctatttctctacatttctcttttgccttttattttccctatggtctttaatgcatttctctttggaatggatgaagttataaagttgccttacataaaagctttgcttgaaagattggtaatcacgcactttgctactgaattgtccagtctattcaatctaaaaaaggctcttctcttttgttcagctcagattatctcctttgcagagtgtaatagaaatatctgggtataaaattgagaaattgttcataaatattatggaaggctttttgagctgtttactattagaggcctgatttagcaaacagtaagcctgcttttgctgggttgggattttttattttttaactttttccttttaactgaatcatccacagttaaaaaaaaaaaaaaaagatacagatttcacagcactttcacccatgattagagcagaagaaaacaaattgctttttttttttttagatggaggtttgctttgtcgcccaggctggagtgcagtggcgcaatctcggctcactgcaacctccacctccagatccaagtgattctcttgcctcagcctcccaggtagctgggactacaggtgcatgccaccacgcccggctcattttttgtatttttagtagagacgggggtttcaccatgttagccaggatggtctcgatctcctgatttcgtgatccgcccaccttggcctcccaaagtgctgggattacaggcatgagccactgcacccagccacaaattgctatttttaagagacagttttaatatcttgtactacatttggagaagaaaaaaacatcagcactgctatcgcctataggcaactttcttatcttgccatttctttatttaaagtctttgcactgaaccagccaatgaaatgcattattctactggccagcgttctctagcagaaacaagagacagcatgcattactgagaagtcagacacatttgcactaaatcaaaaaataaaaataaaaagactctctagctagaggttaataacacaactcaatcaaaaccagtgacattttttatcaaacagtcgtgaaattgccatttggaactctaacttgctacaaatagaattaaaagtgccattctaattctgtctccttgtacaatacgaccctgatatggaaaacaaggtgtctacactgaacacatccagtttacaagagaaaaaacgggatgattttttgattctctcaaatattaggtaagtgtttaacacatgactcctgagtgggagtgccagttaaagagttgtagtacctgtcaacgctggtttaacatttcaacaaagcaaatcatcaattaaaactcatcagcaacagtcatcctgttaattgaccaaatgattatccttcttttagttaagactctacctgacacacttgaagaaatttttttctctgttgtaaaccctctggagtctgtggcacacctcaccttggcaaaccactttggttttcagattcactggaaagcccctctttgttctaagaggggctcctgaatgaaagccaagttctagtctgactttctgattgcttcttctcaggtttttttcttgcttcctaccaggagaaggaaaaaggtagtcataggccatctgttaaacttgtgtttaaagggaagtaccaaggtatggccagctggatattttactcaacatggtggatcatactcaaggtagtgtataaatggtttagcagtgaattccaccccatacttcttggggtaacatctatgctatcaagcccttaaaaccaaatccaactagctctaaaccataaacatatattatgattcaagcatttgcaggaaaaaaattgtgcttcagtataaaactttgcttcatctagaatataaaggatcccatttcccaattaccatattatcagattctgattctatgaggactaattttcaactctgtaaattatagataaatgataacaatgcaaaataattcttgcctataggcaagcaaattgtgttctgttctctggaggttcaattaatccccctaccccaccctcagaaaccagttttgccctccatttgtaacattcttttcagtattcctgatatataaatgtgtctgggctttttggattctctttagactagttataatatttggctggttctctcattataagttgacctaatctttaacatgttttcattttatatcagtatgagagtcatgatttcacctttatttgagaattattctttaatacatgtatagatcttggactaaggctatcaatttcgagacttcacttgtaggactgtgctgtactcctgtctctcacactctctgcacatgccatttcccagcctggaatgttcttccctcctccccactccagcttctggacctagttaattcctaatcttcactcagatttgggcacaattatagcctccataaacaagcattgcctaactacccctcctctctgccaagaagtttagatctccctgttatagttcttgcacttaacaccattgacatttatctgtctggattttctgactaatgtctcttttcctcactagaataatgctcgctgatggtagggaccatatccggttttacataccattgcacccagttaggtgtctggcacacagaaggctgaaacaatatttgttgtgatggggttcttgacacactaccccaaaatatggcatgtcggcatttgacaaaacagtggaagcaggaaagtctctctgaccttctcccacacttttcccctgaagcaggccataaaagaaatctctagccttcctctaaagtgggtcataggccttattcaagaggcacccttcctatgcctggaggaaaggaatgtcattatctctgaaggcacagagataaagagaaaaatctgaataaagaaggcttgctaagttccccccagtttattatctttagatcacaccccctatgtccaatcatacttctacacaactgtctgctcttcatcaaatttagcataaaaatatacaagtttccctgtttctttgagtcttcctttctccatgtcacataaaacttatactaaataaatttatgtccctttctcttattaatctttcttttgttataggggcctcagccattaacctggcaatggaaaagaaaaatattttcttctcccttgcagttgcgtacatcagcaacacagtagatccatggatcagtgaacaaattgggctatgaatattcctattataaatcagaaaaacagatctagaccaaagctgaccaaaggagaaggaaaaggagagactgcattttgatgtaagtgttactgatttgaaaaaccatggagatcgatcacctactacaaggtccaatggtattccagattctagaaaagacctagataaaaatataaagtctctgaaagtcctctcatcttctccaaagagtcctaaaatccaaaagaacctaggatttctgggtattttgaacctgaacaaaggcaaagcacaaaaagcatggtatagaagaaggcttctcaaagtgtggttcccagaccagcagtacctcttggaaactctcaggcctcatctcagacctactgatgaaatcagaaactctggaagagggaccagccatctaggtatcaacaatcgcttcaggtgaaactgatgcttgttagagactcattggcatagaacaaagatgggcctcaacaaagatggaatcaccagactccactgtaaatagctgtgaaacactgagcaagttatttaagttctctaagcctgagtttacttatgaggaaaaatggggataataacaacaaaaactatcccacagaaatgtggtaagaattttttttttttgtttcaacttttattttagattcagggggtatataggcaagtttgttacctgagtatattgtatgatgctgaggtttggagtacaaatgatcctgtcatccaggtactgagaatagtactcaacagttagcttttcaacccttgcttccctccctcactcactcctccagtagtccccagtatcaattgttgccatctttatgtctatgagtacccaacatttagctcccacttacaagtaagaacatttggttttctgttcctgcattaatgcacttaggataatggcctccagttgcatccatgttgccacaaaggacatgcttttgttctttttttatgactgtattgtattccatggtatatatgtaccacattttctatatccaatccaccattcataggcacctaggttgattccatgtctttgctattgtgaatagtgctgcatgaacatatacatgcatgtgtctttttgataaaatgatttgttttcttttgcatatatcctcagtaatgtgattgctaggttgaatagtagtcctgttttaagttctttgagaaatctccaaactgctttccacagtggctgacctaatttacattctcgacaacagtttataagcatcctttttccccacagcctcaccaacatgtgttgtttttagactttttaataatagccattctgacagtgtgagatggtatctcactgtggttttgatttgcatttctctgatgattagtgatgatgagcattttctcatatgtttgttggccacttgtatgtcttcttttgggaagtgtctgttcatatcttttgcccatcttttaatagagttacttgttttttgcctgttcaaaaaattttgagtaatgtctataaattgcctagaaaattgactgacaggctgggcacagtggctcatacctgtaatcccagcactttgggaggctgaggtggacagatcacccaaggtcagcagttcaagaccagcctggccaacatggtgaatctctgtctctactaaaaatacaaaaattagccaggtgtggtggcgcatgcctgtaataccagctactcgggagactgaggcaggagaatatcttgaacccaggagtcagaggttgcagtgagctgagatcgagccattgcactccagcctgggtgacaagagtgagactctgaaaaaaaaagagaaagaaagaagaagagagagaaaattggttgacaaagaatggatactaatgaaataatagctgctattgaatttatcattcatgtcagtagcagcagcagcagcaccatcatcaccattaccatcaccttgtctagattcttaaggcctggaacccagggttggaagaaactgttgtccttttgcctcatacatcagcaaagcgtgcatagggctcttaggaattgggcaggaggaatccaaatttgtgcaccattactgtcttctagctgatgccaccgttttttgtcagtcatttatactaaaatatactaacttagataggtacagaatttaagaggttacacaagcacttagcacacatgctatctgatcttcacaaacaacctgagagtagttatttaattcagagaagttagtggacttgcccaaagtcacattgccagtcctcacagtcatctgaagagccagacttgaatccaggtattttgattccaaacctagtgctttcttctctactcctcgtctatacttctgttttcattataccaccttgccaaggaaacaaacactcaccagacacactgtagagtaaaatagacctgacatcctttagagttcttcttggatcctggaatgtggttcttattgtctctacttacaaacctcacatttacagaagcaggctgtatttttttaacaccttccttattagcaataattggtcccttctgctgtatgtttgtttgatttttaatacacacagttcaagattaactcaaatctgttcaacaccaatctttctaaaaaccaactttccaaatatccacttgtaacacagaaaactgcagatcgtctttcctgcttccaaaatacagtcactttcataaatgttgtccattcattctagcactgagtgttcataaagcacctactcattgctaggcactatgtgaggcaatgggcacacaggtgtggtgtcttaagtaagacaggtgtggtgctttccatcctggaagtgtgagggagtctggcaataaaaaaatcaacaaataaaagaaaatagccacaggttagagtaagtgccattgcaaagcctcaacaggtaaaatgatgaagtagtcactcacattttcttcaggggctggagaagcccagggaatgactccagacagggtggtccaaggtccacttctcactcttcagataaaaacacaaacaagcatatcttgacacagaaaatctaatgtgaaaatccggtaagtggaaatatgagttgacagaatgggtgatttagaaacggattatctactttaacatgagaattcgatacaggatttttcttgagcactttcctaatacaaatacattttatatttatatccctattaaatatatactatatttaatataaatataaaagttggatgccatttataaaaattcaattaataacaaaatgaaacagctactgccaaaaacttgcatatacagacgttaaaagaaatacggggctgggtgctgtggctcatgcctgtaatcccaacacttagggaggctgaggcgggcagatcaattgaggtcaggagttcgagaccagcctggccaacatggcaaaactccatctctactaaaaatacaaaaattagtcgggcatgtgcctgtagtcccagatacttggaaggctgaggcaggagaatcacttgaacctgggaggcagaggttgcagtgagctgagactgcaccactgcactccagcctgggcagcagagtgaaactgtgtctcaaaaaaaaaaaaaaaaaagaaagaaaagaaaagagaaaagagaataaaagaaaaggaaaagaaaggacaggacaggaaaggaaaggaaaagaaaagaaaaaagaaaagaaggtaccaagaggtggaaaggaacagggagaaagaaaacagttattcaatgtttttggaggcccaagcacagggttttggcataatttatttagtccataaaacaactctgtatttagggatcatccacattttacaacaaaggaaacccaatttcagtgaggtgagattatttgtccaagatctctcagctggtaagtgacaaaaccacaacataaaaatctgatctatatccagtaactatatcccatccattctataaagcaagaattggcacaccacagcccacagggccagacttggacagcagcctcttgataccaccacaaattaagaatgatttttacattttaaaagcactgaaaaaattcaaaagaattatgtttcatgacacatgaaagttttataaaactcagatttccataccaataaataaaatgccattggtacacagccacatttacctactgtctagagctgctttcaaattgcaagatggtgttgagcagttgtgaaagaatcagtagggtcccaaggcctaaaatacttactgtctggccctttacaaaagaagtttgctaacccctgaggtagagaaaaggatccatagaaataaaagtaacaaacactctcagaaatgtgacttcaaaaatgagtgacaaaagtatgcaaaaaatggctataaaatgcacctgaaagaatttaacctaatggcagttgcctgaggcacaactttctcaatttcacctgaaggtttcatttttctggccctgtgtcccagtgaggaagacccaagtcaaccttgtgacagggatttatcacgtcttaacttgagcaatgctgtgttcccaccagcactctcagaatggaggccacacaatgtctccactcctgcattcactggctcaacttggtttctgaagaatgcgaatttagttcaaggcacggtttcaagctgtttttgttgatttcccactatattgtcttctctaaatattttctggttcaagtgcatacgctcaattatgaaaatgaattcttacaaacaacctgatctgggcggatagttaactcacaccatgaagctcaaatttgccagtacagggaaaggtatttctttttcttttcagtcttcaggctacaaggttgaaagccagaagctatgtgttataaaatgtccctagtttttcccatgttttgtagcacacatattgatctctatgtctttgccatttacttgtgtgtggtcatccccaattagtgggttattttgtacttttcaaagttaaattctaagtcaatacttagggcgtacacctaagtcaaagatggcctccaccttgaaggaaaaaaattattacatttcaacgaaaacctacacatcatctataaacacactctttccagctgtctgactctagccttgtacaatgtctttgagctattttgcaccacttcgtaagttgtagataactgatagatatatataaattctgtcttacaggctgtgattttaattgacttcctactgtggagaaaacagttttatctcaatttgcaactcatcttaactctcttttagtccatataaatttgtgccattttgacttttcctttgagccagttataacatctgcctggttctctcaaatcatataagtaaaataaaatctttagcatgtgttcatttttatacctatatgagtcataactttaccttttactgaaaattatattttaatgacccaaaagattagtaagaattcagatttatttcaaaatctatctttaaaaactttaaattttgagtgatttcacctttaatatgaatttagttggaagtaatattaagttagtttaaatcatatagaaaaatgaaatgtgatgagaagtgaacttctttgttcccttttattgcttttaaaatgatacaagacaaaaattgtgcagaggggcaagaaacaaatgttaaacaaaaattattctgacatgtgttaaaatggtaaggaagactttattaaggactattgcaatagcagtattgcaacaggggagagagatcaggttcaactccaaatacaacaaagatagatagtcagggatttatagccagtgttagagcagataaggggttcagtgggtagaaaactactaagaggagtaagggaattcttgctaaattaattcctaacaggattcttgctaaaggcaggccaatgacttagacatcaagggtggggtgagaaacttgattagacatcacggtgaccagctatcacttaaaaagattattgctaaagccaggctagaaagatcaaatacaggaatgaggtctggggccaaggtcgctagttgagaaaagggctcagaggagtataattaaagtttgggcaaggagaaaatcttcatcataggtaatagcaaatttataaaaggacaattcaattcaataaatcttgtcctcaaggaatttacaatccactgaaaagagataattaagtcaccacaacctggtcaaattaccttggttttactttgcaattaaattttattcccatatgaatctatatgtaaataatctctttaaagaaaacaaataaaatgagaagttaaagttatttctatctctgtaatctttattttaacctttattttaacttcaggggtacatatgcaggcttgttacagaggtaaacatgtgtcatgagggtttgttgtacagattatttcattacccacatgttaaacctagtacccattagttatttttcctgatcctctccctcctctctcccaccctccaataggccctagtgtgtgttgttcccctctatgtgtccatgtgttctcatcattttgctcccacttataaatgagaatatgcagcatttggttttctgttcatgtgttagtttgctaaggataatggcctccatctccatccgtgttcctgcaaaggacatgatcttgttctttttttggctgcatagtatttaatggtgtatatgtaccaccttttctttacccagtctatcattgataggcatttaggttgattccatatctttgctattgtgaatagtgttgcaatgaacatatgcatgcatgtgtgtttataacacaatgatttatactccttcaggtatatagccaagatttttccataatcccactggtattagatacccaaaaaaatcccattggtattatatacccaaaaaataccaatgggattatcagattactggaccaaatgatatttctgtctttaggtctttgaggaatcactacactatcttccataatggttgaactaatttacactcccaccaaaggtgtataaacattcttttttctccacaacctcactagcgtctgttacttttttagcttgttaatagtagccattctgactggtgtgagatggtatctcattgcggtgttgatttgcatttctctaatgatcagtgatgttgagcttttttgcacacgatttttggccgcatgtatgtcttcttttgaaaagtgtctatcaagtcctttgcccacttttttatggggttcattttttccttgtaaatttgttaagttccttatagatgctggatattagacttctgtcaaatgcatagttcgcaaaaatgttcttccattctataggttgtctgtttagtctgctgatagttccttttgttatgcagaagctctttcattatctctataatcttaatttatagactaaaatattaatttgaaaatataccaactaaagtgtatcacacacctaaatcaaggattttataaaatacactaaaacagaaactaaacatagactatttattcaactttcatataagcaaaagacaccactattggccaccaacctcactactcccagcctgtgaaacaggatgattatgggtatttgtgaaatctaaacatcaccactcactacattaaaatgaaatggcaacaaatttccacaagtctttttactcaaagtgtggtggcccaacccagcaatctgggcatcacctggcacttgttataaatgcagaccctcaggccccacctgctgaatctacattgtaccaagatccccagaaaattcttatgtacatgaaagtttgaaaaccatggatccagaagtgtgtgaaaacataactactgccagaatttttagcatattcccttattcatctcttttttatgaaactaaacgtagtggttttgctgatagagatggacgggggaaaagaaattttgttgtgaccaaagttgctgcattttttgcctaggggtggacctaaagtttcatgtcaatcattttgttttgtgagcaaaatcaaagtcatggggaaaaaggagagggtgcagaaagaagaaaattgtgaatacatagaattttatcactggaagacagaaaacaatctcaattatatatatagtatatgtactcaatacagtaatggttaaataaaccatgacacaactatgcaagagcatatataaagacattaaaaataacaaggtcatttttcatgtaccaagatgcagtgatctctaatgtaaacttagcttaaaatatgcaaggggaaaaatgcaagggcagcacagcatatataatgacttattattcatgtaaggaaaaggacataagtgtgcatatgcatagaacatctctggaatgacacacaagaaagacacacaatggttactgcccagaggggagctgaggcacgagggacagaaatggaaggagactgacatcccactgtgcatcttttaacatcttttgaattatgtgatagtattatccaattaaaacaatattttaatctaagcattgaagaattcctaaaaagtagataaaatacagttactaagataataaaggaatcccttcttcattttccctcatagatggttatgtgactatgtccaaacactttctgtgagttacagatctgagaagttgtgtctaaaattcactgacactggagcttaaatccacgtgcctagaatgctcctcactgcccccacacaacccctgagagcccccactgatgccagttctctctgcaacacaaactaagcctcttcctgtctcagctgtgaacacatttgcagaaggctattgtggttttccttagtcaggggtcagaatggccagcaggggcaggcaggtatcctaaacgagtaaagcaggcctagccaaaacaaagtgagcctttacccctccacctgcaatgaaacagggcagcaactattctgctccaaggaaatactaccatggaggagacagggccagatgttgccatgtcttcccagggatgtcagaagctgctaaatttattttaaataccttgatttaaaaatgttaatattttaattttttaaaaacagtttacagaccaaataaaatacatgtgcagctagatgtaacctagaagttcataatccatcctgtcatctttcgtgtgtggaaccatgaacatttctctttttgttattttctcattggagctgctgaaaagaaaaaaaaaatctctttttaaaaaactcaaacagctatattttggagattcgacaatttactaatctatcactccaaaatgtgctgtataatttatttgacagtcactgtgcttgcctaagaactaaaaataacctcattgtatgtgtgtgtgttgtttctaaagacctgtggtatttattattgttagaatgctttcgatgtctttggtggtatgaactgtgaggtatctctgaaggatagcatttcactgtatttcacagaatatacatatacagtccatcaaaactctgggggttatttgcaaaacatagttctcattttccaacaagctttcagcggaagaaagtttcatagaaaaaaatacaaatttcctaccactctactttgtgagaacctaaagagactgttaggttataaaaaagaaaattgagggataaatttaacacttaaaagtgactcttctagcaggaggtttgggcacccagccagattaaggagaagtagctttatacacacatcttaacagcagtctgaatatcaaatcttcactactctttgcttaaagcccagtacctactgagtcatcccagccagcatgtcccttctaacttgtcatcctgtttgttatcactctatgccctctgcagtactctggactttgaatgtgagattactttatttaagtgaactgcaattgaaaaaagaactcttttgattgaatcttgacctgcagtaattgggaacttatgtaaggaccccatgatactcatattaaggggagtgtgggaggatcccactactaaagcctggctgcagaagagggataatggaaactgcaggtgttagaaaggtaccaacatacatcttccccctatagtacatggactcagtttttacatatggctatgctttctattctgcttaagtaacataaaaactgattaggaaactcaagatcttgcactacatataaaatctgcatccattgcttatggtctaaagtaaatgcaacaactgacaattcttacagagtctcaaaaccaagaaccaccatgataaaacaattatactgcaatgctgaggaaagagacatttaattacagatataatttatgtgagtaagcataatcattttaaatttctaaataaataggcatgtcattaaatataaagcatcaggaaaggatttcaaaatctgtatggttcatctgcgttggcaaatttgatctattcagagtttactctgggcgggggggacctcatgattccatctttatggcccaactgttgattaacttccaaatgaaaatgcttgattcagcatgtattttctgtaagaaaggtatttttcacatgctatagccaggccaatctgtgtcttcaattgttgttaagacactagtatatctttaaatcttttccacttattaatttcagcagattatttgtacacatttctcaggctattctgatatttcaaatgccttgaaaatgttgtagctacataaattaaatgggcaattaagatgtcaccatgcaattctatacaatacatacttgcaatgggatacttgtgagggtaccattatccaaactgtcctattcatcagcctttctagaactttagagatgggagtcagtcagctgggttccagtcatggtgaatggcatgcaatgatctcgaggaaaccacaaagcacatcttcctatgtttgcatttcctcatctattaaatgaagagaagacctggatcctaacaggacgtctgcgaaaccctcacgaaaggttaagaaaagaataaagaacatgacaaaggtaaggtttacatgctcttattgtggcagaagggaaaaaaaagcagaaatgcatataaatacctcacagtttgtcacacaaagcacacatttaaaaaacaataacaaaaaacaacaaaaataagcaaccaaaaataattaacagtagttcaagtaatttaaacctgtattctctcctgaagaaataccagataggtaaaatatactcccgagccaccacaaactctcctaaaatccctttgtccatttctgccactttcaacatccatcttccacccagatgccagcttgaccacctcccccatcaaagtcaccagactgagctctaggaaagtcttcattaaatagtgaacacatgacatatactatcaactcagcttgaccttacaacataggtgctatggtttgaatgatggtgtcccttccaaacttaaatttaattaattaataattaattaaattgttgaaacttaagccccagtgcaacagtattgggagatgtggcccttgggtagcgattaagtcatgagggcgaggctctcatgactgggattagcacccttataaaagggcttgaggtcaaaaggagtactctcttgcccatgtgtccctcctgccatgtgaggacatggtgtacttccctccagaggatgcagcaacaaagcaccatcttggaattagagagcagccctcaacagacaccagtcctactggtgcattgatcttggacttctcagcctccagaactgtgacaaatttctgtggtttacaaatgaccaagtctgtgatattttgctacagcagcacaaacagcttaagacaatggataactaatctaagttccaaaactagtgggcttttgacatgccttggaagtagacagataaagcagtagccaagatcttttctcatctttgcataagcaaatcgtaattgacaaacatcagtatctcagagcattcaacaaagtggcaataagtaaatagataactgatgaacatacagaatcgaaaggctgacgtgggtttcaggtttctctgggttgtggggcatcccatggccaagtactgaaactcttccttgaataactatctccagagtttgagccattgaggctcttggtgacaaagacaactgatatgcttggatccatcaaataacatatcagcaattcatgccccactgatagtagaaaagtgctgcaatcattttattctgaagagagcataaagatttacaccacatgtcaaggctagatgttgttctgccaccaggaaacttgctgtgtgagacacacaaaaaattaaacacctcaagaaatacagctttctggaaaacatcaatacctcttctttttattgttacatttttctaatgaatctttcactgcaacaacttatgcagagaagttatgtatcctggaattattctactttttgataaccatttttaaagctttatactttataaagctttttttattctcccaattcacttaagaatttgcaatatccacctcgaggttaacctgaaactcaatttcacagctaattccaactaaacgtcttctccagctttccagatgccatctaaccagttatattctcactgattcagcagcatattcaaagagacagagaagaactgacatgatgctgatgaagcttaaacttcagggtccctgttgcatgggccctcagagtgccaagagtccttgggagtccgtgttctagctgagaggaaacatgaagaggcatttctctgtaagcatttgtggcaaagagatcttgaaagaaagggaaccggccgggcgtggtggctcacgcctgtaaccccagaactttgggaggccgaggcgggcagatcacgaggtaaggagatcgagaccatcctggctaacacggtgaaaccccgtctctactaaaaatacaaaataaattagccaggcatggcggcgggcgcctgtagtcccagctacttgggaggctgaggcaggagaatggtgtgaacctgggaggcggagcttgcagtgagccgagattgcacccctgcacttcagcctgggcgacagagtaagactccatctcaaaaaaaaaaaaaagaaaaagaaagagaaccaaatcatttcactgaatcattttgaaataaatactcacctttgcatctaattttgtattcataatcttttcctctttttcttaaagaggacctcccaaattgtatgagcttccaactccactaaacctgagtctgcctgatacaagggaaggcatgtaaaaatacttcttagtttatactctccactgcgcaagttttcaatctataaaaaaactcctgatctttaaaaataaaaaataaaggttggggagagggtagtaaaaagttactttaaatgtatatttttaagaatgctgatttcattatgtattttccaataccaaaatataaaataaaatagaacctgcagaacttttggctctctgacatttctccccagtgacttaaaactttcagatgaatgggacatctgggttctgagaagaatggtgtattattactgctctccacaatagcaggcctaaatggatttttcatgtttagactagtaaacataaaaagcaaacctatctcacatgactgatacgtttgcctttaacaaaacaaccccggccaaaaattattagaaaacagatcagcagccccactggactctgaagcaatgtaattaggtagtccaacactacattttgtcaaaaaattctgacaacctaataaccagattgtcatcagatagacattaaaaaatgataccaggtttgctccagcattaaaataccaccactttctgggttttttttccttctgtaaaaataaaaattaaaaatctatcagtgatgcatcccattggtctggatggtgtttaaatgagtctgtgccacttgaaggatggcaaaggaagttttgttttgatttaaagtttaagaaagaattcttcttaggaccacctgcttaacgttaatcacgaaatccctatgtgttaagaggggtaattataaaatggaatgataataacaatagtaaccggcagttattgagtgtttagattgtgccaggcactgggtttcattctgttgaatgaaaccattactggactcccaacaaccttgatgagaggtgctactctcaccctcattttcagaggtggaagggaggcttatcaaggctaaagaatccacttgcacacccaacagaggccacctcatgctcttaacctctgcaatgtgttgctgagaaggtggttagtttggatttgacagggtgaggtggtgggcattggggataagaggtgttattttcaagaaaaccattacgtatgtggccttccagaatatagtaatctagtatgtagtctggcctgtaagccaaattttatgtatagtgtgacactgaagaaaaaaacgttgtaattataggttaattcacacagttaatgcaattaaatagaaaaaggtagaaaccttaagatatagccttaggttcaaatatactctagcctccatttaattagtcaattataaaaaattgtccactaacctgtacaagaataaacctcagggagtacatttctaagatgacctttggaaccctagtatctgaaaatcttaccattttatctattaggatataaatgagttatctggtataaatcactgtcaaatttgcacaaacaaatggtgtggctgacagtcagtaataattcaatgacaccaattttttccccaacatgaaaacaccccagattactcagtcagccatgccatggctagatttgcaaggcactataaagtttccaaagtatttgtccaccacgtgattttgtttgacatccacaagcctacattatttctttttctttttcttttttttttttttttttttgagacagagtctcactctgttgcccaggatggaatgcagcagtgcgatcttggctcactgcagcctctgcctccttgttcaagcaattctcctgtctcagcctcccaagtagctgggactacacacatgtgccaccatgcctggctaatttttgtatttttagtagagacggggtttcaccatgttggccagaatggtcttgatcccctaacctcgttatctgcccacctcggcctcccgaagtgctgggattacaggcatgagccaccatgcccagccaagcctacattatttcttaaacacaaaaagatcattccgaatttcacaaacaatgttgagcaaaatatgccacacacaaagaagcccataccgtatgattctatttattatataaaattagtccaggcacagtgacccacatctgtaatcccaacactttggtggctaaggtgagaggattgctcgagggcaggggttcaagaccagcctgggcaacaataatgagactctgtctcttataaaaaactaaattaaccaggtgtggtggtgcatacctgtggccctagctacttgggaggctaagacgggaggatcacctgagcccaggaagtcaaggctgctgtgagctataattgtgccactgcactccagtctgggtgacagagcaagaccctatctcaaaaaaaaaaaaaaaaaaaaaaaaaaccacccaaaaacacacacaaattcaaaaacatggtaaaaccaatcgcagatgagtcaagatagtgacagcctcagtggaagcaagcatggtagtgagtggaagatggcatcagagtgtcatgttctacctcttattctagatgctggttccttaggcatgatgactttgggaaaattcatcaagatgtacaacttggatttacaagtatacaaatcctatagcatgttatgcttctacagaaaattgacataaaacaaccattctctccctttcagtttgctaactagaccaagaagaaaagatacactgagaaagagggtgggcactctgaaaacactgagaagtttgactttacaaactattgagctactgacagtcttgttaaaacctcttagcgtgcctttccctcacggcatcaatttatatagcaattcactacattaattcttgtaatgaaagtgtgaggagatctgtagtcaatcataattgtgccctgcaaattccagaaaatgtttgctgggatgtaagcctctgatggctggctcagcaagtgatttagagcaatgtggtgaactttcataataacagctcattaacaattgcgtttaaaatgtaaacaattgatatgtttttagaaacaccagtactgattaggtttatttcactttacaggaagtcagaagataatatgctaagcagattttcctttcttccctctcaacgataaattcaataatagttaggttagacctagttttgttttcagtttccatgaatgagaaatgtgaagaccatgggggttccaactcagtctctcttctccagttttgtgtttaggaagcacagacttgaaatgtattttgcatgtcttccaagactaaataccgaggttatgtttgtgcagctgtctgaataaaactgatgctacctcaaaaaataagttgattcagtcacaaaaaagtaccaagcaaagtattaattgatttaattgccctgcttttatttaaagctagacaagaactatgggggagggaccttatcaatgatgttaacagatatatatgtatatgcccagcacctagccaaattatagaaagagcatgggaactgcttaatgatttgctttaccagtcaatctttatgtggagtggggcatagttaatgatagtaatcattttaggcctgagttcctttaaattatcaatttaatatttttattaaatatatgcatttcaagtacatttatctccgttgctttttcgactaaaaaataaagacaaggaattcaaatgtttggattattttccctcactcataccaaatacaaggaaagtaaacataatgaagttaaagtaatattcttagcttgacaaatcacatattggggacatgagaagcctaaattatctgaagtcaattaattgttctttgtcaacggaaagaagaatttagctcccaaactggataaaatcccagccaagtaatgaccaataatggcaataatagtaacattatatttttcctgtctcttgattatcaacaatcaagaggctatagcaaataaatatacaaatatatactgtgaaaacatcaatatttgtatctacaagaaggatgaaaaattaactttgtgtagtaatatccctccactgtatttaggaaaagacaatacaacagacctctaagaatgggtgttccttctggtacttgaaggaagcacacaaacaaatatattatggaactggtggggaaaaaaacagtcatccagaatcacagggctgaagagagcccaggatgtcacctggcctgtcatgtccagaatactaacaagtttcatttaattccagcatcacaggctgctctgatattccctgggttccctctcctggctctgcctaaagacagacccaaagaccaaaaaaatctaccatgtagtccaagtcgtctaatgctagcaagcccctgaatcttgccacatagggcccacttataattgcagtaacatgtctctttcctagcctaattactattcttggagaaaaatctctctttgttttgacaatttttcctatcccttagaaaaaatggttcaggaatagattctagtattatttttcatacatgaaataaatattctatttattctattacatttctgttctataagtgtatggttagatgactgttactattctttctggctactggacataccaagtctggtttaaatactctaaccagaattagtccatgccaacataagcatttaatgagaaaggatcctggggctacatgctccatagtcatgtgaaatcggatactctgaaggggaaataactttctctgaagtgtaaccattaactgaaagagaaagcttggtgtggtatgagtcatgggtaacatgggtgaatcacagtcctgatgggcaggtggccatctctgaagaggatttcagaaatgctctccccaccttgatcaattaaattctcttattaggatagaaaacattgtattccacggttaaagtatgaaatgcctacataaccagataaaatgacacaactgttccaaaagttcagttatttacatactcctttcatgatttgtataatatctatgagccagtgttctatattaatacaacatttctctttaaatcaactcaattctgccagtctaaattacctttttgaagaagacaattttatatccccactgtaaatatccaatgtcactggtatacatattgtatatagccaatatcacttgccataaatagaaggaaactgaaaagatttcatgtgactaaccaaaaatgtattcattcatctcatctcatgtaccacatggaatactgtaacaaactggtttaaattcatactagagagtaaatgaatgatagaattctcaacacccctccatcctgtcctattaatgagattaaaggttgagggaccaccaaaagaggtaggcagggccctgagaacctgaaggagcatgtattcaggatagggggtatggggggtggggttggatgtcacaagctatgagaagtaagggtacaaaagagcagacagtagcccacttcatgattatttatatctggggctgtccctgaatgtgtcatagaggaagtcctctgtactgtttgatttgaaggcccttctacttctatgcaccatctcttttagacatccacatctgagctcacaaattatccatcacaaagaaatcacatgctgttaataggtctcttcattgtggctgacagtgcaaaacaaatgccagtccctgtgctgagatacagatttctggaatactaactgggattcccaatgtggggagacacagtagtagaggtcactccaaggactcctggaacatgctcctgaattctgttgcttcttgccatacttgccacagagtgccgttatgttctagctctctctgggtatccttctctccaatcagattctcaattctctcatcatctttctattgctcttaatacctagctctcagcaaaacaagtgcccaatttatagaaaaagcgagtaagtgactctgaatgaatcaaccacaagtgaatgaatgaatgaaaacagatcagctttgcagaaagaagcacctgcttacctaaggtatatccccaaattatcccaacctcatctaaagttatcagggaacacagcacaaattcattagcatcctgctgccttttcagagaaatgacaggttcttctccccttgcctgatcaaaagatttgctgcactctctctcttaaaatgcctccttgttacaaactgtgcaatcttggtcaacttacctaacctctctgaacatctgttcccttacttgttaaatattgaagaacaatatctgccccatgaattgtgataaagattaaatgagagatttcaagaaaagtgactgtagtatatcaaaagccaaaaagccagctacatttttggaccagatcacaatgccatgataaatatcaatggaataatggtccacaatgtcacaccacatgctttcattctgctgtcctcatgacttccctgtttgccagcatcagggtttttcacgtttacaaagaaaatggagcaggttagcaggtctcggtggcattaatgggcaaagcatcatgggcaactgttgttcataaatgctccttctcaaatgtatcctgggttggtgatgaccacaattcatttccattttgaagcgccctccattttttacttctttctcagtctgaatctcctatacttgtaatactgacggagcttcgctagtttctaaatcagaaagatgagcacgtgcagccacaggaagagaaatctgggacctgatgcctataatatttttcagacagagaatattcccccagtgtctctacccaggagatagtaaactactctgacatttcagctgttgcccctccaagcagattcacacacctcttcggctaacatcccctttgggcaggcatctactcatgtttacagttattcattatgactggctatacacagacagtgcctctggtgtcaaactgaatggccccttagacccccattccaagacagccagaggatacagacatatattaaataagacacaggcaggaaaactgcactgacttccttgagatggggaggctgaagccaaccaaagctgacctgctagagagtcctccagagctccagtgtgggatgactcacagcaaggagcacgggatcaaaatttttgaggtgcttcagggtcagaaagttttccagaacagcttctgcggatgtctgtgaacaaatatgccagcaaggaaaaagaccaactattttgcaggggaatcatcttgaaccagaagggccagcatgcattctaagtgccagggcaagttcccaaccctctgagctagctcacatctattgtgattccacacatctctccatggaataatctgtccaagaacacacaagcagagaagtgcccttctccatctacaagcatctaaatgtagagtcatgagagaaggtgagaggcagtgacttcaagaggtggcctctagacctcagaatccactctaatgaacacgctgtgtttaaacaagggatctcacattttctcaaaaggcagttagacacattcacatacttaggagtgaatctaagaactctagaaagaacggcacatttccctactgacacagttgtattgaaaaatcaatctgtggctctaagggaaatgagaaaacacaactggtgatttctagcacggcatccaatcttcacttttgtgatccctcaattctcagttcaagtataaatagactttttcccccccacgaagtaggaaaaggattaagtaggcaggacattttctaagttctgtgtagcatatgttcataagctttccttttgtagcatttatggattcattctggagtagggttaagccggagcaaagcaatttggcatgcttgcaatttgctttatcaggagaagcaagcacagactgcagaggccacctcgacctgagcagcaaagaagcttcccagaaccctgagggagacactgattattttccttacagggatgctcaagctgagccaacctccttgcaaaatagtcaatgagcttcattcagattatcctcaggaaagcagtggccaagcagacacaagtgatcatcatcatacgaacttaatttctgaccaaattccacaatcacactgctcttcctgaagtcagtcaggcagtatctatactgctacacaaacctcagggtcagcattccaatccatcccagcctaaggatcccattcagcagcagaggtgcttttcaaatctgtacatccacttcggtactttctatccacatgagagaacacactgcagcaggagatgaggatgcagtaggataattcttaatgttcacaatataatgttgaatggaaaaagcagtatgtgccattttcttaaaatacatgcccacataaagaactaactgggaaaaaaacacccagaaatgtcacttggagtcatctctgggctgtaggattatacacaatttctattttcttctcttagctgaactggtttccaaatattctaaaatgcaaatgcattacttttataatagtaataaagtaattctaaagtgatttaaatatatagactgtgattctcaaaatgcaggagttaaagaaaaaaataaagacatagactgaaccttacaaaaaagatttttatccacaaaacaaagaagcattttcattaaaacaatataattaacctgcaccattaggaaagaactacatcatatttcacattcaattttgttattatcaccatcactacttcttaagcatctgctgtacacaatgccctgtagcgggtataagtactcaaaaataaaccaggtggtaactaagttatttacatcactgggactcttccagtgttattaaagttgaagaacttgaaaagcagcatttattaataacaggggcattaatccagctgcctgccctgtactccacttacccagagagtctctcccagtcctgccaagcaagattaagtagaattaagacggcagctaaccaggtagaccttgtgccctgggccacaggtgactctggcaagggtgggcgcctgacctacatcaaaccattcagattctttcccccaggaaggaggaatacagttagtctctatcatccccttgaatgaggcacagggagttgcacgggtagccatagctggctggatatgcaaagaagccagtctgcagacagaagaggtgagaggctatgaggatcctgagacagtctcctgctctttaggatgggatgctgagagatatgtttgtccatttacccatcccactctggttagtttttgagggtcaaccacttcctggcctaaggcttcaggaagctcaccatctaaccttttgtcaaatgagtaagctatcctgtggccttgtagaagcctcacctttcatcgtttttgtcactgtttcttttgtattggttcttgaaaacaaattatctctaagacatagttgcaagattcagaactctgaactctcttcacccactccttacaagctgaatccctcctcctgtccttcttttcagatcttaacttaaacgtcattaactctgaccgctccaaatgaggaggcctgctatgttttgcctcttgatgtttcctaaataagatttacataacttttaattgtatatgctttgttggtttactagttctgatctgtctccttccctagggcataaaataatctgcccgacccatgttccttgtacctcacacagcacattcctagcatattacagaagatcaatagtattgaatgcatcagtcagtcatgtaggtgagtgcatattcattcactcaatatacaaataatgattgagcacttgaaatctgcaaggcttagtcctttcttgataaggaactaaggaactaatgattcaaaaaggagattaggtacatatgcaaagacaagaacatagacacagcagacactgctgagggcctgtcacacagaaatttccctctttgacaaagaaggccattacaccatggtaaagggatgaattcaacaagaagagctaactatcctaaatatatatgcacccaatacaggagcacccagattcataaagcaagcccttagagacctataaagagatttagactcccacacaataataatgggagactttaaaaacccactgtcaacatcacacagatcaacgagacagaaagttaacaaggatatccaggaattgaactcagctctgcagcaagcggacctaatagacatctacagaactctccatcccaaatcaacagaatatacattcttttcagaaccacaccacacctattccaaaattgaccacatagttggaagtaaagctctcctcagcaaatgtaaaagaacagaaattagaagaaactgtctctcagaccacagtgcaatcaaactagaactgaggattaagaaactcactcaaaaccgctcaattacatggaaactgaacaacctgctcctgagtgactactgagtacatcacgaaatgaaggtagaaataaagatgttctttgaaaccaatgagaacaaagacacaacataccagaatctctgggacacattcaaagcagtgtggagagggaaatttacagcactaaatgcccataagacaaagcagaaaagatctaaaattgacaccctaacatcacaaattaaagaactagagaagcaagagcaaacacattcaaaagctagcagaaggcaagcaataactaagaccagagcagaactgaaggaaatagagacacaaaaaacccttcgaaaaattaatgaatccaggagctggttttttgaaaagatcaacaaaattgatagaccgctagcaagactaataaagaagaaaagagagaagaatcaaatagatgcagtaaaaaatgataaaggggatatcaccaccgatcccacggaaatacaaactaccatcagagaatactataaacacctctatgcaaataaactagaaaatctagaagaatttgataaattcccggacacatacaacctcccaagactaaaccagaaagaagttgaatctctgaatagaccaaaaacaggctctgaaattgaggcaataagtaatagcttaccaaccaaaaaaagtccaggaccagagggattcacagctgaattctaccagaggtacaaggaggagctagtaccagtccttctgaaactattccaatcaatagaaaaagagggaatcctccctaactcattttatgaggccagcatcatcctgataccaaagctgggcagagacacaacaaaaaaagagaattttagaccaatatccttgatgaacattgatgcaaaaatcctcaataaaatactggcaaaccgaatccagcagcacatcaaaaagcttatccaccatgatcaagtgggcttcatccctgggatacaaggctggttcaatacactcaaatcaataaatgtaatccagcatataaacagaaccaaagacaaaaaccacatgattatctcaatagatgcagaaaaggcctttgacaaaattcaacaacccttcatgctaaaaactctcaaaaaatgaggtattgatgggacatatctcaaaataataagagctatctatgacaaacccacagtcaatatcatactgaatgggcaaaaactggaagcattccctttgaaaactggcacaagacagggatgccctctcttaccactcctattcaacacagtgttggaatttctggccagggcgatcaggcaggagaaggaaataaagggtattgaattaggaaaagaggaagtcaaactgtccctgtttgccgatgacatgaatgtatatctagaaaatcccaacgtctcagcccaaaatctccttaagctgataggtaacttcggctaagtctcaggatacaaaatcaacgtgcaaaaatcacaagcattcttatacaccaataacagacaaacagagagccaaatcatgagtgaactcccattcacaattgcttcaaagagaataaaatacctaggaatccaacttacaagagatgggaaggacctcttgaaggagaactacaaaccactgctcagtgaaataaaagaggatacaaacaaatggaagaacattccatgcccatgggtaggaagaatcaatatggtgaaaatggccatactgcccaaggtaatttgtagattcaatgccatccccatcaagctaccaatgactttcttcacagaattggaataaactactttaaagttcatatggaaccaaaaacgaccccgcatcaccaagtcaatcctaagccaaaagaacaaagctggaggcatcacgctacctgacttcaaactatactacaaggctacagtaaccaaaacagcatggtactggtaccaaaacagagacatagatcaatggaacagaacagagccctcagaaataatgccacatatctacaactatctgatctttgacaaacctgagaaaaacaagcaatggggaaaggattccctatttaataaatggtgctgggaaaactggctagccatatgtagaaagctgaaactggatcccttccttacaccttatacaaaagttaattcaagatggattaaagacttaaatgttagacctaaaaccataaaaaccctagaagaaaacctaggcaataccattcaggacataggcatgggcaaggacttcatgtctaaaacaccaaaagcaatggcaacaaaagacaaaattgacaaatgggatctaattaaactaaagcacttctgcacagcaaaagaaactaccatcagagtgaacaggcaacctacagaatgggagaaaatttttgcaatctactcatctgacaaagggctaatatgccaaatctacaatgaactcaaacaaatttacaagaaaaaaacaaccccatcaacaagtgggtgaaggatatgaacagacacttctcaaaagaagacatttatgcagccaaaagacacatgaaaaaatgctcatcatcactggccatcagagacatgcaaatcaaaaccacaatgagataccatctcacaccaggtagcatggcgatcattaaaaagtcaggaaacaacaggtgctagagaggatgtggagaaataggaacactgttacactgttggtgggactgtaaactagttcaaccattgtggaagtcagtgtggtgattcctcagggatctagaactagaattaccatttgacccagccatctcattactgggtatatactaaaaggattataaatcatgctgctataaagacacatgcatacgtatgtttattgtggcactattcacaatagcaaagacttggaaccgacccaaatgcccaacaatgattgactggattaagaaaatgtggcatatatacaccatggaatactatgcagccataaaaaatgatgagttcatgtcctttgtagggacatggatgaagctggaaaccatcattctcagcaaactatcacaaggacaaaacaccaaacaccgcatgttctcattcatagctgggaattgaacaatgagaacacatggacacaggaaggggaacatcacccactggggcttgttgtggggtggggggagggaagagggatagcattaggagatacacctaatgctaaatgacgagttaatgggggcagcacaccaacatggcacatgtatacatatgtaacaaacctgcacattgcgtacatgtaccctaaaacttaaagtataataaaaaaaaaataaaataaaaaaagaaattttcctgtttcacctcacaggtaaagccctgtgctggttaattttctgtgtcaactcaactgggccatggggtgcccaaactaaatattatttctggatgtgtctgtgagggtgtttctgggtgagattagcatttaaacagaaggccatcacccagtttgttgaacagaagaaaaggaggagaatggagaaatttgccctgtttctgcttcactgtgtgagctgggatacatgatctcatctttgccggccctcagactgggattatgccattggctcccttggttctcaggccttaggacttggactgaattacaccaccggctttcctgggtctccagcttgcagacagcacatcatggaacttctcagcttccagaatcacataagccaatacctcacaataagtaaataaaccaataaataaccttttggttctgtttctctgaagaatcctgactagtataagccccagttttattagggtggcctccctccataaagctatgtactcaagggaaggtgagattatcccagaaaagagataaaacccgattagtttaaaacagggaaagggttaacagctgctctgatatccctttagctccaagggcagctgggcagacccagagcagccagagaccccacacccatgccctacacacacacatcagccactccagctgtgagcagcctcttctgattgcttaacatgccggccaaattgtattttctatgtgcaccataacaagaacaaagttgggaagcaccaatctaagccaccagggatgagccccattccgcgtgccagtgtctgatttaggaaggagcatgggactgcaatcaactaaatgagacttaaggggaagtcagctcaggggttacaggaacagttccttgcttttaaaaagggacatataagaacagatattttattttgccagtggatgttgccatgtctgcctgtagctcccaaaaaggaaccagccatcttagaactatgaaggcagccagtctaagaactaagtcaacacactgaagatggcacaggaaaaagagcaagaaatagacactttggtaacaatgttgagccactgaattaacaaaacttgaaactgcacccctcccaggaggtcttattccctgagataattcatttctcttattctgatgggtttttatttggtggattttcaaatgtaacttggtagagcaattcacaaaataattgacagtgcttagcaatctgtcaatagctgagtgctcaaaatcctctccctgctacacagtgacaaccatcaaaggcaccctggtgggtccccagttgcttggcaaaagtggattgcagttagattccagacatttggagccaggattctataatgccttcccatcaatcatgacatccctggggcagcaggtagacttgcagagggcagggagcttttttcttttaattcccctattgtttgaaccatttcaagttgactttttgattatttgcagccaaaggcatcttcggtgataaatccatcttcacataattagcagcaaatttatgtggcctcctttgagcaaagactcaggagaaaatgatgcagagattcataattccacccacattccccaaaatctttagatgatgggtcttcagtgaattctctctacaaaaaaaaagacaactgagatgccagaaaaaggattaatcatgtgatcatctgacacttatcatgggagtcataaagtaccacacaaatggtgaggcatcaccttgtctcagtgttgaattaggggcagcataattttaaaatatcaatttgtactctttgttatccctcctgtgtatactgttccctttcgcatctcaaaaacttcaagactttgccttcttccctttgtctcccagacatattcaaacgcaaaagatgctaaaagacaaccaccaatcccctaaatccagtctccattaaagacttttctttttcaaaaaagcctaaattcattgaagggaatgtgttacatcccagcagaaaggtccaaaataaagacaatttgggttgttttgttttgcttaaaagtgttgttctttgatctgtttaggtgggcacttggagtacagtaaggattgggctttcctggtattggagagaagctggagcagttccttaaagtagtggacgctggcaccctgcttcctggcagaactctagagaggtgacaggacttttgatcgggatagtgatgggatactgggaaaatgactaccaaggccttgaagccacagcgaaaatcccagccttctttgcacagatacaacaggactacccaacaatgcatggacaagaagcctctcatggtgaccagagtggactaaagttcagggggcctttttaaaaatgttttatgctataacagacctgcagcatttttgcatcaatgaccttaagtgagcagacactccaaacaccacttagaacttcccaacatttagagaaaaaaaaagtaaccagttatgcatgtatgcatgcttgcaattcatgcagcattcaaaacaatttttcagaatgaaatctttaaatcagagtgcacactcagtttgtatttttagttgatttgacacatcatgagcaaccacaggattccacaataccaggccaagttcccactgtagggatggaaaggtgtgatacctttcctcacctctcacaagagtcacagccaacattcctataacaaaagacaggtcagcaagagaaaagcataacaaatgtatttaatcaaagttttatgtgacatagcagccttccgaaatgaagacccaaagactaaaggaaaatagtttttatgcttaggttcagtgaagaatgcacagctgtgtagaaatgtggtagaacaaaaggggtgtgttctactggaaatagaaaatagattggcggtggtgggggtggtggtggggatcagcaaggcctgactattcagattcttattggcctctctgtgtaacgttctttcttcccagtatggagcagggcctctatggaatgaggatcttcaaaggagaaggaagagagtgacttttctaggtttaatggcttgctgtggggaagagacattctagtttctatgacccaccttagggaagaggaattctggtttatacgacttgcttaaggggaggaagagaagtaggagacagtattatgggagactgccacaaagaccttggttctgagggctttccaatgtatttccttcagttcaaagtactcaggatgctaaggtaccatactttgggggattgggttctaagacccgacaccactagttatttaatattttccttcctgcaaatcctgctaccttaaaaaaaaggaaaactaactgtacaacaggtagttctgtagctaatgagcattattaaatattttcaaaacattccaataaaaggcaataccaaacggcttttatcctaatactttctaaataacgccacattcatttatgaggaattgcatttccctcaatgttctgggcattaatgaagattgaatataaataaaagaattgccttatatgtatagcactttaaagagttgagattcccaaataatacaaaagcattttcaagtcacacatggtatgtaaagtgaaaatgttcttgaaggaaatatcctctaataatacttacctacttcagagggtgatgggaagctctattaacaccaaaagaacacttttagatcttcaaataaaagcactatacaaatgcaaagtattattattatagttctgaaataatttcacacctagggatgagaaaaccccaggccaaattttattgcttctctcatacgtgataaacaagaaatgccataagcaaggggcgaggggggtggttagtggggggtgtgatagtgggggaagtggaaatcaaacagaacaaagacttcaaagtttctctttcactaggactttgtatttgcccagatgtcatttagggaactctcagggaagaaagaaaaaaaaaagtcccttaaaggtcagagttaagtacagggacaaagttctcattgcttttgtaccagataaagcaacaaccggctgagctgaaaaaaaataagcttgtctacttctatgggacataatttctcccaaagcacttctcaaaaaaaaagaaaaaaaaatggccagatgaattattactgaatcacccactagtgtgatgatctcacctatgaagtcaaaaggtagctgctttaacagacaccaggatttctagtcaattactgagagcactgagcaagacatgttattgctgatggtagtggtggtgatgatgatgaagatgataatgatgttgatgatcatgattgtgatgatggtaattacggtaatgataggatatggaacagaagttctcaaacctgctgatcaatggaatcacccctagagctttttacaatacagatttttggttctccacctcagccccactgattttgaatctctgaagatagaactcagaaattttttttaagtagccatcaggataactgaagtgacagtatttgtaagtaatataatgattaagaatgcaggctctgtgaacagactggctggtgtcttctcccagttctaacacttactagctatgtgaccttggaaaaaatacttagccttaagtctcaatttctacaactataaaatggaaatactaatatgacccacctatgaaattgacatgctattactacctaccttataaggtagatgcctaaagtaggcaaatttttttaaaagcacatattaattccaagaaagacaaaaaattttatattaaagaaaacataacaaataccattcggcttagcaacagaaaaaaattacgtaatcatgataatgtaaatattacctgttgatttaaataaaaattgtaatataactatgtcaggaggctgtggggaccagaagtggtaagagtggaaaggatcagagagctattgctaaaattgataaattaggaaaaaataatataagtacattatttagaaagagagaggtgaacaccagaaatatcagaatagaaagttgctaattctgggaagcaatccagagagaggtagaaagaaggcatagatgttgcagtttttaaatatttgctatttaatgctgttttatttaaacaatgtagatacactgctttgataaaaataaaaataaaatgtaaaaggtaatttgtaatgcatataagtacaatatggtatttctttatacactgaggctactataaagcttttcaatttaccaaaacttgcttttaaaaaaaaaagatataatatctccaactatgcaatcaaaatgtccatttcttaaaagtgtacaataaagacttactttttacctggcacactctaaatcctaaaaagatatttgctgaattgggctgaggatggtggaaaaatatataaagaacaaagttcctttgtacaatcaaggtcacagcaggaaggagatgacatcttcacctggggtgaaggcagggttaagggaagaccactaagggatggtctagtgtgctggacttagcaaaaattccattaacactccagactcaaaggggaaaagggaagaggcagttaccagacagtagaaaaagctgtagccgctgaagagaggcccccaaccggaactgtggccttccttagagggatacagccattgccaacccacaatgctgcagggaagaaagtagggaagaatatttcaacctcgtgttcccaggtcttcatccagttccttcccctggctaatacaacagaaagccagcaaacaagggagcccagagaatgcctgcgatagaggttaggcccatggtgcagagccatttagaagagagaggagctggaagcacaaatgtgaatacccagcacaagcactatacaaggtggttgttgctgttgtcgttgttgttgttgtttaatctgtctctttttcctactcagcctcctaaaacaagcccctcaaattttcatctgtttaagaaatattcatggcatgatagtaataaactgatgttatgcatttgttaaaatttactaagcactttcatatatattgtcttcatgtgatcctcaaaacagccctgtgcaataaatagggcaaaagttatcctcattttacaggtgaggaacctcagatcttaaagaaagttaggaatcttgcacagagtcacaaagctagcaaatggcagagccaaaactagaaggaatgtttcctaataccccagctaaggctcttccttccatataatactgtcatgctatttattcacagtaggagtgcaaaattgatatacctgttaaaaaaaaattaacaagttttgttctaggcactgcacagagcacagaagtagtcaacaaataagacacaaggggaaatagagaaaacttgcccattccattctcattctacattccacaagcaatgccagaactggaagtaattgagttttcaatcacattttacacatcattgaaaagaaggtgctcagtagggtaagaacagtgttcaaatgagaaataaaaattcagggaaaagtagacaaatgtctaaagaatatacctgttgtgtttggggttgctgggggtaaaccgaagaaaatctcagtcccttaacaatccccatgacacaaagagaccagggccccagaaattgggagggatgacttctccgcttctcttctcatttccagctctacgcccacatacatacaccttctttgagagctaagagaagcagccaagagtgacttttctgtaccaaacacaggagtactgggaagttcagcaaaataacccatttttgagagtctaataaagaactctgtactttttgtaatctactgcaaaacactgagctacttacacatgatgaaagaaagtaatgagtggcattttaattgtaaacctccaaacataccatatttattccagatctagctcactaatgaatagactatactatcaatgagggttctgtagttgcaagcagaagaaacaaattggctaatttaagaattattggaaggatactggagtctcagccaatccatggcagaatggaaaataaggtttggaggccatgactactagccaagacagacatggaggcaacagtggtctcatagtacatgttggcagatcagaatgcccacctaggacaagggagaatcctttagctaaagaatcaaattccaaagaaggagcatttacttagccaagcttgtggtcatacacccatccataggcagggtgcaggcccctgagtagggcccctggttacagttccactagcctaattacctcaaaaagaaataaagatgctgttaggaaggaaaaacatacacgacagaaaaaaaaaattggtgggggggttccctctatactaccaaggctttctttaaaaattcttgaagaagctaactagcagtagactcttaatttctcaagactattaactagtaattgatgacaaccaaggaaggtagttttcctaatacctacaaaacttcagcctaataacttttcacttccagaggcctcacttcctgtattacctgaaagttaccttttcatttgattcctaaggaccaagcagaattttcccttctttggtagcaacatgcttattttagaaatattatcctgaagcttctaaaaagaatagacttataaaaatgtataatgaataaattcataaagatgctgttgctgctgctgccgccgccgatgatgatgatgatgatgatgatgatgatgatgatgatgatattaataagagcagtggcagctcacatctactgagcacttatcatgggccaggacttctaagtccttgacacagaatacttcatttaattctccacacctacatgaagccaaaaacagtattatccccacttcacagatcaggaaactgagactctaagagggtgaataagttgtccgcagtccaacagctagtaaaagccaaatcatgactaaacccatgtctgattccagagtaccaattcaacaaaagattttcattgagaataaagaaaatggactgtgcctgtgtggaaacattccccaagaggaaaggaagcaccatatctgtgccaaaagattacaaagttgttaagatggctacatcaccaccaaatccaattattcatgagcatttatttctaaaagctatcaagtatttctttattccaagatgtggctcaatggtccagagacatgtagttgtatggccaaaaataagaattatctactgcttaagatagtaatttcttcactgatgttcaacaattatggcaaaattccaagccaaccagttttcatgcaccagagtttagttgccccaaagcaaatcctaagaaaagaggatttttttataactcatatttttattatctaaaaggggttttctccaatatccctgtaaaattcttctttgccctccaaataaacatgaaaaattcagccccagaaatagatttgtcaagaagttaggaagaacttaaagtacatggtaaatcaaaatggcttttcaactttaactaaagtggtcatagtaataattgctgcaataaaaatgacagaaaaaaaccctaaaagtatcaaaaatgtaatttatgatgaaaacaaatgtaaaattatagcatatttcaccctggccaccaaagactcttgatgaaaccgcagccctataattgcccagaatgaattctttaaattaaaatacttcatgcagaacagaaattaaacaatgaatcaaagaacaaagctgtacagaggtatgctcataaatatacctagcaaagaggaaacaattacatttttccatgtaaaaaccaacttgattgtaatgtttcacaagagaccgagtaggtacttttcccattgcttcaagcttggaagttcatttcctgtaattcatttagggctcagagtgactgggtggaatgaaattagatacaccaaattcagtggctcttttctttctacaaaactggctcttccatgcaactgcacaactgactttcacaataaatttcattcaacccaattgaaatgccactctgcattttattttaaatgctttatttggccagctagttttatttaactattggccagaagtggtacaagtgcattctttttccatctagcattaatcttagtaaacttagctccattggaatgtcttagctgctgagaagaaagcaaaagtcagcaagcatacaattgcatttgtctactctcaacacatcattttatttcctcctgctctctgctaactattgctcagcacttttgcctaagagggaggacaagcaggtggttaaggaagttgtcctgtcagctatatctttagtccaagtgtttaaatctctgaataaaagaaaaatcaatgttgtaaaggcaatgtttgtcaaggccatgtaataaatacacttacctttacagactgttctcagtggatttctcttctttcctgagcttcaaagctacaaagacataaaaatgaaagacagagttgtctgtgagtacaacaacaaacattttctccccatgtctctaaatagaatttccatatgccatggtatatggtgctagccaaataaaccattgataaaacttgtgcctcatacctcccgcacaagaggccaaaaaaagacagtcagaaactgaaaatggtgcacacatctacccagaattgaagcacacaaaccttggccaaatctacagtcaaatcttttggagtgtgtactcctcaacagaatgggaacggcttatagcgagatgaaaatcaaattaaacatgagtgtgacatactcagtctgactaagcattttattttcttatttctttttgtcatctttcttgcatgctctatttccatttctctgaaaaagtttcacttagggatgcctattccatttatatgacatgcatggtccttctaatataaacctcaccacttgctccgtaagtatatgtgtgcatgattacagggacaatcacccttcctgtatgtagactgcagccttctctcggaagaaactcacaaaacagaggaagccacaacttgacatttcaaatcaaatcttgttaacttcagctctctgtgatcaaaacataaatactatgcactgaccacacacaaatcaatgtgacaaaagatctgcaaaagcaacagtaataacttacagtatcgtgaagctggttctttaatcatccaatcttactcataaggtgcctctacagtcaccagtaatgggaatatgattctttctctcatttttggctaggtcctaacatctccgaaaggtgcagtagttggggatagacagctacaccacagcttttccatggttctttttttttccttcaatatctgaagggattgttttagcttttactgggctgtttccctccacatccctctattccatcaaagaatgcattaccactgatgcatgaccaccaaagaacaggtcagacttacgggctaagatgtaaatttcagactattaatgcaggaggtaggtcccttctatgggacagcatcagaaatttctccttccccctgagctacaccgtttaccaatgagtttagaacaagcagagtttggagaatattagataaaatagtgtaatattgcatttgtgaaatctaagagatgaataatctgataacatggagattgagctgaatccctttccacttcaaacacagaaatgctaaacaaaatacaataatgacttaaaatacatatatgtgtgtgtatgtgtgtatatatatgtgtgtgtatgtatatacatatgtgcatatatatacacacacatgtacaaatatacatacacatgtgtatatatatacctacatatatatacacgcacatagatacacacacacacacacacacacacgcacatacacacacatatatagccaagcccaaaagaaagagaaaaagccgtctgggaagtgagaagcgcctctgctcagccgccaaccatctgggaagtgaggagcccctctgcccggctggccaactgactgggagtgaggagcgcctctgcccggccgcccaactatctgggaagtgaggggcccctctgcctggccgctgccctgtccgggaagtgaggagcgcctctgctcggcagccgccctgtctgggaagtgaggagtgcctctgcccggctgcccaaccatctgggaagtgaggagcgcctctgcccggacgctgtgcaaccttccaagtgtgaagtgacagccttgtgtgtgatcttttctgttcttccccaagtttgcatttttgacattaaagtttactttttcgttaaaaaaaaaaaaagagagagagaaagccaatataaaaatatatggatgtagagtttctagaatgaaagacatgagtcctctggaaaaagtataacaatatctcaaaaagataaataaaagcaaatgcatactttcatatatcagaatgaaaccacagaacgcagagataaaaataaaatcttaaagtcaaccagagagggaaaaaaaagagacttctagcaaaagaacatgtcattagcaaaaatgaaagtaaagcaacagtgcggacactgtgtctcacgcctgtaatcccagcactttgggacaccaaggcaggcagataacctgaagtcaggagtttgagaccagcctggccaacgtggtgaaaccttgtctctactaaaaatacaggccgggcgcggtggctcactcctgtaatcccagcactttgggaggccgaggcaggcagatcacgaggtcaggagatcgagaccatcctggctaatatggtgaaaccccatctctactaaaaatacaaaaaattagatgggtgtggtaccaggcgcctgtagtcccagctacttgggaggctgaggcaggagaatggtgtgaacctgggaggcggggcttgcagtgagcagagatcgcaccactgcactccagcctgggcaacagagcgagactccgtctcaaaaaaaaaaaaaaaaaaaattagctgggcgtggtggtgggcacctgtaatcccagctactcaggaggctgaggcaggagaatagcttgaacccaggaggcagaggttgcagtgagctgaaattgcaccattgcactccagcctgggcaacaagagagaaactttttctcaaaaaaaaaaaaagaaaaattatatgcccatgctaaacctaacattcaagaatgatagagaacaatagataaatcagaacatttttcaaaaaaaaaattgtttagtgctcacagtagtttacttttgccaaaagaaatactaaaataagatatgcttgaataagcgggaatttatcccagaaggaagcagtgagaaacaagaagcaatagtaaacagagaaattagtaagcatgatggtaaatctggtaactttaataataagtaatgggtattgattaataattattaagctctacttgtaaaaaaacaaaacaaaacaatttttagcatttgccaataaagtgaaactgagtggtttatcacaatcatatggaataaagaagggggtaataaattgtttacaaggaggagagaaatactacttaaggcattaaagatatgcactaaaactactgattaacttgttaaggataaccagcatttctttctctgtctatataagcaaagaggcccttacacatgtactcacagagatttgtacaatgtttacattctacaaatgtattgccaggatggcaaaaaatacagaaaacaacccaaacatctatcagcaatacgataaacactttttttacatattcttagaatggagtattatataactttggaaaatcagtgaaagttacccacatcaacatagatacctctcaaaatataatgtaaaacaaaagaagcaagtcacagaaagctatacatattattctatttgtataacattcaaaaaggcaaaaataaatactgtgttgtttttgaatataaagtataagtggtacaaaacaaaataaagaaagggaagaaatttacacagaattcaggctatctttatcttgagagtgggagaggagatggaatacgtgagaggaatgggggggcttctggaatatggtaatgatctgtttcttggcctagaaagaggtatctggacaatcagtttattattttctttaaactgtatatgtacacttgcacaaattattttgcatgtaggctctatttccgaattttaaaacatacaagagtaaccaccaaaagaacagaaatttccaaatcaatagaggaaacaacatagagtaaacgcaatcgattctctatacaacattgaaatggaagggagaaagaagcaaaggaaaacacgctgaatagaatataaaaaagaaaatattttaactaagtccagctgtgtcaggaatcagggtaagtacatctgttaaaattttatcaaaacgaatgttttaaaatcttgctatgtgttgtttataagaaacaaatttaaacataagttttgaaaagaaaagtgtggataagtacacaccacggaaataggaaccaaaaaaaagctgacggaataagttattgttaggcatgacgaaagttagcaataatagaagagaaagtatttatattctttttttaaaattttattattattatactttaagttttagggtacatgtgcacaacgtgcaagtttgttacatatgtatacatgtgccatgttggtgtgctgcacccattaactcatcatctagcattaggtatatctcctaatgccatcccacccaccccccgccccacaacaatccccagtgtgtgatgttctccttcctgtgtccatgtgttctcattgttcaattcccacctatgagtgagaacatgcgctgtttggtgttttgtccttgtgatagtttgcagagaatgatggtttccagcttcatccatgtccctacaaaggacatgaactcatcattttttatggctgcatagtattccatggtgtatatgtgccacattttcttaatccagtctatcattgttggacatttgggtcggttccaagtctttgctattgtgaatagtgccacaataaacatacgtgtgcatgtgtctttatagcagcatgatttataatccttttagtatatacccagtaatgagatggctgagtcaaatggtatatctagttctagatccctgaggaatcgccacactgacttccacaatggttgaactagtttacagtcccaccaacagggtaaaagtgttcctatttctccacatcctctccagcacctgttgtttcctgacattttaatgattgccattctaactggtgtgagatggtatctcattgtggttttgatttgcatgtctctgatggccagtgatggtgagcattttttcatgtgtcttttggctgcgtaaatgtcttcttttgagaagtgtctgttcttatccttttcccactttttgatggggttgtttttgtcttgtaaatttatttgagttcattgtagattcgggatattagccctttgtcagatgagtagattgcaaaaattttctcccattctgtaggttgcctgttcactctgatggtagtttcttttgctgtgcagaagtgctttagtttaattagatcccatttgtcaattttgtcttttaatgccattgcttttggtgttttagacatgaagtccttgcccatgcctatgtcctgaatggtattgcctaggttttcttctagggtttttatggttttaggtctaacatttaagtctttaatccatcttgaattaacttttgtataaggtgtaaggaagggatccagtttcagctttctacatatggctgccagttttcccagcaccatttattaaatagggaatcctttccccattgcttgtttttctcaggtttgtcaaagatcagatagttgtagatatgtggcattatttctgagggctctgttctgttccattgatctatatctctgttttggtaccagtaccatgctgttttggttactgtagccttgtagtatagtttgaagtcaggtagtgtgatgcctccagctctgttcttttggcttaggattgacttggtgatgcaggctcttttttggttccatatgaactttaaagtagttttttccaattctgtgaagaaagtcattggtagcttcatggggatggcattgaatctataaattaccttgggcattatggccattttgacaatattgattcttcctacccatgggcatggaatgttcttccatttgtttgtatcctcttttatttcattgagcagtggtttgtagttctccttgaagaggtccttcccctcccttgtaagatggattcctaggtattttattctctttgaagcagttgtgaatgggagttcactcatgatttcactctctgtttgtctgttattggtgtaaaggaatgcttgtgatttttgcacattgattttgtatcctgagactttcctgaagttgcttatcagcttaaggagattttgggctgagacgatggggttttctagatatacaatcatgtcatctgcaaacagggacaatttgacttcctcttttcctaattcaataccctttattttcttctcctgcctgattgccctggacagaacttccaacactatattgaataggagtggtgagagagggcatccctgtcttgtgccagttttcaaagggaatgcctctagtttttgtccattcagtatgatattggctgtgggtttgtcatagatagctcttattattttgagatatgacccatcaatacctaatttattgagagtttttagcatgaagagttgttgaattttgtcaaaggccttttctgcatctattgagataatcatgtggtttttgtctttggttctgtttatatgctggattacgttaattgatttgcatatgttcaaccagccttgcatcccagggatgaaacccacttgatcatggtggataagctttttgatgtgctgctggattcggtttgccagtattttattgagggtttctgcattgatgttcatcagggatattgatctaaaattctctttttttgttgtgtctctgcccagctttggtatcaggatgatgctggcctcataaaatgagttagggaggatttcctctttttctattgactggaatagtttcagaagaactggtaccagctcctccttgtacctctggtagaattcagctgtgaatccatctggtcctggactttttttggttggtaagctattacttattgcctcaatttcagagcctgttattggtctattcagagattcaacttctttctggtttagtcttgggagggtgtatgtgtctgggaatttatcaaattcttctagattttctagtttatttgcatagaggtgttcctagtattctctgatggtagtttgtatttctgtgggatcggtgttgatatcccctttatcatttttattgtgtctatttgattcttctctcttttcttcttcattagtcttgctagaggtctatcaattttgttgatcttttcaaaaaaccagctcctggattcattaattttttgaagggttttttgtgtctctatttccttcagttctgctctgattttcattatttcttgccttctgctagtgttgagtgttgctcttgcttctctagttcttttaattgtgatgttagggtggcacttttagatctttcctgctttcttttgtgggcatttagtgctataaatttccctctatacactgctttgaatgggtccaagagattctggtatgttgtgtctttgttctcgttggtttcaaagaacatctttatttctgccttcatttcgttatgtaccccatagtcactcaggagcaggttgttcagtttccatgtaattgagtggttttgagtgagtttcttaatcctgagttctagtttgattgcactgtggtctgagagacagtttcttctaatttctgttcttttacatttgctgaggagtgctttacttccaactatgtggtcaatttcagaataggtgtggtgtggtgctgaaaaaaatgtatattctgttgatatggggtggagagttctctagatgtctattaggtccgcttggtgcagagctgagttcaattcctggatatccttgttaactttctgtcttgttgatctgctaatgttgacagtggggtattaaagtctcccattattattgtgtgggagtctaagtctctttgtaggtcactcaggacttgctttatgaatctgggtgctcctgtattgggtgcatatatatttaggatagttagctcttctcattgaattgatccctttaccattatgcaatggccttctttgtctcttttgatctttgttggtttaaagactgttttatcagtgactaggattgcaaaccctgcctttttttttgttttccatttgcttggtagatcttcctccatccctttattttgagcctatgtgtgtctctgtacatgacatgggtttcctgaatacagcacactgatgggtcttgactctttatccaatttgccaatctgtgtcttttaattggagcatttagtccatttacatttaaggttaatattcttatgtgtgaatctgatcctgtcattatgatgttagctggttatttcgctcattagttgatgtggtttcttcctagccttgatggtctttaaaatttggcatgtttttgcagtggctggtactggttgttcctttccatgtttagtgcttccttcaggggctcttttagggctggcctggtggtgagaaaatctctcagcatttgcttgtctgtaaaggattttatttctccttcacttatgaagcttagtttggctggatatgaaatgctgggttgaaaattctttcctttaagaatgttgaatattggcccccactctcttctggcttgtagagtttctgccgagagatccgctgttagtctgatgggcttccctttgtgggtaacccgacctttctctctggctgcccttaaaattttttacttcatttcaactttggtgaatctgacaatgaagtgtcttggagttgctcttcttgaggagtatctttctggcattctctgtatttcctaaatctgaatgttggcctgccttgctagattggggaagttctcctgaatgatatcctgcagagtgttttccaacttggttccattctccccgtcactttcaggtacaccaatcagacatagatttggtcttttcacatagtcccatatttcttggaggctttgtttgtttctttttattattttttttctaaacttctcttctcgcttcatttcattcgtcttccatcattgataccctttcttccagttgatcgcatcggctactgaggcttgtgcgttcgtcacgtggttctcgtgccttggttttcagctccatcaagtcctttaaggacttctgtgcattggttattctagttagccattcatctaattttttttcaaggtttttaacttctttgccattggttcgaacttcctcctttagctcggagtagtttgatcatctgaagccttctactcttgactcatcaaagtcattctccatccagctttgttccattgctggtgaggagctgcgttcctttggaggaggagaggcactctgatttttagagtttccagtttttctgctctgttttttccccatctttgtggttttatctacctttggtctttgatgatggtgacgtacagatgggtttttggtgtggatgtcctttctgtttgttagttttccttctaacagtcaggatgctcagctgcaggtctgttggagtttcctgggggtccactccagactctgtgtgcctgggtatcagcagccgtggctgcagaacagcggatattgatgaaccgcaaatgctactgcttgatcgttcaagttttgtctcagaggagtacccggccgtgtgaggtgttagaacgcccctagtgcggggtacctcccagttaggctactcgggggtcagggacccacttgaggaggcagtctgcccattctcagatctcaagctgcgtgctgggagaaccactactctcttcaaagctgtcagacagggacatttaagtctgcagaggttactgctgccttttgtttgtctgtgcccggcccccagaggtggagcctacagaggcagacaggcctccttgagctgtggtgggatccacccagagcgagcttcctggtctctttgtttacctactcaagccttggcaatggcaggcgcccctcccccagcctcgctgccgccttgcagtttgatctcagactgctgtgctagcaatgagtgaggctccgtgggcgtagggccctccgagccatgtgcggtatataatctcctggtgtgccgtttgttaatcctgctggaaaagtgcagtattacggtgggagtgacctgattttccaggtgccatctgtcacccctctcttttactaggaaagggaattcactgaccccttgcgcttcccggataaggcaatgcctcgccctgcttcggctcacacacagtgcgctgcacccactgtcctgcacccactgtattgcactccccagtgagatgaacctggtacctcagttggaaatgcagaaatcacccatcttctgtgtcgctcacactgggagctgtagactggaactgttcctattcggtcatcttggctccatcccccgttttttattgacatataacaaattatccaaaaactagatatttaaaaataaaagtggtggctggcagccaagatggccgaatagaaacagctccggtctacagctcccagcatgagcaatgcagaagaagggtgatttctgcatttccatctgaggtaccaggttcatctcactagggagtgccagacagtgggcgcaggacagtggttgcagagcaccgtgcacaagccgaagcagggtgaggcattgcctcactcgggaagtgcaaggggtcagagatctccctttcctagtcaaagaaaggggtgacagacggcacctggaaaatagggtcactcccaccctaatactgcacttttccgatgggcttaagaaacggcgcaccagaagattatatcccacacctggctcgaagggtcctatgcccacggagtctcgctgattgctagcacagcagtctgagatcaaactgcaaggcagcagcgaggctgggggaggggcgcccgccattgcccaggcttgcttaggtaaacaaagctgccaggaagcatgaactgggtagagcccaccacatctcaaggaggcctgcctgcctctgtgggctccacctctgggggcagggcacagacaaacaaaaagacagcagtaacctctgcagacttcaatgtccctgtctgacagctttgaagagagcagtggttctcccagcacgcagccagagatctgagaatggggagactgcctcctcaagtaggtccctgacccctgacccccgagcagcctaactgggaggcacccccaagtaggggctgactgacacctcacacggccgggtactcctctgagacaaaacttccagaggaacgatcagacagcagcattcgcggttcacgaaaatccgctgttctgcagccactgctgctgatacccaggcaaacagagtctggagtggacctctagcaaactccaacagtcctgcagctgagggtcctgtctcgtagaaggaaaactaacaaacagaaaggacatccacaccaaaaatctgtacataaccatcatgaaagaccaaaagtagataaaaccacaaagatgggaaaaaacagagcagaaaaactggaaactctaaaaagcagagcgcttctcctcctccaaaggaacgcagttcctcaccagcaacggaataaagctggatggaaaatgactttgacaagttgagagaagaaggcttcagacgatcaaactactccgagctaaaggaggaaattcaaaccaaagacaaagaagttaaaaactttgaaaaaaatttagacgattgtataactagaataaccaatacagagaagtgcttaaaggagctgatggagctgaaagccaaggcacgagaactacgtgaagaatgcagaagcctcaggagccgatgcgatcaactggaagaaagggtatcaatgatggaagatgaaatgaatgaaatgaagcaagaagagaagtttagagaaaaaataataaaaagaaacaaacaaagcctccaagaaatatgggactatgtgaaaacaccaaatctacgtctgattggtgtacctgaaagtgatggggagaatggaaccaagttggaaaacactctgcaggatattatccaggagaacttccccaatctagcaaggcaggccaacattcagcttcaggaaatacagagaacgccacaaagatactcctcgagaagggcaactccaagacacataattgtcagattcaccaaagttgaaatgaaggaaaaaatgttaagggcagccagacagaaaggtcgggttacccacaaagggaagcctatcagactaacagcggatatctcggcagaaattctacaagccagaagagagtggaggaggcccatattcaacattcttaaaggaaagaattttcaacccagcatttcatatccagccaaactaagcttcataagtgaaggagaaataaaatcctttacagacaagcaaatgctgagagattttctcaccaccaggcctgccctaaaagagctcctgaaggaagcactaaacatggaaaggaacaaccagtaccagccactgcaaaatcatgccaaattgtaaagaccatcaaggctaggaagaaactgcatcaactaacgagcaaaataaccagctaacatcataatgacaggatcaaattcacacataacaatattaactttaaatgtaaatggactaaatgttccaattaaaagacacagactggcaaattggataaagagtcaagacccatcagtgtgctgtattcaggaaacccatctcacatgcagagacaaacataggctcaaaataaagggatggaggaagatctacccagcaaatggaaaacaaaaaaaggcaggggttgcagtcctactctctgataaaacagtctttaaaccaacaaagatcaaaagagagaaagaaggccattacgtaatggtaaagggatcaattcaacaagtagagctaactatcctaaatatatatgcatccaatacaggagcacccagattcataaagcaagtcctgagtgacctacaaagagacttagactcccacacaataagaatgggagactttaacaacccactgtcaacattagacagatcaacaagacagaaagttaacaaggatatccaggtattgaactcagctctgcaccaagcagacctaatagacatctacagaactctgcatcccaaaacaacagaacatacatttttttcagcaccacaccacacctattccaaaattgaccacatagttggaagtaaagctctcctgagcaaatgtaaaagaacagaaattataacaaattgtctctcagaccacagtgcaatcaaactagaactcaggattaagaatctcactcaaaaccgctcaattacatggaaactgaacaacctgctcctgaatgactactgggtacataacgaaatgaaggcagaaataaagatgttctttgaaaccaacgagaacaaagacacaacataccagaatctctgggacccattcaaagcagtgtatagagggaaatttatagcactaaatgcccacaaaagaaagcaggaaagatccaaaattgacaccctaacatcacaattacaagaactagaaaagcaagagcaaacgcattcaaaagctagcaaaaggcaagaaataactaaaatcagagcagaactgaaggaaatagagacacaaaaaacccttcaaaaaattaatgaatccaggagctggttttttgaaaggatcaacaaaattgacagacagctagcaagactaataaagaagaaaagagagaagaatcaaatagacgcagtaaaaaatgataaaggggatatcaccaccaatcccatagaaatacaaactaccatcagagaatactacaaacacctctgcacaaataaactagaaaatctagaagaaatggataaattcctcgacacatacaccctcccaagactaaagcaggaagaagttggatctctgaatagaccaatgacaggctctgaaattgtggcaataatcaatagcttaccaaccaaaaagagtccaggaccagatggattcacagccgaattctaccagaggtacaaggaggaactggtaccattccttctgaaactattccaatcaatagaaaaagagggaatcctccctaactcattttatgaggccagcatcatcctgataccaaagcctggcagagacacaaccaaaagagagaattttagaccaatatccttgatgaacattgatgcaaatatcctcaataaaatactggcaaaccgaatccagcagcacatcacaaagcttatccaccatgatcaagtgggcttcatccctgggatgcaaggctggtccaatgtatgcaaatcagtaaatgtaatccagcatataaacagagccaaagacaaaaaccacatgattacctcaatagatgcagaaaaggcctttgacaaaattcaacaactcttcatgctaaaaactctcaatgaattaggtattgatgggacatatctcaaaataataagagctatctatgacaaacccacagccaatatcatactgaatgggcaaaaactggaagcattccctttgaaaactggcacaagacagggatgccctctctcaccactcctattcaacatagtgttggaagttctggccagggcaatcaggcaggagaaggaaataaagggcattcaattaggaaaagaggaagtggacaaattgtccctgtttgcagatgacatgattgtatatctagaaaaccccatcacctcagcccaaaatctccttaagctgataagcagcttcagcaaagtctcaggatacaaaatcaatgtacaaaaatcacaagcattcttatacaccaataacagacaaacagaaagcctcatcatgagtgaactcccattcacaattgctcctaggaatccaacttacaagggacatgaaggacctcttcaaggagaactacaaaccactgctcaatgaaataaaagacgatacaaacaaatggaagaacattctatgctcatgggtaggaagaatcaatatcatgaaaatggccatactgcccaaggtaatttatagattcaatgccatccccatcaagctaccaatgactttcttcacagaattggaataaactactttaaagttcatatggaaccaaaaaagagcccgcatcaccaagtcaatcctaagccaaaagaataaagctggaggcatcactctacctgacttcaaactatactacaaggctacagtaaccaaaacagcatggtactggtagcaaaacagagatatagatcaatggaacagtacagagccctcagaaataatgccgcatatctgcaactatgtgatctttgacaaacctgacaaaaacaagcaatggggaaaggattccctatttaataaatggtgctgggaaaactagctagccatatgtagaaagctgaaactggatcccttccttacatcttatacaaattaattcaagatgcattaaagacttaaacattagacctaaaaccataaaaaccctagaagaaaacctaggcattaccattcaggacataggcatgggcaaggacttcatgtctaaaacaccaaaagcaatggcaacaaaagccaaaattgacaaatgggatctaattaaactcaagagcttctgcacagcaaaagaaactaccatcagagtgaacaggcaacctacagaatcggagaaaatgtttgcaacctactcatttgacaaagggctaatatcccgaatctacaatgaactcaaataaatttacaagacaaaaacaaacaaccccatcaacaagtgggcgaaggacatgaagagacacttctcaaaagaagacatttatgcagccaaaaaacacatgaaaaaatgctcaccatcactggccatgagagaaatgcaaatcaaaaccacaatgagataccatgttacaccagttagaatggcaatcattaaaaagtcaggaaacaacaggtgctggaaaggttgtggagaaataggaacacttttacactgttggtgggactgtaaactagttcaaccattgtggaagtcagtgtggcgattcctcagggatctagaactagaaataccatttgacccagccatgccattactgcgtatatacccaaaggactataaatcatgctgctataaagacacatgcacacgtatgtttattgcagcactattcacaatagcaaagacttggaaccgacccaaatgtccaacaatgacagactggattaagaaaatgtggcacatatataccatggaatactatgcatccataaaaaatgatgagttcatgtcctttgtagggacatggatgaaattggaaatcatcattctcagtaaactatcgcaaggacaaaaaaccaaacaccgcatgttctcactcataggtgggaattgagcaatgagaacacatggacacaggaaggggaatatcacactctggggactgttgtggggtagggggaggggggagggatagcattaggagatatgcctaatgctaaatgatgagttaatgagtgcagcacaccagcatggcagatgtataaatatgtgactaacctgcacgttgtgcacatgtaccctaaaacttaaagtataataataataaaataaaaaaataaaaataaaagtaagaatttattatctctcacggtttctacggatcaagaatcctggcagggttcagcaggatggcttttctgtatgctacaaagcctgaggcttccgctagcagacttgaaagttaggggctggaatcatctgatatctcatgccctcaaatatctaagctaggggctgggatcatctgaagactcatgccctcacatatctgccagttgttgctcagggttagctgagaccacagctagagctagcagctggaatatgtccatgtggcctctccatgtggcttgagtctcctcacaacatggtggctgagttccaaagacgagttctgagagaagctgtattttttatgacctaggctcagaaatcacataacaccatttacactgcactccactggtcaggtcagtcacaaacccccacccagactaaaagaaagagaacaacagccttgccgccctcaatgagggagtgtctgttacactgtaagaagagcacaggattggataaatgtgctgatgtgatcacctttggaaaatacaatctgccacaacattctttacaagcacatatgaaacataagcaaaaattaaacatatagtaggcctgaaagtagtttcaatgaatatcaaacaatagatatcaaaggtttcttattataatgcattaaagttggaaaagaattactaaatatgatttttaaaatatgtttgaaaattacaattttatgacagtttccctttgtgaattgggattagacaaggaccttaactaaatcccactggatgaaggtccacatctggagtcaaaagagatcactaatttggttgtggatacattgaatttgaagtgccttagagacatctaaaggaaaatatccaggtaagcagttgggtagatgggactgtagctaagaggggaggtctgagagtggtaagttatctgtaagtaggaagtaactgcagttgtgaatatggatgtgactgtccagggagtcagtataagtagaaagacaaaagggcctaggactgatccgtgagcaagttcaacatctaacagttgtgttgaggaggatgaatcctacataagagagagaacagttgccagagaagtaaaactaaatcctcaagattcacagaaaggtcaagcaatataaatactaaaaaaagcccaataggaaggtcatcgaggaactcagcaggaactgttttgtggactgatggaggcagaattcagtttggagttggttaagacagaagtggaagtcattaaacaaagacaatgagtaaagacaatcctagataagcttggctgtgactggggaggaaagagtggcaactaaaggacaaagggctggaagacggtttgtttgtatagtttttaaacagaaaaaaggccgagtatgtatcaaggtaatggagaagatctatttaagatgcagagtgagtgtagaagagaaagggtaaccagtactgaaggttcctgagaaggttgaaagggacaggtggtaggactggttttaaactgagctttggcctcaccgtaatcatatagtgtcttatgataggaacccatgctattgtcttaatgcactactttatcgtgtgtttatgttttctcaccctaattagaatctaagctctataaaatgtatggcctttattgttcaaaccaaccccaccttactcacacattgaaaaccccagattctatcccagcacccaacagtcattcaataaacactcatgtgtcacttagtaatgggagtatattctgagaaatgcacccataggtgattttgtcattgtgcaaacatcactgcatgtacttacacaaacctagaaagtgtagcccactatacacttatcctatatggtatagcctattgctcctaggttacagacctgtaaagcatgttactgtcctaaatgctgtaagtaattataacacgatgataagtatttgtgtatctaaacatctaaacatataaaaggtatggtaaaaatatagtattataatattatggaaccatggtcctatttgcagtccatcattgactgaaatgacattatgtggcacacaaccatacttgttgaataaactaatacaagcagattctatcatctttgtgtacatctttgtgtaaatctaaaaatgtgtgtgtgtgtgtgtgtgtgtgtgtgtgtgtgtgtttgtgtgtgtcctggctatccaaaatgcgagcaagtcagaacccaaaagttcttgttccagagtatagatatctagacaatagtcaggaatagccactcaaattagccctctctttcccatgttttccttgacctaaaaatccaaggatctaaactacaggccatgaaaacattttcacctacagttacaatattataccacttcccactttcctcatgcctaattcgtccatattttgttctagagcagacaaactctgtatccttcatttgacctcctgcaagacataaattaaatttaaatgaatccaaatactttgggcttcagttctcctaaaagaaataaacatggaagtagagcagtacaggccagtaacacactgatttatcttgctgatttttcagaggatagccctccaaaaaatctttacaaacctcaagcctctcaatccatggatccaaaccccagctcccttaaaaataggtctgaatttaaacaaatatctttccgaaatatagaaacctgctttgatggtgactcatcttatcccagtagaaacctttctctgggtaccatccaactgcaccattcttaaggcaacattacctggaactgagggatttgcctctattgttgcattctgcagccctcacctgacttaactgccacgttaaggaattggttattgacctttaagtctttaacaattatttacatacctaggaaagagtctgtgcattcaggtacaagaatgaagacaccgaataaattcagccctcgttttcatttttatgctacgttcagtgagctgttactgcagacaaattattgcagcattctttcaaatgatagccaattttcaactaagagaagattcttaaacccctttctaaaaccttttcctgcatatcggtgaaaaccaggcagttggaaaacacagccctggttaaaccacataataataaattaatactttaaacacatggaattatttaagaatctgcataataatttaaaccctcataagacatagcagcaaaggccccaaaaacctaacacttctcagatatattcctagaagttttatttcaatttatatgtatgcatttcttacagaatattttcagaatttctgaaactcagatacatttagagtccagggaggtgaccagaataattcttacttttgttatttacctggggagctaatcaatattgttaaaatgtaggtgaaagtctttctatttgaccataagttcagcaataatacggaccacatctgtcttgttctatattaaatctacatcttctagaacactgtctggcacatatactccgtaaaatttctttaataaaagaatattataagttttcactattactaggaatgaaaattgattgcaaattattaaggaaaggttagttttgagttttgttcttggttttcattcattctcttaatttgtaccccatgctttcacaaaacaataagttatctctctactgaagcctacccttctatggcctgagacacatacacacaacacgacatgcccttgccacatctattcaatgctgtcatatttgccatgcatcagaaaaataaatttaccaagtagcagaagctctggaaaatcattaggtgacatctgaggagcagaataccaatcagccaataattagcatctgaaaattcatagagtcacagacaaatcaaattccatgaaatctcagggagcttggctccctgaccctggctgggttggtgcccaggcaatgggtaagcagtaaattgtgccaccccaacaggactggaaggtgccatggctagtctaaccccagggggagacattctgacaatgtggcatttgcacagggatgccctaacatggccccagtatgttttctcagaacgggatgacattttaagtcaaatagctctgttcccaatagcacaggtcctctcccaaactctaatagcctgaatttgagaaaaagaggttcatcttggggagaaactgatgttttgcagatgcaatattaaaacaatccatttataaggaaggcaaaaccagatattcagtgtttaacttcatttattacctttccatcattacatagacctcagatagccttagacttaaaaagtcattcacatttaagcaaaactctgttcctggagcatctacactggatacttttcaatgaatgctgaaactggttataaagttgtgctaccaagaggcatgaagagtgactgtcagtaccttaccaaacccctgctgactggaacatgcaagtcagtccaaggatgcagggccaccactgttactgctgcctccagcctaactaaggtcacctttcctgcatgcctgcctcattctaaaggaagaaaacagagaggttggagaataccagctccccatttggtttctacagttgccaactctacccacatgtgacttggggaaagcacccttaagaagagtggggtccaacgtccaaccagactgacccagccttgggggtaaacattccacctccaccacgtggcctgtgtgcacctgatttgaatctgctcctaccctgagccaagggtgaccattctgccaggtccccactccactgcagggtcaggcagcagcctctgctcctggctcctggcccagtgctcggatggcccagcaacgtcactgcggagagggagtctggttgtgccctcctctgaactctccatctggaagactctctagtctccttccctctcatttttaatctgacagacactgcggacagggaaactcagagcagaccaaagttcatcttccctttcctgcttcatggctggcataatcacaggggcagaacaaggttggcatggaccaggatgccaggaattaaatgagggtccctgaccactggaacacattagtcctgccttccaaagtcttaattagtcttcctgtgcctggcacacctaccaccagggaggtggccgggtaaggtgccatgctcacagcaagtattcaacaaaatattggtagagaatggcggtcacaaatgcctgctggctcatggctttgcaacaacagtcagctctgaggtctgggcaccagcggcaagatttctgctctctttactaatgcagacagttctagcagcgttattctgagtgatattcagccaccagctcaatttggaagcaaaatgatcttaacaaacagtggcagacttgatagacaggctgctgagcctggggaccaaaacaaaggatgaaaagaaaaagaaaggaagggttgatgacaagacgaggagtgggaaatgaatactgcaaagaaaaatgaggaggattacagtactagatacttcagtccggcaactctgaaatgagctgtgaacataacaacagactcaagggtggaaacaatggggggaatcaaggcaacggaacagggcagcatctgtcacgaattttgatgctgggacagacttagcgctagcagtggaatagatttgatagtaagtaatatttgagaggtttcaaaagacaatgggtcttaattctgtcctgttttgcacctcttgaactacagtgacataccaaaatttgctatttttctaagaggacattgacagatacaatgaaaattgtgaatacattttttccttctgcattcattatctctggcccttatccacaggcctattgcagactaaattggattttggatcactggtactgaggtgctgcaattaattaacaatagaaacataatatttatatccaggcctaacaacatctgacatttaaactattctgccagtcggacaaattccattcgacaaattttcattttaatgaacatgacagaccacagtttgcatgataggccaagcagcagaacagagttgacctcttggcatgtgttttcaaggactgaccatgctccagaagaaacaatctgagaaactgtcagaataacagaaagaccagatccccagttccacccagacagaccaaatacataccaccctcatgtcccccagcacagatcctagtatgaaactgtcctcatttcatgtgcgagctcaaagttaaatacttactgccccttgtaatccactggataatttttctatctttgggttgctgacattttctttggggtactgaagtcccttagcccttcctaattaaaaagtgataaacatttttgcaaggcatccaataatgtgcaaagtacacaagagttggaactgatgcagctttttcagttggcacaaaactggccttccacattttgccagatggtgtatctcagtaagtccccaatccctgactcgagtgaggggcattgtcaatatgatgctgaagcagagactatctttaaatgctatcttattttgcattatactaacacgatgggtctaacacttattcttgctgaaactttcacagctaaagaagttttcattcttctgtgactcattattcaagccaacagaatatgatacagataaggggaaaaattctgcccctcttaagaaccatataaatttgctggaaaccaatgtcagagagcagatctcccagcaagacttcccattgctcctctatgggttactggtccaaagcacactgggtgaaatagtatgtatttacccaagcccatctctactaccccaaaaacgtggatgtcaaggatagagataaagatgaaaaatgcaaagacagcaaggcagatagaagcttaatagatctgggaaataagtaaggtcagtgaaaaacaatatattgtagctgggatccctaagggccgtatagttctagttcacatatctacaacattccttattctagtttttatgtcaattcaaaagaactgaaataaaattccactttaaaagtaatacttctttggagtagggatttggttcatgggttccaatctcagcaactgaaatgactacctacatggtaatttgttttcaagctgtggctctgactagacccaaaatggtaaccatgcttatgttactattttattttattttattttattttattgacatggaatctcattcttatcgcccaggctggaatgcaacgatatgatctcggctcactctgcctcccgggttcaagcaattctcctgcctcagcctcccaagtagctgggaccacgggcacatgccaccacacccagctaatttttttatttttaatagagacggggtttcaccatgttggccaggctggtcttgtactcctgacatcagctgatccacccgccttggcctcccatagtgctgggattacaggcatgagccaccacatccagctcatgttacttttagatatggccatgataccagaacattaagcactgaaaggatgacagcatttccaccagtgtaacctaatttagaatcaataatgtgtcactcaaatcggcagcatgtacatatatacatacagtgtggatggacacacacacacacatatatatatacatacattaattatagtaatagccacatgtttgaggtttttacatgcatcttctcttatataacaccatgagataagtactattatgaactctgtaacacactgaggaaagggcagttacagttcactgacctccttaagaggtaaagtcaaggtcacaggcatgtaagcggcagagtttaagtgcaaatccaagtctgcccttcctccagagcctgtgctctacacaacacagtggcatatgacagcatccgcaagggaaacagcatgaaggaattgattccttttggcaacagtcaaaatatcttttaaatatcaggtataaaacattttcagaccaccagatgcttattcaattttgaaaaatcaatttttatggagttgctatgagtagtttcatgtttgttaatgcctggttatattcttgaaaaagtagcggcctcatagagaaaaatatatatatttttttgaaagttgggaagaaaaatgagaccttaactggattaaattgaaaatatttgacagaacacaaatgaatagaatctgtaactttaacatgcctttgcaggaggcatgttctaaaatggtcataccaaattcagaacacaatagacttaacatgcttcttgttgtaaacaaaggcattgggttaaatgaaagttccatcaaagcttaataaccaattcaagtgaacacaaagttaagcgttatatactttctgcggtttcagtaatagctaatctaataatggtaaatggagggttattgttgattcctttgcctgtttcataaattagataaagcaacgtggaagttagagtactttagagttttattggactaagtgattttaaagctatctcaaaatataacgaagtcatgacttgaatgactgctgagttgtagcttgttttccatcaccatgttagtacttttcaccagtgttaaataaaaagcttcctgttaactaaaacaattctataaatacaatgtctatctacagaaccaaaccatttaaggtaaagtgtcattgatacagtatgatctgatattctatttcaccagggccaagcttataaaatattaactataagagcagtcaagtgttatttatttcttctgatacaaaactcaggaacagtagaatttctctgcttaatgattttccatagcacatttccaattttctactacagtttattgatctggaatactaaaacagttttcttccctgtctaaagaacacaaaaagccctgtgcccctagtcccatgggatgtgcctccaaagataacagtcgtggcatctcatcaggcgctgaggggtggtaatgagaagcaaggcattttccttactgaaagaaggtgctagtcaaatctcaggccttttgataacgggaaacacttcccaagcctttgcatttggagatgaggctccacacctgcagttctgagagcagatgagttgcccttcacaaaggcagtctattttcctgcatttccccttcatgccctgatatggttactttcaattaccctgatagtccaggaagaaaaatatccctctctccatatttcattcacataataagaatctgcaagctgttctgtatgacagatgaggactgtgtgctgaagcaacttgttccgcctgtcagcctccgagaacccacagcaatgagatacaatcgtgatgacattactagagaagaagtgggtcaaatacatggtcactttaaaacagaatgtcaaccattctttctacttcagtaatttgatgcagtggtactcaaaacacagacagagagagagaaaaggaaagagagagagaaagagaaaaaagttcaccactattagtttagtgtccatacatacacaaatgcaaatgcaaataattgttaaaattactgttcccatatacccttacatgacttttttcatcctccagccaattagtcaagaaatgtttagtaagcatgtggtatgagccagacactgaaatgggtagaatgctgaaaacagacacagcccctgccctcttagagtttacagtctaggataaaggacaaagattaacaagcaattgagattaatgtaatgaagcctgaaaaaaaacgaagtagaaggtactaaaagagcttacaatataagaactaaccaagtctttcaggtcagtaaaggtttctctgaggaagagacatttaagttaaggtcagaagtattagagcagccagataagaggtgagagagaagagtgacaagtggaggacttttctcctcagaatgtttcctttcaaagaaaccattaagacaaaggcctcaggacacagtagaagatataatggagtaaatgacgccatcaagtctaccattgggacttattgtctttccttatttcaatccctagtttagaaaattaatttttaaaaaaaatttttaaacattagtatacctctgtcctatcttgccacataagggcaaaagttaatcataatcacattttcttgctgatctaaatattaaggtagattttactttaaaaaatctaatttatcttgactgtactggttaaaatccatgggttatttttaaaaatatgttttgacagcagtgaaacttgcagcacatacaataccaagagcataaatttgttcagggtataagtacatgaaaattaatataagcagttggtaaatgtgacttataaaaaaaaagactgtaccaactacatgccacaatgggtggaaataaagaagaaaaaggttctttttctctaatatttggtcatgaaaattctgatttgttcttgcagaaaattgtttttggatcattattcatctctcttacagcatagaacttttttccatgggatcaacaaattggaatggagaggaaaaaccggatatattcatgagtatgtttgccctttctactaaagcccgagtgtgatgttcggattattttctttccaaactcaaaatccattcccagaatccaaaatcaataaaaatggtactagcaaaactgagggttgaatttggcctaaaaactcaatgactaagtagagctactaatatgaggagaggtttttaaaaaaatgtctgtagttattaatcaccagcaatgactttagcagctgctctaaagtaaacacaatctacagctactttaaagcaatacagtgtaaaaaccatgagaattaacattctactgggtgaaaggtggcagaatatgccaccccaaaatataccacattggcataagaattattttcaagctaaaggcacttataaaaaaataatttaaaaaaaaaaacagcaggtgcaagaagggttttctgaccctcttctttttcttcataaaagcaagagctaaaatccctgtatggaaaatattctcctgacaccagaaggaaagtaacattcttatcatcaagggcgggatactgagaccaagagaactctgtacaaacaaaccttattaaactagctcttattttcctcgtcacctctccacccagttaaatatcctggcccaaggccctttgccttgtcacatcttcacaatttactactctttatccaattccatatataagtgttcaattctaacttcatctttgggtcttcatttccttatgagggctcccatgtcacaaaaaaacttacattaaataaatttgtatgcttttcttctattaatctgccttgtatcaatttaatttttaagcccagccaaaaaccctaagaaggtaggggtgaaattttgcttcccctacatctgttacttaggtcttatctagagttcaacctgaaaggcatattttaggaggaatattggccaaactggaaaatatctccaagaggacaactagaatggtgagaggttctgaacttcacataagaaacctggggatgttcagcctggagaaaagcaatgggagacagcaaaactaccttcatacattcgatgggtcattcatcaataaggccattccgttttactgagcacttcctctatacaaggtaccatgcaaggcaaaggagatacagcactgagagagaaagccagtcttttcttaccatgcggaagggaaaatggattttctccatgtcacttcacaagatactgtagagtagagcagagcacagattttggaatcagagcactagagtaaaaacctgtactgggttgaatgccattccccacccctccaatatgtctgtgtcaaatccctggagcctgcaaatattactttattagaaaaaaaagtctttgcaaatataattaagaatcttgagatgagatcatactggattgtctgggtgagctctaaatataatgatcagtgttcttacaaaagaaaggcagatgcagacagacagaaaagaagaagatatagaagagaaggccaaatgaagcaaacagttatgtgggtgcaagccaaagaatgcttggggccaccagaagctagaagaggcaaggaagttttctcccctagagcctgttgagggagcatggccctgccaacaccttgattttggacttctggcttccaggactgtgaggaaataaatttctgttgttttaagccaccaaatttgtagcaattggttacaatagctctagaaaactaatataactcccaattacttagctagctgtagtaccttactagctgtgttacccattgctaataactctagccctctgagaaccaggccctcattaggaaactggagacaatagaaatactcatctcacaggtcagagattaaggaggtatgtcaaacgtgcagcacagggcctagaacaaagtaagttttcagtacataatagtgttattattaatggattcagatttactgggaagcttgtgtagaccttagaacaatatatcaacaggtgtaataacagctaatttatgcagtagggctctctctactggtaaatatatgtagagaccagataaatcattttccagaaatactggaaaagggatgtttatattgtttgggaggctggaataaacatccactagccttccttctagatcaacccagtaaccatttctccttggtgcatcaggtcaagatccttaggcaggttaacccagtaagggaagtgaggtatacacagggtttggctgctaccttaaaaagtcccttcccctcgctgtaccttgttgtctttagctataaaataagcatattctgatcatgtcttagtatttccaacttgaaaatgccaagacacaatgagaaagacttggatcaatgagatagtttgggtatttgtccccccaaatctcatgttgaattataattcccagtgtcagaggtggagcctagtgagaggtaattggatgatgggggtggatttttcatgaatggtttagcactatcctcttggtgctgtcctcataatagtgagtgagttcttgtgagatctggttgtgcaaaggtgtatggcacctccccttactatcctcttgctcctgcttttgccatatgacatgcctgctcccattttgtcttctgccatgagtaaaagctccctgaagcctcccccaaaatggagcagatgccagcaccatgcttgtacagcctgaagatctgtgagccaattaaatctctatttttttaataaattactgagtctcctgtatttctttatagcaatgcaagaatggcctaatatcatcacacacttaaattttctgattctcagaaatgaagcaattagactagagtaaggattgctaaggaccagttgacaaaccaggaccaaaccataatattgtttttaaccagtacctagcaaaatgagaaaaatttaaaaaataataattttttaaatgtctttgcttggcagaattaaaagttagcaatcctatgtcagctcccatcctatctcacttcctaattcaaaaattatgtttacagcctctgaaattctaaagttttggaactggtatatcacagaacaatctattaaatttgattcctacactaatattctgtgatttttttaaaggacatttcagaactgtggattctatcactgacgtgttcaagttcaagaataagaagtcatccttttagaatttaaaaatactcactggtaaaatcatatagaactaaatgttcacaacagtaaaatggaaaaatctaaataaaatgagtcgctagtaaatatgatgctatagttttacaaaatgttatcatgaagagaaattgggtaacgcataggcatgaatctctctatactagttcttacaactgcatgtgaatctagaactatctaaataaaaatttcagttaaaaaatactcactgggttgtgtgcaatggctcatgcctgaaaccccattttggaaggccaaggtgggaggatcccttgagtccaggcatttgaaaccagcctggacaacataataagaccccatttctacaaaaagtttaaaaaaaattgctaggtgtggtggtgggcacctatggttccagctactcgggaggctgaggtgaaaggacctcttgagtccagaagttcaaggtggagccatgatcatgccactgcattccagcctgggcaaaagagtgagtctcggtctcttacggaaaaaaaaaaaaaatgctcactgggctctaaaagttcttaatgttgtttattaattcaaacaatggtcagattcaaactcaataaatataatcaactgtgctttatacatagcatatggacagttactatgaaccatttgtttggcaaagatgtactgaggatcttctatattccaggcactatgctaggtactagagtctggtggccaactcagttcttcccttcacagagagtaacacctagctggagaaaaaggcaataaataaagagacaacttcaaattgtaacaagtgctatggaaaaaagaaaggctgaggcagaaaacacagggagggataaggaactacatgagccatacatatggaaaatgaaactgtgatgcaggaatgtgcccttattttttgtatgcctatattattgaactggcataaattctgaataatgaaaatatgtgcttgggttgtgactgtggtgggctcttaaaggtaggctctgcccttctgcaccaataaaaggagtgagaaaaaaaaagtaaagttgacatttgcctttaacaaataaggcaatacaagactgtccatatgtaaaagttaaacatacaatgggggccgggcatggtggctcatgcctgtaatcccagcactttgagaagccaaggctggtggatcacttgaggccaggagttcgagaccagcctggccaacatggcgaaaccctgtctctacaaaaaaaaatacaaaaatcatccagacaccatggtgtacacctgtaatcccagcttcttgggaggctgaggcacgagaatcgcttgaaccagggaggtggaggttgcagtgagctgagatcttgccactgcacttcagcctgagggacagagcaagaccttgtctcaaaagaaaaaagaaaaaacgtattccataaacatacaatggacacagcactctgtgagatgaaattctttaaaaggtatgtgagtcataatttcccatatatgcccaccaccccttggaggaggaggggttggctctctacctaaactagaagataaaactctctcataatcaaagacaggggaggaccagggaggtcttcaagaggagaaacatacctttgaaattctctcccttcttagaagattcagaatatttcaaatactgcaaagtatgccctgggagccagtcaaaatatgtagtaggccagaccacaggactaggaaattaagatacagctgcctgctcctattaggcctaggtgcagggccagaatattaaggttaacttgggcccagtttggctgaaaagacacaggcttcaaataagactggacaggagagcaggtaaataaatagaatattcacataatggaacattatataacagtcaaaccaaataaagcaaggtacagaacaatgtgtattgtacaatatctttatataagaaaggaaggaaaataacgtacatacatatttgcctgtgtgctaataaaagtggctactaccttaagggagatgggtacaaagatgagggtatgagaagaggagcaagaacaaaatttcactttatacctttttatattgttttgtaaaaataaagagctaaaagattataattctcattgctggtgttagtcacacatttggagagggcaattcggtggtatacatccaggtccttaaaactggcatatccctagacccagaaattccacttttgaaaggaagttatctaagaaaataataagagatttgtgtacacacacacacacacattcactgcagaattatttatcatagttaagaaaatttttttaatctacatgtaaaataataaagaaccagtgaaggaaattatgggccatctaaacaatccagtaacatgcaactgtcaaaaactacactgtaaaacatataccgtagaatactcagtggcacagaaaagtattcatagtatattttttaaatcattcattaatttttcaataccttctttagagcatctaccaggtactaggcactgagctaaatgctgatttaaaaggccagttacaaaacagtatataaatggacaattccattttttgtgcatctgtgcatttataactagactagaaggatagacaccaatatgagagtagtgattacctgagtggcaagattatgggtgaaatatattttctataatgaacatatattatttctgcaatatgagaaaaaagcaccacttttttaatcaggctaacaactcccaggatcaagaatgtgtctcattcatctctctgtcctctcaccccctcctgactccctgaatacaaacatgatgcttgcttcagctgcagcaattctgtggccattatggaaaggccaagaactgcaagatacactctccttgacatctctgagctgctgaactaaagccaaagctaaccatttctagacttctttttatgtggaagaaacaaacctctattctttttaagcaggttacttgcagctgaaagcatttgaagctgacatagtaacctattaaataatacatgacacattaaggccagtacaggcaacccagcaaatttctttgatcaaccagcagaaactgaagactgatgtggttaattgccccactagcttctggctctgtattctcttctctgaagctcctgggaagtagagcccaggagaagctgttagtgaggattcgagatccataggggagcactgcttgctgcaaagaaaaaccaggcagctactcctacagctttacaacgtggcccagcattcccactcctggaaatgtctcctaagaaaaaatcatgaatgtgattatgcacacgtgcaaatacatcagaaaaaatggtgaggaaaacctatatgttgaccaagtgggatagattaaaaaataatgtcatgttctaacagtggaatactctgtagacattaatgccatgggaaaatgcatacaatatattgacgagtgaaaacagaaaacaaaactgtatgtaaagtattatccaaatttagaaaaatgtgtccattttctgttagaaaactaacagaacaaatatgcatgcaataaaaacaatggaaaaaaagccacacactgaaatattgatagtgctatcatgaatgggtgaaatgcaatgttattttattttttgagtatttctatatttttttaaatcttccaaatttattttcttgtgcagttggtaagaaaatttcttctaaatagcaccttcttacagaatattctgggccctccgaccaagatgttcaattcatccacaccaactttgtctaatacctgcctgcagatccaatggagttaacaagaaacaatttatttttgtgttttaaaaatagacatggcaacagctgtaagctaagctacagaaaatgataaagaaattttatttccaaataaatttgcattgtataaatgcagtacattttctttaattccataaggttttgatactgctaatttgagaaaaatattgatgtttccttaaataagtctaatttgtattgaaattcatcccctcacttgaaatggaatgatcttgaaaacaataaaaatgaatgttaatttgctatgtcattgataaaagcaattccttttatatccttgtccttatccattagacttcattttacagaaaaggtagctatcaggcaggtctgacctttttgccacctaaggacattagctattagagctcaagctccctagccggatggcctgggtccatatcttaggcccaccacttgccaactgggtgtccttgagcccttgtttaacctctctgagcttcagttttctcgtgtgtaaaacaaggataatacaagtatcgactccatagagttgctaagaggatgaaatacgaaaatctacataaagatcttagttcagtgcctggccatagtaatctaatttaaaaaaaaaaagtaaggtctcttttaacttgctttcaatttttatgtgcagatagatcatggacctgaaattttaggtcctaaagaggcccaagcatcctggtttaagaacccatgttggaaaaattagctgggtgcagtggcgcatgcctgtagtcccagctacttgggaggctgagacaggagaatcgcttgaacccaggaggcggaggttgcagtgagccaagattgcgccactgcactccagcctggatgacagagcgagactctgtctcaaaaaaaaaagaacccatgttggatacagatacttgacttttaaatgcagactcagtatcatttacttagcgttccctatgataaatgagatgtttagggaaaatgttgggtttttttagaccactggaaattgacttcagcatgtgtattagagaatgtaactaccccattcaccttgtcctgtccagtactttcactaaaagcaaggtattgtgaccaataataaaatcatagctaaaataatcactaacatgtcattagtgcttaatatgtaccagaaagtgccctgtgtgttttcatgtattatctcatttaatcctcacaactaaccaatgaggtaagttctcttactatccccatttttagatgagaaaactgtggtataaagagccaggaaagtgctaagtcaagatataaatatagtatgtaacaatatactatatttactatatgtattataacatatactataataatatatttttgttataatatatagtatattatattatatgttataataatataatatagatatataaatataaatatatattattgttatataatatatattatggtaattagtaataataataataacacagcatcattattcaatccctgtgacctgccaaatgcagctctagatgccttcccagtgacatctcttgtgttgacaacaatcttttactattcttatttaatggatgaggaaactgagaacttaaatgagttacttaagatgagctatagctctgactggttccaaagccagccactccagaattactcttctacagagggcagggaaaacagctcattaggtccctgaagtgctctacccaggtcacagaatgttggagaggaataggacttcagaatgatcagatccaagccctcactttacagatgtggaaagggaggcccagagaaaagagacttgcataaggcagtgggagagccagaactaaaacctgggtctcccagttgacatgatgtagccatctcatgttgagtcagctatctcaggcactgtgaaagcaggaagggaaagctgacagcttcagagtgatgacagcagactgtcctccctctctctgctccctgctgaccctgggactgctgcatatgcttcctggcccactcagagtagcagcaacatgacttgagaagaggctcttcaggagagaacccacaatgaagacaggaagcacccatgcccttacatgatctacctagggcccatttccaatggaatccccctgaaatagaattaaagatcaatggagatggagggttgcctcagacacatgtgggtctcttttgtagacatacaacacaacctaaatctttgagaacatgatctgactcaacaaattacctgcattttttctgattaaatgtacatccatcttagtttgtatactggataaaaataaaccaactcgtacagaaagttttttaaaaatagagttttggggtgtttaattaaaaatgctttcagtattatgtaatccttgaaatacaacagttgtttactctgctttgatttctaagctttcctttgatgacagatattaatatttatcatttttctgatgttggactaatgagaatcttaagtgtttatgagaagccatttaaatattacagtactgcagatatgtttgttttctgatttatattcctgtctttaacatcaaccaggatttatttttttgtgctgaatcctgggttgttgttcatcaacattttcagtaaactttaaatagccagaactgatgatttctacatttatttgatggtcaaagtgaatatgaaacttcaccaaataacatagtactatgggaaaggtttagttatgatttataaagtaaaaactggaatgcatgtataactgctagccaggaatagagtaacattccaggtttaatgacactgatctcaggtcatacgtattgagtgctgagtatgtatcaggcactgtgtagaacataattgaaatcaatgatttcacttgattcttacaacagctctaagagctaggtagtattatcatctccattttacaggaaagcgaagctcagagaggttgagcacttcactcaagatgacacagcaaatgagaggcaaagccagaagtgagtcctcagggtcagataatgggctcttatttataattcctctctcaagggtccctctgtgactccccagtatttgaaaaatcttattctctacaaagtataaataacccatctgcacagagcaacagtcttcagacaacccagactttcagatcttgatggctatgatgagtcacacctcattttgtttatcataggccatgcattgttctatgcatggagacagcaataaacagcaccaacaattgtccctgccctcatagtgctatctttctagagagggaagatagataatattaacacaataaacaaagcattatcaccattatggggaggaaacgggaggctatgcaaattcagagaaatagtaaaaggggatgaagtctgcagtttctgtagatttcacttgcatatactccccatgcagccaagactcagctaaccagagaaatgacttacaatcagtaacagaagatggcccagaagtagtgtggtacagtgcaaaatctaacactgaattctcagttagggacctgacataaatcactcaccctgcataaggaccaggtgcaggggagacagccatcagcaaaatagccactaccgctgcccttcatagagcttacagtccaaagggaagagaagcattgatttaaaatcaaaggttaaataaaagctgtaaaaagtataagaaggaagcaaaagacacaggagctaacctataggagactaagaaaggtcaacattctgccaattgcactgtctgtgacccacaccaagtcatttttcctctttacagccagtttttcaaatatgcaaataaaggagagtagactagatgaatccaaccagcttctttcaagctctttttaaaaatctcttgaagccatgattctaacatataaaaattatgtatctcctcttctttccaccaattaaaagatcccaaactgtcagtccctttcattgtattcatctgcctcactactgctagggctttgttcttgattttcactgccatttggcagagaagtcaaatcaggagggatatggatgtgataccgcattagggggcagaagtgggtatcgcagatgctctgatcagaacctagtgaaggaaatgagaaggaattgggttatacaaatggaacctagggtccagagagtgtattaacaggtaacaaattagcctgtggagatagtaggcattagggaagcatcagccaggactgtaactcatgttctggccaaagggaggggaaaaaaaaagtctagaagtagtggagaagcagatgagtggaagagaggtctagacagcaaacagcatggatccaaccacaatactgagatccagggacaggagcattacccatgggaaaaaaatccaaattccatactttgacttcaaggccctgtatggcctgggccctatctatacagccaatttcatctgatgtcagtctccctttccctctctatggttcagccacaggggccttcttttctccctttgatggtgttaagctctttcccaccttaaggccttggtataggctattccttctgcctgggaccccattctattaataccagctcttcatatggccagctccctctcatcctttacttaggtctctgcttaattctcagctctttctgtctggccattttatctcaataggttactcatccctctttctatcacagtatcttataatcttccttcttgtacttgacatattattattacaggtgtttgcctatgtgttatctgtccccttcactagactccatgagggcagtgctgatattttatatagatcatcccatttaattcataacaatctacgaagtgggtactattatgtccattttacaaagagaaataaaactgcaaagaaaaacaactggccatatatatatatatatatatatacacaaattctaaacaatactactcattacattaaaacagaatggcaacttagtagaagccacaaaaatctgaaatctttttatttcaagtgtagcccatggaccagcaacatatatatcacctggcagcttgttggaaatgcaaacacttctggcctcaccagggcccttgcatatagttccagcagtcctcaacccacaggagttggacccagctgttccatctgcaacaggaagccaaacacagctaacacctctaggccagggaaaccttggcctgttgccttgtggaagttcaagaggctagaggaagccttagtttagaggaagctttatccctgctcagaggagccaagagagggcctcagctgtagatttttctgaagcttcttggccttgtttttatccaccaggctggcagaacccagcaaatgggatttcaaactacagtggctacctgttttgctgtatccctagtgtcacatccctcttctgaaggtatcagcagctctcgttaaccagggcctttctgtgtgtacagccctgcaagctttgcacagcacaactccagcaggcaccagtcacatatactctggtatgaatggtggcctctgatgctaagaatgtggcagccctggcccacttcctctgggtgaatctctcctctcccagggtgggcatttgctccacacctggccactcacagtacccctccaactggctatagaaacaattccaagtggtaggcatatggcccaagctagaactccttcaatctgctgtaaattttgaggtattatgggcaaatagatatatttcagcccatacaattgagtctctctaaacttgatggaaaaaatctgggatctttaaggtaacatgttatatctgattattaagatgggaatttaaggtaccttgccttctaatggaaatttatgtagccaattacagtgcccccttctttacataattttaacccattgggattgctttctaaccagtggttcttggccctggctacaagttagaatcactagagcatgtctcgtccagatcaattaaattgggaaaggttggtggcacaggccttggtacctcaatttcagctgcgctagactctgactactcatctatgtaaggcgtcccaaagtggcatatggtgtgctacatagtctatgcttccaggcaggccaacaaagtggtagactacatccagtgaaaatcagacctgccactttctgatgatgtagtaactgacaggcagagactaattttacttacacaagtggctgtaaaacaaaatattcccctctctctccaccccaccattttttgttgttctacctctcccacactctctgcatttgttttacctccctcttgcctctcctgctctcccttggatttcttgccagggtcattcctagaagagattgaactggaatcgctagtgctccaggactgaaacaatcttactctaagcaggttccaacccttccctccacctgtcctcagggctccaaacgcataggtaaacttgtgcttctgggcacagcttaaacatctactgacaaaaccaagcaggtaccgtccttcagttaatgtggagtccaaaggcagcagtgagttttgtgttttgctttgttttttcaaaactaagatgtgggaagaagacttctcagaaaataaaaatcttgttcttaccacattccacagacttcagtgattaaatgactgtagattgtatgctcctccagcctggtctaactaaaatattcatgcattaaaccttgtgagggagtactgatacttcaacattatctatgatggtttctaactccagtagctgtgagtctgagaaactgcaaaatatactgaattttaataggattctgattgttaagaaaaagaggtaaatccataacaaagaacactaataaacacttaaaaagactcagcaagagtctttaagttacagaatcctgaaaatgtgtatcttttgtgaacttctcaagcagtttctcaattttctcttctattcccacttattcatcattaaaagaaaacactggcatacaaacaaaatacccctaaaataagtgatttttaactgcagttaacactctggcaaaaacactctttttcccaccctttctctttttctctgtatggagtgaacagaccagaaaagtaaggccactacattgtgaaataacctcctggtgggcagaaaggttcaggaaatgctgaaaaatgaaattacggtgctgggtaatatatattcaaaccaagaatgttcctggaccgttgatataagggtttaaatataaatataaatactcaaatataactgtatgcattttctatgagtcagaaaaacaactttccaaaggaaagggtctgaaaggggatcagaatatgctaccccaaaatatgccactttggcataagggttatttgagttgaaggcaattaagaacagcagattcagaaaaaacaacaacaaaaaaaaaaacacctctgccctcctccatctagctaaaagcagggcacagattttcctttgtaaaggtgacatattttctataaataaaggttttcccctttccctaccagagagacttcttacctgcataaacaaaccttactaaacaaccttcatttaccatacattttcctagtcattttttcacagtttatccccctaccccagaagcccaaatccccttgtccttttgtaaccacccaacaggttcattttgcctgctgcccagatggtttatccagagagaggaattgcaacagagaaagaatttaattcatgcagagccggctgaacaggagaccagagttttattattactgagatcagtctccctggaacatttcagagactgggattttttaaggataatttggtgggtagcgggccaggcagtggggagtgctgatcggtcgaattggagatgaaatcacagggagtcaaagctgtcctcctgtgctgagtcagttcctgcatggaggcacaagaccaaatgagccagtttatcaacctgggtggtgctatctgatccatctagtgcaaggttggaaaaatatctccagcaccaaccttaggttttgatgttatccctaggagcaactggggaggtttagaatcttgtggcctctagttgcatgactcctaaaccataatttctaaacttgtggctaatttgttagtcctagggggtttgggaaagggttgttatcatctttgttccaaagttacactataaactaagatcctcccaaagttagtctggcctacgcacaggaatgaacgaggacagcttggaggttagaggcaagttagatgcggttaggtcagatctctttcaccgtcataatttttgcaaaggaggtttcactttgtctagtttcttctccacataatatataagcccccagacctaaccacctctttagggtcttcacttcttttctatgaaggcctctgtatgcatatgtaataaatgatttctcctcttaatctgtcttttgtcagtttacttttcagtgccccaggagcagaacctaagaaagtagagaaaggattgtttttcttttttcctccctcacaatcaccacatatatggattatcaagaaaattaaaggtatgtaatcaaattagcttaattattcttctgctttgacagaggatgggggtaggaagaaaactttataataggcagcctttctagaagtggttcatttcaatggttcatttcaagctactcaattagaatgtaagaatattaccagtaaaaatgagtggtattttatctgaacaactgtttaaaccctttcaataacactgccatagatcatgaaagcatgtcactgagtttctttggaacacagttttaatgggattatagccccccactccacccccagctatgaggaatgaggcaaactaagtacaggacgagaaacacaacctgaaattcaatataaggaaaacccttagacaagcacagcaagagatacaaggagggtaggggagaaagagtgtccctggtagttaatctcaaagataactagtgcaaaatttatagttagttcatcaaattccatgacagctttgtgatgacgcttttctttcattcccaaagccttcaaaatgctactttctagatatttcattccccactcagaccttttacctattggattatacctgattcattccacgatgctgtgttattagaatcagtggttttcaatgttaaatgcactttagaatcagctgcgaatcattccacaatgctgtgttattagaatcagtggttttcaatcttagatgcactttagaatcagctgggaaatgtaaaaaataaacaaacaaaagaaatcacacaaacaaaaaaaacacctgctcccctccccactctttcggttatctggatgggaccagccccaggtgattctaacttacagccaagcctgagagccactagttggaaagcaatccaaacaaattaaaattacataatgaaggaataaacttacattaggaggccaggtacctcgaattcccatcctaataatcagatataatgtgttaatttaaggatcccagattttgtccatcaaatttagaaagactcaattgcatgggatgaaatatatctatttgcccatgatggggttcaggacatactaccctgaaatattgtaagctgaatgaatttgagaagacagcagaagccagaaggtcagaggtcactctctgaccttccttctgccctctctgaagcaggtcataaaacctaggaagaattatctggccttctcctgaagcaggtctaagaccctcctgtgaaaggtttctcacttcccatacctggaatgaaagaacatccttatctctgaaaacaaagggttacagagaatctgaacaaacaggtcttgctatgtttcctcccattgttagctcatgttttcttattcaatcatacttctacacaactatgtacttcttcatcaaatctagcataaaaaatacacaggtttaccagttttgggggtcttcattccattatgaagaatcctgtgtcacataaaacttacgttaaataaatctgtgtgcttttctctcgttaatctgtcttttgttacaggggagtcaaccaagaacctgagggtgaggaaaagatacttctcctccccgaccccataatacgccaacttttacagaggattgaagaaattccaaacatcatatcatagaggtaagcaaaaacagtagaattaaaggttatctaagtcctcttagtattcaaaatatgataaacaaggaaacagagcaggatgcatcaacttgtgttttttattgacaatgataagaataaaatcattagctaccatttatggagtaccagttactgtgttaagcatttcaatgggttacctcactgaaaactaaaaacatccctctgcaatagaaattatcgcccccatttcacaaatcaggaaattgaggctcagagagatttggacactttccccagagtcacacacatagaaagtagcagaaccaagattaaagtccaggtcttttgctctatcgagtccattctcttaactacatcatctgtcacctagaccactgaagagtatcctaagtacttgctactcaaaggacgatccatggaccagcagcatcagtctgttagaaatactgactctctgatcctttccaggtctttaatttaatcagaatctgcattttaagatcagcaggagacttgtatgcacattaaaattaaagaagcacaaacatacatgcttatcccacatcaactattacctcagataaattcattatccataatgcatccatactttttaaaacctgatttacttgacaaataaaaattgtatatgtttatggtatacaacatgatgttttgaaatatgtatcccatgtggaatggctacatcaagctaattaatatgcactacctcaaatacgtatttatttgtggtgagaatgtcagaggtgtttgaaccagagcaactccatcttcaataggggctgagtaaaataaggctgagatctactaggctgcattcccaggaggttaaggcattcttagtcacaagataagatagaaggttggcacaagatatgggtaataaagaccttgctgataaaacaggttgcagtagagaagttggctaaaaccccccaaaaccaaaatggccacaagagtgacctctggtcgtcctcactgctatactccctccagcgccatgacagtttaaaaatgccatggcaatgtcagaaagttaccctatatggtctaaaaagaggagtcacgaataatccatgccttgtttagcatatcatcaagaaataaccataaaaatgagaaaccagccaccctcaggactgctccgtctatggagtagccatccttttattcctttactttcttaataaacttgctttcactttactctgtggacttgccctgaattctttcttgcataagacccaagaaccctctcttggggtctggatcaagacccctttctgggaacaagaacacttaaagtctacactctaagtaatcttcaataatacaatacatagctatacatccatacttttatgaaaacaaatccaacaatttcatttccccatttaaggccattaaacaatttcccaaatgccctcggaataaggtcgaaatgcaggtaaccggactctgcatagtattactcaggctcaccattctcagcaaactaacacaggaacagaaaagcaaacaccacacgttctcactcataagtgggagttgaacaatgagaacgcatggacacagggaggggaacatcacacaccggggcctgttgtggggtagagggggaaggggagggagagcattaggacaaatacctaatgcatgcagggcttaaaacctagatgacagattgacaggtgcagcaaaccaccacggcacatgtatacctattaacaaacctgtacattctgtacatgtatcccagaacttaaagtaaaattttaaaaaaatttaaaaaaagaaaaacatatctattactcaggctcacctctgcagccttattctctccacctcctccagccattgattttcataccctaagcacacagaccttctttctgctcatcaaatcccaacatcccctccctccctccctcctgtcctccattgtactaggttcttccctgccgagaatataccctcactcaccccatcagtgcctccctaccagccccatttactgctctcaccagagcagatgcagtgcctggaacagagctaggagcaagataaatgtgctgaataaaaatatgtttaggatactgagggcctccgctgtttcctttgtccttctcctctgctgttgctgtgatcctcattcctgttgctccttccctgttccctgcatcacttcttttcagtaactcacctccttatcgtaacctcatggctattgaagttgtcagctttagaaagaagcactgccacatccccacggtcattgccccaggattactcaccagctggatgacaactgcctcactctaaccctgagcctcctgggataggaccaatcctttctagagatggacagaaggccccactgacagaaacaggctgcttttaaatcaaggatttaatatataggtggaaccatagatcaggggcctctcagcaggcagtaccgagccaaaagcttcactgtctctctgcccacacaagagagtgtcactgtgctgacaagacaggttatcaagagttgtgaggaacttcatattttaaatgtgatgaccaagtgtgctactctaagaaaacaagtggcaaacaaatccttttataatataaatacctgcttaaagttttaaatcttgaggaaatgtgaattttcatatatcaggcttacaataacaaaaataagagctattatatttatctattgactgcaagctgttaagagcctgacaacatgctcaaagctttaaacacactttcttcttcatcatcactgtgaggtagaaatgcttattatccctattttaagagagaaaaccaagggctaagtaacctgtctaaaaggcacagctgggaattaaatcatgggtccccagacaacccctctactgcttctctgctatgtcttactatatagatcactttctcatctgagaagtcacagatatggacattcccaaagagacaaccccttggagaatgatctcaaaggctgagatttttctctgcaatgtacatgttgaaagcaaagtaacctcctacatcttatatttcaaagctgcacttctgcattaaaagagtaaacagattcaatgaagagatgtgggaacagggtgcttatgaatgcaatgccacaagtactttttcagtgtctactggtggtcaggcactgtggtggaagctgaatgatcagactatcagttgggagagcgtgggggtgggggcatgggggtgatgaggagaacttctcaaatagactgtttcaggaatgtttagccaataattcataaaactgttactttattacctaactatatggaaatcatctttcagaagagaccagagttacctgccttattatctgtgaatacataattgaaagggccaatatgtcttccaaaatgaaagtcacaacttgatagatttctgagagttcatattagagggtcagattttaacatgtgaatgcaaacatagtgtcagaatttgttctcaagtgtctgaaagaacaaaagagaaaagagtaatgggagccaaaaccagactaacttccaaaatagaaacagagcatgttgaagttgcataaacacacaaataaagatggggacacaaaaacatttcctaaagcattctatcaaaggctgcaggaaaaaggccaagacaaggataccaaatagaaaagcataagcctaaaaaggttatccacactactgtgaggactccagaaacctgccttcttgcagaaacgggatacttttgacatgagggcatgagatgaagattgcagactacttcgtaacacactctcctcatttataaaataagagttagattagattatttataaggtccttccagtctgaatgcattaagtccttatcatctatgtggtccttgcaccttaagagagatgaccatataaagaagctcaaaaaacatttgttgaattcatgaagtattacaaccttaccaataataaataagataatttataacaattggtcctggtctgtggccttgaaagagcaaattagaggagaaaccattatctaaagagctacacatctggtgttcctgctagctgactgctggtggaatgaaaataaccctggacttgaaaataagatgcttggttctagtctaatctctgacacaaaccaactgtgtgaccttgggcaaactgctttaccacctgggccagtttcctaatctctaaaataaaggtattctaaaactatatacatatatatatggaatctttattataggccaagaagtgttccaagatctttgcattagaattaaatgatctcaaaggtttttgcagctcaaatgtttagtatctaagtacagaggcagcatggtataattaaaagattccaaattctgtagccagaaaggttggactcctcctcagctctgtaaggtaaggtctttctctaagcagagactgttaagcagaagggcttacagtctcagtccttttattcaccagtgttttaacttgaacaagttacttaactttcctagccttagttttctaatctgtaaagttgatataaaaatggttctcactctcatatagcttttaagaggattaaattataacacatatattttattgaatatatattatattgctagctgtgtaatcatgggctatcttctcaagttttttctcatatacaaatgggaaatgtagtattaaaaagagatcatgtgaacaggttctaaatggtcaagtgttagtggttttggaagcatgtacgttaatacttggaacaccgtatacaacaatcccatatctaacacttagaacagcatatgcaatcaataacaacacacacacacacacacacacacacacacacacacacacacacacacacacacacaaaccctagacttctttctttactaaatatttctagtccaggttgcagcaggtggacacaggccggcagccatgaacgcaggtccacatgggagttgtagttccgagtcaagcggctgctctacagaacggctagaagcgagacttcgtctcccaggagacatctcgccgtgcaaaatggcacgccacgaggtggagtacctgcccgacgagaaacaagaggcgggactgcaactcccagaagcctccgcggccaaggcctcaggccgcaggctgaagccaaggagggagagttcaggtagatccggcttaacatcaggtgcgagtagggaccacccttggtagtctgggcccggcccaggtcagaaccttactaaaacaaccactgtgagtattttctattggtcccagcacatttctgagagaccagaataataatagcagtaaatctgcaagtggtaaactttcacaagcataacctcaatttagatttcggcttcaggcaacatcctttggccacttgacctgggagcattgagctccttgtttcccagataagcgctgtgagtggctgttccaaggtaacacagcgagggcagaatgtgagcctacagagaaatctgcagatgcatctcaagttccactaacctgcctccttaccccccaccaccaccaacttggatatacctttaaaattcccccctttgacgctaaaaataaaaacaacaaccataaaataagtgtaagaaagtccgaccaagtaccgatgagttctcccacaacaataaattcgatgcctctttgcctgtttttgaagtagtaatgtaaaattatctcccaaaatgctgccttctctatactccggtttgctcctgtcctgggcacgtgttcagcaaccccttaggggaatccagagctgcgtgtttaacacagacctgttgggacggattttcgctacttgtctatgaaactgacgaaccatcccaaaacggcgggtgccgactacacccccagagccaagagctgtggcgtccccggacccgctggcgtggccccgtgcctcagtttccccaatgtataaacacggtggaggaggaacgggttagggctagggtcggtgcttgggaattggggggcccgagtccccaccctgagaccctcgtggggcggaagagtactcgggacagaagcccaccgccccgtgagcggcgccggccccactgggctccggggtgatgacctgacgcgcgtggaaacccagacccgcgccccagaaacagtattccacttgggcttgcctccccgcccctaccttccaggatgttgacagctgggaatgaaaggcagagggagggagcgcggggccggagcgccgcctgggagtgtgcccactgggtggccgcctgagggacccgggaacagagggcaaaaagtcctgtgaccggacagagcagagcggggactgcaattc

SEQ ID NO: 2001 - DNA, 1502099 bp, Homo sapiens; identical to SEQ ID NO: 2000
  misc_feature (369735)..(369735): n is a, c, g, or t
  misc_feature (455030)..(455030): n is a, c, g, or t

SEQ ID NO: 2002 - DNA, 10454 bp, Homo sapiens
tgcggacgcggggcgccagcaggtggcgctggacgcgcaacggacaaggaggcggggcctgcagctggcttggaggctccgcgctctggaggctcaggcgccgcgtggggcccgcacctctgggcagcagcggcagccgagactcacggtcaagctaaggcgaagagtgggtgagtcccttgaatcgttctcactggccgtttgctcctcgagtccgcccgcgtgtccctgcaaggctgggcgcccgctcccagtcttgggaggggtgtagcgggtcgcaagccttctcgtgacctggacagcggccctcctgggcgagcgctgctcaattctccgcttatgcgcggctctggggcgcgctgccttccagcccagctgggttgtggccgggccgggggttggggagagccagggactcacaggaagccttttcgctaggggcttaaggttgtggtagattattaagtttgtgctcaggttggattttgatggcaagttttttaacgtggcaaagttgccagagtttgctgtgcattgacgaatgactggtgcacagtacttaaaatcgtgctacttctcgtcttcgggtttcctggtaacagaggttttcatttttagtccttagaacactggccctactctttcaggatctgggtggggttcaggttccctccaaaatagtcaatcaaggctttaaatatgtaattctggtcaaatccactggaaggtgtttgtagacataaattttttgtacacttccaaatttcttactttgttacttttgtaaaatacatttccctccacatcctgacgtgtaataaaaggttattcatttaacatgaatgttaagcacagagggaaagcaatgcttaaaaacagcccagtgaaaaaaaaaaacaaaaaactcgacttcacttagttaaatgtaaaacaagtgtgcacttgaaagtataaaaggttggaaatgcaatgcaacccacagtgtattccaggcattgggtttcttcatattctcaactgcgggacataaacatgagtaagttgggctgtgccaacatttaggaacaccagggcagccatcctggtacagcaaaacagcagtcgcattagaaatatgcttcactttttttaaaagggggtgaaagagaactttgggtcgaattctggagttcctaacattttaacaccaggttgttttctgttatttttctttttatgaaaagattttactgtagaacttaaatttcattttggttaatgtctgatggaaaccaacaaatttatttgactcatagtttattttcctggcttatgggcatagagttgactgtgggccacacagtcaacaagcttcctcactgtcatgggcttttccttggctttgctcttgagtgtggtctccttaccatgcagacaaatggctgggtaactctccagggccactctggttttccacccagactccgtttgtagtggccatcagtcagcaaacactgccaacctgctagctaccccaggactgggtctagaagacagcgctgagccttttcctctacttcccttcccatgccaccatctgcctgtaaaactttatcctcctctaggatacatcgctctaccatgcagttgaaatgcctgccttctctcctagacctcaaggtttttcagagcagaggctttatctcatttaactttgcattcctcctgccttacattgttgttcacaatatagttaatgaattcatattgaataaatgtaggtggatttgttagcatccttacgatactgcaaccctcaaagttaaaagatcttctaaacatagtgaattatttcttacatttgattatagtaggtgacacttccattcctagcacctccctcccccaccccacaaactattatgttggtgatatggtttggagctgtgtctctccctcagatctcatgttgaaatgtaacccccagtgagggagctggggtctggtgggaggtgattggaccatgggagcagtttctcatggtttaacaccatccccccttggtgctgttgtcacgttagtgcaggggtacccaaccccgtggccgcagactggtatcagtcagtgtccttttaggaactgggctgcacagcaggaggggagtggcaggccagcgagcattactgcctgagctccacctcctgtcagatgaacagtggcattagattctcctaagtgcatgaaccctattgcaaactgcacatgcaagggatctaggttgtgtgctccttatgagaatctaactattgcctgatgatctgaggtggaacagtttcacctcaaaaccctatcccccttcccctacttggaaaaattgtcttccacgaaaccagtccctggtgccaaaaaggttggggaccactgcgataatgtaagacgcctgctcccacttcaccttccgccatgactataagccctctgagccctccccagaagcagatgttgccatgcttcctttacagcctatggaaccatgagccaattaaatctcctttctttataataattacccagcctcaggtatttctttatagcagtgcgagaacagcgtaatacagttggttaagtcaccaaatgacttggaataatgcttcttaaggagatagagtgtcatttcctccagagcaggcatgagtgtcatttctatttttcctctttaatgttggtcacagagttgggttcataaatacttgatgattggcatatgctttactcagaattcttttacatgccagtggtgaacacccaaatcacactaacttaaaccaaaaaaaaagggaatgtgttgactgtctaactgaaaaattcaggatctagtctcaggggctctaaatactgaaatatgccgccaggactcttctgtgtctttctctgcttcttgttctgcttccgtgttggctttcttcttttctaatgaaaacatgttccttcttagagcatggagaaaaaagcatggcaggcttatactgtgctatcttaacaaaatgttaaagacatctcatctctctcttccacttccatatataaatatcagagaatgaccaggtttaagtagggttctgtgccatcgctaagccaatcaatgggaaaacaggaaactgcccaggcctgagtcatatacccacttctgtgaccagggaatgagcgttactattttacacaatctcccaaaatcacattggagggaggaagggcatttctccaaatggaggaaatgttttaaatcagaaaagaatgtgggcaaactaaaacaacagatatcttcatcatgaatgttctgtaattttgaaatagataatatctggaaaatattccaagagtacctcaacaaagtaaatgttggcatatgtaaaagcaactcgttattctttgttatagttaaacctttaaaacttggagaatgttttaagaacagtcatgtctcttcatgacaggatacattctgagaaattcattgtaaggcgggatttcattgttgaggaaacatcatagagtgtacttacataaacttagatggtacagcctcctacatacttaggctagatggtatagtctattgctcctaggctactaatctgtatagcatgttactgtgctgaatactgtgggcagttgaaacacaatagtaagtatttgtgtatctgaacatagaaaaggtatagtaaacatacatatatcgtacaaaagataaaaaattgtatatttgtacaggacgcttactatgaatagaacttgcagaactggaagttgctctgggtgagtcagtgagtgagtagtgagtgaatgtaaaggcctgggacattactgtacagtactatagactttataaacactgtacactaaggctaccctacatttattgaaaaatttttttctttaataataaattaactttagcttactgtaattttactttattaacttattgtttttactcttttgtaataacacttagcttaaaacatagtcacattgtacagccatacaaaatattttgtttatgtacttactccttaagctttttttctatttctaattttttttttctttttagacttttttgttgaaactaagacacaaacacacacattagcccaggcctacccagggtcaggatcatcagtatcactgtcttccacctctatatcttgtcccactggaaggtcttcaagggcagtaacaggcatggagctgccatcttctatgataacaatgccttcttctggaagacctcctgaaggacctgcctagggctgtttacagttagctctttttttgtaagtagaaggagtacacttcacaataataataaaaagtatagtattgtaaatactaggcaataggaatttttttgctccattatactcttatgggaccactgttacatatgcagtcagtcgttgaccaaagtgttatgtgacacatcactgtattttaaactattcctggaaacagctttccacctaaaaaagtactacacgtggtctaaaattcagaaacacttgggatattttctgtcaatcaaattgttgtatatctaatctgtttttctcattgaatttcataaagtgtaaattgaagatgtgttcctctggaaataaattcagaactaataaaaacaatgaatagtactgtgacatatgttttctttccctaaaaaatgttacaccaatcctggatgaggatctgtgagtttgctaaggaaaagattcttttatcaagtgagaaatttgaaaagttgttttccacagggttgaccagaagactgggcacatcattaattcggcacaactcaccattcccactggaaacatactagcaattcacatcttccaaacaagcaccaacctcttactccaaaagaaaaatggtactctgaaaatactgtttcagactccagtgtcaaccccaaaattctgttaaacataaatcttatatcagctacctccagcctccattgatgacattattactctcaatataatacattcctaattatatttgccattgaaaggagttggctttcctccagatggaaacctgaaattaaatcttcctcaagtaaaaggcaacatctgaccctttgtaatgcatacaggcacctgggttattcattgaacaaataagtagataaagaagagcagttactgttgataagagggcattggtttgaaacttacagattataatatgaagttaaatgtataaatcagtcactatttccatttttattgtattttatctgccattctagtctttaagtaagtaaattttttatattgttacatcaaacattcacatcataagtagaatggacatgaaagtaattatttttatttttacaggtggctgaagccatactattttatagaattaatggaaagcagaaaagacatcacaaaccaagaagaactttggaaaatgaagcctaggagaaatttagaagaagacgattatttggtaaaatattaataataacaataataaataataatttacatctttaaacataattcagatgccattctgtatctcctagtgttatgaaagtgatttttcaccctagtctgctgatatctggacttggattaccgtcactgatactgtgaaggacagagtagcatatgtgagagacatagtaccttcactgattgtcagggacttagctgaataaccttgaataagttactgaaaatctggggtcttagtttgtttataccatgaaagccttggaccagatcatccccaaggcccttccaattctttctaacagtctatagttctaagttaaaaaaaaaaaaaagtcatcaatgcccatataacagtaattttgtaagcaagcatttttgtcatagacacagtggcagcttaccaagagatcagtaaattgacgattcactgtataaccaaataaatctacttttggataagaatcacttgttccacttttggtcaaacacaggattaagtgtttcttactacattttttgactgaaaaagtggcagaaattttggttccaaacttccaaattatctcaatggaagttttagcagaaattatttatttaatcttaataattttaatagggaaaagtaattaataaattacaagcatatactttataagagtaacaatgtgcataaaatgaaataatttcatttttcaagttaactgtcttacctgtctgaagcatgtatttcttttgtcctaaagacaaaagtctttcagtgccacatagactatgctatcttcaactaaccagtattcaaaagcaagattctgaatgcccttattcaatgagaagcacaatgattgagcaataagtaattagttcaagagatatcccattgttttgttcaattttaagatgttaattttctttcctttgtagcataaggacacgggagagaccagcatgctaaaaagacctgtgcttttgcatttgcaccaaacagcccatgctgatgaatttgactgcccttcagaacttcagcacacacaggaactctttccacagtggcacttgccaattaaaatagctgctattatagcatctctgacttttctttacactcttctgagggaagtaattcaccctttagcaacttcccatcaacaatatttttataaaattccaatcctggtcatcaacaaagtcttgccaatggtttccatcactctcttggcattggtttacctgccaggtgtgatagcagcaattgtccaacttcataatggaaccaagtataagaagtttccacattggttggataagtggatgttaacaagaaagcagtttgggcttctcagtttcttttttgctgtactgcatgcaatttatagtctgtcttacccaatgaggcgatcctacagatacaagttgctaaactgggcatatcaacaggtaagatgacagtgttgacactgttactaataaaaagtctaagtcacctaacaaattaatcatttctcattgtaatatcaataccccaaccctgttgaaactctgtgttgaaaaagtcatctattttaaaatttttattataattacactagggcttggttgtcagtcggttttatattgagaaatgttttttaggctgaaaataaggtacaactttagcaacataagaaacattttgttcatggacgaggccatatttcaaacttctaccaccctcacaagattactttttaatattgttgttcttctccttgtttaccaatatgcatgcacattacagttctatccaagtaaaccatcaaataattattagaaaattaatagattatggaagtgttgcattcaagaaaaaaagtgatagctcctatgtcatttgtcttagaggaatgcaaaaaaaaaaaaagaaaaagtcataaatttgtggagacctgttatcagggcttcatagtaggcacagggaagagtgtagaaggagattcacattcaggaaataactgttgtttgcatttcttctttctttatttaccttctggtaggtccaacaaaataaagaagatgcctggattgagcatgatgtttggagaatggagatttatgtgtctctgggaattgtgggattggcaatactggctctgttggctgtgacatctattccatctgtgagtgactctttgacatggagagaatttcactatattcaggtaaataatatataaaataaccctaagaggtaaatcttctttttgtgtttatgatatagaatatgttgactttaccccataaaaaataacaaatgtttttcaacagcaaagatcttatacttgttccaattaataatgtgctctcctgttgttttccctattgcttctaattaggacaagtgtttcctagacataaataaaaggcattaaaatattctttgttttttttttttgtttgtttgttttttgtttgtttgtttgtttttttgagatgaagtctcgctctgttgcccatgctggagtacagtggcacgatctcggctcactgcaacctgcgcctcctgggttcaggcgattctcttgcctcagcctcctgagtagctgggattacaggcacccatcaccatgtccagctaatttttgtatttttagtagagacagggttttcccatgttggccaggctggtctcgatctcctgacctcaaatgatccgcccacctcggcctcccaaagtgctgggatgacagttgtgagccaccacactcagcctgctctttctaatatttgaaacttgttagacaatttgctacccatctaatgtgatattttaggaatccaatatgcatggtttattatttcttaaaaaaaatattcttttacctgtcacctgaatttagtaatgccttttatgttacacaacttagcactttccagaaacaaaaactctctccttgaaataatagagtttttatctaccaaagatattctagtgtctcatttcaaaggctgctttttccagcttacattttatatacttactcacttgaagtttctaaatattcttgtaattttaaaaatatctcagatttactgaggtttatcttctggtggtagattatccataagaagagtgatgtgccagaatcactctgggatccttgtctgacaagattcaaaggactaaatttaattcagtcatgaacactgccaattaccgtttatgggtagacatctttggaaatttccacaaggtcagacattcgcaactatcccttctacatgtccacacgtatactccaacactttattaggcatctgattagtttggaaagtatgcctccatctgaattagtccagtgtggcttagagttggtacaacattctcacagaatttcctaattttgtaggttcagcctgataaccactggagttctttggtcctcattaaatagctttcttcacacattgctctgcctgttacacatatgatgaacactgctttttagacttcattaggaatttaggactgcatcttgacaactgagcctattctactatatgtacaatacctagcccataataggtatacaatacacatttggtaaaactaattttcaaccaatgacatgtatttttcaactagtaacctagaaatgtttcacttaaaatctgagaactggttacactacaagttaccttggagattcatatatgaaaacgcaaacttagctatttgattgtattcactgggacttaagaatgcgcctgaataattgtgagttcgatttgttctggcaggctaatgaccatttccagtaaagtgaatagaggtcagaagtcgtataaaagaggtgttgtcagaacaccgttgagattacataggtgaacaactatttttaagcaactttatttgtgtagtgacaaagcatcccaatgcaggctgaaatgtttcatcacatctctggatctctctattttgtgcagacattgaaaaaattgttcatattatttccatgttatcagaatatttgattttttaaaaacataggccaagttcattcacttcattattcatttatcaaaatcagagtgaatcacattagtcgccttcacaactgataaagatcactgaagtcaaattgatttttgctataatcttcaatctacctatatttaattgagaatctaaaatgtacaaatcattgtgttgattctgcagggatcctgctataagtaagactcagtccctgattttaggtatcctgtgataagcagaattaagacaaatacacaagagacaaagcacaaaaaataaatatcataaggggatgaacaaaatggtggagaaagagtagacaaagtttttgatcacctgccttcaaagaaaggctgtgaattttgttcacttagacagcttggagacaagaaattacccaaaagtaaggtgaggaggataggcaaaaagagtagaaagatgtgaatggacattgttgagaaatgtgataggaaaacaatcatagataaaggatttccaagcaacagagcatatccagatgaggtaggatgggataaactcttattgaaccaatcttcaccaattttgtttttcttttgcagagcaagctaggaattgtttcccttctactgggcacaatacacgcattgatttttgcctggaataagtggatagatataaaacaatttgtatggtatacacctccaacttttatgatagctgttttccttccaattgttgtcctgatatttaaaagcatactattcctgccatgcttgaggaagaagatactgaagattagacatggttgggaagacgtcaccaaaattaacaaaactgagatatgttcccagttgtagaattactgtttacacacatttttgttcaatattgatatattttatcaccaacatttcaagtttgtatttgttaataaaatgattattcaagga

SEQ ID NO: 2003 - DNA, 25820 bp, Homo sapiens
cgatccagcttgggtaggcggggaagcagctggagtgcgaccgccgcggcagccaccctgcaaccgccagtcggaggtgcagtccgtaggccctggcccccgggtgggcccttggggagtcggcgccgctcccggggagctgcaaggctcgcccctgcccggcgtggagggcgcggggggcgcggaggtgagcgggtcggggaggagcgcgaaagaaggtagcggcggcggagttgagggtcaagatgcagtctgcgccacgcgctgcatccatcctccccgattctgcgccctcaccgggcgtccgccctgagctgcggggtccctcatctcctggcaccttaaggtggaaagtgagaagggtggagaagggtgtctgttccactgattccccctcctcctcctcttggttcctagagctaagggcaagtcctgaggttgggcccaggagaaagaaggcaaggagacattgtcccaggtaggatgtgtcccagcaggaaaggacaggcaggttactttcgcccccttgatagtctccctgctactttgggttgatgcagggcatttcatggaagatcatgcagtgctgctttgcgaacaggtatttctagcagtcatttggtttatttcccagtaatgtaatcgtggtgtttaggccatttctgttagaaagtaattggcctcttctttgactgtcctaaattatctttgaaccctgtgttcagcctcagccaaaacttgttgaaaattatgccctaaaaatcttgctcttaaaatagagcagagagataaagagcatttttgttggaagatttccatttattatctctcccaccccgtggagaaggattggtgtcagtttttactcctcgggcagttagttttttagatggaaagacagtccaggccatagttaattatcgctcatcagtataggagaaaaagaattcagactcctgccccacccccacccccacccccaacctcctgacttagattctggtccttttaacagccccgctgcttggaaccctttttgttttctaaaccacctccccatccttccttttctccactttattatttcttcattttattgatctgtttattttttctttctttaaccctataatttttttactccgattctctcttggttgcttcaaagcttagaggctatttaatggaaaagcaaaacaaaacaaaacaaaacacccgtcctaaataatttgcaggatgtttagaaacataaagagtaactatgtgtgctgccattgggatggctgcactctctgcctcttagctagtcactctgtcagggtatggggaaatgagacaatattgagaatgacaacttgagcaaattgtgcagtaaggaaatgaaaagctttatccaagtcactttttattgtactggtgctatggaaaatgtggtgaatgaacatagttgtattttagtactgaaaaaacaggacaggtgaagacaaatttttaaagaaaggattgtaaatgagttagaaaagtgagaaagaagatacaccaaaaatgtgaaagagtaagactgcaggcgtgataaaggacataggacatcaggagatgtatttatccctgctgggccagaaaccaggacattgaggtaactgagacattaacataacaataacattgataaatcacctaccccttaagggcccacatgtgttttcagcaaaaagagaaatctgatctagagaattattacatgtctttttgtcctgaatttttttgatgtattccataacaaagaatttttattgcatccttagttacactgccagccaatgtggaggcagtgatcacggacaagacaaacatggttcttccctcgtgcagtttattgtccaatgggggaaatagtaaacagtaaagaaacaattatataaaatattacaaaataaatttaacaagggctgagtgaattattctgctatagagatggaacagtatatggaaagctcccaaggtacataaagtggttgttgttttctctttctagaagagaatgctgtgggtggacaatatacagataaggttagagaggggaagcggggactaactcattcaggaccttttacgtgatagtcaggaagatggctgtagttctaagtacaaggagcaccgattttaaggagagacattttatgacgatttacattttaagatgattttagctgctgtggagatgtttggaaagggtcaaaagagaaagtaggctgacccattaggaaatgtttgcagagttcaggtgagatgatagacacctggactagcctggtattggtggagagggatttatgaaatatgttggagaacaggaattggtgcaggattttatgtcaaaagtgagggtcagcaaggacttaagaatgactcccaattttctgattggagcaactggtggataatggtggcatttacacatttccaggcgaatgggaccagctctgggtggaaaaagttcaggtttgaacctgtgaagtttgagatgtcacagaaagaggtcataaccatatccccttgggaagcaaaaagggaggctctccaggacataagtggatagactggtctttgataggtaaaattggtgattgttaatttaaggtgaaactaatgagctcagttttctggtttttctccagcaaccttcaccaacgtggatacagatacagagaaaatggatagctgggtccaggactagagttttgccaagcagatatgatggagagtaagagagctgaggatctttttaagggagtgactacaaatctagcctcggtttaaagagaaaccagagcaggctgaaggagagtgcaggatattaagcaattagagaggtagaggtcaacggatcagatttcttttgctgtttagaattatcagtgtgaatatttaaactaagattattggaagtcctggagacagtgcttggagatttcaggcagtgagtgactgaggtggggtagaggcaaaaattcattgtctccaatgagtaagtcaaggaaataagagcccctgaagttgaatggttcatccacttgaatgataaagtccaggaaaaacatgatagctattagggtagagaggatgaccatgtatatactgggagccagagtctgcagtcataaggaataaactagaagtcagtagaggacagcagtgaggacagcagtaaggacagggagagggtatggtgaagtaccatgagcttcaaaggagctgggtgtttgcaggagagacaatgaagaagagatgttcagatgtgggcttacaaagtgaagattacaccaccccacctcatggccctggagaattatgttttcttgatagcctctccaaatctgcaggttgtgaaatgtcatcaaaacctctgtggacagccctttcagagttgctgtcatccaataataaatgccctatttatgtgtgaaacaaattaggttctatttttcaaaagtaacatagcacaacaggtgccattcagcttcaggaatgttcaggaaatccttctaaactgaaaaccttaagaggctgtccagctgaatgtaactgaattccctatcaaaataatacattctcaagtattaaatgtgtacagcaagtcaaatgcccattcaagaaaacgatgtcattgacacagacttttagattgagctcccgaagttgaagtgttaaatatagggtggtgatattaccattattacacagcttcaagacttatttagtgttggaaactaccaccagagtcaagtataacctatttgtttgctgtttaacaaaggaaattgagactcagagaatcaaagtgattgcagaagcttaggcctgctctttcacccctacactatgaagacaaaactttctataaatgacatagttgttttttgtttttgtttgtttttgtttttgttttgaggctgagtctcactctgttgcccaggctggagtccagtggcgcgatcttggctccctggttcaagcgattctccttcctcagcctcccaagtagctgggattacaggcacctgccaccacccctgcctaatttttgtgcctttttagtaaagatggggtttaatcatgttggccagtctgatcttgaactcctgacctcaagtgatccacctgcttcggcctcccaaagtgctgagattacagacgtgagccaccatgcccagcctataaatgacatagttttatcagttatttaatttggattccttatgaataacttcaaaagaaaaggtatagacactgtggacatcacctgggagcttgtgaaaaaatgcagaatgtctaacctccctctagacctaaagaatctgagtgtgcattttaaagaggtccccaggtgatcatatttgcattaaagtttgacaagtgcctttctagtgagtcattcccttggaaacagtggtctgctcaggtcagcaggatcatgatgcctggagaactggggaggggatccccttgtagaacagaaagaagagatacagtcatggaaatattccgaattttgaatattatgaaacaacaggaacaaagtatgttgtgcaaggagtgacgcattttaaggaatggcattgcctttcccagaaagtgaagagaggaaattggaaaattgtgagtggaccttctgatactgctcctccttgcgtggaaaaggggaaagaactgcatgcatattattcagcgtcctatattcaaaggtaactactactctttcgcaagtgtaatttttcattactacaaacaacaacgtaaaaattaacataagtgagggtcagaaagccacatctactatcgccaaatgatgaaagtattagattgaattctgaatcttttactagagtgattttcaatcttggttgcataataaaacatctgctaatcttttttaaaaaatgctgttgctcaggatgaaccccagaacaattaagtgaaaactgggtggtaggggggtgacccgtcatcactgtgttttaaaacttgccaggtcattggagaatgcacctagggttgagaaatactgctttagtagctcattcagaagcagctctgagattgcagttctgctactccatgtgccaaaacagtgggactttccctcactaccataagcgtagtgccaagccaggtcagcaatattcaggtcaccctcactggccagttttcagaacattgagggaagtaggatttatttcttgaagaagcctgcttagactaacttttaaaacaaattgatacatgttacatatctatggggtacacatgagtatttgttatatccatagaatgtgtaatgatctggttggagtttttggggaatccatcaccttgagtatttatcatatctatgtgttaagaacatttcaagtcatctcttctagctactttgaaatacacagtacattgttactgactataggcaacctactttgctattgaacattagaacttacttcttctaactgtacatttgtatccatgaaccaacatctcttcctcccctcctcccatcaacacatccttccagcctctgatatctctcatgctattctctacctccatgggatccacttttttagctcccacacatgagtaaaaacatgtgatatttgcctttctgtgcctgggttatttcacttaacataatggcctccactcctatccatgttgctgcaaatgacacgatttcattttttaaggctgaataatatttcattgtgtatacataccacattttctttatccatttgttgatggacatgtagattgattccatatccttgctagtgtgaatagtgcgcaaaaaaaaaaaaaaaaaaaaaacatgtgaggacgggtatctctttgatatactaatttcttttcctgtagataatacccggtagtgagattactggattgtatggtagttccatttttagtcttttgagaaacaacccctatactgttgtccacagaggctgtactaatttacatttccaccaataacatataaggattcccttttctctgaatcgttgtcagcatctgtcatttttctcttttaataatagcagttctaattgggataagttgaaatctcattgtggttttgatatgcatttctctggtgattagtgatgcttagcattttttcatatacctattaaccatttgtttgtcttctttggaaaaatgtctattcatgacctttacccatttttatgggattatgtgttttttattgtcagttgtttgagttccttgtatattctgaatattagtcccttatcagattaatagtttgcaaatattttcttctattcaataggtggtctcttcattctgttgattgtttcctttgctgcacggaagtcttttagtttaatatagtcccatttgtctatttttttgttgttgttgctgtgcttttgaggtcctagccataaaatctttgcctagaccaatgtcttcaaatatttccccaatgttttcttcttgaaatgaggggttttgggtcttatgtttaagtctttagttgaccttgcgttgatttttgtatatggtgagggacaggggtccagttttattcttctgcatacagatatccaattgtctaagtaccatatatttgaagaggatatcctttcctcagtgtatgttcttggtgcctttgttgacaatcagttggctgtaaatgtgtggattttttttgtggattatctaatctgttgcattcattgatctgtgcatttgtttttataccggtaccatgttttttcggttactattgccttgtaatatattttgaagtcaggtagtgtgatgccttcagctttgttctttttgcttaggattgctgtagctattcaggatattttttggttctatatgaattttaggattgtcttttctaattctatgaaaaatcacattggtattttgatagggattgcattgaatctgtgtattgctttgggcagtatggtcattttaatattaattcttccaatccataagcatggaatgtttttccattcgtttatgtcatctttaatttttttctacagtgctttgtagttttccttgtagcaaactttcacctccttggttaaatatattcctagttgttttttgtttgtttttgttttttttatagctattgtaaatgggattgccttcttggtgtctttttcagcaagttcattgttggtgtatagaaatggtactgatttttgtatgtcgattttgtatcctgcaactttattgaatttatttatcagatctaagagtttttgtgtgaaatctttaggtttatctagatctaagatcatatcatcagcaaagagggataatttgaccttcctcttttccagtttgggtaccttttattctttctctttcctggttgctctggctaggacttccaatatgatgttgaatagaagtggtgaaagtggcatccttgtcttgtttctgttcatagaggaaaggctttgagcttttccccatttcaaaataatgatagctatattattattatatagatcatataagcccttattatgtgaagcatattttttctatccctagtttgttgcaagttttatcatgaggggatgctaaattttctcaaatgttttttctgcatctattgagatgatcatatggttattgtccttcattctcttcaggtgatgtatcacagttgttgatttgcatatgttgaaccatccttgtatccctgggatgcattcctggaataaatcccctttgatcatgatgtgtgtgtgttttttttatgagttgttagatttggtttgcttctacagacacacacgcgcgcacacacacaatttttaggagacagggtcttgctctgttgcccaggagggagtgcggttatgcaatcataaatcactgcagccttcaacttctgggctcaggtgattcttctgcctcagctcccgagtactaggacttcaggtgtgtaccaccacacctagctattgtttaaattttttgtagagacgagggtctcattatgttgcccaggctgggcttaaactcctggcttcaatccatcctcctgcattggcctcccaaagtgctgggattacaggcataagccatcatgtctggcccttggtttgctagtattttgttgagagtttttgtatctgtgctcatcaggaataatagtatgtagttttcttttttgttgagccttgtttgcttttggtgtgaagataatgctgacctcatagaatgagttaggcagaattccctcctgtttaatgttttggaagagtttgaagagaattggtgttaggtctgttttgaaagtttggtagaattcggcagtgaagccatctggccctggacttttctttgttgggagttttttaattactgcctcaactttttttgttactggtctgtccaggttttccatttcttcccatttcaatcttggtagcttgtatatgtgtagcagtttatccatttcctctaggttttccagtttgttggtgtatagttgttcataatagcttctcatgatcttatgtatttctgtggtatcaattgtaatgtttccttttccatttctgattttttattggagtatttcctcttttttcttggttagtctagcaagtgctttatcaattttatcttttcaaaaaacaaaactttttgtttcatccatcctttgtattgttttttaagtcccaatttgtctagttctgctctgatctttattattactttccttttaccaatttggggtttggcttgtttttgcttttctagttccttgaggtacatcattaagttgtttatttgaaatcgtaatgattttttggtgtaggtgcttgttgatataagcttccatcttagcactgcttttgctgtatctcatgggtttcagtgtgttgtgtttttatttttatttgttgagggaaattttttgatttcttccttaatttattctttgcccccgtagtcatttaggagcatgttgtttaatcatttatttttacagtttcaaaagttcctcatgttgttgacttctagttttattccattgtggtctgaggaagtacttgatatgacttcgatttttaaaaaatttgttgaatcttattttgtgttctaacatggtcattcctagagaatgtctatgtgctgatgagaatttgtattctgtaactgttgtataaaatgttctgtgaatgtttgttaggtccatttggtctaacgtatagtttaaattcaatgtttctttgttaattttctgtctagattatctgtcagatgctggcaggcggtgttgaagtccccaaatgttgttgtattggcgtctgtttctccttttagatctgataacactttatttatattaatatatctgagtggtctgttgttgggtgtatatatgtttagaattgttatatcctcttgctagaatttatctattatcattatataatgaccttcattgtctctttatactgtttttgactcaaactgttttatttgatataagtatagtgacttttggtttccatttgcatggactatctttctccatccctttgctttcagtcttatatgtgtttttatatgttagatgggtttcttgtacccagcatatacttgggttatgattttttatctattactagtccatatcttttcagtggaaagtttaatccatttgcattcaaagttattcaacaatgaaaacttcccaagtctagtgagagatgtagacacccggatacaggtaacttagagatctccaaacagatacaatacaagaaggtcttccccacagcacattatagtcatattgtcaaaagtaaaagacaaagagtgaattctaaaaacagcaagagaatgaccagtcacctataaaggaactcccagcaaaataaaatttttacctgttcacattctgatttacagaagggatttgaacttgctttgtaaaataagcagataattaatgttgttttgtttttgtttctgtttgaaaaagtcttgatcatcatgagtgttagatttaaagattttgcaattcttatattttgggagatgctgcagtatatactcagaagaactccaggctgggatataggaaacttggattcccttgtgtgaatctagcaacctttttcacccttagataatgctcatgattaccattaactttcgaatgaagtgagcatggatttcattacttctggtttttttaaccactcctgattcccagcatagctagtgacatctccaaatggatattgacaggtttttttcctaccctggtacctctgactcctgcctgcctttctgggtgcatggaccacaccaagggagtggtctatcttgaaaggtgtgaaatgaaacatgtaattgatttaaaaatagtaaatgttcttctttcccaggatcgggtgctcctaggtaactctgaggagcaatgaaatgaccaaagaaaaaggaataatatactactttgagtacaactgtaattgttacaccttgatacttataaccccccaaaaacaccctttcctaaactccttacatgcacctaaataacacatgtcttagctggacaactacctggcttccctattttctgtctttatgtccttggataaattaattatcttctgcaggtctcagtttcctcatctacaaagtgggtatgacagtattagcacctgtctcttagggtggttgtggggattcaatcagttaatacataaaaaccacaagagagctgaaatacattatgtcctatataagcattaagtaatattactataattattgtctttctaaagtttaacatactgatgtatttggagttactggatgtgactcatttctagggtaaaaagttgaattttcctggctgtagtcatttcaaatttcatttagtaaaaaccccaacttttttttgaaacattccacctgtgcctgtaaagtccattaaatcctctgaaatggtccacatctgctatgagcatagaagaaattgtgcaatgagggtagaatggaagagtatttttctttcagacccaatttcgacactaattcatggcaacctgatttgtattcttgagcaaattattccaaatatgaacatttcagatgctagtctctcaactaaaaaataatttgagagatttttccaggaagaataactgcatcatagtttatgcagccaacaaatgaaagggtgtcatgttgcggtccaaagggcgtgggtggatgagcagaaagaatacttgaagggctgtaggcaggtgaaagatgattttattcaacagcagctctgatcaacaactttctcacactgtccatcctgtctcagctgcttagtctggtggctcccacacacacagctcccttgccttcagggtcagcagcttaactatttctctctctgggcatgggcaagccaagctgggtcctgactcccccatctgtctgcaaagacagacagctctgactctctgtctctgagcacaagagtgcctctacagtgtccacagggcaattataccttttacagacaatagtggcttagagccaagtgatgagttttccctatgtcatagcgatggtggtgagcttctgttatgtctacatggctatgataacaagtaacaagtgaagttatatgcttgcgctctgaactcactcactctggatgtttacctctgcctgtccttgaccaaagcacagccatgttctttacaaaggggaagaaaaagatttcatacatattatataatttaagatcataaacatgttactaatcctttttccataggtaagctatctttctcaatgatacattgtaagatgtagggtgaatgatagaagtccatggtatttactcttttgttatattttgatgcctatttttcttaagatattatttaagtgccaggattcattgttagctaatttgtctagctctcatttaatgataaagtcactagctactgaagtatatagggaactttataacctctaccccaaatgactttagacagttttggtttaaatggctttttaaaaaatggtttttctttcttctcttgtcttgtgagccatcacttagtatcacagtcctctctgcctccagcagcatttgtgatttgctgcctctgatctgctcaaaagctgggtaatcatacttgttacaagtgtgtttttccaaaaagttctgagtgaaaacctcagtcccttttttcatgtgctctagtgaggtaggaggcagaacttgaatccagaggcaaggttcagacactggaccaaactgaggtcagggcagaagcacctccccataagacatgcccatcagtgtgccatgtcagttcactattgccatggcaacacctagaagttaccacccctttccatggcaacagcccaacaacccagaaattaccaccctcatcctagaaatttctgcataaatcaccccttaatttgcatataaatcaagtaggtttaaatatgactgcagagctgccactgagctgctactctaggcacactgcctacggggtaggcctgctctgcaaggagcagtacctctgctgttgctgtaaactgttgcttcaataaacgttgctgtttaacaccaccagctcgcccttgaattctttcccatgcaaagccaagtagtctcctgggctaagcccccatttgggggctttcctgtcctgcatcactagtgccttgctgctcaaagaggggtctcagaccagcattggtattgctttcattagaaatgcagaatgttgagcctccctccagaactactcaatcagaatctacattttaacgagattccgaagtgatctgtgtgcacattaaaatttgagaagccccactttagcacctcacctttgtgacagttaattttcctattgagatgcttttttaaaagccaaaagatttatgaagagaaaccagaatagtgatccttttttagcttacaaattgtgtcttactgtgctgtatgttaaagtgtggtgaaatattttacctctagaaagacaggacattacaatgtctagaagtgttttaatgttcagtaataggtaactgatgaccattttattttctctcccctaggatattcttggtgatcttggaagtgtccgtatcatggaatcaatctctatgatgggaagccctaagagccttagtgaaacttttttacctaatggcataaatggtatcaaagatgcaaggaaggtcactgtaggtgtgattggaagtggagattttgccaaatccttgaccattcgacttattagatgcggctatcatgtggtcataggaagtagaaatcctaagtttgcttctgaattttttcctcatgtggtagatgtcactcatcatgaagatgctctcacaaaaacaaatataatatttgttgctatacacagagaacattatacctccctgtgggacctgagacatctgcttgtgggtaaaatcctgattgatgtgagcaataacatgaggataaaccagtacccagaatccaatgctgaatatttggcttcattattcccagattctttgattgtcaaaggatttaatgttgtctcagcttgggcacttcagttaggacctaaggatgccagccggcaggtatgtattttacatttttattcttatgtatctggtattttgtagttaaacaactaagcaaatatcaaacattttaataccaaactctgacactttccaatgattatcatttgaaaattaattatgagcacctgaagattaatgtcctgaccttgtaagggcacattcccattcccaacatgatgtggaaaactgggaaaataacgtgaaagtcatccagttcaacttgagaataaagcagatggggcactctgtcaacaccattgtggaacaagcttttataagtaaacacataaaatatgttttaaaaatcttttaaatgtgcttatgcattacaattaagcatgattataaaacacttttattgtttttgtccataaagacagttgattagattccttagaaaataagtttcagtattatatcattgtatgctgtatatcagtcatgataaccatttactttccagtctttattttaatgactggtaaaagaacataggctcttctacaggctatttctgaatccttttttctcttttgcatatccaccaaagtttagcagtggatatagaataagcaaattagaaccaggacctgtgagacaaacctgaatttaataatatgcccatatttatgccaattttaaatttttaacagaaaaaaatgtggaacagtgattaaattccaaatgagctacagaaatagtctaaatttgtattatgtagcatttgtgcctttattttgagtgtttggtttatttttagacttattataccgtattataatttatacaaaattttttccaaatgagtttttaaaaaagtttattccaccattgtcacaactgtaataaattaatttagaatacttttttcttatttgtgttataaaaggacctctattttaaaagttcataaatgattatataatattcattcaaataggatttgtcattcatctggctaatgttatccaagattaataatccaaagagtgttatattgtcaccattatgtaaatagaaacatgcaaatatttctatgtggtctattttagagtccttatacaaacatcttcagggatatatttaggaatttgttttccccaaacattacttggagactctgtagcaatatttttctagccctgaatgaggtggcctacccattagtaatagtagctcactccagtaatgaacttggtgctcaataaatacttgttgttgtaggctttcaaactattgaaatctgttagatactataatatagctgaaaattcaacaagtatttattcctcaaggtcatcacaggtgatggtccgtaagtggagcatgcgattgctaccatttttataaacaacaatggtaatgctgagtctttttgttttttccacaggtttatatatgcagcaacaatattcaagcgcgacaacaggttattgaacttgcccgccagttgaatttcattcccattgacttgggatccttatcatcagccagagagattgaaaatttacccctacgactctttactctctggagagggccagtggtggtagctataagcttggccacattttttttcctttattcctttgtcagagatgtgattcatccatatgctagaaaccaacagagtgacttttacaaaattcctatagagattgtgaataaaaccttacctatagttgccattactttgctctccctagtatacctcgcaggtcttctggcagctgcttatcaactttattacggcaccaagtataggagatttccaccttggttggaaacctggttacagtgtagaaaacagcttggattactaagttttttcttcgctatggtccatgttgcctacagcctctgcttaccgatgagaaggtcagagagatatttgtttctcaacatggcttatcagcaggtactgaatgtgcttgttatttatctgatgctagtaaaatactttttattagtataaattgtaaaacataaaattttacatgccctgtaatggaaatttgattttggtatactgcgggaggggaaagaattgttctttaaacaatgtttttgcaaaataattaggtggctaattcaaaattatttaagtaaaggctgctaccatccttttccatacagaataaaagcagaaaaatagagggttgggttctccccctttttcaatgttataattgcaatgagtgctttcagtattcaacaattcattattttaatgttttataattggctgtgctccacaaaatgatgaggcaattctcagtaaatatatacaataaaattagaaccagtaaaaatacaaaacagaacaggaagacaagatcaggagaaaaaagtcgaatacacctctgctaagagtgtctccacagcttctcttttggctttgagattttcaatacaatgagaagggagaccctattatttacaaagctcttgttatcaaaaaccagaaaagataatagttccacaggtgaagcttttctagcacttagctctaaaaaaaaaaatctcagggagcacttcatggaaggggtttgattatgaggtagactatggttttcctccataattcccaatccacaaatgtaatttaaggggtttccctgaagctgtttggtgtagcatttctccatgaaagccaagaacattgcaccaaaacaaatgtgtaaaagcatctgcattttgtaaggatcgaaggcatcatagtccaagtatgtggcatctagtacttaagcttgtttcaacaataaaacctaaaataatatttttctaattagtagattgataacctttaaaccattcactccctgaaaaaaaacttctcttaatgggatactaaggcttttattgttgctcagtcagctcccttgcctccttccagtcatttgcccagatctcaccttctcagcgagtcctatgctggataccatcttaaatgccgctgcctctgccccaaccagtattcccaatccttctgacttaccctgctctacctttctttttttaataacacttaccatcttctaacacacttgatttccatgttaaaaatacatttaccagtgtctgccttcccccaacagaaagtaagttcatgagaagagggatctttgtctatctttttcactgatgcatacccagtgcctagatttgagcctagacattgtggacactcaaacagcccatttgtggatgaatgaatgaactgggagagcaggtagatccaggttgtagtctccgagtacactgggtagtgctgtttttctgtattgtatagatatcaaataagaagatggtaagaactctgtggcctctttcaagatgatggtatgattgccttagggaactaatagctaagaagcagcttttcgttgttaaatttcaagtatgttttgttaactggaattggacaaagttaaactgttgttaagttagaatctgttttccattaatagatacttatttaaatcaaaaatttcagctgaaggagtccaatacttgatttatactctaattatattctgaatgtaaatagaacttctaaaggtagtccctacacaaaataccacaaattcagagttcaccgtctgacttgattatatacacattatcaatgtaaggaaaagacatttggaaaaaatactgcatataaatgacacaattggatagttggggatcatattaaatgaggcagttcaagtggataaatgagctccattggcctttatagctagggaaatcacagctttctaggaagagaagatgagaagaaagataaaacagagatatattattcatgtgatggaagaagatactgacatagtttagaaattccctgaccggatccaagttgaactaaggccagactatatcccagatattcaaccaagtttaaaccagcttgtaatagtacttcaaaactaagtttaactgtcagtaacttcttttgtgtcaccctagaaccaactactaggtattttatggtgttggattccagagtccctgtaatgatgatggcaaagctttgcccctctattctagcacgtatacaaggaaagagaaagttttgtcctccttttgtttaattctcttttcccttacacctggagcagtatcatccagtaacaggttctctgtaatggtttgttagactaaattagtacaacttaaatacgtccatatatgaccaggttcttcttatgccaagagtgaactctgtgctgaatcagttaatgttctactaaataaaggaaattcacattcgctttcttgttaggttcatgcaaatattgaaaactcttggaatgaggaagaagtttggagaattgaaatgtatatctcctttggcataatgagccttggcttactttccctcctggcagtcacttctatcccttcagtgagcaatgctttaaactggagagaattcagttttattcaggtatgtggggttttgtttggtgaaggattgtgcaggataggatttccttgttaagaacaactgcattttaaatatgttccttattaaaagggtgcctttgaggctgtatttatgcatctagatacattatgctggaagccagcttaggattgctctggttaaataagtgaaagaccagtcagtatatgattgtactggaagactttgacagcactgccttccagtatactatgttaagaacaaaaaagttatcttaaaagagaaaaaaaaaatgaaagttgggaaggatgagcttagatcaaatttaatgttgaaagtcaatttattattagccaagtgaatgaaaaattattttatgttttgagtcatcttgatttgtccagaaaaatcttattaatttgaactcaagtggggatgtcaatctgaatattttaaagaaatgtgtgtatatatacacacacatacaaacacaagcagtggcaaactaggtaactagagtaatggattataacatgcaaccagccttaagaattttgttagtatatcagtagtatactaatacgtatggatgtctgtaaagggatttcaaaccaccattgtattctttaataagttaaacattcaccttctccaataatatctaaataataaggttgcatattttaaaaatatataactgaaacatagacccttcctatattttcacaaaatctgtactggttgtatccaaatggtttacagcatagtagacagattcatgtcctttggtggtacacttaagttttgtttcaattcattgcttatttgcttgtttttttttttaaggtcctgtaaaaatctcattcaaagcagggccaaaatgcttatctgaatttatttttcctttttgaagaaaagggagagtactttcccaacagctagtttaatcatacccgaaaagaaatagaaggttctagacagatgcaaattatcattataaatttagatgagtaattgcaaatattttgcctgctggagggttgatattttccagtaaagttagacattacatcactatactgatgtaatattacttttatataacagactattcttcaaagtaagcactcttaaacataataatttagcgaactaaagaatgatgagcttttagaatttaaactgtaaagtgcctaactgaagtattcttaataaactctatattttaattgttgtttatattaatactgcaggatttttcatatttgcctattaaccagtgtgtatatatgtgtgtgtgcccatgaggatgctcatttaattttaatttaatttaattaattttaataattttaaattagtttatttaattttatcatatgtctgtttatgtattaacagtgatgtgttacctaacagtagggaacgttctgagcaatgagtcgttaggcagttttatcatgtgaacatcatagagcatatttatacaaaccatgacctattgctcccaggctacaaacctgtacagcatgttactgtactgaatattacaggcacttgtaacacaatggtaaatatttgtgtatctaaacatatctaaacagagaaaaggtacagtaaaaataaggcatataatcttatgggaccaccgttgtatatgcagtccatagttgaccaaaatgcccttatgtggcacatgactatatttatgtgtatgtgtatacacacacacatacatacacatttctttaatacacaactggtgggaatgtgaataatttttataaagaagagtctagcagtatgtatcagtacccttaaggaaaagctagatgttttgaccaataatcctactattagaaaccagtcctaagaaaataaatcaaaatatggaaaatggcctaacatgacatttatagttgaggaaagttggaaacagtgaattatcaacaaaaaggaatggtttaataaattatgcacatccattcaatagaatattatacagtattaatgtcattttcatatttaatgacatgaggaaaatgttcttgataaaataaatgaagtagtaagaatattaaactgtatgcagtagggccttatttgtgtaacataaggtgtgcatataaataatacatatatatgcatatataaaaatattaatattatttaattcagtagaggacaaaggttaacttgataatttaagacaaaatagttttatcaaaatataaacatggtgtatcttgatagtttaatttatgagtttcagtcatttgtttcttattctttgtttcttttccttcctctcctggcccaagtctacacttggatatgtcgctctgctcataagtactttccatgttttaatttatggatggaaacgagcttttgaggaagagtactacagattttatacaccaccaaactttgttcttgctcttgttttgccctcaattgtaattctgggtaagattattttattccttccatgtataagccgaaagctaaaacgaattaaaaaaggctgggaaaagagccaatttctggaagaaggtatgggaggaacaattcctcatgtctccccggagagggtcacagtaatgtgatgacaaatggtgttcacagctgccatataaagttctactcatgccattatttttatgacttctacgttcagttacaagtatgctgtcaaattatcgtgggttgaaacttgttaaatgagatttcaactgacttagtgatagagttttcttcaagttaattttcacaaatgtcatgtttgccaatatgaatttttctagtcaacatattattgtaatttaggtatgttttgttttgttttgcacaactgtaaccctgttgttactttatatttcataatcaggcaaaaatacttacagttaataatatagatataatgttaaaaacaatttgcaaaccagcagaattttaagcttttaaaataattcaatggatatacatttttttctgaagattaagattttaattattcaacttaaaaagtagaaatgcattattatacatttttttaagaaaggacacgttatgttagcatctaggtaaggctgcatgatagcattcctatatttctctcataaaataggatttgaaggatgaaattaattgtatgaagcaatgtgattatatgaagagacacaaattaaaaagacaaattaaacctgaaattatatttaaaatatatttgagacatgaaatacatactgataatacatacctcatgaaagattttattctttattgtgttacagagcagtttcattttcatattaatatactgatcaggaagaggattcagtaacatttggcttccaaaactgctatctctaatacggtaccaatcctaggaactgtatactagttcctacttagaacaaaagtatcaagtttgcacacaagtaatctgccagctgacctttgtcgcaccttaaccagtcaccacttgctatggtataggattatactgatgttctttgagggattctgatgtgctaggcatggttctaagtactttacttgtattatcccatttaatacttagaacaaccccgtgagataagtagttattatcctcattttacacatgagggaccgaaggatagaaaagttatttttcaaaggtcttgcagttaataaatggcagagtgagcattcaagtccaggtagtcatattccagaggccacggttttaaccactaggctctagagctcccgccgcgcccctatgcattatgttcacaatgccaatctagatgcttcctcttttgtataaagtcactgacattctttagagtgggttgggtgcatccaaaaatgtataaaaatattattataataaacttattactgcttgtagggtaattcacagttacttaccctattcttgcttggaacatgagcctggagacccatggcagtccatatgcctccctatgcagtgaagggccctagcagtgttaacaaattgctgagatcccacggagtctttcaaaaatctctgtagagttagtcttctccttttctcttcctgagaagttctcctgcctgcataaccattcattagggagtactttacaagcatgaaggatattagggtaagtggctaattataaatctactctagagacatataatcatacagattattcataaaatttttcagtgctgtccttccacatttaattgcattttgctcaaactgtagaatgccctacattccccccaccccaatttgctatttccttattaaaatagaaaattataggcaagatacaattatatgcgttcctcttcctgaaattataacatttctaaacttacccacgtaggtactactgaatccaactgccaacaataaaaagacttttatttagtagaggctacctttcccaccagtgactctttttctacaactgccttgtcagtttggtaattcacttatgattttctaatgttctcttggtgaattttattatcttgtaccctctttttttttttttttttttttaaagacagagtcttgctctgtcacccaggctggagtgcagtggcacgatctcggctcactgcaagctctgcctcccgggttcacgccattctcctgcctcagcctcccgagtagctgggactacaggtgcccgccaccatgcccggctgatttctttttgtatttttagtagagacggagtttcaccgtgttagccaggatggtctcgatctcctgacctcgtgatccgcccgccttggcctccaaagtgctgggattacaggtgtgagctaccgcgcccggcctattatcttgtactttctaactgagccctctattttctttattttaataatatttctccccacttgagaatcacttgttagttcttggtaggaattcagttgggcaatgataacttttatgggcaaaaacattctattatagtgaactaatgaaaataacagcgtattttcaatattttcttattccttaaattccactcttttaacactatgcttaaccacttaatgtgatgaaatattcctaaaagttaaatgactattaaagcatatattgttgcatgtatatattaagtagccgatactctaaataaaaataccactgttacagataaatggggcctttaaaaatatgaaaaacaaacttgtgaaaatgtataaaagatgcatctgttgtttcaaatggcactatcttcttttcagtactacaaaaacagaataattttgaagttttagaataaatgtaatatatttactataattctaaatgtttaaatgcttttctaaaaatgcaaaactatgatgtttagttgctttattttacctctatgtgattatttttcttaattgttattttttataatcattatttttctgaaccattcttctggcctcagaagtaggactgaattctactattgctaggtgtgagaaagtggtggtgagaaccttagagcagtggagatttgctacctggtctgtgttttgagaagtgccccttagaaagttaaaagaatgtagaaaagatactcagtcttaatcctatgcaaaaaaaaaaatcaagtaattgttttcctatgaggaaaataaccatgagctgtatcatgctacttagcttttatgtaaatatttcttatgtctcctctattaagagtatttaaaatcatatttaaatatgaatctattcatgctaacattatttttcaaaacatacatggaaatttagcccagattgtctacatataaggtttttatttgaattgtaaaatatttaaaagtatgaataaaatatatttataggtatttatcagagatgattattttgtgctacatacaggttggctaatgagctctagtgttaaactacctgattaatttcttataaagcagcataaccttggcttgattaaggaattctactttcaaaaattaatctgataatagtaacaaggtatattatactttcattacaatcaaattatagaaattacttgtgtaaaagggcttcaagaatatatccaatttttaaatattttaatatatctcctatctgataacttaattcttctaaattaccacttgccattaagctatttcataataaattctgtacagtttccccccaaaaaagagatttatttatgaaatatttaaagtttctaatgtggtattttaaataaagtatcataaatgtaataagtaaatatttatttaggaatactgtgaacactgaactaattattcctgtgtcagtctatgaaatccctgttttgaaatacgtaaacagcctaaaatgtgttgaaattattttgtaaatccatgacttaaaacaagatacatacatagtataacacacctcacagtgttaagatttatattgtgaaatgagacaccctaccttcaattgttcatcagtgggtaaaacaaattctgatgtacattcaggacaaatgattagccctaaatgaaactgtaataatttcagtggaaactcaatctgtttttacctttaaacagtgaattttacatgaatgaatgggttcttcactttttttttagtatgagaaaattatacagtgcttaattttcagagattctttccatatgttactaaaaaatgttttgttcagcctaacatactgagttttttttaactttctaaattattgaatttccatcatgcattcatccaaaattaaggcagactgtttggattcttccagtggccagatgagctaaattaaatcacaaaagcagatgcttttgtatgatctccaaattgccaactttaaggaaatattctcttgaaattgtctttaaagatcttttgcagctttgcagatacccagactgagctggaactggaatttgtcttcctattgactctacttctttaaaagcggctgcccattacattcctcagctgtccttgcagttaggtgtacatgtgactgagtgttggccagtgagatgaagtctcctcaaaggaaggcagcatgtgtcctttttcatcccttcatcttgctgctgggattgtggatataacaggagccctggcagctgtctccagaggatcaaagccacacccaaagagtaaggcagattagagaccagaaagaccttgactacttccctacttccactgctttttcctgcatttaagccattgtaaatctgggtgtgttacatgaagtgaaaattaattctttctgcccttcagttctttatcctgataccatttaacactgtctgaattaactagactgcaataattctttcttttgaaagcttttaaaggataatgtgcaattcacattaaaattgattttccattgtcaattagttatactcattttcctgccttgatctttcattagatattttgtatctgcttggaatatattatcttctttttaactgtgtaattggtaattactaaaactctgtaatctccaaaatattgctatcaaattacacaccatgttttctatcattctcatagatctgccttataaacatttaaataaaaagtactatttaatgatttaacttctgttttgaaatgttgtatacacgtggatttttttctcattaaataataattctagta

SEQ ID NO: 2004 - DNA, 25994 bp, Homo sapiens
cgccccctccgagctccccgactcctccccgcgctccacggctcttcccgactccagtcagcgttcctcgggccctcggcgccacgagctgtccgggcacgcagcccctagcggcgcgtcgctgccaagccggcctccgcgcgcctccctccttccttctcccctggctgttcgcgatccagcttgggtaggcggggaagcagctggagtgcgaccgccgcggcagccaccctgcaaccgccagtcggaggtgcagtccgtaggccctggcccccgggtgggcccttggggagtcggcgccgctcccggggagctgcaaggctcgcccctgcccggcgtggagggcgcggggggcgcggaggtgagcgggtcggggaggagcgcgaaagaaggtagcggcggcggagttgagggtcaagatgcagtctgcgccacgcgctgcatccatcctccccgattctgcgccctcaccgggcgtccgccctgagctgcggggtccctcatctcctggcaccttaaggtggaaagtgagaagggtggagaagggtgtctgttccactgattccccctcctcctcctcttggttcctagagctaagggcaagtcctgaggttgggcccaggagaaagaaggcaaggagacattgtcccaggtaggatgtgtcccagcaggaaaggacaggcaggttactttcgcccccttgatagtctccctgctactttgggttgatgcagggcatttcatggaagatcatgcagtgctgctttgcgaacaggtatttctagcagtcatttggtttatttcccagtaatgtaatcgtggtgtttaggccatttctgttagaaagtaattggcctcttctttgactgtcctaaattatctttgaaccctgtgttcagcctcagccaaaacttgttgaaaattatgccctaaaaatcttgctcttaaaatagagcagagagataaagagcatttttgttggaagatttccatttattatctctcccaccccgtggagaaggattggtgtcagtttttactcctcgggcagttagttttttagatggaaagacagtccaggccatagttaattatcgctcatcagtataggagaaaaagaattcagactcctgccccacccccacccccacccccaacctcctgacttagattctggtccttttaacagccccgctgcttggaaccctttttgttttctaaaccacctccccatccttccttttctccactttattatttcttcattttattgatctgtttattttttctttctttaaccctataatttttttactccgattctctcttggttgcttcaaagcttagaggctatttaatggaaaagcaaaacaaaacaaaacaaaacacccgtcctaaataatttgcaggatgtttagaaacataaagagtaactatgtgtgctgccattgggatggctgcactctctgcctcttagctagtcactctgtcagggtatggggaaatgagacaatattgagaatgacaacttgagcaaattgtgcagtaaggaaatgaaaagctttatccaagtcactttttattgtactggtgctatggaaaatgtggtgaatgaacatagttgtattttagtactgaaaaaacaggacaggtgaagacaaatttttaaagaaaggattgtaaatgagttagaaaagtgagaaagaagatacaccaaaaatgtgaaagagtaagactgcaggcgtgataaaggacataggacatcaggagatgtatttatccctgctgggccagaaaccaggacattgaggtaactgagacattaacataacaataacattgataaatcacctaccccttaagggcccacatgtgttttcagcaaaaagagaaatctgatctagagaattattacatgtctttttgtcctgaatttttttgatgtattccataacaaagaatttttattgcatccttagttacactgccagccaatgtggaggcagtgatcacggacaagacaaacatggttcttccctcgtgcagtttattgtccaatgggggaaatagtaaacagtaaagaaacaattatataaaatattacaaaataaatttaacaagggctgagtgaattattctgctatagagatggaacagtatatggaaagctcccaaggtacataaagtggttgttgttttctctttctagaagagaatgctgtgggtggacaatatacagataaggttagagaggggaagcggggactaactcattcaggaccttttacgtgatagtcaggaagatggctgtagttctaagtacaaggagcaccgattttaaggagagacattttatgacgatttacattttaagatgattttagctgctgtggagatgtttggaaagggtcaaaagagaaagtaggctgacccattaggaaatgtttgcagagttcaggtgagatgatagacacctggactagcctggtattggtggagagggatttatgaaatatgttggagaacaggaattggtgcaggattttatgtcaaaagtgagggtcagcaaggacttaagaatgactcccaattttctgattggagcaactggtggataatggtggcatttacacatttccaggcgaatgggaccagctctgggtggaaaaagttcaggtttgaacctgtgaagtttgagatgtcacagaaagaggtcataaccatatccccttgggaagcaaaaagggaggctctccaggacataagtggatagactggtctttgataggtaaaattggtgattgttaatttaaggtgaaactaatgagctcagttttctggtttttctccagcaaccttcaccaacgtggatacagatacagagaaaatggatagctgggtccaggactagagttttgccaagcagatatgatggagagtaagagagctgaggatctttttaagggagtgactacaaatctagcctcggtttaaagagaaaccagagcaggctgaaggagagtgcaggatattaagcaattagagaggtagaggtcaacggatcagatttcttttgctgtttagaattatcagtgtgaatatttaaactaagattattggaagtcctggagacagtgcttggagatttcaggcagtgagtgactgaggtggggtagaggcaaaaattcattgtctccaatgagtaagtcaaggaaataagagcccctgaagttgaatggttcatccacttgaatgataaagtccaggaaaaacatgatagctattagggtagagaggatgaccatgtatatactgggagccagagtctgcagtcataaggaataaactagaagtcagtagaggacagcagtgaggacagcagtaaggacagggagagggtatggtgaagtaccatgagcttcaaaggagctgggtgtttgcaggagagacaatgaagaagagatgttcagatgtgggcttacaaagtgaagattacaccaccccacctcatggccctggagaattatgttttcttgatagcctctccaaatctgcaggttgtgaaatgtcatcaaaacctctgtggacagccctttcagagttgctgtcatccaataataaatgccctatttatgtgtgaaacaaattaggttctatttttcaaaagtaacatagcacaacaggtgccattcagcttcaggaatgttcaggaaatccttctaaactgaaaaccttaagaggctgtccagctgaatgtaactgaattccctatcaaaataatacattctcaagtattaaatgtgtacagcaagtcaaatgcccattcaagaaaacgatgtcattgacacagacttttagattgagctcccgaagttgaagtgttaaatatagggtggtgatattaccattattacacagcttcaagacttatttagtgttggaaactaccaccagagtcaagtataacctatttgtttgctgtttaacaaaggaaattgagactcagagaatcaaagtgattgcagaagcttaggcctgctctttcacccctacactatgaagacaaaactttctataaatgacatagttgttttttgtttttgtttgtttttgtttttgttttgaggctgagtctcactctgttgcccaggctggagtccagtggcgcgatcttggctccctggttcaagcgattctccttcctcagcctcccaagtagctgggattacaggcacctgccaccacccctgcctaatttttgtgcctttttagtaaagatggggtttaatcatgttggccagtctgatcttgaactcctgacctcaagtgatccacctgcttcggcctcccaaagtgctgagattacagacgtgagccaccatgcccagcctataaatgacatagttttatcagttatttaatttggattccttatgaataacttcaaaagaaaaggtatagacactgtggacatcacctgggagcttgtgaaaaaatgcagaatgtctaacctccctctagacctaaagaatctgagtgtgcattttaaagaggtccccaggtgatcatatttgcattaaagtttgacaagtgcctttctagtgagtcattcccttggaaacagtggtctgctcaggtcagcaggatcatgatgcctggagaactggggaggggatccccttgtagaacagaaagaagagatacagtcatggaaatattccgaattttgaatattatgaaacaacaggaacaaagtatgttgtgcaaggagtgacgcattttaaggaatggcattgcctttcccagaaagtgaagagaggaaattggaaaattgtgagtggaccttctgatactgctcctccttgcgtggaaaaggggaaagaactgcatgcatattattcagcgtcctatattcaaaggtaactactactctttcgcaagtgtaatttttcattactacaaacaacaacgtaaaaattaacataagtgagggtcagaaagccacatctactatcgccaaatgatgaaagtattagattgaattctgaatcttttactagagtgattttcaatcttggttgcataataaaacatctgctaatcttttttaaaaaatgctgttgctcaggatgaaccccagaacaattaagtgaaaactgggtggtaggggggtgacccgtcatcactgtgttttaaaacttgccaggtcattggagaatgcacctagggttgagaaatactgctttagtagctcattcagaagcagctctgagattgcagttctgctactccatgtgccaaaacagtgggactttccctcactaccataagcgtagtgccaagccaggtcagcaatattcaggtcaccctcactggccagttttcagaacattgagggaagtaggatttatttcttgaagaagcctgcttagactaacttttaaaacaaattgatacatgttacatatctatggggtacacatgagtatttgttatatccatagaatgtgtaatgatctggttggagtttttggggaatccatcaccttgagtatttatcatatctatgtgttaagaacatttcaagtcatctcttctagctactttgaaatacacagtacattgttactgactataggcaacctactttgctattgaacattagaacttacttcttctaactgtacatttgtatccatgaaccaacatctcttcctcccctcctcccatcaacacatccttccagcctctgatatctctcatgctattctctacctccatgggatccacttttttagctcccacacatgagtaaaaacatgtgatatttgcctttctgtgcctgggttatttcacttaacataatggcctccactcctatccatgttgctgcaaatgacacgatttcattttttaaggctgaataatatttcattgtgtatacataccacattttctttatccatttgttgatggacatgtagattgattccatatccttgctagtgtgaatagtgcgcaaaaaaaaaaaaaaaaaaaaaacatgtgaggacgggtatctctttgatatactaatttcttttcctgtagataatacccggtagtgagattactggattgtatggtagttccatttttagtcttttgagaaacaacccctatactgttgtccacagaggctgtactaatttacatttccaccaataacatataaggattcccttttctctgaatcgttgtcagcatctgtcatttttctcttttaataatagcagttctaattgggataagttgaaatctcattgtggttttgatatgcatttctctggtgattagtgatgcttagcattttttcatatacctattaaccatttgtttgtcttctttggaaaaatgtctattcatgacctttacccatttttatgggattatgtgttttttattgtcagttgtttgagttccttgtatattctgaatattagtcccttatcagattaatagtttgcaaatattttcttctattcaataggtggtctcttcattctgttgattgtttcctttgctgcacggaagtcttttagtttaatatagtcccatttgtctatttttttgttgttgttgctgtgcttttgaggtcctagccataaaatctttgcctagaccaatgtcttcaaatatttccccaatgttttcttcttgaaatgaggggttttgggtcttatgtttaagtctttagttgaccttgcgttgatttttgtatatggtgagggacaggggtccagttttattcttctgcatacagatatccaattgtctaagtaccatatatttgaagaggatatcctttcctcagtgtatgttcttggtgcctttgttgacaatcagttggctgtaaatgtgtggattttttttgtggattatctaatctgttgcattcattgatctgtgcatttgtttttataccggtaccatgttttttcggttactattgccttgtaatatattttgaagtcaggtagtgtgatgccttcagctttgttctttttgcttaggattgctgtagctattcaggatattttttggttctatatgaattttaggattgtcttttctaattctatgaaaaatcacattggtattttgatagggattgcattgaatctgtgtattgctttgggcagtatggtcattttaatattaattcttccaatccataagcatggaatgtttttccattcgtttatgtcatctttaatttttttctacagtgctttgtagttttccttgtagcaaactttcacctccttggttaaatatattcctagttgttttttgtttgtttttgttttttttatagctattgtaaatgggattgccttcttggtgtctttttcagcaagttcattgttggtgtatagaaatggtactgatttttgtatgtcgattttgtatcctgcaactttattgaatttatttatcagatctaagagtttttgtgtgaaatctttaggtttatctagatctaagatcatatcatcagcaaagagggataatttgaccttcctcttttccagtttgggtaccttttattctttctctttcctggttgctctggctaggacttccaatatgatgttgaatagaagtggtgaaagtggcatccttgtcttgtttctgttcatagaggaaaggctttgagcttttccccatttcaaaataatgatagctatattattattatatagatcatataagcccttattatgtgaagcatattttttctatccctagtttgttgcaagttttatcatgaggggatgctaaattttctcaaatgttttttctgcatctattgagatgatcatatggttattgtccttcattctcttcaggtgatgtatcacagttgttgatttgcatatgttgaaccatccttgtatccctgggatgcattcctggaataaatcccctttgatcatgatgtgtgtgtgttttttttatgagttgttagatttggtttgcttctacagacacacacgcgcgcacacacacaatttttaggagacagggtcttgctctgttgcccaggagggagtgcggttatgcaatcataaatcactgcagccttcaacttctgggctcaggtgattcttctgcctcagctcccgagtactaggacttcaggtgtgtaccaccacacctagctattgtttaaattttttgtagagacgagggtctcattatgttgcccaggctgggcttaaactcctggcttcaatccatcctcctgcattggcctcccaaagtgctgggattacaggcataagccatcatgtctggcccttggtttgctagtattttgttgagagtttttgtatctgtgctcatcaggaataatagtatgtagttttcttttttgttgagccttgtttgcttttggtgtgaagataatgctgacctcatagaatgagttaggcagaattccctcctgtttaatgttttggaagagtttgaagagaattggtgttaggtctgttttgaaagtttggtagaattcggcagtgaagccatctggccctggacttttctttgttgggagttttttaattactgcctcaactttttttgttactggtctgtccaggttttccatttcttcccatttcaatcttggtagcttgtatatgtgtagcagtttatccatttcctctaggttttccagtttgttggtgtatagttgttcataatagcttctcatgatcttatgtatttctgtggtatcaattgtaatgtttccttttccatttctgattttttattggagtatttcctcttttttcttggttagtctagcaagtgctttatcaattttatcttttcaaaaaacaaaactttttgtttcatccatcctttgtattgttttttaagtcccaatttgtctagttctgctctgatctttattattactttccttttaccaatttggggtttggcttgtttttgcttttctagttccttgaggtacatcattaagttgtttatttgaaatcgtaatgattttttggtgtaggtgcttgttgatataagcttccatcttagcactgcttttgctgtatctcatgggtttcagtgtgttgtgtttttatttttatttgttgagggaaattttttgatttcttccttaatttattctttgcccccgtagtcatttaggagcatgttgtttaatcatttatttttacagtttcaaaagttcctcatgttgttgacttctagttttattccattgtggtctgaggaagtacttgatatgacttcgatttttaaaaaatttgttgaatcttattttgtgttctaacatggtcattcctagagaatgtctatgtgctgatgagaatttgtattctgtaactgttgtataaaatgttctgtgaatgtttgttaggtccatttggtctaacgtatagtttaaattcaatgtttctttgttaattttctgtctagattatctgtcagatgctggcaggcggtgttgaagtccccaaatgttgttgtattggcgtctgtttctccttttagatctgataacactttatttatattaatatatctgagtggtctgttgttgggtgtatatatgtttagaattgttatatcctcttgctagaatttatctattatcattatataatgaccttcattgtctctttatactgtttttgactcaaactgttttatttgatataagtatagtgacttttggtttccatttgcatggactatctttctccatccctttgctttcagtcttatatgtgtttttatatgttagatgggtttcttgtacccagcatatacttgggttatgattttttatctattactagtccatatcttttcagtggaaagtttaatccatttgcattcaaagttattcaacaatgaaaacttcccaagtctagtgagagatgtagacacccggatacaggtaacttagagatctccaaacagatacaatacaagaaggtcttccccacagcacattatagtcatattgtcaaaagtaaaagacaaagagtgaattctaaaaacagcaagagaatgaccagtcacctataaaggaactcccagcaaaataaaatttttacctgttcacattctgatttacagaagggatttgaacttgctttgtaaaataagcagataattaatgttgttttgtttttgtttctgtttgaaaaagtcttgatcatcatgagtgttagatttaaagattttgcaattcttatattttgggagatgctgcagtatatactcagaagaactccaggctgggatataggaaacttggattcccttgtgtgaatctagcaacctttttcacccttagataatgctcatgattaccattaactttcgaatgaagtgagcatggatttcattacttctggtttttttaaccactcctgattcccagcatagctagtgacatctccaaatggatattgacaggtttttttcctaccctggtacctctgactcctgcctgcctttctgggtgcatggaccacaccaagggagtggtctatcttgaaaggtgtgaaatgaaacatgtaattgatttaaaaatagtaaatgttcttctttcccaggatcgggtgctcctaggtaactctgaggagcaatgaaatgaccaaagaaaaaggaataatatactactttgagtacaactgtaattgttacaccttgatacttataaccccccaaaaacaccctttcctaaactccttacatgcacctaaataacacatgtcttagctggacaactacctggcttccctattttctgtctttatgtccttggataaattaattatcttctgcaggtctcagtttcctcatctacaaagtgggtatgacagtattagcacctgtctcttagggtggttgtggggattcaatcagttaatacataaaaaccacaagagagctgaaatacattatgtcctatataagcattaagtaatattactataattattgtctttctaaagtttaacatactgatgtatttggagttactggatgtgactcatttctagggtaaaaagttgaattttcctggctgtagtcatttcaaatttcatttagtaaaaaccccaacttttttttgaaacattccacctgtgcctgtaaagtccattaaatcctctgaaatggtccacatctgctatgagcatagaagaaattgtgcaatgagggtagaatggaagagtatttttctttcagacccaatttcgacactaattcatggcaacctgatttgtattcttgagcaaattattccaaatatgaacatttcagatgctagtctctcaactaaaaaataatttgagagatttttccaggaagaataactgcatcatagtttatgcagccaacaaatgaaagggtgtcatgttgcggtccaaagggcgtgggtggatgagcagaaagaatacttgaagggctgtaggcaggtgaaagatgattttattcaacagcagctctgatcaacaactttctcacactgtccatcctgtctcagctgcttagtctggtggctcccacacacacagctcccttgccttcagggtcagcagcttaactatttctctctctgggcatgggcaagccaagctgggtcctgactcccccatctgtctgcaaagacagacagctctgactctctgtctctgagcacaagagtgcctctacagtgtccacagggcaattataccttttacagacaatagtggcttagagccaagtgatgagttttccctatgtcatagcgatggtggtgagcttctgttatgtctacatggctatgataacaagtaacaagtgaagttatatgcttgcgctctgaactcactcactctggatgtttacctctgcctgtccttgaccaaagcacagccatgttctttacaaaggggaagaaaaagatttcatacatattatataatttaagatcataaacatgttactaatcctttttccataggtaagctatctttctcaatgatacattgtaagatgtagggtgaatgatagaagtccatggtatttactcttttgttatattttgatgcctatttttcttaagatattatttaagtgccaggattcattgttagctaatttgtctagctctcatttaatgataaagtcactagctactgaagtatatagggaactttataacctctaccccaaatgactttagacagttttggtttaaatggctttttaaaaaatggtttttctttcttctcttgtcttgtgagccatcacttagtatcacagtcctctctgcctccagcagcatttgtgatttgctgcctctgatctgctcaaaagctgggtaatcatacttgttacaagtgtgtttttccaaaaagttctgagtgaaaacctcagtcccttttttcatgtgctctagtgaggtaggaggcagaacttgaatccagaggcaaggttcagacactggaccaaactgaggtcagggcagaagcacctccccataagacatgcccatcagtgtgccatgtcagttcactattgccatggcaacacctagaagttaccacccctttccatggcaacagcccaacaacccagaaattaccaccctcatcctagaaatttctgcataaatcaccccttaatttgcatataaatcaagtaggtttaaatatgactgcagagctgccactgagctgctactctaggcacactgcctacggggtaggcctgctctgcaaggagcagtacctctgctgttgctgtaaactgttgcttcaataaacgttgctgtttaacaccaccagctcgcccttgaattctttcccatgcaaagccaagtagtctcctgggctaagcccccatttgggggctttcctgtcctgcatcactagtgccttgctgctcaaagaggggtctcagaccagcattggtattgctttcattagaaatgcagaatgttgagcctccctccagaactactcaatcagaatctacattttaacgagattccgaagtgatctgtgtgcacattaaaatttgagaagccccactttagcacctcacctttgtgacagttaattttcctattgagatgcttttttaaaagccaaaagatttatgaagagaaaccagaatagtgatccttttttagcttacaaattgtgtcttactgtgctgtatgttaaagtgtggtgaaatattttacctctagaaagacaggacattacaatgtctagaagtgttttaatgttcagtaataggtaactgatgaccattttattttctctcccctaggatattcttggtgatcttggaagtgtccgtatcatggaatcaatctctatgatgggaagccctaagagccttagtgaaacttttttacctaatggcataaatggtatcaaagatgcaaggaaggtcactgtaggtgtgattggaagtggagattttgccaaatccttgaccattcgacttattagatgcggctatcatgtggtcataggaagtagaaatcctaagtttgcttctgaattttttcctcatgtggtagatgtcactcatcatgaagatgctctcacaaaaacaaatataatatttgttgctatacacagagaacattatacctccctgtgggacctgagacatctgcttgtgggtaaaatcctgattgatgtgagcaataacatgaggataaaccagtacccagaatccaatgctgaatatttggcttcattattcccagattctttgattgtcaaaggatttaatgttgtctcagcttgggcacttcagttaggacctaaggatgccagccggcaggtatgtattttacatttttattcttatgtatctggtattttgtagttaaacaactaagcaaatatcaaacattttaataccaaactctgacactttccaatgattatcatttgaaaattaattatgagcacctgaagattaatgtcctgaccttgtaagggcacattcccattcccaacatgatgtggaaaactgggaaaataacgtgaaagtcatccagttcaacttgagaataaagcagatggggcactctgtcaacaccattgtggaacaagcttttataagtaaacacataaaatatgttttaaaaatcttttaaatgtgcttatgcattacaattaagcatgattataaaacacttttattgtttttgtccataaagacagttgattagattccttagaaaataagtttcagtattatatcattgtatgctgtatatcagtcatgataaccatttactttccagtctttattttaatgactggtaaaagaacataggctcttctacaggctatttctgaatccttttttctcttttgcatatccaccaaagtttagcagtggatatagaataagcaaattagaaccaggacctgtgagacaaacctgaatttaataatatgcccatatttatgccaattttaaatttttaacagaaaaaaatgtggaacagtgattaaattccaaatgagctacagaaatagtctaaatttgtattatgtagcatttgtgcctttattttgagtgtttggtttatttttagacttattataccgtattataatttatacaaaattttttccaaatgagtttttaaaaaagtttattccaccattgtcacaactgtaataaattaatttagaatacttttttcttatttgtgttataaaaggacctctattttaaaagttcataaatgattatataatattcattcaaataggatttgtcattcatctggctaatgttatccaagattaataatccaaagagtgttatattgtcaccattatgtaaatagaaacatgcaaatatttctatgtggtctattttagagtccttatacaaacatcttcagggatatatttaggaatttgttttccccaaacattacttggagactctgtagcaatatttttctagccctgaatgaggtggcctacccattagtaatagtagctcactccagtaatgaacttggtgctcaataaatacttgttgttgtaggctttcaaactattgaaatctgttagatactataatatagctgaaaattcaacaagtatttattcctcaaggtcatcacaggtgatggtccgtaagtggagcatgcgattgctaccatttttataaacaacaatggtaatgctgagtctttttgttttttccacaggtttatatatgcagcaacaatattcaagcgcgacaacaggttattgaacttgcccgccagttgaatttcattcccattgacttgggatccttatcatcagccagagagattgaaaatttacccctacgactctttactctctggagagggccagtggtggtagctataagcttggccacattttttttcctttattcctttgtcagagatgtgattcatccatatgctagaaaccaacagagtgacttttacaaaattcctatagagattgtgaataaaaccttacctatagttgccattactttgctctccctagtatacctcgcaggtcttctggcagctgcttatcaactttattacggcaccaagtataggagatttccaccttggttggaaacctggttacagtgtagaaaacagcttggattactaagttttttcttcgctatggtccatgttgcctacagcctctgcttaccgatgagaaggtcagagagatatttgtttctcaacatggcttatcagcaggtactgaatgtgcttgttatttatctgatgctagtaaaatactttttattagtataaattgtaaaacataaaattttacatgccctgtaatggaaatttgattttggtatactgcgggaggggaaagaattgttctttaaacaatgtttttgcaaaataattaggtggctaattcaaaattatttaagtaaaggctgctaccatccttttccatacagaataaaagcagaaaaatagagggttgggttctccccctttttcaatgttataattgcaatgagtgctttcagtattcaacaattcattattttaatgttttataattggctgtgctccacaaaatgatgaggcaattctcagtaaatatatacaataaaattagaaccagtaaaaatacaaaacagaacaggaagacaagatcaggagaaaaaagtcgaatacacctctgctaagagtgtctccacagcttctcttttggctttgagattttcaatacaatgagaagggagaccctattatttacaaagctcttgttatcaaaaaccagaaaagataatagttccacaggtgaagcttttctagcacttagctctaaaaaaaaaaatctcagggagcacttcatggaaggggtttgattatgaggtagactatggttttcctccataattcccaatccacaaatgtaatttaaggggtttccctgaagctgtttggtgtagcatttctccatgaaagccaagaacattgcaccaaaacaaatgtgtaaaagcatctgcattttgtaaggatcgaaggcatcatagtccaagtatgtggcatctagtacttaagcttgtttcaacaataaaacctaaaataatatttttctaattagtagattgataacctttaaaccattcactccctgaaaaaaaacttctcttaatgggatactaaggcttttattgttgctcagtcagctcccttgcctccttccagtcatttgcccagatctcaccttctcagcgagtcctatgctggataccatcttaaatgccgctgcctctgccccaaccagtattcccaatccttctgacttaccctgctctacctttctttttttaataacacttaccatcttctaacacacttgatttccatgttaaaaatacatttaccagtgtctgccttcccccaacagaaagtaagttcatgagaagagggatctttgtctatctttttcactgatgcatacccagtgcctagatttgagcctagacattgtggacactcaaacagcccatttgtggatgaatgaatgaactgggagagcaggtagatccaggttgtagtctccgagtacactgggtagtgctgtttttctgtattgtatagatatcaaataagaagatggtaagaactctgtggcctctttcaagatgatggtatgattgccttagggaactaatagctaagaagcagcttttcgttgttaaatttcaagtatgttttgttaactggaattggacaaagttaaactgttgttaagttagaatctgttttccattaatagatacttatttaaatcaaaaatttcagctgaaggagtccaatacttgatttatactctaattatattctgaatgtaaatagaacttctaaaggtagtccctacacaaaataccacaaattcagagttcaccgtctgacttgattatatacacattatcaatgtaaggaaaagacatttggaaaaaatactgcatataaatgacacaattggatagttggggatcatattaaatgaggcagttcaagtggataaatgagctccattggcctttatagctagggaaatcacagctttctaggaagagaagatgagaagaaagataaaacagagatatattattcatgtgatggaagaagatactgacatagtttagaaattccctgaccggatccaagttgaactaaggccagactatatcccagatattcaaccaagtttaaaccagcttgtaatagtacttcaaaactaagtttaactgtcagtaacttcttttgtgtcaccctagaaccaactactaggtattttatggtgttggattccagagtccctgtaatgatgatggcaaagctttgcccctctattctagcacgtatacaaggaaagagaaagttttgtcctccttttgtttaattctcttttcccttacacctggagcagtatcatccagtaacaggttctctgtaatggtttgttagactaaattagtacaacttaaatacgtccatatatgaccaggttcttcttatgccaagagtgaactctgtgctgaatcagttaatgttctactaaataaaggaaattcacattcgctttcttgttaggttcatgcaaatattgaaaactcttggaatgaggaagaagtttggagaattgaaatgtatatctcctttggcataatgagccttggcttactttccctcctggcagtcacttctatcccttcagtgagcaatgctttaaactggagagaattcagttttattcaggtatgtggggttttgtttggtgaaggattgtgcaggataggatttccttgttaagaacaactgcattttaaatatgttccttattaaaagggtgcctttgaggctgtatttatgcatctagatacattatgctggaagccagcttaggattgctctggttaaataagtgaaagaccagtcagtatatgattgtactggaagactttgacagcactgccttccagtatactatgttaagaacaaaaaagttatcttaaaagagaaaaaaaaaatgaaagttgggaaggatgagcttagatcaaatttaatgttgaaagtcaatttattattagccaagtgaatgaaaaattattttatgttttgagtcatcttgatttgtccagaaaaatcttattaatttgaactcaagtggggatgtcaatctgaatattttaaagaaatgtgtgtatatatacacacacatacaaacacaagcagtggcaaactaggtaactagagtaatggattataacatgcaaccagccttaagaattttgttagtatatcagtagtatactaatacgtatggatgtctgtaaagggatttcaaaccaccattgtattctttaataagttaaacattcaccttctccaataatatctaaataataaggttgcatattttaaaaatatataactgaaacatagacccttcctatattttcacaaaatctgtactggttgtatccaaatggtttacagcatagtagacagattcatgtcctttggtggtacacttaagttttgtttcaattcattgcttatttgcttgtttttttttttaaggtcctgtaaaaatctcattcaaagcagggccaaaatgcttatctgaatttatttttcctttttgaagaaaagggagagtactttcccaacagctagtttaatcatacccgaaaagaaatagaaggttctagacagatgcaaattatcattataaatttagatgagtaattgcaaatattttgcctgctggagggttgatattttccagtaaagttagacattacatcactatactgatgtaatattacttttatataacagactattcttcaaagtaagcactcttaaacataataatttagcgaactaaagaatgatgagcttttagaatttaaactgtaaagtgcctaactgaagtattcttaataaactctatattttaattgttgtttatattaatactgcaggatttttcatatttgcctattaaccagtgtgtatatatgtgtgtgtgcccatgaggatgctcatttaattttaatttaatttaattaattttaataattttaaattagtttatttaattttatcatatgtctgtttatgtattaacagtgatgtgttacctaacagtagggaacgttctgagcaatgagtcgttaggcagttttatcatgtgaacatcatagagcatatttatacaaaccatgacctattgctcccaggctacaaacctgtacagcatgttactgtactgaatattacaggcacttgtaacacaatggtaaatatttgtgtatctaaacatatctaaacagagaaaaggtacagtaaaaataaggcatataatcttatgggaccaccgttgtatatgcagtccatagttgaccaaaatgcccttatgtggcacatgactatatttatgtgtatgtgtatacacacacacatacatacacatttctttaatacacaactggtgggaatgtgaataatttttataaagaagagtctagcagtatgtatcagtacccttaaggaaaagctagatgttttgaccaataatcctactattagaaaccagtcctaagaaaataaatcaaaatatggaaaatggcctaacatgacatttatagttgaggaaagttggaaacagtgaattatcaacaaaaaggaatggtttaataaattatgcacatccattcaatagaatattatacagtattaatgtcattttcatatttaatgacatgaggaaaatgttcttgataaaataaatgaagtagtaagaatattaaactgtatgcagtagggccttatttgtgtaacataaggtgtgcatataaataatacatatatatgcatatataaaaatattaatattatttaattcagtagaggacaaaggttaacttgataatttaagacaaaatagttttatcaaaatataaacatggtgtatcttgatagtttaatttatgagtttcagtcatttgtttcttattctttgtttcttttccttcctctcctggcccaagtctacacttggatatgtcgctctgctcataagtactttccatgttttaatttatggatggaaacgagcttttgaggaagagtactacagattttatacaccaccaaactttgttcttgctcttgttttgccctcaattgtaattctgggtaagattattttattccttccatgtataagccgaaagctaaaacgaattaaaaaaggctgggaaaagagccaatttctggaagaaggtatgggaggaacaattcctcatgtctccccggagagggtcacagtaatgtgatgacaaatggtgttcacagctgccatataaagttctactcatgccattatttttatgacttctacgttcagttacaagtatgctgtcaaattatcgtgggttgaaacttgttaaatgagatttcaactgacttagtgatagagttttcttcaagttaattttcacaaatgtcatgtttgccaatatgaatttttctagtcaacatattattgtaatttaggtatgttttgttttgttttgcacaactgtaaccctgttgttactttatatttcataatcaggcaaaaatacttacagttaataatatagatataatgttaaaaacaatttgcaaaccagcagaattttaagcttttaaaataattcaatggatatacatttttttctgaagattaagattttaattattcaacttaaaaagtagaaatgcattattatacatttttttaagaaaggacacgttatgttagcatctaggtaaggctgcatgatagcattcctatatttctctcataaaataggatttgaaggatgaaattaattgtatgaagcaatgtgattatatgaagagacacaaattaaaaagacaaattaaacctgaaattatatttaaaatatatttgagacatgaaatacatactgataatacatacctcatgaaagattttattctttattgtgttacagagcagtttcattttcatattaatatactgatcaggaagaggattcagtaacatttggcttccaaaactgctatctctaatacggtaccaatcctaggaactgtatactagttcctacttagaacaaaagtatcaagtttgcacacaagtaatctgccagctgacctttgtcgcaccttaaccagtcaccacttgctatggtataggattatactgatgttctttgagggattctgatgtgctaggcatggttctaagtactttacttgtattatcccatttaatacttagaacaaccccgtgagataagtagttattatcctcattttacacatgagggaccgaaggatagaaaagttatttttcaaaggtcttgcagttaataaatggcagagtgagcattcaagtccaggtagtcatattccagaggccacggttttaaccactaggctctagagctcccgccgcgcccctatgcattatgttcacaatgccaatctagatgcttcctcttttgtataaagtcactgacattctttagagtgggttgggtgcatccaaaaatgtataaaaatattattataataaacttattactgcttgtagggtaattcacagttacttaccctattcttgcttggaacatgagcctggagacccatggcagtccatatgcctccctatgcagtgaagggccctagcagtgttaacaaattgctgagatcccacggagtctttcaaaaatctctgtagagttagtcttctccttttctcttcctgagaagttctcctgcctgcataaccattcattagggagtactttacaagcatgaaggatattagggtaagtggctaattataaatctactctagagacatataatcatacagattattcataaaatttttcagtgctgtccttccacatttaattgcattttgctcaaactgtagaatgccctacattccccccaccccaatttgctatttccttattaaaatagaaaattataggcaagatacaattatatgcgttcctcttcctgaaattataacatttctaaacttacccacgtaggtactactgaatccaactgccaacaataaaaagacttttatttagtagaggctacctttcccaccagtgactctttttctacaactgccttgtcagtttggtaattcacttatgattttctaatgttctcttggtgaattttattatcttgtaccctctttttttttttttttttttttaaagacagagtcttgctctgtcacccaggctggagtgcagtggcacgatctcggctcactgcaagctctgcctcccgggttcacgccattctcctgcctcagcctcccgagtagctgggactacaggtgcccgccaccatgcccggctgatttctttttgtatttttagtagagacggagtttcaccgtgttagccaggatggtctcgatctcctgacctcgtgatccgcccgccttggcctccaaagtgctgggattacaggtgtgagctaccgcgcccggcctattatcttgtactttctaactgagccctctattttctttattttaataatatttctccccacttgagaatcacttgttagttcttggtaggaattcagttgggcaatgataacttttatgggcaaaaacattctattatagtgaactaatgaaaataacagcgtattttcaatattttcttattccttaaattccactcttttaacactatgcttaaccacttaatgtgatgaaatattcctaaaagttaaatgactattaaagcatatattgttgcatgtatatattaagtagccgatactctaaataaaaataccactgttacagataaatggggcctttaaaaatatgaaaaacaaacttgtgaaaatgtataaaagatgcatctgttgtttcaaatggcactatcttcttttcagtactacaaaaacagaataattttgaagttttagaataaatgtaatatatttactataattctaaatgtttaaatgcttttctaaaaatgcaaaactatgatgtttagttgctttattttacctctatgtgattatttttcttaattgttattttttataatcattatttttctgaaccattcttctggcctcagaagtaggactgaattctactattgctaggtgtgagaaagtggtggtgagaaccttagagcagtggagatttgctacctggtctgtgttttgagaagtgccccttagaaagttaaaagaatgtagaaaagatactcagtcttaatcctatgcaaaaaaaaaaatcaagtaattgttttcctatgaggaaaataaccatgagctgtatcatgctacttagcttttatgtaaatatttcttatgtctcctctattaagagtatttaaaatcatatttaaatatgaatctattcatgctaacattatttttcaaaacatacatggaaatttagcccagattgtctacatataaggtttttatttgaattgtaaaatatttaaaagtatgaataaaatatatttataggtatttatcagagatgattattttgtgctacatacaggttggctaatgagctctagtgttaaactacctgattaatttcttataaagcagcataaccttggcttgattaaggaattctactttcaaaaattaatctgataatagtaacaaggtatattatactttcattacaatcaaattatagaaattacttgtgtaaaagggcttcaagaatatatccaatttttaaatattttaatatatctcctatctgataacttaattcttctaaattaccacttgccattaagctatttcataataaattctgtacagtttccccccaaaaaagagatttatttatgaaatatttaaagtttctaatgtggtattttaaataaagtatcataaatgtaataagtaaatatttatttaggaatactgtgaacactgaactaattattcctgtgtcagtctatgaaatccctgttttgaaatacgtaaacagcctaaaatgtgttgaaattattttgtaaatccatgacttaaaacaagatacatacatagtataacacacctcacagtgttaagatttatattgtgaaatgagacaccctaccttcaattgttcatcagtgggtaaaacaaattctgatgtacattcaggacaaatgattagccctaaatgaaactgtaataatttcagtggaaactcaatctgtttttacctttaaacagtgaattttacatgaatgaatgggttcttcactttttttttagtatgagaaaattatacagtgcttaattttcagagattctttccatatgttactaaaaaatgttttgttcagcctaacatactgagttttttttaactttctaaattattgaatttccatcatgcattcatccaaaattaaggcagactgtttggattcttccagtggccagatgagctaaattaaatcacaaaagcagatgcttttgtatgatctccaaattgccaactttaaggaaatattctcttgaaattgtctttaaagatcttttgcagctttgcagatacccagactgagctggaactggaatttgtcttcctattgactctacttctttaaaagcggctgcccattacattcctcagctgtccttgcagttaggtgtacatgtgactgagtgttggccagtgagatgaagtctcctcaaaggaaggcagcatgtgtcctttttcatcccttcatcttgctgctgggattgtggatataacaggagccctggcagctgtctccagaggatcaaagccacacccaaagagtaaggcagattagagaccagaaagaccttgactacttccctacttccactgctttttcctgcatttaagccattgtaaatctgggtgtgttacatgaagtgaaaattaattctttctgcccttcagttctttatcctgataccatttaacactgtctgaattaactagactgcaataattctttcttttgaaagcttttaaaggataatgtgcaattcacattaaaattgattttccattgtcaattagttatactcattttcctgccttgatctttcattagatattttgtatctgcttggaatatattatcttctttttaactgtgtaattggtaattactaaaactctgtaatctccaaaatattgctatcaaattacacaccatgttttctatcattctcatagatctgccttataaacatttaaataaaaagtactatttaatgatttaacttctgttttgaaatgttgtatacacgtggatttttttctcattaaataataattctagta

SEQ ID NO: 2005 - DNA, 25820 bp, Homo sapiens; identical to SEQ ID NO: 2003

SEQ ID NO: 2006 - DNA, 25994 bp, Homo sapiens; identical to SEQ ID NO: 2004

SEQ ID NO: 2007 - DNA, 23860 bp, Homo sapiens
attctgctatagagatggaacagtatatggaaagctcccaaggtacataaagtggttgttgttttctctttctagaagagaatgctgtgggtggacaatatacagataaggttagagaggggaagcggggactaactcattcaggaccttttacgtgatagtcaggaagatggctgtagttctaagtacaaggagcaccgattttaaggagagacattttatgacgatttacattttaagatgattttagctgctgtggagatgtttggaaagggtcaaaagagaaagtaggctgacccattaggaaatgtttgcagagttcaggtgagatgatagacacctggactagcctggtattggtggagagggatttatgaaatatgttggagaacaggaattggtgcaggattttatgtcaaaagtgagggtcagcaaggacttaagaatgactcccaattttctgattggagcaactggtggataatggtggcatttacacatttccaggcgaatgggaccagctctgggtggaaaaagttcaggtttgaacctgtgaagtttgagatgtcacagaaagaggtcataaccatatccccttgggaagcaaaaagggaggctctccaggacataagtggatagactggtctttgataggtaaaattggtgattgttaatttaaggtgaaactaatgagctcagttttctggtttttctccagcaaccttcaccaacgtggatacagatacagagaaaatggatagctgggtccaggactagagttttgccaagcagatatgatggagagtaagagagctgaggatctttttaagggagtgactacaaatctagcctcggtttaaagagaaaccagagcaggctgaaggagagtgcaggatattaagcaattagagaggtagaggtcaacggatcagatttcttttgctgtttagaattatcagtgtgaatatttaaactaagattattggaagtcctggagacagtgcttggagatttcaggcagtgagtgactgaggtggggtagaggcaaaaattcattgtctccaatgagtaagtcaaggaaataagagcccctgaagttgaatggttcatccacttgaatgataaagtccaggaaaaacatgatagctattagggtagagaggatgaccatgtatatactgggagccagagtctgcagtcataaggaataaactagaagtcagtagaggacagcagtgaggacagcagtaaggacagggagagggtatggtgaagtaccatgagcttcaaaggagctgggtgtttgcaggagagacaatgaagaagagatgttcagatgtgggcttacaaagtgaagattacaccaccccacctcatggccctggagaattatgttttcttgatagcctctccaaatctgcaggttgtgaaatgtcatcaaaacctctgtggacagccctttcagagttgctgtcatccaataataaatgccctatttatgtgtgaaacaaattaggttctatttttcaaaagtaacatagcacaacaggtgccattcagcttcaggaatgttcaggaaatccttctaaactgaaaaccttaagaggctgtccagctgaatgtaactgaattccctatcaaaataatacattctcaagtattaaatgtgtacagcaagtcaaatgcccattcaagaaaacgatgtcattgacacagacttttagattgagctcccgaagttgaagtgttaaatatagggtggtgatattaccattattacacagcttcaagacttatttagtgttggaaactaccaccagagtcaagtataacctatttgtttgctgtttaacaaaggaaattgagactcagagaatcaaagtgattgcagaagcttaggcctgctctttcacccctacactatgaagacaaaactttctataaatgacatagttgttttttgtttttgtttgtttttgtttttgttttgaggctgagtctcactctgttgcccaggctggagtccagtggcgcgatcttggctccctggttcaagcgattctccttcctcagcctcccaagtagctgggattacaggcacctgccaccacccctgcctaatttttgtgcctttttagtaaagatggggtttaatcatgttggccagtctgatcttgaactcctgacctcaagtgatccacctgcttcggcctcccaaagtgctgagattacagacgtgagccaccatgcccagcctataaatgacatagttttatcagttatttaatttggattccttatgaataacttcaaaagaaaaggtatagacactgtggacatcacctgggagcttgtgaaaaaatgcagaatgtctaacctccctctagacctaaagaatctgagtgtgcattttaaagaggtccccaggtgatcatatttgcattaaagtttgacaagtgcctttctagtgagtcattcccttggaaacagtggtctgctcaggtcagcaggatcatgatgcctggagaactggggaggggatccccttgtagaacagaaagaagagatacagtcatggaaatattccgaattttgaatattatgaaacaacaggaacaaagtatgttgtgcaaggagtgacgcattttaaggaatggcattgcctttcccagaaagtgaagagaggaaattggaaaattgtgagtggaccttctgatactgctcctccttgcgtggaaaaggggaaagaactgcatgcatattattcagcgtcctatattcaaaggtaactactactctttcgcaagtgtaatttttcattactacaaacaacaacgtaaaaattaacataagtgagggtcagaaagccacatctactatcgccaaatgatgaaagtattagattgaattctgaatcttttactagagtgattttcaatcttggttgcataataaaacatctgctaatcttttttaaaaaatgctgttgctcaggatgaaccccagaacaattaagtgaaaactgggtggtaggggggtgacccgtcatcactgtgttttaaaacttgccaggtcattggagaatgcacctagggttgagaaatactgctttagtagctcattcagaagcagctctgagattgcagttctgctactccatgtgccaaaacagtgggactttccctcactaccataagcgtagtgccaagccaggtcagcaatattcaggtcaccctcactggccagttttcagaacattgagggaagtaggatttatttcttgaagaagcctgcttagactaacttttaaaacaaattgatacatgttacatatctatggggtacacatgagtatttgttatatccatagaatgtgtaatgatctggttggagtttttggggaatccatcaccttgagtatttatcatatctatgtgttaagaacatttcaagtcatctcttctagctactttgaaatacacagtacattgttactgactataggcaacctactttgctattgaacattagaacttacttcttctaactgtacatttgtatccatgaaccaacatctcttcctcccctcctcccatcaacacatccttccagcctctgatatctctcatgctattctctacctccatgggatccacttttttagctcccacacatgagtaaaaacatgtgatatttgcctttctgtgcctgggttatttcacttaacataatggcctccactcctatccatgttgctgcaaatgacacgatttcattttttaaggctgaataatatttcattgtgtatacataccacattttctttatccatttgttgatggacatgtagattgattccatatccttgctagtgtgaatagtgcgcaaaaaaaaaaaaaaaaaaaaaacatgtgaggacgggtatctctttgatatactaatttcttttcctgtagataatacccggtagtgagattactggattgtatggtagttccatttttagtcttttgagaaacaacccctatactgttgtccacagaggctgtactaatttacatttccaccaataacatataaggattcccttttctctgaatcgttgtcagcatctgtcatttttctcttttaataatagcagttctaattgggataagttgaaatctcattgtggttttgatatgcatttctctggtgattagtgatgcttagcattttttcatatacctattaaccatttgtttgtcttctttggaaaaatgtctattcatgacctttacccatttttatgggattatgtgttttttattgtcagttgtttgagttccttgtatattctgaatattagtcccttatcagattaatagtttgcaaatattttcttctattcaataggtggtctcttcattctgttgattgtttcctttgctgcacggaagtcttttagtttaatatagtcccatttgtctatttttttgttgttgttgctgtgcttttgaggtcctagccataaaatctttgcctagaccaatgtcttcaaatatttccccaatgttttcttcttgaaatgaggggttttgggtcttatgtttaagtctttagttgaccttgcgttgatttttgtatatggtgagggacaggggtccagttttattcttctgcatacagatatccaattgtctaagtaccatatatttgaagaggatatcctttcctcagtgtatgttcttggtgcctttgttgacaatcagttggctgtaaatgtgtggattttttttgtggattatctaatctgttgcattcattgatctgtgcatttgtttttataccggtaccatgttttttcggttactattgccttgtaatatattttgaagtcaggtagtgtgatgccttcagctttgttctttttgcttaggattgctgtagctattcaggatattttttggttctatatgaattttaggattgtcttttctaattctatgaaaaatcacattggtattttgatagggattgcattgaatctgtgtattgctttgggcagtatggtcattttaatattaattcttccaatccataagcatggaatgtttttccattcgtttatgtcatctttaatttttttctacagtgctttgtagttttccttgtagcaaactttcacctccttggttaaatatattcctagttgttttttgtttgtttttgttttttttatagctattgtaaatgggattgccttcttggtgtctttttcagcaagttcattgttggtgtatagaaatggtactgatttttgtatgtcgattttgtatcctgcaactttattgaatttatttatcagatctaagagtttttgtgtgaaatctttaggtttatctagatctaagatcatatcatcagcaaagagggataatttgaccttcctcttttccagtttgggtaccttttattctttctctttcctggttgctctggctaggacttccaatatgatgttgaatagaagtggtgaaagtggcatccttgtcttgtttctgttcatagaggaaaggctttgagcttttccccatttcaaaataatgatagctatattattattatatagatcatataagcccttattatgtgaagcatattttttctatccctagtttgttgcaagttttatcatgaggggatgctaaattttctcaaatgttttttctgcatctattgagatgatcatatggttattgtccttcattctcttcaggtgatgtatcacagttgttgatttgcatatgttgaaccatccttgtatccctgggatgcattcctggaataaatcccctttgatcatgatgtgtgtgtgttttttttatgagttgttagatttggtttgcttctacagacacacacgcgcgcacacacacaatttttaggagacagggtcttgctctgttgcccaggagggagtgcggttatgcaatcataaatcactgcagccttcaacttctgggctcaggtgattcttctgcctcagctcccgagtactaggacttcaggtgtgtaccaccacacctagctattgtttaaattttttgtagagacgagggtctcattatgttgcccaggctgggcttaaactcctggcttcaatccatcctcctgcattggcctcccaaagtgctgggattacaggcataagccatcatgtctggcccttggtttgctagtattttgttgagagtttttgtatctgtgctcatcaggaataatagtatgtagttttcttttttgttgagccttgtttgcttttggtgtgaagataatgctgacctcatagaatgagttaggcagaattccctcctgtttaatgttttggaagagtttgaagagaattggtgttaggtctgttttgaaagtttggtagaattcggcagtgaagccatctggccctggacttttctttgttgggagttttttaattactgcctcaactttttttgttactggtctgtccaggttttccatttcttcccatttcaatcttggtagcttgtatatgtgtagcagtttatccatttcctctaggttttccagtttgttggtgtatagttgttcataatagcttctcatgatcttatgtatttctgtggtatcaattgtaatgtttccttttccatttctgattttttattggagtatttcctcttttttcttggttagtctagcaagtgctttatcaattttatcttttcaaaaaacaaaactttttgtttcatccatcctttgtattgttttttaagtcccaatttgtctagttctgctctgatctttattattactttccttttaccaatttggggtttggcttgtttttgcttttctagttccttgaggtacatcattaagttgtttatttgaaatcgtaatgattttttggtgtaggtgcttgttgatataagcttccatcttagcactgcttttgctgtatctcatgggtttcagtgtgttgtgtttttatttttatttgttgagggaaattttttgatttcttccttaatttattctttgcccccgtagtcatttaggagcatgttgtttaatcatttatttttacagtttcaaaagttcctcatgttgttgacttctagttttattccattgtggtctgaggaagtacttgatatgacttcgatttttaaaaaatttgttgaatcttattttgtgttctaacatggtcattcctagagaatgtctatgtgctgatgagaatttgtattctgtaactgttgtataaaatgttctgtgaatgtttgttaggtccatttggtctaacgtatagtttaaattcaatgtttctttgttaattttctgtctagattatctgtcagatgctggcaggcggtgttgaagtccccaaatgttgttgtattggcgtctgtttctccttttagatctgataacactttatttatattaatatatctgagtggtctgttgttgggtgtatatatgtttagaattgttatatcctcttgctagaatttatctattatcattatataatgaccttcattgtctctttatactgtttttgactcaaactgttttatttgatataagtatagtgacttttggtttccatttgcatggactatctttctccatccctttgctttcagtcttatatgtgtttttatatgttagatgggtttcttgtacccagcatatacttgggttatgattttttatctattactagtccatatcttttcagtggaaagtttaatccatttgcattcaaagttattcaacaatgaaaacttcccaagtctagtgagagatgtagacacccggatacaggtaacttagagatctccaaacagatacaatacaagaaggtcttccccacagcacattatagtcatattgtcaaaagtaaaagacaaagagtgaattctaaaaacagcaagagaatgaccagtcacctataaaggaactcccagcaaaataaaatttttacctgttcacattctgatttacagaagggatttgaacttgctttgtaaaataagcagataattaatgttgttttgtttttgtttctgtttgaaaaagtcttgatcatcatgagtgttagatttaaagattttgcaattcttatattttgggagatgctgcagtatatactcagaagaactccaggctgggatataggaaacttggattcccttgtgtgaatctagcaacctttttcacccttagataatgctcatgattaccattaactttcgaatgaagtgagcatggatttcattacttctggtttttttaaccactcctgattcccagcatagctagtgacatctccaaatggatattgacaggtttttttcctaccctggtacctctgactcctgcctgcctttctgggtgcatggaccacaccaagggagtggtctatcttgaaaggtgtgaaatgaaacatgtaattgatttaaaaatagtaaatgttcttctttcccaggatcgggtgctcctaggtaactctgaggagcaatgaaatgaccaaagaaaaaggaataatatactactttgagtacaactgtaattgttacaccttgatacttataaccccccaaaaacaccctttcctaaactccttacatgcacctaaataacacatgtcttagctggacaactacctggcttccctattttctgtctttatgtccttggataaattaattatcttctgcaggtctcagtttcctcatctacaaagtgggtatgacagtattagcacctgtctcttagggtggttgtggggattcaatcagttaatacataaaaaccacaagagagctgaaatacattatgtcctatataagcattaagtaatattactataattattgtctttctaaagtttaacatactgatgtatttggagttactggatgtgactcatttctagggtaaaaagttgaattttcctggctgtagtcatttcaaatttcatttagtaaaaaccccaacttttttttgaaacattccacctgtgcctgtaaagtccattaaatcctctgaaatggtccacatctgctatgagcatagaagaaattgtgcaatgagggtagaatggaagagtatttttctttcagacccaatttcgacactaattcatggcaacctgatttgtattcttgagcaaattattccaaatatgaacatttcagatgctagtctctcaactaaaaaataatttgagagatttttccaggaagaataactgcatcatagtttatgcagccaacaaatgaaagggtgtcatgttgcggtccaaagggcgtgggtggatgagcagaaagaatacttgaagggctgtaggcaggtgaaagatgattttattcaacagcagctctgatcaacaactttctcacactgtccatcctgtctcagctgcttagtctggtggctcccacacacacagctcccttgccttcagggtcagcagcttaactatttctctctctgggcatgggcaagccaagctgggtcctgactcccccatctgtctgcaaagacagacagctctgactctctgtctctgagcacaagagtgcctctacagtgtccacagggcaattataccttttacagacaatagtggcttagagccaagtgatgagttttccctatgtcatagcgatggtggtgagcttctgttatgtctacatggctatgataacaagtaacaagtgaagttatatgcttgcgctctgaactcactcactctggatgtttacctctgcctgtccttgaccaaagcacagccatgttctttacaaaggggaagaaaaagatttcatacatattatataatttaagatcataaacatgttactaatcctttttccataggtaagctatctttctcaatgatacattgtaagatgtagggtgaatgatagaagtccatggtatttactcttttgttatattttgatgcctatttttcttaagatattatttaagtgccaggattcattgttagctaatttgtctagctctcatttaatgataaagtcactagctactgaagtatatagggaactttataacctctaccccaaatgactttagacagttttggtttaaatggctttttaaaaaatggtttttctttcttctcttgtcttgtgagccatcacttagtatcacagtcctctctgcctccagcagcatttgtgatttgctgcctctgatctgctcaaaagctgggtaatcatacttgttacaagtgtgtttttccaaaaagttctgagtgaaaacctcagtcccttttttcatgtgctctagtgaggtaggaggcagaacttgaatccagaggcaaggttcagacactggaccaaactgaggtcagggcagaagcacctccccataagacatgcccatcagtgtgccatgtcagttcactattgccatggcaacacctagaagttaccacccctttccatggcaacagcccaacaacccagaaattaccaccctcatcctagaaatttctgcataaatcaccccttaatttgcatataaatcaagtaggtttaaatatgactgcagagctgccactgagctgctactctaggcacactgcctacggggtaggcctgctctgcaaggagcagtacctctgctgttgctgtaaactgttgcttcaataaacgttgctgtttaacaccaccagctcgcccttgaattctttcccatgcaaagccaagtagtctcctgggctaagcccccatttgggggctttcctgtcctgcatcactagtgccttgctgctcaaagaggggtctcagaccagcattggtattgctttcattagaaatgcagaatgttgagcctccctccagaactactcaatcagaatctacattttaacgagattccgaagtgatctgtgtgcacattaaaatttgagaagccccactttagcacctcacctttgtgacagttaattttcctattgagatgcttttttaaaagccaaaagatttatgaagagaaaccagaatagtgatccttttttagcttacaaattgtgtcttactgtgctgtatgttaaagtgtggtgaaatattttacctctagaaagacaggacattacaatgtctagaagtgttttaatgttcagtaataggtaactgatgaccattttattttctctcccctaggatattcttggtgatcttggaagtgtccgtatcatggaatcaatctctatgatgggaagccctaagagccttagtgaaacttttttacctaatggcataaatggtatcaaagatgcaaggaaggtcactgtaggtgtgattggaagtggagattttgccaaatccttgaccattcgacttattagatgcggctatcatgtggtcataggaagtagaaatcctaagtttgcttctgaattttttcctcatgtggtagatgtcactcatcatgaagatgctctcacaaaaacaaatataatatttgttgctatacacagagaacattatacctccctgtgggacctgagacatctgcttgtgggtaaaatcctgattgatgtgagcaataacatgaggataaaccagtacccagaatccaatgctgaatatttggcttcattattcccagattctttgattgtcaaaggatttaatgttgtctcagcttgggcacttcagttaggacctaaggatgccagccggcaggtatgtattttacatttttattcttatgtatctggtattttgtagttaaacaactaagcaaatatcaaacattttaataccaaactctgacactttccaatgattatcatttgaaaattaattatgagcacctgaagattaatgtcctgaccttgtaagggcacattcccattcccaacatgatgtggaaaactgggaaaataacgtgaaagtcatccagttcaacttgagaataaagcagatggggcactctgtcaacaccattgtggaacaagcttttataagtaaacacataaaatatgttttaaaaatcttttaaatgtgcttatgcattacaattaagcatgattataaaacacttttattgtttttgtccataaagacagttgattagattccttagaaaataagtttcagtattatatcattgtatgctgtatatcagtcatgataaccatttactttccagtctttattttaatgactggtaaaagaacataggctcttctacaggctatttctgaatccttttttctcttttgcatatccaccaaagtttagcagtggatatagaataagcaaattagaaccaggacctgtgagacaaacctgaatttaataatatgcccatatttatgccaattttaaatttttaacagaaaaaaatgtggaacagtgattaaattccaaatgagctacagaaatagtctaaatttgtattatgtagcatttgtgcctttattttgagtgtttggtttatttttagacttattataccgtattataatttatacaaaattttttccaaatgagtttttaaaaaagtttattccaccattgtcacaactgtaataaattaatttagaatacttttttcttatttgtgttataaaaggacctctattttaaaagttcataaatgattatataatattcattcaaataggatttgtcattcatctggctaatgttatccaagattaataatccaaagagtgttatattgtcaccattatgtaaatagaaacatgcaaatatttctatgtggtctattttagagtccttatacaaacatcttcagggatatatttaggaatttgttttccccaaacattacttggagactctgtagcaatatttttctagccctgaatgaggtggcctacccattagtaatagtagctcactccagtaatgaacttggtgctcaataaatacttgttgttgtaggctttcaaactattgaaatctgttagatactataatatagctgaaaattcaacaagtatttattcctcaaggtcatcacaggtgatggtccgtaagtggagcatgcgattgctaccatttttataaacaacaatggtaatgctgagtctttttgttttttccacaggtttatatatgcagcaacaatattcaagcgcgacaacaggttattgaacttgcccgccagttgaatttcattcccattgacttgggatccttatcatcagccagagagattgaaaatttacccctacgactctttactctctggagagggccagtggtggtagctataagcttggccacattttttttcctttattcctttgtcagagatgtgattcatccatatgctagaaaccaacagagtgacttttacaaaattcctatagagattgtgaataaaaccttacctatagttgccattactttgctctccctagtatacctcgcaggtcttctggcagctgcttatcaactttattacggcaccaagtataggagatttccaccttggttggaaacctggttacagtgtagaaaacagcttggattactaagttttttcttcgctatggtccatgttgcctacagcctctgcttaccgatgagaaggtcagagagatatttgtttctcaacatggcttatcagcaggtactgaatgtgcttgttatttatctgatgctagtaaaatactttttattagtataaattgtaaaacataaaattttacatgccctgtaatggaaatttgattttggtatactgcgggaggggaaagaattgttctttaaacaatgtttttgcaaaataattaggtggctaattcaaaattatttaagtaaaggctgctaccatccttttccatacagaataaaagcagaaaaatagagggttgggttctccccctttttcaatgttataattgcaatgagtgctttcagtattcaacaattcattattttaatgttttataattggctgtgctccacaaaatgatgaggcaattctcagtaaatatatacaataaaattagaaccagtaaaaatacaaaacagaacaggaagacaagatcaggagaaaaaagtcgaatacacctctgctaagagtgtctccacagcttctcttttggctttgagattttcaatacaatgagaagggagaccctattatttacaaagctcttgttatcaaaaaccagaaaagataatagttccacaggtgaagcttttctagcacttagctctaaaaaaaaaaatctcagggagcacttcatggaaggggtttgattatgaggtagactatggttttcctccataattcccaatccacaaatgtaatttaaggggtttccctgaagctgtttggtgtagcatttctccatgaaagccaagaacattgcaccaaaacaaatgtgtaaaagcatctgcattttgtaaggatcgaaggcatcatagtccaagtatgtggcatctagtacttaagcttgtttcaacaataaaacctaaaataatatttttctaattagtagattgataacctttaaaccattcactccctgaaaaaaaacttctcttaatgggatactaaggcttttattgttgctcagtcagctcccttgcctccttccagtcatttgcccagatctcaccttctcagcgagtcctatgctggataccatcttaaatgccgctgcctctgccccaaccagtattcccaatccttctgacttaccctgctctacctttctttttttaataacacttaccatcttctaacacacttgatttccatgttaaaaatacatttaccagtgtctgccttcccccaacagaaagtaagttcatgagaagagggatctttgtctatctttttcactgatgcatacccagtgcctagatttgagcctagacattgtggacactcaaacagcccatttgtggatgaatgaatgaactgggagagcaggtagatccaggttgtagtctccgagtacactgggtagtgctgtttttctgtattgtatagatatcaaataagaagatggtaagaactctgtggcctctttcaagatgatggtatgattgccttagggaactaatagctaagaagcagcttttcgttgttaaatttcaagtatgttttgttaactggaattggacaaagttaaactgttgttaagttagaatctgttttccattaatagatacttatttaaatcaaaaatttcagctgaaggagtccaatacttgatttatactctaattatattctgaatgtaaatagaacttctaaaggtagtccctacacaaaataccacaaattcagagttcaccgtctgacttgattatatacacattatcaatgtaaggaaaagacatttggaaaaaatactgcatataaatgacacaattggatagttggggatcatattaaatgaggcagttcaagtggataaatgagctccattggcctttatagctagggaaatcacagctttctaggaagagaagatgagaagaaagataaaacagagatatattattcatgtgatggaagaagatactgacatagtttagaaattccctgaccggatccaagttgaactaaggccagactatatcccagatattcaaccaagtttaaaccagcttgtaatagtacttcaaaactaagtttaactgtcagtaacttcttttgtgtcaccctagaaccaactactaggtattttatggtgttggattccagagtccctgtaatgatgatggcaaagctttgcccctctattctagcacgtatacaaggaaagagaaagttttgtcctccttttgtttaattctcttttcccttacacctggagcagtatcatccagtaacaggttctctgtaatggtttgttagactaaattagtacaacttaaatacgtccatatatgaccaggttcttcttatgccaagagtgaactctgtgctgaatcagttaatgttctactaaataaaggaaattcacattcgctttcttgttaggttcatgcaaatattgaaaactcttggaatgaggaagaagtttggagaattgaaatgtatatctcctttggcataatgagccttggcttactttccctcctggcagtcacttctatcccttcagtgagcaatgctttaaactggagagaattcagttttattcaggtatgtggggttttgtttggtgaaggattgtgcaggataggatttccttgttaagaacaactgcattttaaatatgttccttattaaaagggtgcctttgaggctgtatttatgcatctagatacattatgctggaagccagcttaggattgctctggttaaataagtgaaagaccagtcagtatatgattgtactggaagactttgacagcactgccttccagtatactatgttaagaacaaaaaagttatcttaaaagagaaaaaaaaaatgaaagttgggaaggatgagcttagatcaaatttaatgttgaaagtcaatttattattagccaagtgaatgaaaaattattttatgttttgagtcatcttgatttgtccagaaaaatcttattaatttgaactcaagtggggatgtcaatctgaatattttaaagaaatgtgtgtatatatacacacacatacaaacacaagcagtggcaaactaggtaactagagtaatggattataacatgcaaccagccttaagaattttgttagtatatcagtagtatactaatacgtatggatgtctgtaaagggatttcaaaccaccattgtattctttaataagttaaacattcaccttctccaataatatctaaataataaggttgcatattttaaaaatatataactgaaacatagacccttcctatattttcacaaaatctgtactggttgtatccaaatggtttacagcatagtagacagattcatgtcctttggtggtacacttaagttttgtttcaattcattgcttatttgcttgtttttttttttaaggtcctgtaaaaatctcattcaaagcagggccaaaatgcttatctgaatttatttttcctttttgaagaaaagggagagtactttcccaacagctagtttaatcatacccgaaaagaaatagaaggttctagacagatgcaaattatcattataaatttagatgagtaattgcaaatattttgcctgctggagggttgatattttccagtaaagttagacattacatcactatactgatgtaatattacttttatataacagactattcttcaaagtaagcactcttaaacataataatttagcgaactaaagaatgatgagcttttagaatttaaactgtaaagtgcctaactgaagtattcttaataaactctatattttaattgttgtttatattaatactgcaggatttttcatatttgcctattaaccagtgtgtatatatgtgtgtgtgcccatgaggatgctcatttaattttaatttaatttaattaattttaataattttaaattagtttatttaattttatcatatgtctgtttatgtattaacagtgatgtgttacctaacagtagggaacgttctgagcaatgagtcgttaggcagttttatcatgtgaacatcatagagcatatttatacaaaccatgacctattgctcccaggctacaaacctgtacagcatgttactgtactgaatattacaggcacttgtaacacaatggtaaatatttgtgtatctaaacatatctaaacagagaaaaggtacagtaaaaataaggcatataatcttatgggaccaccgttgtatatgcagtccatagttgaccaaaatgcccttatgtggcacatgactatatttatgtgtatgtgtatacacacacacatacatacacatttctttaatacacaactggtgggaatgtgaataatttttataaagaagagtctagcagtatgtatcagtacccttaaggaaaagctagatgttttgaccaataatcctactattagaaaccagtcctaagaaaataaatcaaaatatggaaaatggcctaacatgacatttatagttgaggaaagttggaaacagtgaattatcaacaaaaaggaatggtttaataaattatgcacatccattcaatagaatattatacagtattaatgtcattttcatatttaatgacatgaggaaaatgttcttgataaaataaatgaagtagtaagaatattaaactgtatgcagtagggccttatttgtgtaacataaggtgtgcatataaataatacatatatatgcatatataaaaatattaatattatttaattcagtagaggacaaaggttaacttgataatttaagacaaaatagttttatcaaaatataaacatggtgtatcttgatagtttaatttatgagtttcagtcatttgtttcttattctttgtttcttttccttcctctcctggcccaagtctacacttggatatgtcgctctgctcataagtactttccatgttttaatttatggatggaaacgagcttttgaggaagagtactacagattttatacaccaccaaactttgttcttgctcttgttttgccctcaattgtaattctgggtaagattattttattccttccatgtataagccgaaagctaaaacgaattaaaaaaggctgggaaaagagccaatttctggaagaaggtatgggaggaacaattcctcatgtctccccggagagggtcacagtaatgtgatgacaaatggtgttcacagctgccatataaagttctactcatgccattatttttatgacttctacgttcagttacaagtatgctgtcaaattatcgtgggttgaaacttgttaaatgagatttcaactgacttagtgatagagttttcttcaagttaattttcacaaatgtcatgtttgccaatatgaatttttctagtcaacatattattgtaatttaggtatgttttgttttgttttgcacaactgtaaccctgttgttactttatatttcataatcaggcaaaaatacttacagttaataatatagatataatgttaaaaacaatttgcaaaccagcagaattttaagcttttaaaataattcaatggatatacatttttttctgaagattaagattttaattattcaacttaaaaagtagaaatgcattattatacatttttttaagaaaggacacgttatgttagcatctaggtaaggctgcatgatagcattcctatatttctctcataaaataggatttgaaggatgaaattaattgtatgaagcaatgtgattatatgaagagacacaaattaaaaagacaaattaaacctgaaattatatttaaaatatatttgagacatgaaatacatactgataatacatacctcatgaaagattttattctttattgtgttacagagcagtttcattttcatattaatatactgatcaggaagaggattcagtaacatttggcttccaaaactgctatctctaatacggtaccaatcctaggaactgtatactagttcctacttagaacaaaagtatcaagtttgcacacaagtaatctgccagctgacctttgtcgcaccttaaccagtcaccacttgctatggtataggattatactgatgttctttgagggattctgatgtgctaggcatggttctaagtactttacttgtattatcccatttaatacttagaacaaccccgtgagataagtagttattatcctcattttacacatgagggaccgaaggatagaaaagttatttttcaaaggtcttgcagttaataaatggcagagtgagcattcaagtccaggtagtcatattccagaggccacggttttaaccactaggctctagagctcccgccgcgcccctatgcattatgttcacaatgccaatctagatgcttcctcttttgtataaagtcactgacattctttagagtgggttgggtgcatccaaaaatgtataaaaatattattataataaacttattactgcttgtagggtaattcacagttacttaccctattcttgcttggaacatgagcctggagacccatggcagtccatatgcctccctatgcagtgaagggccctagcagtgttaacaaattgctgagatcccacggagtctttcaaaaatctctgtagagttagtcttctccttttctcttcctgagaagttctcctgcctgcataaccattcattagggagtactttacaagcatgaaggatattagggtaagtggctaattataaatctactctagagacatataatcatacagattattcataaaatttttcagtgctgtccttccacatttaattgcattttgctcaaactgtagaatgccctacattccccccaccccaatttgctatttccttattaaaatagaaaattataggcaagatacaattatatgcgttcctcttcctgaaattataacatttctaaacttacccacgtaggtactactgaatccaactgccaacaataaaaagacttttatttagtagaggctacctttcccaccagtgactctttttctacaactgccttgtcagtttggtaattcacttatgattttctaatgttctcttggtgaattttattatcttgtaccctctttttttttttttttttttttaaagacagagtcttgctctgtcacccaggctggagtgcagtggcacgatctcggctcactgcaagctctgcctcccgggttcacgccattctcctgcctcagcctcccgagtagctgggactacaggtgcccgccaccatgcccggctgatttctttttgtatttttagtagagacggagtttcaccgtgttagccaggatggtctcgatctcctgacctcgtgatccgcccgccttggcctccaaagtgctgggattacaggtgtgagctaccgcgcccggcctattatcttgtactttctaactgagccctctattttctttattttaataatatttctccccacttgagaatcacttgttagttcttggtaggaattcagttgggcaatgataacttttatgggcaaaaacattctattatagtgaactaatgaaaataacagcgtattttcaatattttcttattccttaaattccactcttttaacactatgcttaaccacttaatgtgatgaaatattcctaaaagttaaatgactattaaagcatatattgttgcatgtatatattaagtagccgatactctaaataaaaataccactgttacagataaatggggcctttaaaaatatgaaaaacaaacttgtgaaaatgtataaaagatgcatctgttgtttcaaatggcactatcttcttttcagtactacaaaaacagaataattttgaagttttagaataaatgtaatatatttactataattctaaatgtttaaatgcttttctaaaaatgcaaaactatgatgtttagttgctttattttacctctatgtgattatttttcttaattgttattttttataatcattatttttctgaaccattcttctggcctcagaagtaggactgaattctactattgctaggtgtgagaaagtggtggtgagaaccttagagcagtggagatttgctacctggtctgtgttttgagaagtgccccttagaaagttaaaagaatgtagaaaagatactcagtcttaatcctatgcaaaaaaaaaaatcaagtaattgttttcctatgaggaaaataaccatgagctgtatcatgctacttagcttttatgtaaatatttcttatgtctcctctattaagagtatttaaaatcatatttaaatatgaatctattcatgctaacattatttttcaaaacatacatggaaatttagcccagattgtctacatataaggtttttatttgaattgtaaaatatttaaaagtatgaataaaatatatttataggtatttatcagagatgattattttgtgctacatacaggttggctaatgagctctagtgttaaactacctgattaatttcttataaagcagcataaccttggcttgattaaggaattctactttcaaaaattaatctgataatagtaacaaggtatattatactttcattacaatcaaattatagaaattacttgtgtaaaagggcttcaagaatatatccaatttttaaatattttaatatatctcctatctgataacttaattcttctaaattaccacttgccattaagctatttcataataaattctgtacagtttccccccaaaaaagagatttatttatgaaatatttaaagtttctaatgtggtattttaaataaagtatcataaatgtaataagtaaatatttatttaggaatactgtgaacactgaactaattattcctgtgtcagtctatgaaatccctgttttgaaatacgtaaacagcctaaaatgtgttgaaattattttgtaaatccatgacttaaaacaagatacatacatagtataacacacctcacagtgttaagatttatattgtgaaatgagacaccctaccttcaattgttcatcagtgggtaaaacaaattctgatgtacattcaggacaaatgattagccctaaatgaaactgtaataatttcagtggaaactcaatctgtttttacctttaaacagtgaattttacatgaatgaatgggttcttcactttttttttagtatgagaaaattatacagtgcttaattttcagagattctttccatatgttactaaaaaatgttttgttcagcctaacatactgagttttttttaactttctaaattattgaatttccatcatgcattcatccaaaattaaggcagactgtttggattcttccagtggccagatgagctaaattaaatcacaaaagcagatgcttttgtatgatctccaaattgccaactttaaggaaatattctcttgaaattgtctttaaagatcttttgcagctttgcagatacccagactgagctggaactggaatttgtcttcctattgactctacttctttaaaagcggctgcccattacattcctcagctgtccttgcagttaggtgtacatgtgactgagtgttggccagtgagatgaagtctcctcaaaggaaggcagcatgtgtcctttttcatcccttcatcttgctgctgggattgtggatataacaggagccctggcagctgtctccagaggatcaaagccacacccaaagagtaaggcagattagagaccagaaagaccttgactacttccctacttccactgctttttcctgcatttaagccattgtaaatctgggtgtgttacatgaagtgaaaattaattctttctgcccttcagttctttatcctgataccatttaacactgtctgaattaactagactgcaataattctttcttttgaaagcttttaaaggataatgtgcaattcacattaaaattgattttccattgtcaattagttatactcattttcctgccttgatctttcattagatattttgtatctgcttggaatatattatcttctttttaactgtgtaattggtaattactaaaactctgtaatctccaaaatattgctatcaaattacacaccatgttttctatcattctcatagatctgccttataaacatttaaataaaaagtactatttaatgatttaacttctgttttgaaatgttgtatacacgtggatttttttctcattaaataataattctagta

SEQ ID NO: 2008 - DNA, 65891 bp, Homo sapiens
tagcaacgcgctggcttgtgttaacaaccggcccgggatcagaggtctgggtcaactggggggcggcagcggcgctaagcggactgtatggcggtggcctaggcccctggcggaattttgggacctttcgcgactctagcgactctcaggctgccttcccttctcggtggcggggcctctttgggcccagcggctgcgggcgcactgtaggacaggaagatccccccactctccaccccgccgccaccggccatgtggacagaggaagccggggcgaccgccgaggcccaggaatccggcatcaggaacaagtctagcagttccagtcaaatcccggtggttggggtggtgacggaggacgatgaggcgcaggtatgagcaggtgtctgtgctttcagaggtggagggggtgggagtgaagtctcgagacggggtccagacctgggggtggcaagggtggaactggggacaggagtgaagatgggggaagccgcgggatggagattccaagcgcagagctaatcctgatcccccaccccctgcgaactgcaccggttgcgaggggctggctgttgtcaaccatcctgtctggggaccagcgctgtgtggtcctcctggagggtcctagcaaactgagtaggcggggttttgccgcgcttcttcgaaaagtggtcatagagctacagggaggaaaggaatcattcttagcaaaatcttgatttgatgacctgatcagtttgaactgaactttttaatacgtagatccctgttaccgagtgatgttcttgatatagatgtaaattttcccatgcttaaatttgctgcgactaaagcctgcacccagaggggaggaaaacgctgttaaattagaaattaagcatttttaaaatatgaaattggaagctggttgttacacgttgggtcggagagaaccgggagagaatagagttgatttgttttattatgcttgtactgtatttggttttgggtttgcttttgttatgaatacaaaattcactcttggaagttgatctgttgagaaattccatttgaggcccttggatctctattcgaggcggaggtgtttagaaaccccaagttgtttgtttcctactaggattccattgatcccccagagagccctgatcgtgccttaaaagccgcgaattcctggaggaaccctgtcctgcctcacactaatggtgtggggccactgtgggaattcctgttgaggcttctcaaatctcaggctgcgtcaggaaccctgtctcttgcgttcacatcctggagccttggagagttccttgggagtggtcagttgactggggaatagagttgagctctctgaggtctgacatttacgcagtaacctgcggagcaacagcattttgcatgaggagaaataggtgttaggggaatttgcctaatcgattttgtggacctattcccctctgggcggggagaattttgaggaacaatagctctccactccctgggctgcaagaaagatcaacaatacagccatactcccaggcaaggggcaaaactgaaaagtatgtgaatttgataactgatggctctcagtcttcctttacttgctccaagaaaaattgggcaacgttatacaaggcaagcaagcgtggatttttttttttttttagggaaaaatactttttaaaagccattgccaaaatagtccaaaacataccaaatgaaacaagtatacctgtgtatatgtgtgtgcattttctccccattttaattttctttcttttctttcattactactgctctttccagggcctaggattctcttccaagaagaaagcaatcaatttgcattaattcatgtttctgacttgttaattactaattctaagagtagtaacattttcgaagtactgaggaaaaaggtagtttctccccaaagaaatagaataggaactttttatagctgggagaaatcttagtgatcctcagccttcttgttttttgcctgtggttgtttttacaaatgagaaccctaagttcatgagaagttaactgagttactcagtttctttactcatagaatgggggtctagagaccctggaacgaaaaaatgataaccttttaggcctctgccttaggccagtttaggaaagatcctgggaactgtttccagttctttcaaaccactgcacatttgcaaacttctcttctgcctgtgtgtgcttctgagacagtatatcctagtggctaaaggtgagagtatcacaactacttcagttcattgtcagcttcatcacttaccagctatgtgaccaaagaccagtatcttaacctttctatcaaatggagataatgacagtactcatgtccattgtaaagattaaattaaataatatatataggccgggtgtggtggttcacacctgtaatcccagcactttgagaggctggggagggcagatcacgagttcaggagatcaagaccatcctggccaacatggtgaaaccccgtctctactaaaaatacaaaaattaggtgggcatggtgatgcacgcctgtagtccagctacttgggaggctgaggcaggagaatcacttgaacatgggaggcagaggttgaagtgagccaagattgtgccactgcactccagcctggcgacagagtgagcctccgtctcaaaaaaacaaaacaaaacaaaacaaaaagaaataatatataagcaaacttatacaataatatagagaacttatagagagacctatatatataattgaaaacaagcagttatcaacatcatcattgtcattgtcatcatcctttatccagggaactagagctcataaagttatttgggccttaaagctaagggattctctagaattctgattgttcccactggcttccaggatgtgagagtgagactggatgcccctgaaatcttacttgctttaatgcagatttcggtctgctcactttatcccttcagagatgtttctaagttgcagctggatttcctaatatagaaatgctactttggctacctgggcttttgatagctgttttatatcattttctttattacagacctaaattgaacctttcagttaccctaaccttagtttttagtaattaaagaaataggcttgaatattgctgcctaaggcagcaggtaaaatgtacgggttattttgctgatttttctgtgtgtatgctttacttctgcattaagtggtatttttttcctgcatctttcacaaaaataactttgtaaaaggcaatagcgcctataaattctatctaagctactacaaatgatattcacagagtattagatttttctaactttaataactttgaaatgttctctgatagaattatggaaaatgtaaatatagattatgagtaaagttattagtaaatagggaaaacaatagtttaggaatctgggattttgaattgttattttcattccatgttgtgaacttctcatagacatattctatgtaaacattatatcttcaaattttctctctataaaaattttgataatccctactgtagtgattccagcgtcttcttttttaaagtgattatcatacttttccagtttcgaaacaataaaatagtaccagaattttggtggccattttctaattgtgaggaacttaggacatgttgcttgccctttctgtgtctgtttcctcatctgtaaaagatatttttagaaatgcctacctcatcgaattattgtgagaattaaagtatttgtaaggcatttagcacagtgcccagcacatacattccaagtgccccataaatggtaactttctgctattattaatgactctagtcataacagctttattaaattattaaataaattcagatgatatttacagggttatatggtttggctttgtgtccccacccaaatctcatctcgaattgtaatccccaggtgttgagggagggacctggtgggaggtgattggatcatgggggtgatttcccccatgctgttctcatgatagtgagttctcacgagatctgatggttttataagaggttcttcctctttgctctctctctctctgtctttcctgccacctgtgaaggaggtctttgcttcccctttgccttccgccatgactgtttttcttgaggcctctctagccaggtggaactgtgagtcaattaaacctctttcctttataaattacccagtcttgggtgtgtcttcatagcagtgtgaaaacagactaatacactgggtatcaaaacctaccaaataggaagatagttctcagattgtttttctagtattaatcccagtgtttatgtggctctggcttcctacaggaaggtagaggtaatgtagtttaaagggtgctttatcccctggagagtgatgggattggcagtgaaattcaccttaatcatatgttgaaatcacaagatatctaatttatctattttctatttagttttgttcccctcattctaaagtatcccaaccccctttagagcagtgcttctcaaattttaatgtgcatatggagcacatggggatcttattaaaatgtggattctgattctgtaggtcttagatgaaccccagcactccgcttttctaacaggtttccaggtgatgcttgtgctgctagttggaggacctcatttcccactttgaataacaattaatataatgattagttgactggcgtaggtatcatgcctgaacttccttgctcaaatttgctctccctctgagaacccatgagaacttccacaatcttttagttgatatcatatcctgtcactgtcagtaatacttccatgaactgtgtgcttaaaattgtctagccttgtttatagggtttttgcaagaaataacctctgtagttggctgcatgtgtctatagtgccagctacttgagaggctgaagcaggaggatcgcttgagcctaggaattcaaagctagcctgggcaacatagggagacccccactctttaaagagaggagagagagagagagagagagagagagagagagagagagagagagagactccttggttgtccattgaggagtcaggcagagaactaaggaacaaagaaccagagtttctacattagacagacctgctggcccatttattattaatagctacgtggctttaacaagttaggtcccagggcctcagtttcattaagagggataatagtgctacctttacttggtagatttgaagactaattgagatcaaaaatgccagacacatgaaaggaccactataagtgttagtctctttccctgtaactgagtatcaaatgagcaggtttctccctctgaaatgtccctgggtaaagtgggaaataagttcatcctataatttgaatgaagtaagtctgattgtcttcaaagcaatttattaaacttttgatcttaaaaggttttgtgaatgcttttacaatttctccataaacatcttaagatgatagtattttggtatttacatatgtatgttctgttttgtttctattctctgcttgtgtgatctcatttacccaaaatcttcaattgtcacgttaagcctatgattcagaaacctctgccccaaatttttctcatctccaacccccaacacaaacctcttcctccagcattccctgtctcaggaaatggtgaaatcatttatgtaattcctcaagccagggaattgtcttcagctttttccttctttctcccactgcgtccagtaactcattaggtcttgatgaatctacctcttgatgtttttaattccatttgctgttgtctataccagttgctgctacctattcaaggcccaaagttacaatctacctccaacccagtcttctcccagtctacctccaaatcagtctcacacagcatacaagatgatcttttcataattaaattcttctggttaaatcttgtggaaataaatgaaggctaccacaataaacagagactgtttattcagcggttgctatagggagggattcagccactatcactttttggcagagactccaatgcagcctgggaagctttatagtggtaaaaagaaaggtgtgggggaggcttcaggtctactctaattgtaggttgctgacatgggaaagctagaggtggactagctggaagtagggtatcctctgtgattgacttggaaagcatatttggctttctctggttggtcttaagttggaagcagagggacaaaaaccgggaaagctggcagtcattggccaaatcctgacttttctgagccaattgcagcagaggttgttggccagagttattttgtcacatatagtctgaccagttttgtttatatgttcagtctcaaaccattcaatggctttttaagatccttgtgttacatacaaagccttctataaaatcccatgccagaccaatagctgcatgaggtgaggacattgttattccccacacctagcacaattcctgaaacaaaaaaaacctactaataaatagttatagaaggaggaaaagtctagggaaggtagagggagagagagaaatctttaaaaatctgccaagcaggtaaaactagagtaacatgaaatggataatgcaagataaatctaagaggaatctatgctttaatctttactactctctgttcttttaaaaattatacctgctcatttggagaaaaaatctgaaaatacacacaaatattagaaagaaaatcctgcaattggggtggcccaagtgcagtgctctttacagctaattgattacagctagttacggatttcttccttttccattcccactgcttcccttgattagccttaaaaaaaaaaatcctgcattgacatttcattccaatatccttgtctaaccttctaaacaaatatttcagaaaaccagaaaagaaaaacccactgtgtgtgtgtgtgtgtgtgtgtgtgtgtgtgtgtgcatgcgcgtataaaatctgagagtgtaggaggaaaagagaaaagacagctgaggtagtggtggatatcactgccaaatccccaaatcttaaaaggcagaagtctatttaccaaaattttttgtaacagtaaatttaactatttaacagtaatatttaacaatttttaatggtaacataagaccaggtatagattagtatttagtaaatcctttttaaaattattttaaaaagtaaaaatggctgggcatgttggctcatgcctgtaatttcaaaactttgggaggctgagactggcagattgcttgagcccaggcattccagaacagcctgggcaacatggcgacactctatctctacaaaaactacaaaaattagcaaagtatggggtggtgtgcctctgtagtcccagctgctcaggaggctgaggtggaaagattacctgagcctagggaggttgaggtaagcagtgagccgtgattgcaccactgcactccagcctgagcaacagagtaagactctatgtcaaaaataaataaaaataaatataattttgagtaaatgagctcattcagatacttactccacagacttaaagttagcatgtttcattacaaattgtttttgatgccatgacatctcagttaggattaatttctaaaaattgtttttgaaagaaatttcttgagatcagaatatatgaatttgtaatttttaaaggcaaggaaatactaaaactaagacaatgaataatgattatgtagaagtatggaaaagtatgtattgcagatttaaaactcagaagctgccatggtattaactaacactaagtgaaattgtgtaaaatacttatgcatgtaaggaaaaacaaaatatataaaaataaaaatagatgcatttactacatgataggaataagtaggattttttcgcttttgtttgtatcatcattacatcaccttttcaaacatttattttaaagtagaagtaagcgtgaaagcaggaaagaggatacaaaggaaactgggagagcttaactcctgtaatgggggtaagcactgtgacataaccctgaattaagataaaatgtcaggtagcaaggcattaacccccaagataaatatagtcaaaaccacacttagaatttgtagatccctgtatcatcataaatactttacctctgatcggattatttcatttttgttgttgttggggttgtttgttttgttttgttttgctatttgtatttgtttgtttgttttttgagacggagtctcactctgtcacccaggttggagtgcagtggtgtgatctcgaatcactgcaacctccacctcccgggttcaagcaattcttctgcctcagcctcccgagtagctgggattacaggtgcccgccatcacacctggctaatgttttgtatttttagtaaagacagagtttcatcatgtttgctaggctggtctcgaactcctaacctcagatgatccacccgcctcctcctctcaagcgctgggattataggcgtgagccatcacggccggccttgttttgctattgagttgtgttccttgtatattcttgttattaatcccttgtcagatggataggttgcaaatattttctcccattttttgggttgtctcttcactctgttaattgttttctttcctgtgggtacactttttagcttggtgtaatcccgtttgtctatttttgcttttgtggcctgcacttttgaggtcctacccaaaaaaacctgtgcccagactagtgtcctaaagtgtttccccaatgttttattccagtgacttcttagtttggggtcttatatttaagtctttaatccattttgatttgatttttttatttggtgagacataggagtctagtttcattcttctgcatatgtctgtccagttttcctgacaccatttattgaagagactgttctttccccactgtatgttcttggtacctttgtcaaaaatgatttggctgtgaatgcagggacttatttctgggttctctgttctgtttcattagcctatgtgtgtgtttttatgccagtaccatgctgtgttggttactatagttttgcagtatattttgaagtcaggtagtgtggtgcctccaggtcttttctttttgctcaggattgctttgggtgctcgcggtctactacttaaactttggatgatagtacccatttccttccccgtttacctatgaataactttattataatatagcctcttcttggttgcattttccaaatctttattaagcaactaacaatattatatgtcaggcccagtgttggatgccgggagtgcctgaaagcaaaaaaatttttgctcttgagagaactttggggcagggagtggtggggaacgaacatgtagaccctttcagaacaatgtgatgggaattttaatggatataaacttagggtgctatgagagcacggcatttttctagcctttttcatcctttgggaaggtaacacctgagcttcgtcttgaaggacctgtgggaattaaccaaggagaggaataggaatgtaacaacatgagtgacaacagaggagatgtgagaggcattaatggggagtcattgaatagtttagacgggtcatgttcagatttcagttttattgttctgatggtagaatagaggatggtgttgaagggtgcaagagtggagtcgacgagaacagcaggaaccccttgaaattaagtaagagctaaaaactgaataaatcagtaagatggaatggactcaagaaatatttaagatgtaaaatctgtagaacttggaggttcctgtttttttaatgtggatgactggaagaatgctggtactaactgagataaggggatacctagttgagaaaagcaatctcctacctatagtttagaagctactcttaccatgtatctgcataggcaaacttagtgtaatgtgtatacaagataattttatttctcaacttatggaagtactattattctaaatattttcttgggcccttcagggctgatgaaattttaaaacattaagattatacaaaatactagaattcaggaggggttttttactccaaaatctatttattcctgtgagttttcatctactgttcattctccccttactatcgtagtgtcataaaacattttttaagttaccaagggaaagtatcatataaattagtgtgttagatatgacttattgatatagaagatgatctagaatagtaagagttgtatgttttttaggatgttttcaagcctatggaccttaatcgtgtcatcaaactcctcgaagagactgataaagtgagtaagctttgagagaaaattactccgctgcattacttacaaactatttccctgaaaggtaacatatattccttcaaatgtaagtctcatttatctcgttttgttgaaaacattttaaatagtacatatcttatattcaaggactatttaaatttagtatgaatatatttaatgaagtggggagactggaggaagagaatagatttgcttttatgagatagacaaacccatggtggctgtaacagaaggaatcctaagagtacagaaaggatcatctagcctctgttaagtgcttgttacctagtaggattggaggacagaaatggtagaaaacagggtaccgtggtgtactaattatgaaatcaggatagatacacacaaacatgtacacatagataatttattttgagaacaatcatatataagatgtaatggaaattaagttattttagacacaagactcaaaattgggaaagcaggcattgagagaaaagacaacaaatgtatatgcacacatgctcatataccacctgatgttatcaagaatcgactgaatgcctaaaagccagcacacgctaggaacttatgtggtgatttccaaaaaggaatacgtattgttagtaagtagaaaatgagttgaccacaaatgcccatcaatgatagactggataaagaaaacgtggacatatacaccatggaatactatgcagccataaaaaaggatgagttcctgtcctttccagggacatggatgaagctggaaaccataattctcagcaaactaacacaggaacagaaatccaaacactgcatgttctcactgataagtgggaggtgaacaatgagaacacatggacacagggaggggaacgtcacataccagggcctgtcaggggatgggggactatgggaaggatagcattaggagaaatacctaatgtagatgatgggttgatgggtgcagcaaaccacatggcacgtgtatacctatgtaacaaaccttcacattctgcatgtgtatcccagaacttaaagtataaaaaaaaaaaaaaaatttttaagtaagtgggttgaccatagtatagcctatcaaaagaaaacaatgtcctatgaataggaggcacaaaaatttggtcactgttttaacattttttattctctgcttttttacatataaaggagaaaaagtgactattggaataatttatctttttctggctatcattgttgtgaaaagttattttttattgtgactatatctacatttccttaaaaaaccacaactgcatagagtgcctattagctgtttaataaggctacagagaaaaagtatagacaatatcacagcttttcaggaacatttaagattaaaaggacagacagaattcagtcatggaaacacatcactgtgtagaagttttacttgcttattttcatttttaattgacttaagatgtttggcttgcacagaacactgagcatattttagaagttaaaaatacaatctctacagtcagctttccaaatttgtcttctaacaccaccactttttagctgtgtattttggacacgttactttaaaatgtttcagcttgtgtttcctattctggaaaacagagatcatagtagtatcttcctaatagggtcattttggaaattaatgaagtgatatgtatatatggtacccatgtggtacatgacgtagaaaaaatattcaatgtactttagctgttgttaatattatttctggaaacaattactgcttttatattaacctggttttgattcccaatttcctaatcaaatttaaataatagtttatttttgatacataatgtctgtaaatgtttatggggtacttgtgatattttgttacatgcataaaatgtgtaatgatcaagtcagagtatttaggctatctaccacctctagcatttatcatttctatgtgttgggagcatttcaaatcccctcttctagctagtttgaaatatacaatacattgttgttgactttagtcaccctactttgctaacaaatattcactaacacagtcttcctatcttttgtaattatcattctagtctatatctccatgagaacaacttttttagcttccacacatgagtgaaaatgtgtgatatttgtctttctaaacatggcttatttcacttaatatcttctagttccatccatgctgctacaaatgacagaatttcattcttttttatggcttaataggattccattgtatatatagaccatattttctttatccattcatccattgatggacacttaagttgattctgtatctttgctattgtgagtagtgctgcaataaacatggaactgtaggtatctcattgatacactgatttcctttcctttggataaatacccagtagtgagattgctagatcatacagtcgttctgatagtttatttttaccttcactgtttcagaaaacattttataacgtttacattataatatagtaatttaagaattacttgataattttaaagtgtctacttttatgttgaagaattttttaaaatctcaacagatttaaaagcacaaaagaactaaaataggtgatctgttttaggatggcttggaagaaaaacaacttaaatttgtcaagaaactggtacagtgttatcagaatggacttgtatcctttacatatatatgtatgttcatttcatttattctgaaatgagaatttcttttagaaaatgtgttagttttccattgctgttgtaacaaattaccataaatttgatggcttaaaacaacataaagttattatcatacagttttggaggttagaagtccaaaatcagcctcagtggactaaagtcaagatgttgacagggctggtttctcctgaagactctagaaaggaatcatttccttgccttccccagcttctggaggcttcctacattccttgcctcatgccctcttccccccactggcatcactctcacctctgctgctgtcgtcacatcatcttctctgtctgaccctcccttcctccctctttcctttataaggatccctgtgattacggtgggcccacctggataatctagtataattttctcatctcaaaattcctaatcatatgtgaaaagtccctttgctatgtaacatagttacaggttccaggaattaggacatagatatcttggggaaggccattaatctgtctaccacagaaatactggagaggccattattctgtctaccacagaaaatatctaacattttatgttctttataagactgtattttctatcagataatgtaaataaaattgaagaaacaatataacacaagtaactgtggataatgtcagtttttgtcgattcagaaagacaatggatgtagttagagggccaagtcaaagtcattatttctattaatttacatgggcagttgtacctttgataagctctccacccttgtaaagtaatagaagctcatgaggttgttagcaagattagatgagatcatgtacatccaagtgcttgataatctgcaaaatattatataaatatattatccctactaaatatacgaccctgaccagaatacatgaaaaccagtgtgtcttaaaactatctgtacgtaaaagccaggtgtgatggcttacacctataatcccagcactttgggaggccaagacaggaggattgcttgaggctaggagttcaagaccagactggtcaacataccaagaccctgcctctacaaaaaaacaaatagccaggtgtggtggtgtgtgcccatattcctagctactgggaaggctaagacaggaggattgctgaaacccaggaattcaaggttacagtgatcaaagattttgacactatactccagtgtgaacaactgagtgagaccctgtctcaaaaacaaacaaacaaacactacctttggataagaaccagtttgttttgttttgttttggggtgtttgtttgtttgtttgtttgtttgtttttgacacagagtctccatccagccttagttgcccagactggagtatagcggggcagtcatagctcactgcaacttcaaactcctgggcttaagcgatcctctcacctcagcctcccaagtagctgggactacaggaatgcacccaccacacccagttaattctttatttttttgtggagtctcattatgttgtccaggttggtctcaaattcctcagctgaaacaatcctctcgcctcggcctcccaaagtgctgggattacaggtgtgagccaccacagctggccatttttttttaacatttacatatatatgctattgtaaaatacaataaaagtatcccacaaatattagattgttataaaagtttttatatgtccactctcactttatgtattcattttgtcacagactagtaaatatacttccagaactgacagtggtccatagaccacactttgaatagtattcatctaaatcaagcttgtccaaccctcaacctgtgggctgcatgctgcccaggatggcttggaatgcagcccaacacaaatttgtaaactccttacaacattatgatttttttgataattttttttagttcatcagctatcattagtgtttgagtattttatgtgtgacccaagacaattcttcttcttccagtgtgggccagggaatccaaaagactgaacaccctgaaaatgatcttgaacagttgtctgacttggtctaaagaagttatcaagcccgtgcattgtggctcatgcctgtaatctcagcaccctaggagtctgaggcaggaggatcatttgaggccaggagtttgaaaccagcctgggcaacatagcaagaccccatctctaaaaaaaaaaatagccatgtatggcgatgcacacctgtagttttatcttctccagaggctgaggctgaggtggaagggtcgtttgagcccagaaattcgaggctgcagtgagctatgtttgtgccactgtactccaacctgggtatgggtgactgagtgagatcctgtctctaaaaaaaagaaaaaaagaaaagttatcaagctctaatattagctcattccagttcaaaacctcttaagacttccattcaggaaaatgtttcttataatttaatctaaatcttttattatgttttagccttggttttatttggacctgttccatcttagggcttgtgtatatcaagccctatttactggtagctgaaaatgtctactagcagggatttcttttcctattttaacctgacatctcaacacctccattttttttttcttcatgttaaaccgttggtggcaattggctctatttctaaatccctctcataggctggctatagaagttgtaaaacttagcaaagttagagaagtatcttggtcacttctctaggaagttaacagagctttctatttccagtgtaccctgctctcccatcttttcctaaaaggtcctagaaaaaggctaggagtaataagattcaaccaagaagtgtaagtcacatctaccataatttcttagctgtaaaacaaaatcaatgaaatgtgtttatgtgccaataggatttttttttttttttgagacagaatctcactgtgtcactcaggctgcagtgcaatggcatgatctcagctcactgcaatctccgcctcccggcttcaagcgattctcctgcctcagcctcctgaatagctgggattacaggcaccaccacgcccagcgaattttgtatttttagtagagacggggttttaccatgttggtcaggctggtctcgaactcctgacctcgtgatccacctgcctcggactcccaaagtgctgggattacaggcgtgagccagcaggatttttaaatagataaaataaaagatgcttttatctgaatatctagaaagtccatattttgctttcatattagtttcagataaaatcctaaccaatttaagccttaaacacaggaaaatgcatctcagtttaatattaataaaatagtggagtaaagtaatgtttaggttgcttattctgagacagcatatgtttgtgtgggcaggggtagggggtgaagatgaagggtataattgagcctaatcagtaagttaatgttttcaatgtgctattactcattgccagtgggaagttattgatcaactgaatctgtgttgtagcagttggtaatccaattctaaagttgtgagaggaaaaaaattttgagtaggcatttactgaggcaaaaatgaaatggtttttttaaaaatatggttctaaatttccttttttagacttcaaaataagaataattaaaacagtatctaccacatttggcaaaatagttggaattctatagactttcttcacagaaatactataaagaatatgttaataaagatattaatctgaattttatttcttaactaaaaatattaaagccattaagggatttagcacagatatttaaaattctgaatctgtgttcaggaaaaataaaaaaccagcctcgttttatagaatctgcatatgatatcataaaactgtgtgggtaagttatctttctttaactttattttgtagtaacatggagtattttattatgtttcttatatcacaaacatactatgcattatagtgtagcagattgctacagaactcagaaaacttcagttcatcacttgattccagcagttggcatttcaggtaatcagtttgctgtggtctgagattgctagccacaagagattaaattctaagtatattgaaatgctttcttgtaattagttactctgaagtaaatgctaaatattagatgtaaccaaggaattatagtattttcagaaaatctttgagtgaacttatggatatgcttataatttcagtctagtttttttctctgtctttagaaaatttgagtctcaaagatatattaggttatatatgtcatgttttatttgatttttgaaatttgagtgaagaataaaaatcaccaattacatttgatatatattttaaaaatgtaagttagagataagaattgtaaaattaacatgtcttattctttctactgttggttctctaacaagttctgggaactgagtatatggtgcttccttggtgccacatagtggctaatctaggtatatattaaaatatccatttttagttgctaaatgtaatgtagtagggaggaataaaccttttggacaattttaccttctgaacctttctaccaatttaactttttagatagcaattatttattttaatatacaaataatatataaataatagaaaggtttagtagaattatgcatacatgataggttctaactctcacttttagatttactagcaatatttaatatgtaaccacttaaatttgtattttctgatatctgaataaaataaccaaaataatatattgaatgcctataccatgccttgctttttaatagacaggtacaatggaaaataaatggttgctctggtgttttcaaggaacaaattggaaattattattatattgacatacgattatataatgtaaaacttttaaatctcaaggctttgcaaatcctagaatgccaagtttataagaattgctttcaacatctatgctcctacagagctctgcacaaagttcattgtctatgaaaacttgtgactgaatgtttaattgtataatatgataaatcctttttagctgcagtcttcattttccctcatatttcataattattcacattgttaattttttctacttttctaatttcagcttatgtctagataacttctctatgcctcaccctcacttgtttctcttttcaagacatttttggaagataaaaacaataaaaatagaataataatgtcaagcctttccgttttggcctccaagtagtatggttttctcatggcattagaagtataatgctaattttttcataaactttttggttgaaaactcttctgatgctttatcttatagattgtgtcctttgctagaaaaggaaaaagtttgggaacaaaaagtactagttttagagtccttcactttagagatccaaaaagcagctggataacaaatataatacattatttgtttcaaatgacaaattctgacaaacactagaaatgaacttctgtggcatttataaaattgtcctttttgtagcttgctcttcagatatctttaaattcaaattggcctgtatattgctattgatacatcctcatgtgatagttctcaataccattttcaactacttctttaatttttcttgaaaaatatgaattggccaagcgcggtggctcatacctgttaatcccagcactttgggaggccgaggcaggcagatcacgaggtcaggagatggagaccatcctggataacacggtgaaaccccatctctattaaaaatgcaaaaaaaatagctgggcgtggtggcaggcacctgtagtcccagctactcgggaggctgaggcaggagaatggcgtgaacccagaaggcagagtttgcagtgagctgagatcgtgccactgcactccagcctgggcgacagagcaagactccatctcgaaaaaaaaaaaaaatatatatatatatatatatatatatatatatatatatatatatatgaattaaaagtcctgtctctataggatatattgtactttaaatagtacaggaggttcaaattttgaactcatgaaatgtcaagatagtttatatatttaaaaaataacttttatattttctttgaaatttagactgacccaggtttatgtgctggatcttttatgatttataaataagttactttaaaataactttggttatagaagttgtgaaatgcgattctaatataattaatatttgttaacttgaatgccttaatgtctgcaaaaccattctgttattttgtggatagttactaacccagctaataagcaaaaatgcactgatctctaagaatgaataaactatcgattttgcctagagttttgaaaatttcaggaaaagctcttaaccagtttttaagttactggtgagcttagatctatggtttgttccagattatccaatgtcgtactaactttgatataattatagctataatttattactattttgacctctaagagaaagagggttcctaagtttttttattcatgaagcgatgcaaaatggctttcttaacctatgccttttacatccatttcttaattcttataattaatataatattttctttttggtcagttcattagaaacattttttttctttttttctttttgatggaggctcgctcactctgtcgccaggctggagtgcagtggcgcaatctcagctcactgcaacctccgcctccaggattctagcgattctcctgcctcagcctcccgagtagctgggactacaggtgcacgccaccatgcccagtgaatttttgtatttttagaagagacggaatttcaccatgttggccaggatgatctcaacctcttgacctcgtgatccacccacctcggcctcccaaggcgctgggattacaggtgtgagccaccgcacccggccccagaaacatttttaatagttacaatactattaaactgtaatactgtgtattacaactggtagttaataattgtcaatccccagggctaaagaatagaatattattattaatttattctttagaaatgaactctcccccacttacaaatgatgcttcaattaaagactttattaaaaattactgttacaattcttcattcttattgaagcttgccatttttgaaaaagaaagtgtcggatgaaataacttatgctgaagatactgctaattcaattgcacttctgggtaagttaagatttccttaaggtatagggatgtaacatacgacaggtcctactgacaagggaatatctattttccccaagtttcactaagaggactccttctccatgtctaggatcttctcttgttagtgaattaatcacagtgtgcttggtgataattctggtattgtattctgttcaggttgtttcgtgataccaataaaagtccatcttctaagtacaaggacaggctgataatgtagtttgatgaattattatttagtttaatgaagtgtttgttaactatttttgtaaatcagaaagtgtacataccctttttaaataatcacaaaaacatttcaactttgaactctaatattgaattgctgcaatcatagaattattcattaaatgatctaaaattttaaatcaaatcataaaatagcatattaagaacttcagcataatgcacataaagatgcagatgcctatattttgtacacaaaaatatgaaaaatatcataaaagggtaggcacttatgtatgggttatcacttgattttctagagaaagaaaacaatttcctaggaaactagatcagggaaacactggctctttgagtcagctcctgggacatgatggcatgttcccaaaacaaatcctacattaaatctatacttactagtttaggtctttatttgtacaggaggaataaaagatacacaattgatccagtgcatttttaaaaatatttacggaataatgatgttcccagcattatactccatatagaaagatgttagagattcaactggaatgaagaaaaaaaggatttttatttttaacatagacactaacccttttatatctcagtaggttttatagtttttagttactttgggaaaactacctagggttcacctactctatatcctagagtaggtgaaggtgttgttgagattaggttaaacatgaagggggcaatttaaagaaaaacaccttaggaagcaggcaggttcagaaatatgggaatttttaattatgtgaatctctatcatcagcagaaatttacaatgagaagccaacccaaaagaggacatggtagtattaacagataaaaagtgtagtttttgttggtaacattattttttaaaatacccctgttgccattatttttaaatattgcttccaagagtgttgacagtcacttgtattataaatacatggctcactttttactgagtgtcaacttattctttgcttaatgactggtaccctgcctgcagaacatgttactatctcatatgacaacagtatgaactcttaactttaaatgagcttccttcgctgattactgactgcgagtactgctcttctgtttcttggtttttttaatggctggaaacattaatttaaactaaaataattgtatataagatgaaatgttgaacaaaaactcttcatgattttagttagaacttccagtttctactacgtactaataagttatattacattttcttccaaatgatacatagatatttctgactcagaggcaagattctggaaatggatgggggaagaagttggtactctgccctgggattatgaaacaggaagctatgataaattatctaaatttacaggaactaaaacagtggaaaagcagacgaaagaccctagaatttcccataagcctgcatatttggatagtcttgttggaaaagcttagttgttcttgttgcctaatatgttttaaaacctaagtagtgattttgcaactccaaaagaacagtccgaaaaataaataaaatttagagttagaataatcttaaaactgtcttttaagtgatatcttttgcagagattctcctgaagctagggtcaggctttcctttgtgcttcctccttctttccacttgccaccccacttgctgaccacctccagagatgagcgtcttgcaagggctaatgcaaaagaggaattcctaattattcttttactctcagagagtccaaccagttctagtttagttctaaggtcgatattactgactaccgctgtccttgggcattcagagaacctggatcatttccagagtcccacagatcattttcagatacccttggggatcatgtttataggacttcaacagagtagatgcaatccagtttgaaatacaggctgaagccaatttaattgtagtttagatatgactgaaaacgaaccttcctattcgccaaccccatgcagacagcttgaacataaaactattacccttgcatgtggggcagctgcttaaaaactcactctcttccagtctgccaacaaactgaagagcaaagttcacctggaacttctctaagcaaagaatgcattagtaaaggcaaaaaattactgaccctctagttagggagaaaaatgctaacccatatcttgtcaaaataataatagtatctaacacatgtagaacttacaacatgctagatgcttttctcagcccttttctcatattagctaatttaatcctcacaacaatcttaaatgtggtaactattgttatacctgcttaatagatgagaaaagtaaaacacaagtttacatgggtagtaaatggcatagccaggatttaaccttagacagtctggttctagcatttgtattaataatcatcattctttcttccctagaaaggagaggctgaattgattgaggggccaaatgtataaggatggattcagggtactgtttatatgtatgtatgtgtgtgagcatatgtataaaaatatgcatataaattgaacatgatccagtttgaatctctgagaatatttttaataatcatcatattattaacattttatgcctaaattctacaaataagcttatgacagtgttgttaaatagcacctgtttatctttctggcaggtgacttaatgaaaataccaagttctgaattgaggatacaaatttgtaagtgtattgttgatttttatcatgcagaaccaccaaagaagcatattccaggtgaagtttacaatggtctttcagtgataacttgtgtatgtagaaaacagaacattctcatatctctttgaatttgacagacacagtgggctcataaatgtaacacattaaaaagaaaacttttttgtagtcttgagctctttggtcatcttttgaaagttatatatgtatttttcagtttttgatttgcatatttttattctgatgctaaatatgaacaaatttgtaaagtgatgcccaatttagtttattaataattataaatgttactattatgttatttaataccattgataaaattattttttaaacactttataattatttataatatctgcccccactcagttaaatgttaagctaccaatgccagggccattctccatcctgtttgggaaaatagttctatgtgttatagctaagggaccttaatatatagtggtaaatgagccacactgaattggttgggaccaagacagtggcacgtgcactgtgaggatataatgttaagatgtacttcttaccttcatagtttctgtaatttctaatcaatctaggaagggagagaggatataaacaataatttcttaagttatatgattcttaatataggtggaaataagtgtctgtggtagttcaaaagaaagattatttaagactaaggaaaaatgggaaccagaagtcagttaaaaaaagacaatttaaaaaaaaaaaagaaattcagggaaaacagaaggaagtcaaaaagtaaaacaaaaaaatggaacagcacctaaactagagaaatgaataaggagattattaaatgtccagtttgaactgttgatgagatagatggggaaggagtgtcttggtagataaaagatattggatactaaaagcaacaggaccagaaatacaggtttggaatccacccaaatagagttgaaaattgaagccaccagaatggttgagtttgccaagagataaaacatataagcagcaaggcatcaagaatgacatggagagtgtccatattgaggtttggaaaaaatgattcaaagaaattggcagtgaagggaggctcaaagaggaggaagaaaacctaaagactgccatgtcttgtgtgccagtgaatcaaatatttgacaaaggaggagaaagttgtctcagtgtcaaacgctgcagttttctgtaatggaagagttaaaaggccaagttaatgtgacacttgaaaagttgtagttaaatctttgacagatctattgatataaagtggtcagggcagatgcaggattaaagaatcagaggattgtgagagtagaggcactggatttgagagtgagagagtagtggcagttcatgaatgcagacatatcttaagatcagatggtgaagaaaaagaaagaagatggagaacagctcagctagtgcaaagtcagagaaaggttatttgggttttgttgtttttaggataggaagaaatcacatttgtaggcagaggagctagaagctggtaagaaagaaatgggaaggtgaaattctcaaagaaagcacaagaggatggaattaagagcacaagcttagagttaaccttggcaaaatacagacgcccttcaaagaaagggaaaccagtggtgtaggacttaagaaaaaggagtattatggggcaaagacgtgaggttgatttggtcagtctctgaaaattaggagtcagtgctctcactatcacacagttggtttcaagtgatgggtatggccagacatccgggaccacggctgaaaagtcctcagtatggcagttgaaagagacatagccctggagacaggaattaagtccatgagctttaatggtgttatatccctctgttaaaatgtacctgcaatagaaaaagatacagtaagtataaagtacattttggtccatccatatgatagactattatgcacataaaaatcattattttagaaaacactttataggatggggaaaagcttacaataaaagttttagtgagtacagtagaatataaaattctgtatactagtatgttgttaaaattgtatgcatacattaaaaatatcacaagaaatatatgaaaatgttaatgttatctctagattatgaaaatataggcaatttttaccttcctcttcttactttttaaatgctttttataattcatgaggtgagtagctagagcatatcatagaaagctcatcacagcattggacagggccttgtccacagccagagatcatatttacaaagataagacaaactgacagatacctcagaactagggcaaagttaaagaatctagttggactcaaaaatcaaaaagtcagggtgttagataaatgagatcactaagaaaaaataaagcctcatctcagtaaatgaggaccctttggtgtttatttaatccctctagttgaatgtaattaggtatacctgcatcaaaaggagagatagtatttctcacaggtgctaagacagaaggaatttttataagacatgtcaccaagaatcaaacttccctaaaatactattaaattcactcacaattatcagagtagcattacatttttcacctcttattttattgctgacactacgtaattgttgtcccttgaaagtactgaagtaatgcattgaacctgaacagtgaaactgactagtgaaaacattcagtatttgtcattaaatcattttccattattgaaagtcatatctactgacaagaaatattgttcttttttagaatttaggatgtttccaaaattcatcgtcctattttaaatactacaccagggatcagcaaactctgggtcccaggtcaaactaggcctactgaaaacaaaattgtgttagaacacagccatgtccacttatatttgtactgtttattactgctttcttgctacaatgtgctatagagttgagtagttggcaagaaaccttataacctgcaaagcttaaaatactatctggccctttacagaaaaaatgtggcccatccctatgctgcgcaatttttaaattccatatacttttaaaaagtttttcttgctgttgcttaataataaattactcattcttttgtcttaatgatcattctgtgagataactgtatgtatttattaatgaattgttgttaggttaccagcaagcgagttcatcatacaagattcaaatggctgaagttggaggattagcaaaaacaatggtccagtcaatgaccttgcttgaaaatcaacttgttgagaaactttgggtacttaaagttctgcagcatctctcaacttctggtttgtatattattaagtttaaacacttcattgtcaactacttttgtttatgtctaaaaatgtcaatattgtaaagcacaaataatttttaaaatttattttcagaagttaattgtactataatgatgaaagcacaagcagccagtggaatctgtactcacctcaatgacccagatccctctggacagcttttatttcgttcatcagaaatactttggaacttgctggaaaaatcttcaaaagaagaagtcatacaacagcttagtaacttggaatgtttgctgtaagcgtatgtggttagataggaatgttcttttaatcttaaaatgacagccagtgacataactaacatctttgtttgaatctgtgttcaattatgttttagattcatgtaatggctatgtttcaggacatcttttttgttccatggtataaatgaatctgcacaataacaagccacacttttctatgtggaaggctcttgaagtagcttcttaacactaaaatataacttggaatatagataaagtaaaattagactttagaagaactatttcatttatttatccagtgaatctattattgagtgcttactatctcccagatattgcagtaagcattagcaacaaaatgtgcgtaagccttcaagttgcttcttcacttattcaacaaataattgtctgctctatgccagcttcagtattaagccatagaaataccactgaaaacaatatagatattgtctctgctttcgtggaatttacattgtgctaggagggatggacaagtaaatagacaactaaaagagaacatactaaatgttatgaaacagattattgtaagatgctacatgttcttcagaagaagatcagtcagcacatttttgtttgcaagtgactaaaaacccaaatgaccaaagcaatatagaaaatttatggcttatttaactacaaagtcaaggataaaactggtttcatgtgcagctttattcagggatcagcagatactaggacttcgtccctcctctctctacattgtcttccatggtgctggcttcacacccaagcctatgtagtaagacctaagaagtctacgatcacatcatttcaacctcaaatcaagcagaagagaaaccttgctatcctgaaggctcagagaaaagtctttgaattgagtccagtttggccctgaatggtctaatattggtcaaatgcctgttccacagtgatttattagtgccaaaagaaaaaatgctctgactggcgaaaaggcagctgaaggcagcctcacaggagcaaaagtcaggaaggagtaaatgcctaaataaaaataagaatgctgttcttataaaaagggcaagtaggtcccaggaggcaaagcaacaaatatctactattaatacaagggaacctaactcagagttggagaattaataactgcttcctaatgaactcaagtctagtaactgaatgacaaacaggacttggtaacagaaaagttttgcatgcggagagcatcctagacagggaaaacaagtgaaaatataattagcaaaatcagaaaactaaaattcagtatgatgagagcagaaggaacaggctacaatggtgagagatgaggctaacaatgttatcagggaccataacatgaaaggtctaataagccttgttaaggaggtaggacttaatcctaagaacaaagaatagtctttaaatggttttacaaaggaaaatgacatgattgaatgtgttatagagctgtcactttgaccaccatgtgtaatagactggtttagtggattcttatctggtacatagaggattagaggcagatttggaagtgtaaaaaatattagaaatatgttcaaatgaatagtataatataaaaagggagattttgttgatagacattcaggaagtattttcataaaagtgtgtgttttagtttgagctgctataataaagtaccgtaaactgggtggtttataaacaacagaaagttatttttcagtttgggaggctagaattctgatatcagggtgccagtgtggttgggttctgatgagggtgctcttctgggttgcatactgctgatctcttgtattcttacatggaggaaagagagcaagacagctctctggagtcccttttataagggcactaattccattcatgagggctcattacctccctaaggcctcactcctaaaaccatcacattgggggttaggatttaaatatatgaattttggagggacgcaaacatttagtgtataacaatatagtttttaaaatatgattttactttctagggctttgaaggaagtatttaaaaatctgtttatgagaggtttcagtcattatgaccgtcagcttagaaatgacatattagtgatcactacaattatagctcaaaatcctgaagcaccaatgattgtaagtatgaatcaaattgcattaattttaattgtggaagtggtgggcttgggtgaaagaagtcctatattatgttggaatatttgtgtattttcttgtaatgctaagttatgctgtaatatcttgatggtcaccagtgtgcttatcactctgccaattcttctttgcaatcctttggaaatttggaatcttcctcatattgtgtgatttatacatgtatttaccacttatgatgcttttctttccttcctgatgatttgagtttccatctggcatcatttctctttcactggaagaactttgtttacaatttcttgtggtgcaaatctactggctgctggcaacaagttatcttagttttcttttatctgaaaatatatttaattcatcttaattcttaaagtctatgctcattgaatatagaactctaggctgaaaaatgtttttgtttagcatttcaaagataaagttctgctgtcttatggagtctgttgtttctgatgagaaatattcattgtgaggttccatggtgtaatggtgagcaccctggactctgatgagaagtatccattatttcaaatcgttattcccctatgtataatatatcatccttttctctcactgttttcaagattttaactctatctttggttcctagcagtttcgaaatgatgtgctaaggtgagatctcctttgtatttgttctgcttaggtttcatagagcttcttggatatataaatttaagtctttgagaagatttggagaactcttggccattatttcttcaaatattttttcagccccattctctctccccacttcttcagaggctctgattacttttatgtttgactttttgatattgtcccacaggtttgtgaggctctgctcacttttttcaatcatttttctctctattcttcaggttggataatttgtattagtctatatatttaaattcactgacttttttatttctgtcatctccattctgctgttaatctcatccagtgcatttttacttcagatatatttttcagttttagaatttatttttattcctttttatagtgtctctcctgagagttcttatctttctattcattatgagcatctttactgtagattctggtatactcctctgaagaatttttaataactacatatttaacttagctgtactcatccctttttgaggtatggcagcccaaatcttaattcagttcttgcctgggatgcttgagtattctctgcacttgtgtggttcagctatcagccagatatttgggaagagtttgtacacagaatttagcattctctctctctggctctctcctttatgggatttctcccttcactttccaatggctgtggttgcctctgccctctggttcttcaggccactaagaccacagggttactctgagttttagcatttccacgaggtgtagaatacggcctgctctcaggccaaaagcctttttttttttttttttttttttttttttgagacggaatcttgctctgtcgcccaggccggagtgcagtggcgcgatctcagctcactgcaagctccgcctcccgggtttgcgccattctcctgcctcagtctcctgagtagctgggactacaggcacccgccaccacacccggctaattttttcgtatttttagtagagacagggtttcactgtgttagccaggatggtctcgatctcctgacctcaggatctgcccgccttggcctcccaaagtgctgggattacaggcgtgagccaccgcgcccggccccaaaagccttttttaaaatgggaaactcgtgtagtgccattcccttctacaaaattctgacatccttccagtgtctgcttactcttggtcacaagatagttttatttgtcaccagcaggagaatttctctcggagctactactcatctgtaccagaagctgagccttcacatattttataattaaaaatcattgaatgattgaaattatttaatagagatccttggcaacaatattcacaagtcagtcacgtaagttctagttgtgctacaaagaactggctgtgacgacctcagcccactaacagtggacgtcaagtagtcccaagagtcatggaattcatgctgtgcaaatagggaaacagtgctacatagtatcctagttaaagctgcaacttataggtagacctttgtttctctagaatcccctggtcaggtagtaatttctcattagtgtccttgcaaacattcagatgaatttcacgaatgtgagtcaaaggaaataatatcttcagcatctaaagaaaccatatagatcctaaagtaatggggctataaaactacaagctcataagcccagggtttgcccctgtaaactctccctaatgtgcaaaatccaactaggatatctctgtcaggaatgctgatatgctaaaatgtttgcaactctggtgattcttcagggcttttcatgctaagtaggaactactttattatctcttgaccaaacatttgacataacaagaatggttggggtagaagtggaagtgtttaagaagaaaagctgttgagaataactggattttcctcccttactgtgtcatttgaagtataggtaacgaattatagaagtaactataaagacctaatatactttggatccttaacaattttaaacagactattcatagaataatataaaatatttcttagaacctacagaagtaagtttaaaattaaataaatctggcttatttaattttaaataagcttatctggctatatgtttttattttttgcctcactctttattactattcatgctttatgaattcaaatgaatgacagtaggagaatttgataaatgtacttaagtagtaaatatgagcatctgcatcataactttcatcttattcattcatctttctgcttattttatgtatttatattaggaatgtggctttaccaaggatttgatactgtttgccacctttaatgaaggtaaaaagaataaaactttaaacttcttataattatcttgataagtcttgtacaacatttaagctttcattttactttttttccctcacagttaaaagtcaaaatcttttggtaaaaggacttaagctttctaattcctatgaagattttgagttgaagaaattactattcaacgtaattgtgatcttatgtaaagatttacctactgtacaggtaaagagtaatcaaggcaggaaaatcaataaaaattgtcttactttgtagtataactattttaaagtcttgactgtaaatattttatcggttcatatatttaccacagaaagcagtaaaatcttactggcctgaattttagcttttaaattttttctttgcttatctgttagtaaacagtgaagtacttaaatttaaaccacataaaccagagaaaaatagtagaacctaagagatttaataatacagttagatctcttgaattagacagcataaaatgaaagaagcttcacataggcccattccagcctaataatctgtctctgaccataacaaggactgatttaatgctggagaaaattattaacctctgtgatgccaatctcaaactcttatgaacctgctttttcatcacacaaacctaatgtctttaatcacttttactctctatgaatttatcttaatactttgtttcctgcataacagcgtgatataatttgaaaaatattggaactgaatttcacttctggcttatcacctactagctatgtggccttagaaaaattacctcgtctatctgtggttcatttcctcctcctgtaaaggaaagattataatgcttcagctctgctcacaggtctatcgtgaagttgctatgaaggctttttaaactataaagtgacagtaaatgtattattaacaattctgtttagttagttactgcattaagtgaaatttccatttaatctaaaactctaccaagctccaaggattactatgaaaaagaagtaggaattcagtctatcaacttcactaccaataatagaaagatggggtagtctagcagtaaaggctttagtcagacagaatctcagtgctaccgctttctagctatgtggcattaaatgggttgtttgatttctctaaatcccaggtagctcaacttcaacatggggataacacctacctcgagattattatgagcatttaactgagctgaacattttcttagtaatgcaactttaaggaatatatatattttcaaatgctcaggaaaagaaaagttgtctttataattataactttattatttgtgacaaaaaaatacatactgtgtagaacctaaatgtattttccaaaatgcaaatggaaaatcatttggaaaattattccataaagtatggtttattattccaatacagtattatataaatattaaaattagacctataaagataataaaatttatactacagtttataagtcaattctaattaattgaacaacactttataggcaacagagccaagtagcacagattatggtgaggagcttcttaaaacactttgtgagcggtgaaatcaacaatttttatgtgtcacataatttgtggtccagtaatattactagtaatgataatgaatatgtacactatcatttgcaatacacaggggtgttttttgaaacattatatacttaattctagcaagaatgttagaactagtagttattcctgttttctcaactctaaatcttgcattcttttcacatggactagtaaggaactagaaaaattaattgtttttgttaaaatctttatagaataatgccaaattaaaagaaaattaaatatagcatatggtgttttattctcttgtgaatcataaatatgtatccatcagaatcagctgtattaattctgttgtcataatagctatgcattttaatctcatttttattaaaatgatgggttcaataaaattttaaaatactaggcatgtaatgaaacatggcttgtgacctaactgacatttatttggtagaatgtttatgtaagtactgttgcatgtggttaaatattcactgtagtcattacctcagacaaaattcttttttatggtacacaactgagtctgtgagatatttccttttaaaaaaagagtgaggaaagagatgtcagcacttgccccaaaatattctatgttttattgtacgttaaagtaaaatacgttatacgttttattatacgttttattatacgttaaaatatcctatggttttattataagcaggaactacattacatatatgagcagcaaaaacaaaaaattaatacatattttatattattgtcagggagtacatacctcagaaaagaggattataacttatttaatttttggtgttttttttttggtacctatcatagattggggttattttataaaggaattattttgaaataatccccaataaaacatcaaaatgtaaatttttatttaattgccttaaagtatttttggctatgtttctaacaaagtatcctttgttctttctcacagctattaattgatggcaaagttattttggctttgtttacctatgttaagaagcctgagaagcaaaaaataattgactggtctgcagcacagcatgaagaattacaactgcatgcaattgccactttgtcatcagtggctcctttattaatagaagaatacatgtcatgccagggaaatgctcgagtccttgcatttctagaatggtgtgagagtgaaggtgagtggcccttcaagattcttgtcaaaattctaatcttcatatttcaactgaatgctcagtatatgcatagaaataacaatgaagttaattaaagcaatgagaagtaaaaacacacagacctatcttcttaatgtatttatatgttgttttaagaaaaacacagattttaaagtcagacgtcagtaaatgtcatagttgatgcacacccgaaagaaatcatacatgtaatttgaatttttgtattattagacctatctaaaaattatatttgggaagaaaataaatgctggcaatattttatttgctttgtttgtttgttgagacagggtctcaccctgtcacccaggctatagtgcaatggcatgctcatggctcactacagcctcaacctcctgggctctagcgatcctcccaccccagccttcccagtagctgggactacaagttcatgccaccacacgaagctaatttttgtattttatatagacagggtttcgccatgttgccccggctggtctcaaactcctgggctcaagccatctgcctacttcggcctctcacagtgttgcgattacaggcgtgagcctgaaatgaattacaatattgcccagtctggcagtattataatgcattcattcaacaaatatttatgactgcctactgagtactagatactgtcttaactactgaaaatacagttaggcttaaaataaatatccttttctctatggagcttaaaatctagatctctagccagaagtaatgactccagtgtggtctaccaaattagtagagccccaatttatttgtattttgttttagttcttagaaaggaaataagaaatacattccttttttaaaaagttttataaggaagatattgcctcttttctggtagaaattttgctctggcaataattttgtatgatgcattttcattagatcaagaatatcacccatttatgcatgaaggaggaaaaaatgataggctttttattctctagtttctaatatgctgagctactaaatttagtcttgtaaaattattttccactgaataaagcaattcttcagcctatcctttatatcatttatgtttgtagaagactttaaggcaaaaggggaaatgctggctaataagagaaagactgatagctaatagttattcagaacctactatctggtgagctttaaacaccttccaagtattaagtcatttagtcctctcaacaaacctaggaggtataggtactcttattatccctttgtatcagatgggtagaactcagtctaagaagctaaataattattcctggccacaagtggcagagcaaaaatttaacccaggttctataatagaacccacaattttaaccaacatgcaatactcagaacagtattttcaactttttttttttttagctagaaacataaagctacttctaaaagcagcttttaaagaaagcatagcataaagaagggaggatttgccttgctatttatcaagacctacgataaagctatagtaattaaaattatgtggtactgggtcatggagagaccaatggcatggaatatatgaaaggttggctttatgagagatgatactgccaatcagtgagggaagggtggtgttggggcagttggtcctccatgtgaaaaaataaaaattagacctcttcactttgttttttctaaaaatcaattgcaaaagtaataaattaaagatgtaaatatgaaaagtcatacagtgaaactcttagaagaaaacatgggaaaatatctttttgctagatatcagtgtaggaaaggtttctttaaaaagactcatgagttaaaggtataagaaaagatcgatgcatttaactactgtaaaacgtacaaatgtctatttgacaaaatctaagtgaaatactaatttacaaagtgagagatgacatttattacccctgtgactgataatagattagaatccaggttcataaagaactcctatatatcaataagaaaacaactcagtagagaagtatacaaggactagggactgccatgtcacagagaaaaccccaaattttcaaaaaacattgaaaaactctaaatcctgttggcaatcagataaatgcaaattaacagcaataaactaccatttcacatttaacagatttcgtgggggaaaatcaaggccaggtgcagtagctcacacctgtaatcccaacactttcaaggcaggaggatcacttgaggccagaagttcaagaccagcctgggcaacatggtgagaccccatctcttaaaaaaaaaaagcagctggtcatagtggcacacacctgtagtcctagcttcttgggaggctgagatgggagtattgcttgagcccaggagattgagacttcaatgagctgtgatcataccactgcactctagcctgggcaacagagcaagaccctgtctcttaaaaaagaaaaattaactcatcttatacattgtatctgtataaacaccttggaaaacaatttagcacctttagtaaaattcaatgtggatgtatcctgtattattctggtcacatggaaaaactcttctcaatggatataagaggacatgaaccagaatgtttattgtaacagtttatagtagtgaatggataaactataatttatttataaaaatgaatgctgaaacgaattaaaattaataatctagatctacttgtgacaatgtgaataatttttaaaataaacatgttgaataacagaagcaaattacaaaagatacatataatatgatacatttgagtaaaattccaaaacacatacttctattctgagaatagtaagagggaaaagggataatattttatttctctaaaaaaaaactaaagcaaatatgacaaaattttaacatttgtttaaacttttgatagatgtataagatatctgatatatttgctttatttgaaatgtttttgttttaaattatcactttttctccacagatccgtttttcagtcatggtaacagttttcatggtacaggtggccgaggcaacaagtttgcccagatgcgttacagtttaagactcctgagagccgtggtctaccttgaagatgagactgtaaacaaagatctttgtgaaaagggaacaattcagcaaatgataggtaaaatataacatggtggtttactgatgaaagaggaatatttttaatagtagtagttttgtttgaaatgtttttccaaaatttattttgtctttatgactgagaaattcctgaatattttcttgatttttgtttcatattgctgctataaattagtgtgtcttattgaaatatcatacttactaaccctttaagcatttatttcttcaactcaaatatcatttcatttaggattatctttatctttttttaaaatggtctattgttatgttttattcttttagtaataaaggtcaccacttttgaccaaggcttttggagctattttaaaacaggataacatggcatattccaatgcatgtgtcataacagaacactggtacattggtatttacagaaatgtacagaggagtttcttttctgatatgaaatatcagaatatccttgacttttagcttacacttgactatgctagaaaagaaaatggaaattatgtgtatcatagaaatactgcatgtgttaccctatacgtcatcaattagacacttaatgagtatctcataaaataagtacacataaactcagtgtaaaattcagaacccctaaacaaaagctgctttgccttttgttatttaaaaaataaatagttctctagatccttgactttgaaaagagctatttcagtcgttcgtattcagtgattgcttcactagtcaattatataatctgctagatgtcaattaattataaatgcctactcaaaaaatcttctacttgttaaattaaggtggttactcttccatcactagtggagtggagtggtgctctccaataataataataataatataggaaatagcaggaaatcaaagtatattgaaaaggagctaggtgaaaacatttacctttttgcccagtttgtttgggatgaacaaacctgaaagtacagtttatcattcctgtgcacattctgttgcacaaaactcagtctaactagaggaaatccaggaaacgtaatctttcatatgtctaggaagaattcttaatcctgcctgcactagggaatagggtagggaaaagggaaaacaaatagcaatggtttttttcttcttagaaccttttccctttaaccggaaagaagctgatctttatgttaagttcttagaggcagggaccttgtcttattgagtctaacatggctgtgtagtagtaacgtgctcaataagtagtaactagattttaaatgtaaatgtttatacacttcctgggtacagtgtacactgcttggtgacaggtgcaccaaaatctcagaaaccaccaataaagaacttatccatgtaaccaaaaaccacctattccccaaaaactattgaaataaaatataaatgtttatatacttcctgtgtagacactggggttacaaacatgtatagagcaggacaccaaggaccttttccttaatgagaaaatagaaactacatgtatcatagaaagatagcatgtgttagcctacacgtcatcaattagacacttaatgagtaggacagagtaaatgttacagaaactaagaggcttgggtagttttcaaggctaggaagtcttaggattctgtgaggtaaaggtagtttagaggtggaaaagaagagaaggccttcaagcaaggaaataccatgaacagagagacatggtcctgaaatatgcatggtgatgtgttcagaactagtttaagaggagccaaagttttatgaagataaataacacaagataggttaattgtatagtcagaggccaagatggaatgagttttgagtgattgacagtagttcgaacttcatcctcttaaggcatggagagcctcaaagggttttgattagtgaggttatatgtacaatgttatgttttaggaagaagaaactgggagaaatagaatgatctataacaaggagagaataaaggcaaggagttgaagggtacataaatatgagcattatactatgtgttacaggcagcagggaaagtttctgcctgcacccaggtaggaagaagaatgctatgatctagaaagaagaagcagaactatggccagtcaaactggattcccagaagatgttcctgataaagcgatataggcccctctgtccatggcataccccagcactgggcctccagcaggctcagctagcctctcttagggtctgatcccccacctgtaattcatcctaatgggacctagaatagtcagtcgctcagggccagttatggagataggctatgatttccatggcccttctactttggaacatagctccatactttcccactaatgccagttacccctttaaccgagaaaaagtcactttttttctttatttaaagcttaaaaaaatcctttttgaggcaaaagtgtatcatgaatatcatttcgtcagtgttagtggccatcttcagtccttttcaatttcaactggaagcaaaagagggattttaaaggacatggaatactgttacctaaaattgtttaaaacaccttcagttagacatcaaggaaagatgcagaaagcaataacaggaatagaaagcacacctaaagagatctgccacctttgcttagaattgaccctgttaaccatgaggagaggaagagattaggcaaaccacagtcaggaaatttggtcatatatttgcaaaggcactcatttcctacctcatgaaactctgcatatttttaaacccagtttgctgagcaaagtgtcaggttattggggcatcctttaatgacatactgttaattctgaactagaatttctatatatgtgaggctatggattacattcagaaattctatatatgtaggtagggctactgattgtattgaaagctccaggaattcatttatcatcttcttttcacagcctctaggttactatgcaatgaaaatatcctcttctaaaatagtttttctaggctgggcatggtcgtgcacgcctgtaatcccaacactttgcaaggccgaggcaggaggattacttgagctgaggaattcaagattagcctaggcaacataatgagaccctgtctctttataacaaataaaaataaataagtaaataaaataaaagtttctctagccaaataaactttttagaagagatttccaaacagtaattgatcaaaataaaagtagtgtccaataactatacagtctttaaatgttttcataccaggaatctttaaaaatataataagcaagcctaatgaaaaggaagaagccattgttttggaaatccagtctgatatattacttatcctatctggcctttgtgagaatcacattcaaaggaaggtatgtatgcctgtgaaagttttgttcaggtctcccagtcacctaacactataaactatttttggaagtctctataattgtatttaattttgtgaaaatttaatatttttgttaataattagagcataattatataaagtaaaaggtacagaatatacaacagtatacacccatttaactcatacccccaattaaaacagagaatatttctatctctataaaatttcctcatcccattagaagccatgcccctactcacttccagacaaactactgttctgttttctattcctataggttggttttccctattctttaagtttatatcaatggaatcgcacaatatttactcttttatgtctggattctgtcacccagcatcatattttagaaatatatccatgttggccgggcatggtggctcaggcctgtaatctcagcactttgggaggctgaggcaggtggattgcctgaggtcaggagtttgagaccagcctggccaacatggtgaaacctcatatctactaaaaatacaaaaattagccaggcgttgtggtgtgcgcctgtaatctcagttactcgggaggctgaggcacgagaattgcttgaacctaggaggtaggttacagtgagcccagatctcaccactgcactccagcctaggtgacgcagtgagactccatctgaaaaaaaaaaaaaaaaaaagatagaaatatatccatgtcattgcatgtatcaataattcatttctttttattgctaaatagtattccattgtgtgactatgccaaaatgtgtttatctgttcccctattgatagataggcacttgggttgtttttatttacagctataatgaataaagcttcagtgaatattcttgtactagtctttactagtgggtataatgctttcatttctctcgggtaagtatctacaattggaattgatgtatcataaagtaggtgtatctttataagaaactgccaaacagttttccagagtgggctgtaccattttaaatgttgtttggggtttgaattgggttcaaacccaaagccaaaatttagaacgagatcttaatccccttttatcttttttagctccatagtgaactctgagtctcagagattgataatttaaatgttaaatagcaagggatggaattggaaagataaaaacaaaaaaatgatggtttcaatagatagattttaagtgaacgcctgtttagctccaagctttgatgcaatttctcatcatattctaccaccctgtgcctgggctcctctggaaaaataatcataatcttgcttactgggaaccagaactgaacagcaaggcaataagaaaggtaattagtaagagaaaaatattaagtggttaaaacttcacaaaaattattaaatgttttaactacatttatatcttatttctctcggggtcattagaaaatcttgcatgatagttcttactatctaagaattgatctgacataatgctagactgcattgattataatattgaagaaaatcaaggtacaaattttatgacttcttttaggagaaagggaataaaacaaaaaatatcaagggatattattaagctggcatgttgattgatgccccctcttaaaatgattaattttataataatttgttttaaattcctgagaacaagtaagtacggttttttaaattgcagtaaaaatagtatttttctaacaatgttgctgtatttctctggtaaaaaagcaatattaggggaccgataaagtaggaaagggaggaattatttatttatttcaagaaataatttaaaacaaatatcttaaacaggaaattttcggaactgaaggagtagatatcgttcttcatgtgatgaaaacagaccccaggaagttacagagtggcttaggctataatgtacttctttttagtacattggacagcatttggtgagtattgctataatcaaattaggtagactcacagcagtcatgcatcactttacaacagtgaggatactttctgagaaatgtttccttaggcaatttcatcttatgcaaacattataggatgtagttacacaaacatagatggtatagcctactacacacttaggctagatggtatagcctaaaggctacaaactgtatgtcatattactgtactgaagattgtaggcaattgtaacacaatagtaagtattgtgtatctaaacatacctaaacattaaaaaaggtacagtaagactacagaataaaagataaaaaaaaattcttaacgcttgtatagggcacttataaatggagcttgcagtaccagttgctgtgagtgagtcagtgagtgaatggggaatgaatgtgaaggctaggaccttattatacattactgtagactttatcaacactctacatttagattacactaaacttacttttaaaatatttttcttttctcaataaattaaccttagattactgtaattttttttttactttataaatgttttcattttctttatgtttttggctcttttgtaataacatttagcttaaaatacaaatacattgtatagccatacaaaaatattttctttctttatatttttattctataagtttcttctgtttttaaaaaaattacattgtttttacttgttaaacattttgttaaaaactgattcaaacacaaattagcctaggcttatgaaaaaatatttgtgtgcatatattttattaaacatcatagatatttctgtccagtatacacctagatgtaaaaatgcccagatctgggcatttttacgtctgttcagctttaggagataatactaaaaaattttccaaagtacttacatcaattacacctttcccagtagtgtggaggtttctcctttttccacacccttaccaacacactgcgttgtatctttcattgcagccatccttatggacttgtgccagtgtctctttgtagttttaattttcatattcctgattgctagtgagttcatttgccatttaaatagcctttttttgtgtgaaatccctactcaagtctcttgctcatttttctactgaattacctattgttttttagagttctttatatgtcctggatatgagcctttttctgttatatgtttgtcaaatatattctgccactctgaggcttacattttcactctcttcactctctttttgttgaacagatagtcttaatttcagtgtggtccaatttaccagtctttttttatggtcagtacttttagtgccctgtttaaacagtctttccttaccccatagtcatgaagatcactgcctatgtttcttctagaagctttattgttttgccctttacatttagacctacaatctacctggaattgatttgtatgtatggtgtaaggtgaggtacaagttttactttttttgtatggttgtaattcaatgctgtttttggataaaccatcctttacccactgctttgcagtaccttctttgtacaaatcaaatgtccgtatatatttggatctatttctaggctttctgtgctgttctactggtcttttgtctatccttctgtaatgtgctattttaataattaggtcttgataagtctagacatctggtagagtaagtctttctacgttttccttccccattaagattgtcttagcttttgctgaccccttgcatttggatattatattagtcaagattccctagagagacagaaccagtaagaaaaaaacatagagaaagagagattgagatttatcataaggaattggctcacacaattataaaggctgaaaagtcccaagaactaccgtcagcaagtggaatacccaggagtaccgatggtgtagttccagtctgagactgaaggcctaaggaccagaaaacccagtgttctgagtgccaatctgaaagctggatgcttgaagcccaagaagagcaaatatttccatttgagtctgaaaacctgagtcccagctcagcagtcaggcagaggagttccctcttactcagcctttgcattctgtttagatcttcagttgcttgcataaggcccacccacattagtaagggcaggctactttattcagtttactgattaaaatgttaattacatccagaaacaccttcacagacacacccagaataatgtttgcccaaatctctggccaccccaggggtaaaacctgggaccacctgaatgggaggagcaaagctgatggcatttcatataccagcctctaccctactcctactttctatgcactatgatgaaacaggcagtagaaacaatgtcttttgaaacaggcagtagaaacaatgtcttttcttttcttttcttttcttttcttttcttttcttttcttttcttttcttttcttttcttttcttttcttttcttttttaaggggagctatgtttagaaaggggacacaggaaagtgaccacagcaggcttgcaatttctgggaggaactgagaatagtatctgttgcaaccaccagtgatagcttgttcagtccacattccctatcaggaagaagagtgcaagtagccccggcagcagctttaaaccttgattccatgtgagctgcacaaaccaaagtaggcactttagcaaattcttataggaaagggttcctgatccagaccgaaagagagggttcttggatcacacacaggaaagaattcaggatgagtccaaaggataaagtgaaagcaagttaattaggaaagtaaaggataaaagaatggctactccataatcagagcagccctgagggctgctggtttcccatttgtatggttatttcttgatgatatgccaaacaaggagtggattatttatgcctcccctttatagaacatataagttaacttcctgatgttgccatggcatttgtaaactgtcgttgcactggtgggagtgtagcagtgaggacaagcagaggttatttgtgtcagcatattggttttgatgagttttacctggcttattcactgcaacctgttttatccccaaggtcttcatgacctgtatcttttgcgacctcctatctcatcctgtgacttagaatgccgtgaccatctgggaatgcagcacagtaggtctcagcttcattttacccaggccctattcaagatggagttgctctggttcaaatgcatctgacattttccccatcccttttataagagaagccttaatccttagggttgcagagggattaagatccgtcttctgtaacatcttcaggctgaagaggggtgatgatattcctgcctatctattagggtctcttgtgttcagggtacaggggagctcagtcagaaagcactggtatgttgagggtcattcataactcttgagttctgacagaaggtgatatctgaaagagtaacaattgaaaattaattattgattaatattgataaaattgaatagaatatcaattctggttttcacattacctagccctcttgtttcttctgagcagcagtcagagatcactggttggttcccaggaatgagcagcgttagcctaaattgcagaaacaaacttgaaaacagctgatgagactagaatctaacaacaggtgtaccatagttcttgaaacatatttctctctccagtttcccatttatcctaaagacaaattataataaggccaatttgctttattatacttggcctgattatttgtataaggtgcagcaagaataattatttgccatatgggctatttgaattggctttgatggaactctgttccataaggaatctcagataagacttttttaaagccaagcccagccatgggtttgtaccctcacatacctaagagtttggtaaatttctcttctcttgaggtcccaagataacttggggctcctgggcctgtcagaaagtgacattctttacttaccacaggccaggaaccctatacagagactgtgtagacaaagtatcaagttttcccaaaggacttttattggctttacacatcaagtctgattcctcaaagcacaccattccagtcaaagccttagtaaaataatcagtttctccaattgtgtcctgttgcaaaagaaaacagattcttattatacttcttgttgcaaatacctatattgccataaattaagaacactcacgaatagttgtcaaattctggagaaattgggtagaaaaaacaaatatgctccaaattttgttcacacgagcatactttacccaattgttaaaagctgtaaatagctccaaagatgagttgtcttgactctgggcggaaaaaaggatcagcaacattttaagcaacaagttaaaaaagatgattttagacttctgttagtttagtccacaaaattaatttctgtttgatattcatgaacatttcagctctctatgagagttctgaaaggttttttcctctattcagagatcacaatctccaaagttatcagaaacctgcatttaagaatacctgttagagttctatagctgactataaacgaccttttgaagaggatcaaaacaaaacaattgtttgtggatgacaaaacatcgcacagtcaaaaacatgattgacaaagcaatttagttatctcagtggcatacaacgattttatgtagcaattataactattagtgacctatactaagtcatatgagaattgtaggcgtttcccatcattttggaacacataccaataacacatttatgcaaatatagcccaaagaaagctaaatactgtttcacatttgacaatgcttcctgtatgatgtttataccaaataagccaaattttacctttacattagtgtactattaattttacactcaattcttaataaaaccttatagacatatctacccaattttaatgtttgaccataaggtaagattctcataaaccttttataaccctttacaatttctgttaaagagcagatcataaacaggattttgctccaagaaaaacctgttgtcatttatgccaatgttcagtttacagaaaaactgaataatacccctttaattttagccaatggccacacacagaatttcttttacaattttttcacaaatctgccccaacttgcttaaaccttcagctttatcttatctaattgtaaaataccctttaatgtaggaaaaaaaaatccacattcccatgacttcttataatcttttgccaaaaacacatttcactttctttatacaccttacatataaaactgtttctttagtagtctcaaatacttgttacgctgttaactcttggcaacttttgcttttggcaaaaagcttggtaagttcagcattctaattatgtactaggcatggagcctaggacccagacagaagtacagataaggtctgactctttccagcatcttattccatgtgtcccaggccttacctagccataaagcaggcaagttacagtaagagtcatagtggcattttatgaagcattaagggggcctaacgaccttcaaattgtacaacatttcttgcacaaactccctttcactaatcctttcacgacttacatagactatgacatgcttagactttctgacttttcctaaacatccctctttttaagcaaccagttgttttactttaggacaagaatctaccatacaagattgttttttatataacatctgttttctttacaaccttctttgcatagctagggggcatggctaatttcacatgtccccagccctatctacaatctaatgctcctaaataaattgaacaattttcaaaagtcaaagaagccatttatgaccgtaaagtatttggaaaacctgatacctgatctgcataatttacaccaaatgttacatttttgaagaatttttgttttaccaataatctttattaaaactgtcttgatttccctaagattactaaagtcacatgaactgaacatcattctactttttacttttctgaaaaaatatttgatttaagttcttcttattaataaactaattagagctctttcatatataaacatcacacacataatacatttaaatatggagacacgcagaagatgaaggactccttccctaagccaggaattgaaccctggaccggggccgccattgtgaaaagagaaagcatggccacaaggttacaaggtcaagctcccaaggacatacaagacgagggaaacctcgtccagttttagttttttgggggacttgcagcaaagtttgtaactgaccagtttgctgggccatcttgaaagcaggcttacaggtgtcctaaccctatgttctctcctaaggtacccctctttatgacagaacaatacagaaagacaaagtacaccagattggctacaggttaagattaggctttcaaatcatttctcccattaatcaaaactttacagaggagacagtgatttttaccattcattcaactggtttgcacagaggggaagggaagggaaaaagggaagggagcattgcttttggcagtgtggggaaggtgaggtgctcagggaggccagagaaagacctgcccattggtgccaacactgaatcaaaagttcagccagttgcttttcagtcgagacgggatcttttccagcattcccatttgctctcaagtttccccttttagggaggaaaaagcttcctctgtcccacaatcctacatgcgcctaatcctctcacccataaccataagcaaaaagtgcaaggcagattattccaaagagaatagcaattaacatcccatagtgccaaacccattcttagccaaaagggactttactgagaggggcctctaacttcctaaatcttagaagggattctaaccctcctaaatttgccttcaaatccagggtcggtcaagtttccttgctttttaataagaggggcttttaacccactttgacttaaggagagaccctaactcccctaagttgacctctaacccaatgccatccttcagccgagtacccaaccactcacccaaggtcggccaaccagtgctgtcgtctctttcctttggtttggggctgagggctttcttcagtatcgtcccttcggggcttgccagaaagatgttaccagaccccaacacttacccaatattagcctttgagtcgggggttttctcactattgtcccttccatggttgccagaaggatgttacaggaaaggggtcccaatccagaccccaagggaaggttcttggatcaggcgcagaaaataattcagggtgagtccacagagtaaagtgaaagcaatttattaggaaagtaaaagaataaaagaatggctactccataatcagagcagccctaaggactgctggttgcccgtttgtatggttatttcttgatgatatgccaaacatggagtggattatttatgcctcccctttataggccatatagggtaacgtcctcatgttgccatggcatttgtaaactgtcattgtgctggtgggagtgtagcagtgaggatgaccggaggtcacttttgtcagcatcttggttttggtgggttttagccgccttctttactgcaacctgttttatccgcaaagccttaataacctgtatctgtgctgaactcctgtctcatccgttgacttcgagcgccttaaccttctggaaatgcagcccagtaggtctcagccttatttcacccagcccctattcaagatggagttgctctcattcaaacacctctaacaaaataatctcaactgcaaagatgagatataatcaataattatccaatgtttaaagtgcaccaacatcttgaaacagcaatgtcgacaaggcctgtaaatattttacagagtttcattctgagcccaatataattgaccaaggcctgaggcacggttttttgttgttattgttgttgttgttgttgtttagacggggtctcattctgtcacccagcccggggtgcagtggcgtgatctcagctcactgcaacctcctcctcctgggttcaagctattctcctgcctcaggctcctgaataactgggattacaggcgcccaccaccatgcccggctgattcttgtatttttagtagagacctcgttttgccatgttgaccaggctggtctcgaactcctgacctcaggtgatccacccccctcagcctcccaaagtgctggtattacaggctgaccaccacacccagcctgaggcacagttttaagaggtcctgagaaaatgtgcccgaggtggttgggctacagcttggttttatacgttttgtggagatataagacatcagtcagtacacataaggtgtgcattggtttgattcggaaaggaaaggcaactcaaagcaggagtttacaggtcagaggtggattcagaaatttcctgattgctatctgttgaaatgggtaagttattatctaaaaactggggatcaatagaaaggagtatctgagttaaaataagggattgttgagaccaagtttcttattatgtggaatagttggtaaatgtctcttatcagaccttaaaaggtgccggacttagttaaatctctcctggatctggaaaatacttggacaggggaggggattcgctacagaatgtagattttccctagaagagacagctttgcaggaccatttaaaaatatgtcaaaggaatatattttggggtaaaatactttgatttctttcagagcctactgtcatgtgatgctataccagagtcaagttggaatttggtatctcattgctgtgaagagtctgttttttcattcttaagatctctgttttaacgttaatactcactggtcagttgtgcctgaattccaaagggaggaagttataatgaggcatgtccaacccctccttcccatcatggcctgaactagtttttcaagtttactttggaatgccttggctgagagaagggttcgttcagttggttggggggcttagaattttatttttggtttacagcaacaataaatggatatatcttgcaaaaaaagttatgagaccagccagagatgatcactaagaataattaatatcatgaaagcaaaggagaatgttttatttgtaggaaagaaataggcagttatggaaaagaatggatattgatttttaaaaacgttgaaactgaacaacgctggtaaagtttcttcaaagttctatttttttaggtaaaaacattagctacttgatttaagaaaatgaagaaaacatattctttgaaaatgctttgataaagataaagctgtacaaattcagtttaacaataaatgtttgtcaaatgaataactttcttttaatttaaggtgctgtattttgggatgttatccctcagaggattattttcttgaaaaggaaggcatttttctccttttggatttgttagcagtaagtatggctataacaatcataagacaaaagacaaatatgtctattaaaggccgtttccaaactgaatgccacagagcacaagtctatgaataaatgtgccccaaatcatgttcaaaggtacggtcttaaacaaaattgctcctagaaattcataatacacagtgttttaaaggctctgaaaattcctctggttggaaagtcattttaccagtgttttttcagtgttttcaaatacacgggaacaaagaatttgtttttctttgtactccatcaacctgttaagaaacagtttgtgaagagcttgaccatatgaaaacccatagtcatttattaataacttctagtttcttcccctgatattaaaagataagggccacgttagacaaggagcaaagataagcatttttaaagaactatgtattatttggaggtaacctgaagaagtctagtgactcatggaccattgttttgcagaatgagcagatgtgagcaagctaggccttccaatagagacagtgccatctagcagctgtgaagaatatagccccttactagcctcaattctaactggaatccatagtcaggatgatatgggaggaaacgtacaattttgtttcaataaaattttgagagagattctcacacagagttctagcccgctccctgtccgtgattctatgattgccactattcttgattttattaacagaataacaaacctactttgatttagcaaaagtgctaaaattatttgtgccccttaacctccctgaaagttagttcatttctctcttttcgatttctttacctgtaaaacagagataacaacattatatatcttattgtattgttggaaggattaaatgagtgattgtatgtctgtgtgtgcatctaagtgtgcatgcatacatatatattatagattaaatatagtgcctaacatgattcctgtatttactgttattatgaatattattgctagaatatatttaatgctgattcaaccaaattaattgcaaattacagatattatttaatgaagattttatatcaatttcaatctttcacatttgcctgtctcctgaagtagagaaataaaaaaactcatttccttgagtgttttgcttaatacaactctgctgaaatataaagtatgtaatgataactgctaataatggttaaatgttaatgagagctgactatgtaccagggagtctcatataactcataataaccctttgcaggtaatattattatcctttcattttataaaaggaaactgatgatgttcgcaattaaaacaaaagcttacatatttcctttgctatattcaaataacagtatactgtaaaagttaatcaacaaaaagtatttcacatagaagaattagattatggaggccattgctctggatggaattttctatacctaaattttggtgtactgaaaactacttgtagcaaaataaaggaaatatgctttataataggagaatttttttgaatccttaaatactcttttatggatgatgattgccacaaaaccaaattacatcttgttttattttcatatgtgattgtcatttgcagttaccatcagttactctcttaataacaaagagattacagttagtatgaatctttacaagccttaataaagcatataaattggaaagatcctgtaattacagtgaactctgtataacactatcgagcttcgccacttaaaatgaacatcttcacttatttgtgcaaatctttttccaactcagccacatcagtcacattttggtcatgatatatgtttataatgacttcagaattatattaaatcttttactttttatccttttaaatttctaatgtttgaaaatatagtcattacaatgggtgtccattttaacaggagattttcctgactctgagtttagaagaaacttaatgataatagaagtgtttctctcttttttttttgaagacaataattcttaatatttattgcaacttttttccttttctgtttccttgctaaagttgaaccaaaaaaaattctgtaatctaatacttggaataatggttgaattttgtgataatcccaaaactgcagctcatgtcaatgcttggcaagggaagaaggatcagacagctgctagtcttttaattaaattgtggagaaaggaggaaaaagaactaggagtaaaacgtgataaaaatgggaagatcattggtgagtatatttataattgttagtagaagcaattaatgtatatattttaaaagatctttaaatggtattaagaaagcatcaggcctttcacccctttgtctaaagttttttttttttttttacaagggtttgaaaaatttgctatcctaagtgactggaagaaaactaagtaaattagtagtaggttcatatttttagagaatatttttaagaaatggtatttaattatattcttttaactaaaaaaaaaattaaagtagttcctaaagatgcttctttgggttttctgcttttatagatagattcaataatatttcattgagatgtaaatagattgcttcaaaataatattttggtattttatacatttctgttcatttttcctttttctaaatccattaggcaacatgatctgattaatgtttatagagtttactttttatatgaaagaagatattgtttcctaaataaaaatagtccaaatgttcaaaaattttaattactagattctaaattaatgagacttacagtatcataatttttagttcatttacatattccatactgctatattacatttttttcttttttttttcttttttttttgtgagacagggtttcactcaggtcacccagactggggtgtgatggtgcaatcttggctcactgaaacctctgcctcccaggctcaagcgattttcctgccttagcctcccaagtagctgggactacaggcatgcactaccacacccagctaatttttgtattttttgtagagatgaggtttcaccgtgttgcccaggctggtctcaagctcctgggctcaagcgatccactcacctcagcctctgccaagtgttgggattataggcatgagccaccacacctggccaatatattacattttctttttttcttttttttttggagacagagtctcgctctttcgcccaggctggagtgcagtgacatgaactcggctcactgcaacctccgcctcccaggttcaaatgattcttctgcctcagcctcctgagtagctgggtctacaggcacgtgccaccatacccagctaatttttgtatttttttaattagagacagggtttcaccatgttggctaggctggtcttgaactcctgacctcaggggatctgcccaactccacttgccaaagtgctgggattacagacatgagccactgcaccccgcctacatattctaagccttttaagattcttatggtttcatctaaacggttcacttttttttttaaattttattttaggttcaggggtacacatacaggtttgttatatgggtaaactcatgtcacaagggtttgttgtacagattattttgtcacccaggtactaagcctagtacccaatagttattttttctgaccctctccctcctcctactctctaccatctaataggcctcagtgtgtgttgttctcctccatgtgtccatgaattctcatcatttagatcccacttataagtgaagacatgcagtgtttggttttctgttcctgtgttagtttgctaaggataatggcctccacctccatccatgttccctcaaaatacatgatctcactatttttatggctgcatagcattccatggtgtatatggaccacattttctttatccagtctgtcatgatgggcatttaggttgattccatgtctttgctattgtgaatagtgctgcagtgaacattcatgtgtgtgtctttatgatagaatggtttatattcctctgagcatatactcagtcacaggattgctgggtcgaatagtagttctgtttttagctctttgaggaattgccacactgctttccacaatggttgaactaatttacactcccagcaacagtgtataagcatccccttttctccacaaccttgccggtatgttattttttgactttttaataacagccattctgactgatgtgagatactatttcattgtgatttgaatttgaatttttctaataatcagtgatattgagcttttttcatatgcttgttggctgcatgtatgacttcttttgaaaagtgtctgttcatgtcctttgcccacttttgaatggggttgtgttttttcttataaatttgtttaagttcattatagatgctggatattagacctctgtcagatgcatagtttgcacaaattttctcccattctgttggttggcttttcatcctgttgatagtttcttttactgtgcagaagttcttaagtttaattagatcccatttgtcaatttttgcttgtattgtgattccttttgacatctttgtcatgaaatctttgcccattcctaagtccagattgctactgcctaggttgtcttccagggttcttatagttttgggttttacatttaagtctttaatccaacttgagttgatttttgtatatggtataaggaagaggtccagtttcaattttctgcatatggctggctagttatcccagcaccatttattaaatagggagttatttccccattgcttgtttctgtcagctttgttgaagatcaagtagttgtaggtgtgtagccttatttctgggctctctattctgttatattgaactgtgtctgtttttgtaccagtactatgctgttttggttactgtggtcttgtagtttagtttgaacttaggtaacgtgatgcctgtagtgttgctctttgtttaggatttccttggctattggggctctttctggttccatatgattttttgaatagttttctctagttatgtgaagattgttgttgatagctttatagaaatactattgaatctgtaaattgctttgggcagtataaccattttaatgatattgattcttcctatccttgagcatgggatgtttttccatttgtttgtgtcatctctgatttctttaagcagtattttctaattctcatcatagaggtcttttggctccctggttagctgtattcctaggtattttattctttttatggcaattgtgaatgggattgtgtttctgacttggctgttggcttggctgttgttggtgtgtaggaatgctagtcacttttgtacattgatttcgtgtcccgcaactttgctaaagttgtttatcagctaaaggagcttttgggccgagactatggagttttctagatacagactcatgtcatctgcaaacagggatagtttgacttcccctcttcctgtttggatgctttttttttttctttctcttgcttgattgctctggccaagatttccaatactatgtggtgaaagagcgcatgcctgtcttgtgccagtttacaaagggaatgcttccagcttttctccattccatataatgctggctgtgggtttgtcatagatggctcttattatttttagatatgtttccttaagtattgtttatttttaaatgtaaatacttccccttctgatgacttgtatcttcaatccatttttattgtttctgagttttgacctatagcatcataaaatagtttttatatttatagcataatatatagaaaccaaaagtaaacaaggttacatcactgttaaactgacattactcaagttctggatttcaaaattttttaaattatttacatagaagttttacttttaaaaagtaattttgtgaaattttaatattttacataaacaataaaaatgaaggctctaagttttgccacagagtggggaagaaatagctgcttaattattatttcaaaagtgtaaccgtgtaataggcactatttttttgctacaatatttttatatattttatgttatctagactaaaatctcaaaattaagtatttgtttactatggtttttatctgtcccttttctattttcatgctatccaatgattagatacaaaaaaacctctatttactagctttcaagaagagcaaaaaatcatcccactgcctgctaactgcccatctattgcggttatggatgtttctgagaatattagagcaaaaatttatgctatattgggcaaactaggtaagaagttctcttcaaatttgcaagagtctgttttgctaagtatacacactgattttactttggagacagtttttcaaatataatgagcaaaaatctctttatatagagaaattcattttccattgttaccccaattcccaaactgcacccctcaccaattaaatcagaatctctgtgtgtgggatccaggcaatagtattttttaaagctccccaggcaattccaatgtgcagataggattaaggacagttagtttagatgattaagcttaaaatactgacattctgagtcacttgagtttttttttttaagtctttgctgtctattaaggaaaaagtttatcaaacactcttcagcttctgaagtaagatattattgtctgactacaacacagaaagaaatgattcctatatattggatgacctggcagaaatgtgttatagaaagaagcctactcacaagctactcacagaattaactttttcataaatcaagatgaaatcaaaagtaactttgcatttgtttttagataggtagatagatagatagatagatagatagatagatagatagatagattcttagaatcacttgctctgctaaagtaattctgtctttataaactttattttagattttgaaaatttacctggcctatctgctgaagattttgtcaccctttgtatcatacatagatatcttgattttaaagtaagtatctttttaataacctgattattaaaatctagatagcaaaaaattaactggaaaataaaatatctattcatggttgtgagcaatcatctacatactgtatagtttttatttttcattttgcatctgatgctgttgaagaaatacaccatacacccatcccatgattgggtgtttttcatgggataagatttcatccaacttagtttgtgaaagaagatgtacaaaactgatataagccgggcacggtggctcacgcctgtaatcccagcactttgggaggccaaggcaggtggataacgaggtcaggagatcaagaccatcctggctaacatggtgaaaccctgtctctactaaaaatacaaaaattagctggatgtggtggcgggcgcctatagtcccagctactcgggaggctgaggcaggagaatgatgtgaacctggaaggtggagcttgcagtgagccaagattgcgccactgcactccagcctgggcgacagagcgagactccgtctaaaaaaaaaaaaagaaactgatataaaactgttcagaagcctagcaaaaaaaaaaaaaattatttttatgagatggagattttgctcttgtcacccaggctggagtacaatggcatgatcttggctcaatgcaacctctgcctcccaggttcaagtgattctcctgcctcagcctcccaagtagctgggatgacaggcacccgccaccacgcccagctaatttttgtattttttaatttttgtattctcatgcctgcaatcctagcaccttgggaggccgaggtgggtggatcacccaaggtcaggagttcgagaccagcctgaccatacagtttcttctctttggagttgaaattaaataagtttttatttattaaaataaattattaatacttattaaagtattattttatcattactttatattatgatccaatcttgattaaaagatagtaggttacttaccttgctagttatatttgtcagtaaatacttttgaagtctcaagaaagtctttttaagttaacattgtccttctactaatattagtactgtatatttggatgttgtaaatgagtaaacctctattttctttctttccttctttttttttttttttttgaggcagagtctcatcctgtcacctagcctaaagtgcagttgcatgatcacagctcactgcagcctcaacctcccaggctcatttgatcctccagcctcatcttcccaagtagctgggactacaagtgtgtacccccatacccagctttttattgggggggggcggggcggggtagagacaaggtctcactgtgttgctcaggctgccttcaaactcctaggctcaagtgatccacccactccattcagcccaaagatgaattttttccttatcatagatatataatttttttctttaattttatgggtccagcacacttctgctgcacaactctgctcttttttctctaattctaaatacactcaagaacgttaacttctagacagcctagaatatgagatggagccactgacatgatggaaccatggagttaaaagcttgagattccattataatttgccttagctagaaagtgaggggcagggcccctttctcagggtggctgggttctagggtcctagtaatccccatgttcattctcctaaaagttcatcttgacctagccttcaatatagggctttagggaggaaagtaacgatagttcagaaagatcagaataaatcagcagtttctgcagctgtgaaatcaaggtaactataaactagagggcagtgatgatggtgatgatggcagggaactaggcataggagagccttatccatgaataacataccattgaaaaacatttgataaattcctactgagtactcaaatgtagctggtaccctcaatcattcccaatgcacttattcccaggaagtaatttaggaaaagtttaagtgttaacaggagtgactaaccatataaaaaattgtataattgtacaattgcatgatttgtttttggttaatttaactttgttaaactttgttataacagattggagaaatatggaatgaaatatatgaagaaataaaattagaaaaattaagaccagtcactacagataaaaaagctttggaagctattacaacagcatcagaaaatattggaaagatggttgcttctctgcaaagtgatataattgaaagccaagcatgccaagacatgcaaaatgaacaaaaagtatatgcaaaagtaagctacataggtagtgaggagggagaatgaagataggttggttaatgggcacaaaaatacagttagatagaataagttctgttgttcaatagcacagtaggacaactatagtaacaataatttattgtacatttcaaaatacccagaagacttggaatgctcctaacacaaagaaatgataagtgtttaaggggatggatatcccaattaccctgatcattacacattgtatgcacatatcaaaatatcacatgtatgccataaatatgtacaactattatatatcaataagaaagtaagccacagataccattaaggcacaagataataatttcaatgtataaacccagatgaagttatccataagatatatttttcttacttgtgggtgtttcagccttgagttattttgtggttttctcttagagttattttcagtgtctctgtgcagttttaaaagaaactatggagtttgagattgagttactatattcaatgctgtttttttgcattataattttatttctacagtcttaaatttttaaaaggcagagagatacttgagacatgccactggactccagcctgggtgacagagtgaggttctgtctcaaaaaaaaaaaagaaaaaaaagaaactgaaacttaattatctttctcatttcagatacaggccacgcacaagcaaagagagctggctaataaatcatgggaagatttcttggctagaacatcaaacgctaaaacgttaaaggtaggatttttaatgtattatagtatccacaacaaatagccaactcttacagacagactttttcaggaacaaatattcattcattttttcctagtgacctttccgtacaataccagcactattagatgctcatatgcaatttagagtgataagtgaaactgcatttcacagttacagaagatgctgctttgagtttcatttggtttatcagggagaaacaaggctgatgttcttgacctacataaagaagaagatgatagccaggaatgagcaggaaaatgtgttctgctttccattctgaacctgcttattcattgatttcttttctgtgagaggcaaagtaaaggacacaaagagcaactatcttgtattactctgtcccccaagagcttttccctctgtgatcaccaaaagaagcattatgttaaacttaaatgtgaactggggataaatatccctttgtagaaaaatgtggtaagctacttcaactgtaagctagaaactaatctaaaaaatgtatagtgctaatcgttcacttgaaatatgtgagaaacaccatggatttccagaatttcattacttttccccacccttttccattaatatcttggatacactttttaaaaaatctctccttcatttctgatactttggatagactttacctaatgtttcaatacttcctatagatataaaattgctaaatgttaagttagtccacaagacggtggaaccatattaagatagcaaaaccaaatttaagaacaagctcactcaaggtaccaagttatctccctgttcactgaaagttcttcccaattctacttataaaatgtcttcctaactgcctgtatttttagcactagttaatgaaaatcagctcctttcctgcaggtcatttattacttcacatttcacttgtttagtgtagcaaataccttgaaaataacttcaaatagcttaaatataactgcaatgaattacataatttatattattctgaatgcttaaaacatttaagtgtacttaatcagttggtaatttatgcaatatgttttgcaatatgcatcacctgatataaatttaatagcttattaaattatgtgctaaaaattgaacctgatttcttcaggatctgcttgactccttggtcatatatggatttcttggactacttccagaaatctctggaagacttttaggtgactggagtcttcttcaatgtgcaaagtatctaacttactaataactgtctttttagtctaaatgagtaaatgcagatttcagcgctatctaataaacaaccaaagcataagccagacacaattaaatatgtttttcattgtaagtaccatcattactgatttaatagcaattaatattttctttctaatttaaaaatcctcagaaagcaaaaagccttcaagaaaaagctatagaagcctccagataccataaacgaccacaaaatgcaatatttcaccaaacacatattaaaggccttaacacaacggtaagattctttctccataacattttcttaatagacattaaatttagagtgtttgaacaactgtgcaaatatactgaaaaccattgaattttacccattaaatggatggattgtgtggtattgaattatatctcaataaaactgttcaaaaaaaattttaaatttaaaaattagaagttaaaaaaattaataaaaaaaaaacttaggcccccaaaatattatgtcaatgggattttcatctcacattttttctttttgctgttcaaatttcacatcattaaggcatatttatctccaatgtatatccacttttgcccggttctggtttagagtaggcccagccctccaggatttctaagaaactgctataaacactagtcagcttataattgtccttatatctctttaacagaaaagacgcagtgcttccccttttcctggcgagtagatcccaagtgttcctggtatcctctgctagacttaatttgcccccagttacaaagctgataagcaatagaaatagaattcaaacctacttttcctggctccgatgcccttatctttctattataccataactgcctcctagttattcattacatttgtgtcttttcaaaagtaagctgaaggatgaatgagtttttctcttgttgaaaattgtgtaaatggacttttagatatttaccttttgcctttttaggtgccctctggtggagtagtaacagtggaaagcactcctgcccgattagtaggaggacctctggttgatacggatattgctcttaaaaaactgcccattcgaggaggagccttgcagagggtgaaagcagttaaaattgtggatgcaccaaaaaagagtattcctacgtaatatactatagagactttttgaaataaagtcagcttataattttttagctgaatatatctttatacatatgtaaagccaatattttagaataagtattttagtataaatattttagtaaaatactataaaaataaaaggacatataatttatttttatggaaaacatcaacatgtaatatcagaagagttgtcatcagtttctttggaaaggctaccaattttactaagtgaaattgtaaaacatagtacatcagttaggactctgttggttgcatgtgaactattctaactagtttaagtcagaaaaaaaatttcttacaggctctatacctatcaaatctaggaggaatttagactacaggcattgctgaatctaaggactaaaactatatgagtaggatcttctccttccctagcagctcctggcttacattctcttaggttcatgcctgtgtctctgtggtttctgcagctgcctatgcatctcaggacccctgattgcccacatgcctacggtagtcctgagccattcaccatgactttggccatggctgagtactgcctattcctggagccagaagcagggcaactccatccaaaacatatggatagagtggggaatcagggtactattatcagaagcaagtatatatgaatattgggcagcaagataaacaataactctgcaacaagtatgttggtcaaaataaaattatgttttctctgctataaaagcaaatgttagtcatgagccaaatggtaaaaaagaaaaaaaaatgcagctggttttactcttaatatataaatatacaaagcaaactctaa

SEQ ID NO: 2009 - DNA, 65891 bp, Homo sapiens; identical to SEQ ID NO: 2008

SEQ ID NO: 2010 - DNA, 25994 bp, Homo sapiens; identical to SEQ ID NO: 2004

SEQ ID NO: 2011 - DNA, 1384 bp, Homo sapiens
gaacttgctgaaaggactttatttgagatgaggaaacaaagttgatggcaatgtataggacacacgacagtttccttctaggtcataaagtaaattatgaatatatttctctctgttctcatccctcagaggcagcagaatctgtggttaatacccatgacagtgcaggtcccataggaatattctgttgaataacaggaccttctgcaatggcaagtgaaagcccttgttgagcctggggacagagagagagagcatcagaaattgagcaccagggtcagcagcgggcagtaaagagaatcttcaggaagttgcatgcttgctgacatgtaatgctggctgcattacagccaatagcatgatcacaccatcaataggaataaatacgcagagcagtgttggtcacacacaggattagagagccattctgatatgctgtacttatctgctccttccctgtcacacacacatctgaatgcacccatatgactgtctccagtttgcaacggttcctataaaagtcagattaaaaaacattcctttagcagctggatgtggtggcttacgcctgtaatcccagcactttgggaggccaaggtgggtttatcacaaggtcaggagttcaagactagcctggccaagatggtgaaaccccgtctctactgaaaaaaaaaaaaatacaaaatttagccaggcttggtgtctggtgcctgtaatcctagtgacttgggaggctgagggagagaattgcgtgaacccaggaggcagaggttgcagtgatctgagatagtgccactgcactccagcctgggtgacagagcgagactccatcaaacaaaacaaaacaaaacaaagcaaaacaaaacattcctttaaaattaggctctcttccttgaagtagagactcctcaatacatttctacatggcaaaaaattagaaaatttcatagacttatcatagaattaaaaaatctttagagaaaagtcatgccttgaatatcactgattcttccttttcagtacaaacataaagtaattgaggcctggggaggtgatcacctaagagaaagagccagctgttggatctaattctagaagtgcttggttttcctctctacactcctagctctgcaatgctggtgtctcttacccaaagctctaagacttgagcttgcatcctctgcaaaggagacggcaaagtcctggtcatttgccccacgctgctcctgggcatcagcctcataagcttttgcctgcagtggatcatcctcagcttggagtggctcagccttggcctggagggccacgaggagaacagcagtgaggatggtgagggttctcatggctagggtcgctggaggagagagagcaggagcagatgtgt

SEQ ID NO: 2012 - DNA, 974 bp, Homo sapiens
ctcagcagcagcagatccggtataatctaccaggaagggcacaggacccaaagcgacgttgaaagaaatggcaaattcctcgtctgcaaatgcacctcaagcctctccctgagcctggggacacagggacagcatcagaaatggatcaccaaggtcaacagtgggttgtaaagggaatcttggagaagtcacgtgccagctgatgagtgatgttgtctgcattagggccggtagcatgaacaacctcagtcaataggaataaatacacagagcagtgctggtcacacaggatttgagactcattctcatttgctctcatttttgtgcttctgccccatcacacacacacctgaacacactcttaggcttggctctacttttaaaaaaccattctatagatacagtaaaatattctccttataatgaaatctacttgtttagatccagaaagaagtagtcagactgtctcttcatatcttaaacctactgagtttcacaggcatatcttggaatcaagtctttcctttttatttattttttctaaagtgaaaggattattaagaaagtaaaagagtaaaataatggctgctctccatgcagagcagccttaagtctttaaagacagaaaacctgttagatttattgggctctctcttcaatttatagatgagaataccaaggaccagagatgctaaatgaagccacctaagtgacatggaccattgagactcgattccagactctctctcccgtccaaccctctagactgtgcagctctctgcatgccggcctgtctcacctgaaagtggaagtgcagcgctttcatcccatgtaaaggaaacagacacttcctgatcatctgctccaggctactcctgggctgcagcttcatcagctcttgcccgaagtggctccgcctgagcctgcagggccacaaagagaacggtggcagtgaggagggcaagggtcctcat

SEQ ID NO: 2013 - DNA, 7432 bp, Homo sapiens
tttggcccaaaggaggtatacttcaaaagcaattttcctttattaaaagaatgcttataaaaagttcatttcacttctgcgtcatttcttctggtcactcccagctcacttgcagcacttggccttccctctgtaacaggtgccttgaattttggtaaagatcgggcaggcagaatagagacattgccctccactgctgacgcaattgtaatgatcagatctgtggccaaggcctgtgagaaagttaccacctgtaaggagggaacacaaacacttcagactcatggcttgtagctgcaacgatttgagaacatctcgcgaaagcagaacaaataactgcaaaacaccggagagtcttctcttccaagaaattggcccatgattgatctttggggctactcatgaaatgaggtgtctgaacagcttactcagtctggggctatgccagctgtggccaaatacaagccaaggaatgagcagtggggttctgagtggggttttcttctgctgagagattttaaatgtgcagggaattcaagttatttttccaaacaagttttctgccttgtctcaacacaccccaaaatcacatcctgtgttttagaaatgtggaagcagctgccactcttcaaacacagcctacacttccctccttccatgccttcagttacgctgttccctctgccttgaatcccggccccctcacttcccacatcactatttcagctgaaatctaggatcgtttcacatcgggctgaaattatggttactctctaaaactttcatagtttttttttctacttggactttattttgcccttctcccagtatcccagatctgataaatagagacagtactctggaatagccttctattccatgcaacagggaacagtcgcctgtgatattcctggcgagggaccagcaggccgccatgttgcaagtctccactggtaggcgttttggactgaactgaatcccctaggaaaagaattcctgtgtcgaagccctaacagtgcctcagaaggtgattgtatttggagagagaaactttaaagaggtgattcaagttaaacacggtcattggggtgtgctctgatccataagacttgcatccttataagaagagattgggacagacacacacagaggaaagaccatgtgaggacccagggaggcggcggtcatctaccagccaaggacagacacctgagaagaagccaaccctgcttccaccttgatcgcagacttcctgcctccaggactgcgaggaaataaatttctgttgtttaaactgcctggtctgtttatgggcagtttaaacgataaatctggtagcctgagcggactaatacaagaggccatcgctaccctaggagacagtacattctcatgttgcagatctctgttggaaagatggctttcacaccgatggaaattgtctcatcagtaacttccatccaaaggctatttttccactttttgcagtaattccacttttgaaaaactcttctcattgtcctcaatgcctggtttctggtcccttcccaaacctcttcattctcctgtggatgtgtttaagttggccagtacacttcccaaagtttgaagcctggtatcaatacagagtcccttcaatgtgttccgccaaccaaggtaaatagaggcttcatttctctcattttgttctcaaagcagcaccatccaatatggcagccacatgctccctgtggctgttctcttttaggttaattgaaatcaccctagccgcattgcaagtgctcacgagcactatgtggctagtgggtgctgcattcattgaacagcagatatagaatctttttaccactgcagaacgttttattcaacttcatttcaatagaaggtactctgtattgataccaggcttcaaacgttgggaagtctattggccaacttaaacacatccacaggagaatgaagaggtttgggaagggcccggaaaccaggcattgaggagaatgagaaaagaagagtttttttgtgttgctgtggagatggaagggaattgagaggcactctggttctcccatcccagtactcagggaagcatcttgggccaaggccactcatttgttcatacaaaacacagtctcttgattgccagcttatattctttttctctgactgattcctaatgaggctgtctgagattgtactatgttttaataatctcgccataatgttgacctcaagtaagatcatgaccagctagactctgccaaagtctccactttctgctttagtctccctgcactggaggctcccagtgctggaaagatacttagaggatgcctactccaacccacactgcgaaagatggaacctctccaagtgattatctgttattagagagatcaactgagcatataaatttgaaagcactttgaaatcgagaaggtttatacatctttgttcttgattgttcttctcagtaatcaaatggttgggtgtatatatgctgattaagcagaggaggcccaaatttaatatggatgtagctttttagagccaggatggacttcggaactcaattaattcaacctttctgtgatcctctccccagatgaaggaacaaggtccagtgatgtccccagagcatgtagctggtcaaagaccaaccccggaccagaatggatgcctcctgatctcacttcagttctcattccacttcaccacactgctggttgactgtggtgtcacggtgcataaccagaactaatttctggcattaccttccaggatctagtacattatgggacacaaaaggaattgcagcaaagttagtgagagggtactttgattacattctgtgttccacatctaatctactgtgtgatcttttgcaaaccactcaacctctctaggcagcagcttctcaaatttaaaacggaggagactacgcagccataaaaaagaatgaaggtgtgtcctttgcagcaacacagatgcagctggaggccaatatcctaaacaaattaacacaggaaaagaaagccaagtaccacatgttctcagttataagtgggggctaaacactgagacactgggggctactagaggggaaaggaggcagaggagtgtggaaaactaactgtggggtactatgctcattacctgggtgacaagatcacattccattcctcagcatctgagtgggtctgggttggggctgataatttgcattttaaaacaagctcctaggtgacactgaagcttctggtccagaggccatacttttacaacctttggtctggaatattgaggttccttcctgttggagcagtctatgctgctttcagtctaggggccttttaaaagcacttgcctttaacattttcatgacatttgccttcaccttgtgttagatattgctgtgcctgtgtctgtttctcttacgtgcttcttaaggatgttagtgtaatctaaatgcttctgaaggtttttgttttccaataattgtggaccaggcagcccaaaaagaacagctagaatatctgacatacacacacacacacacacacacacacacgcacacacacgcacatgtgcactttgtaggtattagagaaccaacagtaaagaattactaggtcaagatttgagagaaagaccgaaacaaaagcaggaacatcacattctactaacataaaaaaagttattatgaaggcctgaaacattttgaaatgaagaagacctaaatgagtggaaatgctctgttaaagcatttgaagattacttttttaaaaaaaattaatcttctggttcaaccaaataccatgggaatccccagaggttctaatttgacaaagtgattctaaattttatttggaaattcaaagggccgagaatagccaagacacatttggaaaaaaggtgagaggtcttgctttactgtatttcaagactaagtgtagagcgtctgtaattaaggcaatgtgcttatggcacaaggacagaaaaatgtccaaatggaataagatagagtgtagaaagaggctcatgcatacatggagaattgatgtagaatagtagtggctcagcagaacagtggggaaaaatagtcttatcaacagttggttctgggctgggcatggtggctcatggctgtaatcccagcactttgtgaggcagaggcaggcagataacttgaggtcaggtatttgagaccagcctggccaacatggtgaaacctgctctctactaaaaatacaaaaattagccaggtgtggtgacaggcgcctgtaatcccagccactcgggaggctgaggcaggagaatcccttgaacctgggagggaggggttgcggttagccaagattgtgccactgcactacagcctgggtgacagagcgagactcagtctcaaaaaaaaaaaaagttggttctggacaatcagatattcatattggggaaaaaaagtaacttgaccgttacttcataccgaagccacacacacacacacacacacacacacacacacacacacacacaccccattgccagatggattgtaagtctaaatgtaaaaagaaaaaggataagcttttagaagacaatattggggactatcttcatgtctttgatgtaaagaaagtcttcttaaacaagatagaaagtgcagtaaccttacggaaaaagacatgacacattcgactacattgaaatcatgataaaagcctcttttctaggaaagtttccattaagagagtgaaaaatcaaaacacaaagcaagagaagatatttgtgatgtatataattgacaaaaggcttgcatagaaaatacataaagaactacaaaccaataagaaaagacagataatccaaaagaaaacatggacaaaagacaaacaggtattttacaaaaaataacccagttgcctgtaactatgtataaaagggcccaacttattatttatcagggaaatgcagattaaaactccagtgagctattgctacactcaccaggtggttaaaatttaaaaataattgatgttatcaaatgttggcaaggatacagagcaagaggaactcttattcactgcttgtgggagtgcaagttggtgtaaataatcttggaaaacagtttggcattgtccaatacaattgaatatatgcatagcctatgatccggtgatgcaacttttcagcatgtagaaatagaggcataagggcacctactggccaatagaaatgtgtgcacaaaccaagctgtactattcaacctgaatattaattagtgtggcaaaagtgtaaagaatatgaaaagttaccaccataaaagtcaagtgagtgattattcttgggggtaggagggagttgtgactgggaaggctcgagaatagcttctcataattcaatttagatataatagactgaaaacaaaaattctttatgttaacaaagtgcctttcaaacccttttgagtttggactgaaccaccatcagaaagaaatttctcactgctactcagtaaaaacatatgcacacaccccaaactgaaatatgggtgtaattaaatagcatctacttttactacatggcatgaagtaatattttctattcctttaaaaaaacatgggctgggcgtggtggctcatggctgtaatcccagcactttgggaggcggaggcaggcggaccatgaggtcaggagttaaagaccagcatgaccagcatggtgaaaccccgtctgtactaaaaaatacaaaaattagccaggcttggtggcatgcacctgtaatcccagctaactcaggaggctgaggcaggagaattgcttgaacccaggaggtggaggttgcagtgagctgagattgtgccattgcactccagcctgggtgacagagcaagactccatctcaaaaaaacaaaacaaaacaaaacaaaaaaacacggtaggctgagtggagtggctcatgcctataatcccagaactttgggagtctgaactaggagggttgcttgtgcccaggagtttgagaccagcctggtcaacacagtaagaccttatctctacgaaaaaataaaaataaaaaaattagccaggtgtggtggtgcatgcctgtagtcacagtttcttgggaggctgaggtgggaggatggcctgagctcaggaggcagaggctgcagtgaggcgagatcacaccactgcactttagcctgggtgacagagtgagaccctgtctcaaaaaaaaagcaaagcaaaaacaaaaaccaaaaaccaaaaaccaaaaaaaaaaacaaaaaaacaaaatccattgtagcaactggcagcatgaaaagttctgcatttagaatgcttttgtactcagctttcagatggaaaaactgaggcataattggaataaattaagcctatctgctggatacagtgatggcctagagaaacttacaataggatcttacagagactttctgaactggagtgcttgctttcaggatcatccttcccagcccctcattctgcagatgaataaaccaaggcttagcaccatgtgactcgtgtgaacaaggatagggctgggataaaacatgttcccgattcctcctgcacgtcccaccatcatgtcagggtcatggctgctttggcccagagaagctgacatacacctggctcacaggaagccccctcctattgactggggagactgctaacctggagaatgtggatgcatttctcaggagagggagaggaccgcctgcctgcacaggaggtgagtccaaggcaccggctgagctggcctgatgggtggggcggcagcacctcacctgtaccagggcaccccaggaggctgcacccagtgacgtgggctgaggatggggccggcccctctctctgcataggaagctggcctctcagtgtgaggagtcgtcttgcaggggaagcagcaatctcatccacataggatactgtctacatgtccaggacaaggatgcaggcagctgcctgtgacaagcgccatgaccctgccaggctcactccttggcggctcacagaccctgaaggcttggcagggcttgcctgctgccttctgccaactgcaggccactcaaccacgggatgctttcctgctgcttgttcctcgtcccttgggacacggaggcagccatccgagactcacatcagccccattgtccccagccctggggatgggaaactcttgcaggtaccagagcttacctgaggccatctcagacaaaagtaagcagagagtaaacagcagaaggtaggaagttctcatggcgactggcaggcaacacccaggatttcaggaactggggagacgctggctcctttggaggctgagctgacagaggcttccagaggctggagcgtcactgtatttataagactggtggattgcacaacctcgtcgacggaactgaaggga

SEQ ID NO: 2014 - DNA, 2443 bp, Homo sapiens
tcttgttacgagatatatatttaggatcaagaaagatgttaaggacaaagtataggagaaacaaccatttcctgtagctctcaaagcaaattatgagctcatttttctctattctgcaagctcagctgcagaagcatgtgaagctaacaccaccgatgatggcgttcccagcatgacattctcttggacagcagaacgttaatcgacacgcgtgcagcagtatgtgaaactcacaccaccaatgaggcagttcccaacacgaagttctgttcgccggcagaatactaatctgcaagagcagaccatgccccttgttgagcctgggaacacagaggaagcatgagaaattaagcaccaaggtcagcggtgggtggtaaagggaatcttggagaagtcacatgctggctgaccggtgatgctggctgcattagtgccggtagcacaaacaaccttagtcaataggaataaatacacagagcaatgctgctcatacaggatttgagactcattctcttttgctctgatttgtgtgcttttgccccatcagacacacacctgaacatactcttaagcccatctccagtttttaaaatttcctttgttggcagaatgaaatattttccctataatatctacttgtttagatccagaaagaactggtcaatctgtctctccgtatcttaaccctagcgaattttatagacataccttggaatcaagtctttggagaaagaagactacttacatttgtttgtctctctattcagtttggagataagaaaatcgaggcccagagatggtaagtaaagccacctaagtgacatccaccattgagatgtgattccagagcccatctcccatccgtctctctagactcggtagcttttttatgctggcctctctcacctgaaacctgaagagcagagcttttatcccatgcaaaggaaatagatatgtcctggtcttctggcccacgctgctcctggcctggagcctcatcacctcttgcctggagtgggcctgcccggacctggagggctaccaagagaatagcagcgaggagggcgataatcctcatggctggggtgacctggaggagggagagcaggagcagctgtgtggggagggagaagccagcttggatttatagctttgctgggagaaggcacagagataagaaacctttggccttctgagtgagaggaggtgtgcattttgttagagaggatgccgactcctattggccttgacatccctggaatgctcctctgctctcccagctttcttcacaggaagctctatgtttagtgtctgtgctaggttgaagttgatggtgatgatgaggaccctggcattttttcctgttttcaggaaatacctaatatttcctggttaaatctttaatattctaaaaagaatggaaacagtgctttcattcaataatttaagagagcaaatgcctcttatttcctgataatgggccctactattctcttcaggtctaaacactggtgccagacctgtattccggtggagtagagagtaactcattgcaggcttctaggtcattataccctcatgaaggggcgactgaggtaatggggtgagtagtctcctgtaggggccagagtgaagaggacaatgaccttatcagggtacaggtgaaatgagctcagtgagagagataaagagttgtgtaaggttcatgagttgctaggtgcatacacgtggtcctttctctcacagcatgtaaaaaatcagctcaacatggattgaagactcaacatagacttgaaaagacctgaaaccatacaactacgagaagcacatacaaagataaagctttggacattgacgtgagtaatgatttcttggctatgacaccaaaggcacaggcaataaacaaatgggaaaatagacaagcggggctgcattgaacgctaaagcatcttcatagcaaaggaaacaatcaactgagggaaacggcaacccagaaaatgagagaaaatgtttgcaaagcctacgtggtagaaggggtaaatatctgaatacataaggaagtcaaacaactcaatagcaaaaaacaaacaacctgattgaaaaacagacctaggacctgcagaggcttctctcacaataaaataatgttttaagaagctgtgatcgtctttattggacatgtcaagtaggacacgtgtgtttggaaggaaactttttgagtttctctattgacttagctagtagccattacccccagcagccgccagacacccagatagaagttcacagcaggggcttcacccgctgggtccctctggggtggccccacagtgagaggtcagactggggacacagcttcaatattgaaacctcaatgtgaaagtttaagttttgtgttacttacagatcctcaagctaggcagggcgagcagagagggcagac

SEQ ID NO: 2015 - DNA, 2427 bp, Homo sapiens
atcttgtaacaaggcatttatttgagatgaggaaaggaaattgagcagaaggtacaggagtaatagcaattccctgtagctctcaaagcaaattttgagctcatttttctttttctgcaagctcagcagcagaatgcccagagtcttccctggtagatgcaggttccatagcgacgttctcctgcaatgcacgctggtattctgcaatagcagtccatgtttttccttgagcctgggacagggagagcatgagaaattgagtatggagttagcagtgggtaagaaaaagaatctcggggaagtcacatgctagctgacaggtgatgctggctgcattgcagccgttagcacgaacaacctcagtcgataggaataaacacgcagagcagtgcttgtcacacagaatttgagactcattctcctttgctctcatttttgcattcctgccccatcacacacacacctgaacataccctcaggcttggctgcagtttttaaaagctcttctgtagagtaaaatgttctctttacaactaagtctacttgtttagatccagaaataactagtctgtctcttcatatcttaaacttagtgaatttcacagatgtttcttggaatcaagtctttggagaaataaagtttctcaggtttatttggctctctgttcaatttctagatgagaaaatcaatgcccagagattctaagtgaagccacctcagtgacatagactgctgagacccaactctggaacctctctcccgtccttccctctagacttagcagctctgcatgcctgcctctctcacctggatgctttggagccaagctttcgtcccatgcaagggaaacaaccacttctgggatgtccgctgcaatctgctccggggctgcagcaacctcatcagctcttgcctggagtggctcagcctgggcctgcagggccaccaggagaatggcagcaaggatggcgagggtcctcatggctggggtcacctggaggagggagagcaggagcagctgtgtggggagggaggagccagcctggatttatagctctactgggagaaggctcggagacaagaaaccttcctcaatctcagtgagaggaggtgtgcattttacaagagaggcccattggtctcaaggttgctcgaatgctcctgttctcccagtttcatgctagtatacatctgtacctttaatgtctgtgctaggttggagctaataatgacaagaaagaccctgctatgttactcgtgggttcacctgcttaaatattatgatttactttttaacattccaaaaagaatagaaattgcactttgattcaacaggctcagggaacaaatgcttcttattttctgaagatgggtcctgctgttctctggaggtctagattctggtgtcctatatgagttccaatggaatagcgagtaattcacttcaggattcaggtgacttaccatcctcatgaagaggtttttgaggttatggggtgagtagtctcctgtaggaatcagggtggagaggacaatgattttatcaggctaaaggtgaaatcagctcagtgacacagagtggtttaagtaaaaaaaagaaagtttattatttccacctctacttagacttgagtaacaattaacaattgtatatttatagtgtacactacctcatgattttatatatgtatgtatttaaatctttatctcacaccatgtagaaacatcaactcagaatgaattgaaaacctaaatgtaacaactgaaaccataaactactagaagtgtatagaaggataaagcttttgacattgatgtaggtaatgatttcttggctatgacaccaaaggcacaggcaataaaagggaaaatagacaagtgtggcttcatttaacgctaaagcatctgcacagcaaaggaaacaatcaaccgagtgaaaagataacccagaaaatgagagaaaatatttgcaaaacctacatggcagaaggggcaaatatctgaatacataaggaattccaacaactcaatagcaaaaatcaaacaacctgattgaaagacagaccaaggacctaaataggtttctctcaaaagaatgttccaaagacctgtgatagtctctactggacatgtcaaccaggacatgtgtgtttagaaggaaactgcttgagtttctctattaagttagctggaagccatcgtccccagcagtcaccagaggtccggacagacgttcctagcagggattcacccgctgggtccctctggggcggccccacagtcagaggtcagattggaggcatagcttcaatgatgaaaactcagtgtaaagtttaagttttgtagtacttacagatcctctagctaggcagggtgaccagagagggcagacagcagtcctctgtcccaggtcttctatagcaagg

SEQ ID NO: 2016 - DNA, 2434 bp, Homo sapiens
atcttgtaacaaggcatttatttgagatgaggaaaggaaattgagcagaaggtacaggagtaatagcaattccctgtagctctcaaagcaaattttgagctcatttttctttttctgcaagctcagcagcagaatgcccagagtcttccctggtagatgcaggttccatagcgacgttctcctgcaatgcacgctggtattctgcaatagcagtccatgtttttccttgagcctgggacagggagagcatgagaaattgagtatggagttagcagtgggtaagaaaaagaatctcggggaagtcacatgctagctgacaggtgatgctggctgcattgcagccgttagcacgaacaacctcagtcgataggaataaacacgcagagcagtgcttgtcacacagaatttgagactcattctcctttgctctcatttttgcattcctgccccatcacacacacacctgaacataccctcaggcttggctgcagtttttaaaagctcttctgtagagtaaaatgttctctttacaactaagtctacttgtttagatccagaaataactagtctgtctcttcatatcttaaacttagtgaatttcacagatgtttcttggaatcaagtctttggagaaataaagtttctcaggtttatttggctctctgttcaatttctagatgagaaaatcaatgcccagagattctaagtgaagccacctcagtgacatagactgctgagacccaactctggaacctctctcccgtccttccctctagacttagcagctctgcatgcctgcctctctcacctggatgctttggagccaagctttcgtcccatgcaagggaaacaaccacttctgggatgtccgctgcaatctgctccggggctgcagcaacctcatcagctcttgcctggagtggctcagcctgggcctgcagggccaccaggagaatggcagcaaggatggcgagggtcctcatggctggggtcacctggaggagggagagcaggagcagctgtgtggggagggaggagccagcctggatttatagctctactgggagaaggctcggagacaagaaaccttcctcaatctcagtgagaggaggtgtgcattttacaagagaggcccattggtctcaaggttgctcgaatgctcctgttctcccagtttcatgctagtatacatctgtacctttaatgtctgtgctaggttggagctaataatgacaagaaagaccctgctatgttactcgtgggttcacctgcttaaatattatgatttactttttaacattccaaaaagaatagaaattgcactttgattcaacaggctcagggaacaaatgcttcttattttctgaagatgggtcctgctgttctctggaggtctagattctggtgtcctatatgagttccaatggaatagcgagtaattcacttcaggattcaggtgacttaccatcctcatgaagaggtttttgaggttatggggtgagtagtctcctgtaggaatcagggtggagaggacaatgattttatcaggctaaaggtgaaatcagctcagtgacacagagtggtttaagtaaaaaaaagaaagtttattatttccacctctacttagacttgagtaacaattaacaattgtatatttatagtgtacactacctcatgattttatatatgtatgtatttaaatctttatctcacaccatgtagaaacatcaactcagaatgaattgaaaacctaaatgtaacaactgaaaccataaactactagaagtgtatagaaggataaagcttttgacattgatgtaggtaatgatttcttggctatgacaccaaaggcacaggcaataaaagggaaaatagacaagtgtggcttcatttaacgctaaagcatctgcacagcaaaggaaacaatcaaccgagtgaaaagataacccagaaaatgagagaaaatatttgcaaaacctacatggcagaaggggcaaatatctgaatacataaggaattccaacaactcaatagcaaaaatcaaacaacctgattgaaagacagaccaaggacctaaataggtttctctcaaaagaatgttccaaagacctgtgatagtctctactggacatgtcaaccaggacatgtgtgtttagaaggaaactgcttgagtttctctattaagttagctggaagccatcgtccccagcagtcaccagaggtccggacagacgttcctagcagggattcacccgctgggtccctctggggcggccccacagtcagaggtcagattggaggcatagcttcaatgatgaaaactcagtgtaaagtttaagttttgtagtacttacagatcctctagctaggcagggtgaccagagagggcagacagcagtcctctgtcccaggtcttctatagcaaggagcagcc

SEQ ID NO: 2017 - DNA, 2445 bp, Homo sapiens
atcttgtaacaaggcatttatttgggatgaggaaaggaaattgagcagaaggtacaggagtaatagcaattccctgtagctctcaaagcaaattttgagctcatttttctttttctgcaagctcagcagcagaatgcccagagtcttccctggtagatgcaggttccatagcgacgttctcctgcaatgcacgctggtattctgcaatagcaggccatgtttttccttgagcctgggacagggagagcatgagaaattgagtatggagttagcagtgggtaagaaaaagaatctcggggaagtcacatgctagctgacaggtgatgctggctgcattgcagccgttagcacgaacaacctcagtcgataggaataaacacgcagagcagtgcttgtcactcagaatttgagactcattctcctttgctctcatttttgcattcctgccccatcacacacacacctgaacatatcctcaggcttggctgcagtttttaaaagctcttctgtagatagagtaaaatgttctctttacaactaagtctacttgtttagatccagaaataactagtctgtctcttcatatctgaaacttagtgaatttcacagacgtttcttggaatcaagtctttggagaaataaagtttctcatgtttatttggctctctgttcaatttctagatgagaaaatcaatgcccagagattctaagtgaagccacctcagtgacatagactgctgagacccaactctggaacctctctcccgtccttccctctagacttagcagctctgcatgcctgcctctctcacctggatgctttggagccaagctttcgtcccatgcaagggaaacaaccacttctgggatgtccgctgcaatctgctccggggctgcagcaacctcatcagctcttgcctggagtggctcagcctgggcctgcagggccaccaggagaatggcagcaaggatggcgagggtcctcatggctggggtcacctggaggagggagagcaggagcagctgtgtggggagggaggagccagcctggatttatagctctactgggagaaggctcggagacaagaaaccttcctcaatctcagtgagaggaggtgtgcattttataagagaggcccattggtctcaaggttgctcgaatgctcctgttctcccagtttcatgctagtatacatctgtacctttaatgtctgtgctaggttggagctaataatgacaagaaagaccctgctatgttactcgtgggttcacctgcttaaatattatgattcactttttaacattccaaaaagaatagaaattgcactttgattcaacaggctcagggaacaaatgcttcttattttctgaagatgggtcctgctgttctctggaggtctagattctggtgtcctatatgagttccaatggaatagcgagtaattcacttcaggattcaggtgacttaccatcctcatgaagaggtttttgaggttatggggtgagtagtctcctgtaggaatcagggtggagaggacaatgattttatcaggctaaaggtgaaatcagctcagtgacacagagtggtttaagtaaaaaaaagaaagtttattatttccacctctacttagacttgagtaacaattaacaattgtatatttatagtgtacactacctcatgattttatatatgtatgtatttaaatctttatctcacaccatgtagaaacatcaactcagaatgaattgaaaacctaaatgtaacaactgaaaccataaactactagaagtgtatagaaggataaagcttttgacattgatgtaggtaatgatttcttggctatgacaccaaaggcacaggcaataaaagggaaaatagacaagtgtggcttcatttaacgctaaagcatctgcacagcaaaggaaacaatcaaccgagtgaaaagataacccagaaaatgagagaaaatatttgcaaaacctacatggccgaaggggcaaatatctgaatacataaggaattccaacaactcaatagcaaaaatcaaacaacctgattgaaaaacagaccaaggacctaaataggtttctctcaaaagaatgttccaaagacctgtgatagtctctactggacatgtcaaccaggacatgtgacatgtgtgtttagaaggaaactgcttgagtttctctattaagttagctggaagccatcgtccccagcagtcaccagaggtccggacagacgttcctagcagggattcgcccgctggttccctctggggtggccccacagtcagaggtcagattggaggcatagcttcaataatgaaaactcagtgtaaagtttaagttttgtagtacttacagatcctctagctaggcagggtgaccagagagggcagacagcagtcctctgtcccaggtcttctatagcaaggagcagcc

SEQ ID NO: 2018 - DNA, 2545 bp, Homo sapiens
taaagagagaaatcttgcaacaaggtatttattttggatgagaaaaggaaatggaggacaaggtacaggagtaacaagaatttcttttaactctcaaagtaaattctgagcttatgtttcttgattctgcaagctcagcggcagcagatccggtggagtgtaccacgaaaggcgcaggacccaaagcgacgttataacaaacggcaaattcctcttccgcaaatgcacctcaagcctctcgctgagtctgaggacacagggaaatcatcataaatggatcagaaggtcagcagtgatggtaaagggaatcttggataagtcatgtgctaggtaatgagtgatgttggctgcattggggccagcagcatgaacagcctcagtcaataggaataaatacacagagcagtgctggtcacacaggatttgagactcattctcatttgagctcatttttgtgcttctgccccgtcacacacacagctgaacacactcttgggcttggctctactttttaaaaactattctacagatacagtaaaatattctccttgtaatgaagtctacttgtgtgaatccagaaagaacgagtcagactgtctcttcatatctaaaacctactgaatttcacagacatatcttgacgtcaagttttatttttcaattttatagattttctaaagtgaaaggattgttaaggaagtaaaggaataaaagaatggttactctccaggcagagcagcctcaagtctttaaagacagaaagatttatttggctctctattcaatttatagatgagaaaaccaaggcccagagatgctaaatgaagcccccgaagtgacatggaccattgagactcgattccacactctgtctcccatccatcccactagaccctgcagttctgcatgccggcctgtctcacctgaaagcggaagagcggcactttcatgccatgtaaaggcatgagccatttcctgatcatctgctccaggctgctcctgggctgcagcttcatcagctcttgcctgaagtggctctgcctgagcctacagggccaccaggagaagcatggcagtgaggagggcaaaggtcctcatggctggggtgacctggaggagggagagcaggagcagacgagtcgggagagaggagttagcctggatatataggtctgcagagagaaggctcggagacaagaaacctggaaccctctcagagaaaggaggtgtgcatttcgttggagactgtgtgggatcccgttggtctcaatgtccctgttttcttcctttgctctcccagctttcactctagtttgaatctctacgtgtagtgtttgtgctgggttggagaggatggtgacgacgaggatcctggcatgtttttcttgtttctcacttcattatatattgactttttactattctaccaaaggataacagcagtgcttttgttcgataagctcaggatacaaatgcctcttttcctgcagatggccccactactctgtacaggtctacactctggcagcaggcgtgaattcctatcaagtgaagagtcatttgttgcaggcatcaagggcgtgaccactctcatgaaggcatggggtgagtagcctcctgtaggggccagtgtgaagaggacaatgaccctatcaggcgataggtgacatgaacacagtgatattaaggcaaaaagttcgtctacagccaaaaatgtgtttctggctctattgagatatgaataagaatttaaaacggtatatatctcctgtataccaccttaggatttgatgttcatgtacatgtggttttttatcatatactatatacacaaatcaactcaaaatgatcgaagacccaaacatagacctgaaaccataaaatgacgagaggaacatatgaagataacgctttgtcattggtgtcgataacgatatctttgctatgacaccaaagacacaggcaataaacgggaaaatagacaaatggggctgcactgacctctaaagcatctgcacgtcaaaaaacaaaccaacaaacaaataatcaactgagtgaaaaagcaacccagaaaatgaaagacaataattgcaaaccctaggtggtagaaggggcaaatatctaaatacataaggaagtcaaacaactcaaaagcaaataacaagtaacctgtttgaaaaacaggccaaggagcaggataggcttctctccaaataaaaggatgttctaaggagctattgttgtctgtattggacgtgtcaagtaggacacgtagatttagaaggaaattccttgaggttctctattaattgagccggtagctaaagctcccagcagccaccagaggttcagagagaaatgcgcagcaagagattcacccacaaggtccctctggggtggcccaggagtcagaggtcagactgggggcacaggttcaatgttgaaacctcaatgtgaaagttttaagtcttgggttacttacagatcctcaaggtaggcagagtgaagagggagggcagacagcagtcctctgtcccgggtctcc

SEQ ID NO: 2019 - DNA, 2545 bp, Homo sapiens; identical to SEQ ID NO: 2018

SEQ ID NO: 2020 - DNA, 1432 bp, Homo sapiens
taatgcttgaactttattttggagagagaaatttagaaagacacaaggtacacagagtaaaatgtttttcttttttcaggaccttgaactgaatcttgcactgctttggtttctatctaggaagctcagcgacagcagagtctgtagaggcggccactgatttcacacaccccggagagggactcacgggtagcacaacggccggttcggcaatagcaggtggctcttgcctgagaacctgtggaaagaagagagggtcaggcacagcgagggaggtgggaaaaaggacaagcacagccagactaactgagatagtctaaataagagacactgtatcagtcatgttaggatggagaaaattcatgtctttgtcgtaagtgacaagaaatcttactagctatgtgttagtcatgcaagatcatagtttttttccccatgtgagtctatccaggatgtatttattacctgctccctggtccaacaatatacctctcaacctcagggttacctactcttcattctgcttcatccacacgcctaatcttgacctccatgtgtgatttccaggtcctaacaaggctccctaaagcacctgaatcagtttctgaaatgccgcattgtgcatgctaatgtcatggaccaaatactttggtgctcaaggagtctttgaagactttccaaattcaaattcttcattctctgtctctcctttttttttttttttttttttttttaacattttacatatttacttgttttaattgacaaacaataattgtgtatatgtatgagacacaatatgatgttttgatctaaggatgtattgtagaaagatttaatcaagcctattagcctacatcaaaacacacctataggttcctctctaggttctaaaagcttttccaatggacaaagtaaaacactctctatataactaagtctgcccatttagatctacaaagaactagtcagtgtagctctttctatcttaaaagtagcaaatttcacagaaatatcttggaactgaaagtcttagaaaaaagaaaatcttttagatttatttggttctcactgattaatttatagatgagaaaatcaaggtccaggaagattaagtaaagtcactcaagtgaggtagacctttccacacttgactccagatcctttctccaatcctttttttctagattttgcagatgtgcaagattgatgtctcctacctgaggttctaagagcagagagtccatttcctgcaaaggagatagcaaggtcctggttgtcttccccagactgcttctgggttgtagcctcatcagctctttcctggagtgactcagcctgggcctgcagggccaccaggagaatggcagcaaggatggcgatggtcctcatggctggggtcacctgcaggagggagagcaggagtggatat

SEQ ID NO: 2021 - DNA, 51483 bp, Homo sapiens
gtatagtagaaacaggattttaatataatattcaagtctagcatttgctatttacaacaaataaatattgcccctccccaatcagtaaacaaacattttttttttctttttgctttttatacaaatattcaatcaccccacccccaccccaaatcctccttcctcactaacccccgtcttgcatggtctcgtaaagcccaggacgcagtggtgaatggcacttgcagtggcatgagattcaacatcgatgggactcagctgggactgtcctcactcaccgggtgcagagtctggtccatgaagagggtttctctctctgctcccaggggagggctggggtaagcggtgggtgagactccctcactctcagttggccctgatgatggaatctttggtgcagcctgagaaaggctagagtggtgggaggggccgggacccctgcgaaggtcacaggccagtgcctgtgggcatgagagaactgcagtggtcacagtgggtgctctggggtgcccatgggcacaggtggcagtgacccacacctgggaaggtgtcagggaagtgtacagaggtggcgcccgggggcaggcagggcaccatgccatgcccgttggcactgctccttggcaaaagtcagctagtcctctggttccagagagcagaaggcacctaaggcagcgagtggtccacgggaggccaggtcagcctgaccaatggcaggcgtcaatcccagcagcgggagaggttcaggatgaaactggagtctggggtaccctgggctggcaggtgggaggaaggcgcccagctggcctgggccactctggtccataagtgcttggctaccagccagccagaccctgggaggatgccctcagaagatgcccttggcaatcttgagtcctttctgcttcatgcgagggagggtggagctggctccgtgcttgaccttcactcccttggtgaaggtccgcttcttgaggacaaagtcatagttggcggtagagttcatggcatagaagacgttggcgttttcagggatcttcagctctggtggggaggggcagaggggtgatcagggatgctcctgggggccctgcaggatacccctaccgcttgagagcccatacaaggactgtcttgagccacagacctcagatcccctccaatacagctccagaactccaaggacccctctcaatgactcctgcctgaggacagactctgctgaggtcctcacaaaacctgatgactcttgtttaaacagggactgactccagaaccccccggcttggcctgagctggcagagggtcaccccgtcctgcccatactgcagtgctggctgcccacctggaacaggctttctagaatccaggtcacctcccagaatcctgccctactcaggacaagggatccaaggaccaggaaaggacaggcctgccccagggctctggcgcccgttccagggaggcctgtactccttgaaccctggcacccggcaagcacttccttttggctccatttcccaccatctcctctggcccacagcctgctataaaccagagctgggctcgatttgtgctcctgccgacatcgtgtggcttttcgtcatctttaacctctctaggcctcagtcttccttttctgtaagatgggggtcccgcctaccctgcccacctaaccgaaatggtgcaagaagctgccagaggatttagactgtaacttctagggatcacaggagtcattgcttactgtctgggctaatggtgggaggtggtgttcagctcactggaaagaaaacagcgatgatagtatttatagttaacttttatggtgcacatagatgctttatatatacatgcatatatatacacacacatatacatgcatatatatacacacacatatacatgcatatatatacacatatatacatacatatacacatatatacatacatatagatttttacatatatgatgaacacactggctactttcatttccatttgggggatgagaagacaagcacagagggcttaaggagcttgcccagcgtctccaggcccaggataccccactctgagcctgcactggttcttgacactttcccagtttctagaatactgagttggcctcctagtagcctgttctgcttttagaatcacacactcatggattttaacacttgacactttggtccacagctgtcaccattctttgtagagcacatgttttcttgtcttagccagaaagagtcccttccagtgggccacgtggctaacctgtcccagtgaaaaatgccttttctctttgctcctcactgatgtgagctttgaactgcctgttcacgcctagggaagggcacacactggggaggtccagtggttgctggggacagcaagcagacaatgggggcagccagggctgccctgtccacagtgtctacccacactctgctggtgaattttctggggccaaaggcttccaacctggggctggggagtggtgtggacctgccccctctgccatcgccctctggtcttctgacttactccggtcatctgagagaatctgcagcagctcatagtcctccggctcctcctcctccaggttgtgtttgtccatggccttgcggattacagccggagccttatcttggctggtcacctgcatcgcggcgggggatggaccatcagggaaaagaccctggagcggctcccccagagtgcagtggccaaggaccctctggagtcccctcagcaccaagcacaggcactcacagcctctggccaggtgctgggtccggagagggccttgtcacattctcctactccccaagtgaggcctccgtccttctgttccccatgtgaggcctccatggaatgaggaggggtctgtcccagcagtgcctaccctgcttctcctgtaagagactgttccctcctcccacacttccttgagaagcacttgcccctccaggataacagcatcactgagcctggggaacagacagtccctagtccaagccctggaggtaagaaaggaggggccggccaggatgctcagtgtggtcagcataggccaggcccctgctaccttgaccctgagggccagagcacaggcggaactcggacatagggccacaggtgactgcttaatgacaaccatgctagctcctggcaatgaggggtcaggagcgtgtgtgaataatggggcacctgacccagggctggggtacagagggtgggggttacaaatggttcatctgtcgcaggacacctggaggatgaagaaagagcccccaggcaaacccattctgtgagcaattcccatctgctgtctccaaatcctgtctagactctgaccctgctggccccttccagggctcccagcctggttgccacagcggcctcctaaccaacacccctgcggctctggtaccagcccacaccagacagagaagccagccatcattgctcctgtcttcctccccgagaaagtcgaggtcctggcagggctcagggcctatgtggccaggccctggatacttccctgacctcacctcccctacagcaccgccccttcagctcctgggggctttgcacggctgctcctttcctccccctctgccctcaggccagccttgtccctgatcactaccttcttcatttctgtacctggctgacatctgtccttccccgccaactacaaggtagaccccgggagggcagggatggtgcactgtgttcagggtgcatttgccgccagtggagggaggcacccaggccacccccgccggcttaccaggatgctcttgtacatgttgccattgtccacgtccaggctgacgcggatgatacagcagtcgcccacctgctggttgtagagcggcagcgcggagctggagttgcagagccctgagacagagcgcttgtgggtgcgtgtggcagccacgggcgtggtggaggctgaggaggacgaggtgctgctggaggctgagctgatgccggaggtctccggggatgactgtgaggctgattcccagaactgagggagacggtaagatcagcagatcccactgccctgtgggggcaccccaggccagctgccagatggggaaccttctagaagctgtgttcaggatccagggcttcctggccccatgcatggatttggagtggggagatgggaaaggatattggggagaagggcaggcagtcaccttcttttcctggccatcaggagactccgggacgaagctgatgttgatctcctccacgtcggagctagaggagccggccgagtgcacgctgagcgcgtcagcgatgtccccgctgctgaggtaggggccacacctgagctggtcacaggacttggagtgggagctgccactggtactgagctcagtgctgggggcctggcggctgggtgaagagttggcttagttaagggggctccccaaggacacatcccaaccccacagcccctgcaccctgcgcccaaggactgtgcaaagtgctgggacagttgccagtactccattcaccacagccatctgggagagcatttagtatcaccccatttcacagaggaggaaactgaggcccaaaaaggtgaggggactcatcccagtctcagggccagtcagcagcagggtaggattccagggccagcctccctgactccctgagcccaggctcagccctgaagcttctgagccccaaggcagctgcccctaccacccttggccaggcccttactcgctccagcgcttgacaatggctgtgttcttcttggtcctgagggtgttgctggctgactcggatgggggctccagctcgcacgacaggttgtagctatgagcagaggggcagtggtgtgacaaccaggggccatgctccggccttcccccagcacctgcccagaagctggagtcggggtgccccggccatcctcaggcaacaggggctgaggctgaccatgggtcatagctgctggccctctggagctggccccctaggacagcctgcccccactgtccccatttgctgccccggcctcacctctcagtctcgctgagccgctccacggcccggaaccaggccccaaattgctcatctggcgcgatgctgtagttgttgcaggccgactgcagcagcttgatctgggcgatcacctcgaactcctggggccagagggaagcacagggcggtgacaaggccccccgggcagcacaggggccagtctctgggtctttgttcttggggtcccttcctcccctctactcccatccaggccttcctgttctcaaagttgggctcagccactccccaggaggtggtcctggattataacctcctaccctcaccctccagtgggaggggacccccttctctctgtgtccaaatgtcccatgtcccatgaatctaaggagagggtaggagttgaaatgtcctaccctggtgggtctgttttccacccctccccaagtcagggctgcctgcagctgcttaccttcctcctcttctcaaagttgatgagtctgccctggaaggtggacacccaatggccgtcagaaagtgaccccttgaccattacagtctccccacctcatgctgcactatcaagagtgcccaccagggggcagggcacgcacacccctggattgaagccggtgctgggcaccagggcaaggggacatgcgggcagaggcttggggacttcttgtccagcactctcggaggacaatggactgaggccttgggtgagaaggccctgctcagccaccacgtgccgcctgaccgctgagggcctggcttccctctgtgctcagggtcactgcctgagggatgggctgtgtcccactcagccaaaccctgctgcagctctgtgtttgggcagccctggggtgtcaccagcagggcactgagctgtttactcattgctgggacaggtgtggcagcccagcccccagggctcagggaaggtctctcctcccgggccctactccagccccgcccggcacactcacatacagatagtccttcatggcagtgtccagcatcaccaggtcggtgaggaacgtgcccaggtagggaacggtgccctggatgatgccctgtgacattggggtaggaggatgagcaaggcccctcccctgaaggctttctcagcccccagccccaactggtctcacttggaacagctgggggacctctgggggcctcctggggcccactgtctccctggaccccagactccctctagccatctccctggctggcatctgggaaatgccaggttcccaagtcgtgtggcccctggccctccccagccccacacccgcctgagccggctctgccaggcctgtcctttcgtggctgcagctggtcttcccagataccagctgatccaggtgtggctctgctagggtccagaggaggctacctctaatggggcccataggcaccgtggctagagaggaaagggccctcctccctacccccaggccagccccctgcccctccgcggccttgggcactctcaccgtctccttcggccgtttctgggctctcttggggttcatctccagggtggcaaacttggaggtgccctcctgccagggtagaggacagggtcagcaaggccctatcccctcagccctcaggcaccctgacctggggtgctgccagtgtggtcgggttccagggctgaccctgtatcaatactcactagtgtggggtcctgggccggtggcctggccttcctgagcctgcctccccctctggaaagtgcggatgagaactccgcctgctgcatggtgcggtggctcacgcctgtaatcccagcattttggaaggccaaggcaggtggatcacttgaggtcaggagtttaagaccagcctggccaacacagtgaaaccccatctctactaaaaaatacaaaaattacctgggttggtggtgcacacctataatcccagctacttgggaagctgaggcaggagaatcccttgaacccaggaggtggggattgcagtgagccgagatcacgccattgcactccagcctgggagacagagcgagactccttctctaaacaaataaaaaaactccacctgcctcgcagggcctcagagactctgcgctacagtcctgttatggctgcacactcctttctcccttgaaccttccataaggtcagcaccccagggctggcattcctccattttctagatgaggaaactatggccctgagatgggcagtgacttgccctgggccccccagggactcagaacaggctcttctgtcctagccagaggctctgccccatctgcctttacccgtttggtcactgatcagggtaccgtcctctgggcttctcgtgcatgccagggcccccagtggagctgtgccacggagggagagggacaggtgtcccaggagccccctgcgatgctcccctgtagggaactctgtgtgtgtccacgcaggaggggggccctagatgccatttcactgaccgggtatgccaggggcaccaggcagtgacacttgactccctctgaggcctcgtgaatccattagtcactgaaagttctcctcagtcatctggggtatccgccacagctaatggggtgccatgggaagaattctacagggttctctggtcagtgtctcttctcggggcagggtagggaagccacatggggcctccaaatctgcctcccaggtctggccacctggcccctggcatcccctgcagctcctgtccctggggtaggcaggctgccctctccttgggtgtgtagagcagacagaggtagcgtcaggagcctggcctcccggggacagactgggccggtgtgggggcaggagccgcatccccttcccacccagcaggagggaccggcgaggaagccagaggcctgctggtcctgatgcccatctactcctcctggaacctccactgctacccttactgtgtccaattaactggggccctgtccctcaaacacccaggggccaaacagatccctcttcccccttcacgcacacgggaaaggaactttcccagcaagaagcgaatgccaccgcccgccgccccagcccccgccccagcccccgccccagcccccgccccagccccagcccccgccccagcccccgccccagcccccgccccagcccccgccccagcctgccgccactccaccttgatgagcagctcccggctcaatgagtagttgttctcatctgagaagatctctgacagcttctgaaagatccggaaactgtccctgtcagaagggcaaagaaggaaagagaaagctgggaatggtagggaggggtgtgagtgcaaatccgttttattttagagctgaaagaccccagactgcctgaacgcagcacacagggtaccccagagcactaacgctctgcaggtctggggagggggccttcatgttggtgcaacaggaccccattcccgtttccactgagcagctatttccaaaggggtttttttctttttttggagacagtttcagtcacccaggctggagtgcagtggccagatgtcgactcattgcaacctctacctcctgggtccaagaaattctcctgcctcagcctcccaagtagctgggattacaggcgttagccattgcgcctggcacaaaggttttgatttcaattggatgagggttctgtggctacaacacgaatacctgaaaatctctgatgtggctcaacccaccatctgacagcttaggaagccgagctctgaggcagagctgctgccaactcaggtcagtgaagggtccctgccctcagggtttgtggcctcccatgggctcactaagggggtgatgccagccctgtgggaggtccctggtgcaccaggagctcctacagaggcatgcccacctggaaacgtcttcccacgtcttcttcagacggtggatggagttgctctgcagggcagagaggatggcatacagtgacgagaagttcttgaggatccggcactcctggggcgggaagagcaggaggcatgaggtggggctggagctcccagcttgcctggcctcagtcccccttggccaagcctcccctcctaatgagacagacacccagggagtccccagagggcacgcctgcgacccgggggtgacaggaggattttagctcaacccaaggaaagagtgtaaggaagacgtgagcatccaggcagtgggctgggagagtcaaggccagcatgcccctgggaagggtagactggggcctgtacagggccttggactgcagaccacaacctgagaacagatgaagccaaagtgggggcccaggcccctcctctggcataccctggccacctcgatccagtgctccaccaccctggccctgtctggggctttcgtgcttcggttcccgaggcaggtggtgatgacacagttggccacactgttgaactgggtgacagtggcgcggatggtgggcgccaggtgctccttgcccttcttgtcccgctgggaccagatggagcccaggcagtggtagggcaccaccttcttgaacagttcctggggaggaggctaaatgtcacctggtcctgccccagcagtctgggctggtgctggggaagctgaggatgcagcttgagccttgtggggatctctgggttttatcccgtgtccatgcagggtgcccagcacacaagtgacccgggacagaacgctggtgggaagaagaggagcaccgcctcgcgcagcctcaccaagccccagctccaacaggcggctcacgcctgcccaccccccatccccccgcctcagtctgctccccatccagacgcacatctgctgtgggcgctacaactaagggctttgtccagtgtctgccataggctccaggacacaccaagtgcctaatgagtgctgaggctggtgagcctcctgaacagatgggggtgacccatggatgcaccttggtgagcaccctccgctcccacaggccaggcctgctgagcttcctgtctgttccatctagaatctgcacagtcactctggaggataggggtgacctcatctctactgtccagaggtaaactgaggacttggggttaaggaacgacctggttacttggtgtgtagcagcagagctgggatttgaccagaacatcagctctggatcagcaaatggtaggtctgggacagcagatgctgccagaaggcaggcccacccctgccctgccaagctgagctgctcaccgcatccatcagtgtaaactgctctgccaccagatctggagggaacaccaagaggtgaggcttctcctcactcagcccgttctctgcaaccacaggtgaaggccaggaaggctgtaatgatggaactggtgctggagctggctccagctctagagtttgtgagggagctggatcctgttctggagctggctctagttccagagctggcgctggagccgattctagtcccacagctggctctggagcctgctggagctccggagctggtgctggagctacttctagctctgaacctggagctggtgttggagctggctctggctccggggctggagccggcactgggctgggtgctcgagctggtgttagagctagctcgagctctggagttggttttagagctggcactggtgacagagctgcaagaggagaaaagttcaacaacatgccagcctttcctgtgcctttccaaagacacagaacagccccggcttccagagaagcctctctccccgaacccacaaaacgtgtaccaggccactctcctgcctgtggtccctgcctgtgtggtctgaggctcatctgggcccctgacccagcaccagaccctggagcctcctcttcgtgtggcccagcaccgacccctcctcattcaccctctggcacccaccccagtcctcctcaccctcaggctctgcctcaatgggttccgagtgctccagctgggccaggagaaggtgggcacggcgctccaggtctgagcctggcatgttgagctgcacgtaggccaccagctgcttgaggcagggaaagtccggaggttgacagaaatcctccgagtactggtccagccaggtgcccaggatggaggagatggcactggggacaggtgggtggcagcagagtcagaggcctgggctcccctgagccaggctgggctcctgagccggcccctgtccatctgaaggccacctgccccggcccaagcccccttggctgtccagctaaaagaaccaaggaggcccctggtcagtggcgaacacctctcccctcctccaaggaagccccgcccacagctctgcatgtctcccagcaccccctcctcgctggaatgtaaactccatgagggatcggtcctcctgccgggcatctgcaggtccctggcggctcctcaacttgtagctcagtgctggtgagctgccttactctctcagagctgtgtgtgggtctcatcttcccactaatcctgttctcccagagggtggggtgcagcctgcccactgagcactcactattgaggggtgaggcaatgtgagagcagaggctcaccccacctcttgccaggggcccctagatcagggcccactgagccaaggccagctgggatgaggctatggtgggatgagttcccgccgggggctgccccgagccccagccaccccaggacccctccacagctctcggtcgtctttcttcctgcaggcgaagcccccagaccccagccctctagcaggaaccacaagaggtgtgggagccagggttctgcccagccagccccggctccggccccagccccatgtactctcccactgttcggtggggacagggtcccttcctcttggctcaaagctcactcactttttaagttggtcctggggtccaccatcctcgtcggaataggggaggatgcagccgtatctagaggaggccgtgagggcgtcacatctaccgtacctgcttatgacgtctagtgttactgtctgactctccgactagaacggaggcccaggagggcagggatttttttttttgctttttttcatcaaattatattaaatgcctagaaaagggccagcacacagtaggtgcttcatatatatttgttcaatgaataagtcccaaccagctccttcccagctatctgagcgccccttgggtccctccaacagcccccagatagaatccggaatctccttgacaagtgggaaaactgcttcgcccaaggccacatacaagagaggcttggggcagagagcttccccatgggggacaggaaaatcataaaaacgagcaccacagccccgcagcccattccctacagggccaggcgttgagggagcactttccacgcctcatcccgcccaggcatggtgacaaccccatgaggtcctcttagcactccagtttctctttcatatgagcaaagcgaggctcagagaggtgaatcagcattgccaagacccgcagccaggtgggggtgggggcgagggcccctgtgcaccctgtgcagtggagggctcatgctcaccttttgaacagcaggtccaggacctgttgggtggtggtgaaggctctataggtacacaggaagatggtgacgtaggagaggtcgctgccctggaaggctggcaccaggtgctccaccagcttctccagcgtgccagccttcacggtccgcaccttgcaagtctcataaaggttcagggccgactcattctcatactggggtgggacagaggagggacagacagtcagtggcagcacacgaatctcctggagctcagatggaaccccgagccctcagcagcttgtggcaagaggcaggactgagtatctctagcagaaaaaggttatcagctttaaaagtagaatttcaggccaggtgtggtggctcacatcagtcatcccggcactttgggaggccaaggtgggagcatcacttgaagccaagagtttgagaccagcctgggcaacaaagtgaaatcccccagctctacaaaaaaattgtttacaaaacttaaaaattagccagggccaggcatagtagcttacgcctgtcatcccagcattttgggaggctgaggtgggcaaattgcttgagcccaggagtttgagaccagcctgggcaacatggcaaaaccccatctctacaaaaaatacaaaattagccaggtgtggtggtcccagctacctggggaactgaggtgagaagatcgcttgagcccaggaggtcaaggctgctgtgagctatgatcatacctctgcatggcagcctgggtgacagagtgagaccctgtctctaaaagagtgaaaaaatttttaaagtagaatttgaggtgcgggaatgatttaaatactgacaccttcaggtccgttgttagctgagtaatggtagctgccctgtgggaagagcgtcatctgagagctctaacaaaatatccccattctagagatgaggaaacagaggcttatccaggggctgggagggactggcccgttaggacgcacagcatcttccccgtggcactgttttgttttgttttgagacagtcacccaggctagagtgcagtggtgtgatctcggctcactgcaacctcagcctcctgggctgaagcaattctcatgtctcagcctcccaagtagttgggattacaggcacacaccaccatgcttggctaatttttgtatttttagtagagatggggtttcaccatgtgggccaggctggtctcaaactcctgaccttaggcaatcctcctgccttggcctcccaaaatgctgggattacaggcatgagccactgcgcctggctcctgcagcactgttgaagtgtcctcagaggactcacagtggccccacagtcatgaggagctgaactggggcagtggctccagcctcccttctggaatattatgcagctgagtcaggccccggctctcaacctggaggaaccccagggatgtgttctgggagatggcaacttgcagagacctaacagcctgaagcccttttgtccttgggtgaagacagccccactactccagatggtgtgcacatctgggagaaggcatggaggatggtgaggctgatggctgcacacccggggaagggaggtcaaacatgaaaacccgattaagcctgggctggacagtgggggtcgggaagggagtgaaggccgtttcctttgggatcagaactgggggccctcaagtgaaaaagtcctgggagggatccccagctgcgtctcccagtggagaccccgagcgcactcaccccgagccagcgctgccccttgttgcctccgtggtgcagctgcaccttgcgcagggagatggagtagatgactccgttgatcagctcctcaccgatctcctgcgtggagctctgtgaagacaacgcccggcagccgggcgcggggacgtcaagggcctgcctggccaccgtgcaggggatgcacctgtgtaacctgtttcccagatagggcacagactggcggctgcacagacctacagcctggggtggaatgagatcacagctcgagagccactgtcccggcactccacttccccaacccggccagccacgacctgggacgtgattatgatgagtccaccaggcttccaatcccctagtaactggcttctgctcctgcccaggacagacccaccctcaagccatccccttccacacaggggactgttattcagccattgcacagatgggtaaatggaggctgagagaggaacaactggtccaaggtcatgctgcctcgggtaagtggtgaggcagggaccccagggctctgacacggctgactgcatccaggcggctatgccccaagagaaggtccccctacctccccagggccagaggcccatgggcatcctcacactcacccctcctctacccagcctggggggccctggctgacctagcaggaacgcacagctcctctgggcccagccctggtgcgttggcagcccaggtctgggcaggtgtggggcaccccagacagccacatcccagccacttccttcccctctgctcattcatgccctcgtgcctgcttgggcaatgggagttcccagttccctgaccatcatcacgtgaggggacgggtgtgagaggtgacggtgctggtatccaggcagatgctggggttccacagagccctaaaccacaggcctagactggaacaggaagggggcatctggccccaggcagtaaggaaaggccgttgtcttaggagacagacttcccccacctggcaggctggcctaggtcacttagccacaattacccccggcctcacagccccctatgccacctgctctgtccagggacggaatgagcttgcagcgggtagaggagccggggggttaaggacatcaacctcagaggttaggaaggagctaagaggtactggcctggcccagggtcattaaccgcccagtcagtgccccagcccaggtaggcgtggagctcagagaaggcctggcagacagtgctgactcaggcccttccctcaaccccagcaggagccaggtagactgtccagcatgctgtggacgggaccctggcctcctgcctcctgcgcaccctcagaggcccaggagccatcctggaagtccacttcctccgacctgaggtcgcctcccacgctgggctttgtacaacaggaaagctgcgggcattgtgccgggctcctgaccgccaccgcctctggacagagagccagccccatttcttggaagttagcagggaacccacaggcacactcacacccacaccccacaaacagccccgccaggggaggtctggcccttccactgacaggaaaagagacatacgctcaccccccttttcctgactcacacatctctcccctgcctagaaagttgttcctttgaaaagaaaagcattagaggttacagcgaccagggcccccaaccacccgggcctcctcaggggtcccagactgcctcctgtgaaggccgttggctcagctgggagtctctctctctcccagggattttagccacatctggaccagctgggaggcagacagtatcctgagtgtccaagtcaccggcagtggctctgagatctcgtgcaggacaagcccgccacaggggactaaacattaaccctgggggagcccagcacagcacccaggtcctggctgagcaccatcagtgcctgctggacagaggtgtccccaggcaggccaatccccaggaggggctgaagccaggtggcctcggctgtccctgagcaggtctagagagcggctcctccgtgagctggcaggccagcagctggcccagccctgcttggtgtcatgtgatccctgcacccttcccccacccccggggggccctcttctgccagccgggtggtggggaaggatgcaggcccaacactgagagccatgcatgcttggggtaagggagttgccaccctgtcacacagtcggggagacgctctagcccgcgtggagctggcctgtcttctctggtcgcttcccgtcacagcagcagcaggcatggaaccagaccatagagctacgtggagtacaggggctgtttaaaccatctgctcagatggtggaggtgcaggctccagagagagctgccctggggtctgggaacaaagtggcagagtaaggcctctatcccttgccccctcacaggacagagaaagaaagcagccaacagccctggcagctgccccagaaccctctgcagcaagaaaggcagggttccagcacccacaggccaccctaggtcactctgttagcagacagcccatctgggcagcgcctgggccccagggcactctggccgggctgggagctcagagcgggaggagcaggaacggcctagtgaacagctgatgcagagaaaacgctttcccctgagggcaggtgcccaggcagccgctatgagctgactgctaggaggagaaaagaacaccacgtgcttggctgtgtcctcaagggacactcctgtcccacccctagcaggcatgctgatgtccctgggctctgggacccagtcggcagctgtgcctgtaaacacactgtctggccttctaacatttgggtcagtgcagtgagggtggcatggggtccccggtgagcaggggcccccacaccccaatgtctccagggacacagcccagagccctgaagatgaggatgggaaacagggcctggtggtgtctggtgagtgtgtcacctgatcagccttctcagagtgacaggccagcaggatgccgtgtccctggctgacagaaggaggaagccacaggccaaacccagactccctctgggtagaatagtgagggtcttgaggaaccctacggggcctgccccagccctgccatctccccgctcaggccaacggcacctcctcccagcatcagccttctggtgcagctccggactcagacgcctttccttggaaaccgtagctagtggccccctgccccatggatggctccaggaactcaccggcccctcccaaggagacctggctgagggctgaagcggagtgaggagagggctctagcctgcacctcggcctgctccgcccctggtcctccccgggcctgtgtgtggaaaggctcacggcagagcctccgtgtgcgtgagattgtcctgggggacctcccaagcccctctgagctgctgctcaggtcccagtcaccagaggtcaccccggggtgcttgccacccccctgccagcacctcacagttctggcccaccagacagcagctccctgtctctcgctggctctgcccagcccctggccctcggccttggtgtgtcatctggggagggcagcactacctgtcacaggcaacagtgggggtcaagagagaatgcacacagctcggtgaccggcactgggacctgatggcgtggtaccggacaacacctgacatcatatccccctggggccggcgacggatgctgggctgtaaaaacctgagggaaacttgtctgaggcctgcctaaggctcagggacctagccgagggacactgtaaagagaggctgagtcaccctgaaacccagtgggtgggagcagctttctgacttcagctttccgctccaatacagaagccaaacgtaaaacgcatcacagaaggctgctcgctctctacagagcccaggctcctgcgacagtgcggggcccacgctgctgtgcccttctccgtcctacagaggtggggacccatgcccgaggacaggagccggtggggcgtgtgctggctgagccagaggtgagagcccaggacttctcaagtcatgagctcggaccatgagccccatcaagggaggtggaacgcaagggcctcgtgtccgtgtccgtgaccctcctgccctcgggcctgccctccagctccaggtgggtggacccaaccctgatccccagcgcacagacaaagcatcaagatgacaggaggccagcccggggtgtgggtgggccacactcctgatcctgggcatggcagcccacagaggcggcctcagaccgggacgacacgcggtgcctgcccaccaggatgctccctggcctcagaaagtggaggctgggaaccaaccagtgctgagccccgcaaaggccggcccatctctccagaaaccctccctgccggcctgtgccctgctactcactgatgggaaaatcgtgcctcaagcaggaggagggagaaccagacctccaggtcagccgcaagccttgggcatccagggtccctgtccacgcccagcccctgacagtcaggtgaacacagggccaggcccgggaggggcgtggctggtggcagctgaggaggaaggtgggctggtcccaagggggtgcagggcagccccaactttaaccagctacagtgcccagcacatgcgggcacttcctgggtgcaaggccctttggacacccatcacgtttaatcctcctaacgccctgcctgatggacaaggaaacagcctgagaggaactcgcccaggtcaggagccaggacgtggcagccagaacagggatttgaaccctggcctgttgggacccacccaggcctggcgctgcctctgccatggtctcaggcttggagcagagtccagccccttgtggcacagatgtggaggaggggccagagacaggaaggatttcctcaggtcacacagcaaattcgcaggggagggtggcagggccagctttctagcacctgcatctccgagaggtttgtggacgtgccctgggcaaaaggcctacaagacaccaggccagggaagtgccatgctgaaggtgccaggtgacgcacccgaggagcccagggcacttggaagggtcaggccgctcccctggcacctaatcagaaaacctcattgtggcagctgctacctgtccactgtgccaagtgctgtgcaggctgctcctcaggtctcttgtctaactcgagggtcctcaccagaaccctaacaggagagctggcatcatgtccattttacagatgaggaaactgaggctcaggagcacgtctacatctgctagggggctgagctggcatcccagcatagctctcttctctccagagcccaggctccctgcccctcggttgagatggacaaaagtctccaggaatgactacaggggaggctgccaaagcatgcaagcttccccatggaggaaaacgccaaaaccctccaacgcaggtgtcctgccccgcccgccaagccactgttgggctgccatcccactgcctcccccgcccgtgggcagccaaggtgtgcggaactgggagaattgggtctgctcaaagctcagcttgtcctgcatgaggctgcatgcatcagtgtctgccccttaacaatcaaatggggaacactgctctgctgttgctgtatatctgggaacacagtgattctgggcctgcaaggctggaagtccaaccctgggactgggtggccacagcatggtggcaccacgccatgggagccatctgggcggccaaccagcagctcttgggaaccagtccttgactgcctgggtgcagcttcctgaaaccgctccactggctcgttcagagcctgcctgcagagggccagtgataaatctccccactcttttctcattggcaacgcagacaggtcctggaaatgcccaatttccaggttaagaatcagaccccagctctggcaacgagcagcttgatatctcccagggccattcctgagcctcccgggaaacaggccagcatgcctgagcatcccccgcctggagaaggaacaaagacccaggaccagccagcctggtccccctcttctgggggaccctcccgagtagagcaagaggggaacctgagggtcctgggggctgccccttcagagtcacccaggaagctctcctggaagaccacagtctgtacacatgcatgcagggacacacacccacacagggacaggccctttgccttggggtcttcagtgtcaaagtgctcatgagccctggggattaaaccgaagacctgcacacagtgtgatcaagagatcaaacagtgggaagacgcgggaggctgaagggagatgctccctgtgaatacagagaagccctcttcactccagcccacctgcaactgccctcaggccttgggtcagaatcctggccctgccactgaccagcttggtcactctgtgcaatctaattcacctctgttgcctcagtgactttatctgtcaagtgagctcttaacagtcttgaccccaaaaggagatgatgcaaattacttagccaaggacctccccaaaacctgctggctcttattagctgttatcttaaacctgtggggtccagttctgggcttgcttcctccaggtagctctccccagcgtcctgtggcccaaagcacttttgccttcctctgagccataagcttccctactgctcacctgacctcagggcttctgggctgcctgggcttcctctgactcctggtggctcctgcacacagtaggtgccacagagaacacagcccatgcttaaatcctggctgcggcccttgctggctgcacgggtgtttaggtcagagacttcccttctctgaccccctagcttcctagaaggtggtgttggcacctactctgtagggttggtctaaggcagatgaagtgagggggtggcccacaacctgcactttttgtctggccaaagcaacagcctgtccagagatgggggcacggaccaggtcacctccagaaagcaagaactgtgcaggccaagctgggtcattggtggcttggcttagaatcgggaagataagcggaagcccagatgtgaggagatctggcagcccagagggaagcaccgggtggaagctaggtagggaaacagggatgcgggggaaggcagaaactgtctggtggtttccagagaggacagggaccaagtgcgcagcgtcagctctggcaggccacatagacaccaggaaaccagccccaggacggggggtgttggcaggagggacagggacttccccgccccctcccttgggcccttggtaaatggtcattgtgttcagtttccggcagtggcctcctctcctgccaggatcctggttttcctgacccagccagaagcttcccctttgatttctaaatagcagtcgaggtctggatctcagtgctgaggctgggcaaggagcgccagggccagagagagggaagacaagacccccaggcaggggtggggctcagctctgcctctccctcagttcctcagggacggagagagggaacctgcacggccactgtgagcgctccgccggaccctcccagcacacaaagcccgagctgctgccagaggtaatgaaagccagatgagcgctgggctggtgtcagcctcccacccccaccctcccaggggtccctctccagccgccaatgaggaccagagccctggatagatgagggttgagggaacacgtctggtccggccatctgccaagctcaggaggaaagggtctctcaggcgtgtggtgttcccccaccaagagctctgcccaacactgggcggagaaacaagtcgcatccaggccctgtctaggtaccgggacaccaagaggcacgagactcaggctaacaatcgccagcaatcacaacgcgccacagtctaaagccatgaagcgactggagacgcagcaaggcaacacgatgccgcacggggactcaggaggttcactgtgaaggctgcagcccagccaaagctctgatgggccctgagcccccgatccaggaatggcctctgtgcaggccctgtgcccaggcagagcagggcgaggggggcatctctggattccactccctctgctgtgtagtcagcagcagtcaggtgggaggcagatggcaccacccagagacccagggcacacgagaaacaagcccccgccctcacctagtcaccctcccctccatccatcacaggtacaccactcccttctctgaatcctacccagtccttaccgattcagggtgttggcactctttccagttaagcagaaacaagtcttgcccgccctgggcctgggccaccctcctcccctcaccaccaggacatctggtcccacgtgttggaggcctgctgctccaccccatcccccgaccccccccccaccccgctctgagcagccccgatgtccctggtcaccagatccacatctgccccaagtagggtctgtctggaaggcccctatggtctcatcacctctgaggattctaggatttggccttcccgaccacttgttccacacctgcatcgtaaaggctaacgacgcgctgcgggccctgggtgggaactgagtgaaataaggcacaggccaccgatgtaaacagggacagtgccgcagaaaaaggtccacctgggctgcagcggccttggtgacagcaggccctggaacggtattgaggggcgcaaaaccccagccgtggtccctactgttggacggggcgcggcggcagcccccactgcccaccctgctggctgatttctgcagaaggccccgacccccacctatggaggagagaggagggaggcggcccgctgggatcgcccggccccgtccggggctcgccccgacctgcccagctctgccgcgggtggggaggctccgacgcaccccccgcccgaccgccccagctcacccacctccgggcgcggcaggtcggggtctagctgcgtgaagctgtgcagcaccaccgggcagctgtcggggacgcccacctccaggcgcacggcgtcccacacgctgcggctccgccgggagcccggaaacagcggctcggcgccgccagcaggcccggccgcctcggcccacatgcgctgcaccatggaaggctcgcagcgcgggcgcggggccggcccggcgcgcggcgggggcggcggcgcggcccgcgcggctgggctttgccaccgctgtgagcccgcggcccggccctgctgatgtcaggctggggggcggggccggaggggaagagggtggggccggggaggggcggaaccggagagtccgagggacgcgtgcgtgcgcgcgcccgcggccccgccctcgccgaggtcagacccggggcgggaccgggagcctggaggggcggggtctgaacaaagagggcggggccggggaggtcgaggggtgcgcgttggctgggtctcccggaggaccggctgtcacgtgtgtcgtggggccttgggtaccccggttaggcaccgtttgcgtgtcacgctgctgcagtgcgtgtgttgcgtagggctgaaatgtgtacgtgctgatcatgtgtggggaagccgccctggagtcagctaccccgaattccagcaaagcctctccccaactctgtggccttccacaagttgcttaacccctctgagcctcactgtttcttcatctggaaaatctgggtagtgaaaatgacttcctcaaacagttgcggggaggatgacattacgtaatggacatgaagcactcagcactgagcacctgcacctgactacaggctcaggcggagtttggagaggctgaccatgtgttcagtgaccctgtcagtgcaattggaaatcctgagtgtggggctgtgtgtgcagtgggggaaagggtcagagagtggggccctacctttttggggcaaagccccacactatccccttacagacaccctcagaggaggggaagccagggaggtgggggagagcggaaggcaccaaggttggggctgagaggcatctgacaaggaggaaggcatcaagagtgacaacgctgggcagagcacatggctgcgtggcctgtcagctggggctgcttgtggcttggacatccctggtctcagggtggaagtggggctgctggggctgaaggggaagcagggacagggacatcctcaactactctttctggaagccagtgaggaaggaagacagcctggggcttaacagcagggccaggagaatggatgaatgaatgggacccttcctcatgcctcactcatcactgggcctgccctggcctcagccttcagtcttcatggaggccagcaattgctgccagcagccctggccatgccaacctccccaggtctggtccgtactattgggcctcagtttctccatctgtaaactgagagggcgggaccagacagcacattccacgagcacatcttgcccccttcccaagtgccaatcctcagacacccacgaaacacttccactgtgactggagtgaggcggcagttcatccgttcagaacaagacccccatgtgcacacgactagaagggcctacttcacaaaaattatggtggtaagttgcagctgggtggaagctctactggttttcattttacttctctgaatttctaatttctaaaatcagtattttaataatcagctctatgtgataaatgctgtttttgagacagtctcactgtcacccaggctggagtgcagtggtgtgatctcggctcactaaggcctccgcctcttggggtcaagtgattttcctgcctcagcctctcgaggagctgggattataggcacctgccaccatgcccagctagttctgtatttttcgtagagacagggtttcaccatgttggccaggctgatcttgaactcctgacctcaagtgaaccgctcgcctcggcctcccaaagagctgggattacaggcaggagcactacgcccagcctgtttttgttttttttttaagaagcaagatgggtagatttgatttgggatggagatccctagaggctgtttaggaagcctccaagccgtttggccagggagggtaatgtgggtgaggcgtatttcgaggcaggaggtccccacagggccacaaagaggtgaccgagacactgccctcggccctaagctcctcctcccatccctttcttctggggccaagctcccaatgcctccggaaactgaaagtccagaagctgcctgccactgactttatctcctctgctctctttatctccttcgctgagtgatgggcctgggaacaagcgcccacccgttttatagcccagaaggacaagtgactcatgaggacatagaggaatcaccactattctggccttgaaggtcctgggtgctggggcgaggggtggccccaaggaggctggagtggtgaagagtaaagaattcatcacactaaaccccccaacgcggctggcctggctccctcccatctgactatatcatctacaggagccagggcgggggagggcgttacttagccagtccctctggccggtgtctgtttttacaaagttcctcttcctgccttgttcccctacctttgggactcacctcccaacttctgggaagcctgatcactgctctggctgtacatgagacacacacacacagacagacacaaagatacacagagatgcacacacagagacacacacatagagacagagacacagacacacacacacacacagagacacaaagatacacagagatgcacacacagagacacacacagagagacagagacacagacacacacacacacacacagacacacaaagatacacagagatgcacacagagacacacacatagagacagagacacagacacacacacacacacagagacacaaagatacacagagatgcacacacagagacacacacatagagacagagacacagacacacacacacacacagagacacaaagatacacagagatgcacacacagagacacacagagagacagagacacagacacacacacacacagacacaaagatacacagagatgcacacacagacacacacatagagacagagacacagacacacacacacagagacacatacatagagacagagacacagacacacacacagacccacagagacacatagagacagagacacaggcacacacacacacacatagagacagacacagagacacagacgcacagagacagacacaggcacacacatttagagacggagacacacacacagagacattggaacagagacacacacgcagagatagagacacacagacagagacatacctactcagagacatagagacagacacagaggctgggtgtggtggctcatgcctgtaacccagagcttagggaggcagaggcaggatttcttgagcccagaaattggagaccagcctgggcaacatagcaagaccccattctccacaaaaagggaaaaaacaagtttgagatagacacagacacacacacacagatatagagacatagacacagatacacacacatagagacagaaacacagatacacatgcccccctaatgaaggcacagataaagttccctgcacaggatgtgttgcccaatgccctcagatcgggcgggcctgactctgcctcacactgttagcaactggggttggcattcatgggacgcctcctgcatgcaagaccctctcctgaggcctcctgtaagctgtggggacaccctaaccaagggcaaggccatcctgggacagcgtgtgtcaccagtggaggaacgcagcaccactcacagtgttctcctcaaaacccaaacctaaatcaaggcaggcctctgcatataactgccatttgtgggattacaggggacagagaaacatgttcaacacaccacaagggtgcaatccacaaatccaggctgtgggaacctctatgggacaaacaacccagtttcttcaacaaatacatttcagaggaaaaagaaaggggaaactagactaaaagaagggtcagagacgtctaacaaatgcaatgtgtggattttggatcatgatgtcagcaagacaactgtttaaaaaaaacaactataagacatgtggattgtctgaacactgctacatattggatgacattagacatctttttaggtgtgagaatggtgttgccgtcactagtagagttacatcttgggctatctgtggatggcatcacatgcctgggattcatgtaaacatctccaggggcgggcagggagtggggcagtgagaggtgaacaagagtggccctgcaccgatggtcgtgaaagctgggggtctttatgccattttctctatttttgtgtctatttggaattatccataataaaagttataagaagaaaaatggccagacgcagtggctcacgcctgtaattccagcactttgggaggttgagctgggtggatcacttgaggtcaggagttcaagaccagcctggccaacgtggtaaaacctcatctctactaaaaatacaaaaaaattagcctggcatggtgacgcgtgcctgtaatcccagctacttgggaggctgaggcaggagaatcgcttgaacctgggaggtggaggttgcagtgagccgagattgcaccaccgcactccagcctgggcgacaaagcaagactccgtctcaaaaaaagaagaaaaaggacacagcttgagactcaccctctgatgcctctgaggctcccagcagtcctccagagagggctacaaacttctgaccccgggcagtgactcctgccaggctcaccgtttcctgtattactctctgtgggcacaggggtcactgatggcatcttcactacaaaaggggttgggggctctgctgtggggactgaggccgtgggcagctagaacccgagtccggatgcccacatggggctatcagagatggctgggggcagtccaggtgaacttgggtgggtttgacactcaaggccaatgacaaccctgtgcttggcggttggagcctctgctgggaggaactaaggactctcgagatcactaagcactgcccggaagtggggggttcttatgaatcggcattgatcccttcctccctcctgccccagctcacgcccccccacacccccacctagccttcccaggttcccaacctccccccgggacgtgcacctgcctttccttgggggctacaaccacaagcccctggagagcacggctgcacagacctttcggaagtcgggacgctgctcgcagaggaactttaaaaggcaggctgtgaactgacagctggcagccagatcccacccacacatgtgttttgtttggcttgcgaagtgtttttaaaattttaagccaacagtaaaaggtcaggcgacttcacataaaaacccacatttccctcttctcctgtaactctgggtgacctgaccacaccgggtctgtgttcccaagtgccgccggaagctgactgcagctgccccctgtagccagggcatgtgtggggactgctctgacaactgtcccccactcccgcagtgcccagtgcccgacaccctggggagtcactgccaccccggaggggccaccaattcaacatgtgacaacccgaagtggagggaagcagaggaggaagagacggagggggacacacagatggaaactgagcccaagaaccaagagtgagcctgaggaccacagcgagggacagcgggagagggaggcagcaggcagacggaggcgaggagcgattccttgggcatcttaagtcactctctggcccctgagcagctgtctcgtttagggaaaaggtgtgttcaggctgaatctctgtggtccctcttctccctgctcccatacccagacaccgcggccagtggggtcttgatcccgcaaagccccccactgccctcaggcagaagaccactggcttggtgtggccccagctccccactccaggttccctctcagcagaactgctgcagctccttcttcatgccgccccttctgtctggctggtgcgtccctccttccacccattccttggccagtacatccttggccggtacctgagaggcagatcataaaagctgcccctgtggaccttcaagtcgggacccaggcctgccttaacgcagggccccagacagtgggctttgggcctggggtgcagttctgggggctgccggacacacagcagttcagagcgggaactgggcacagggcagtgactgggtgactgtggcctttggccatcaccttttccaacctgggcttggccaaggccgggaggaatggcagccaggtaccctgactcaggtcaggccctggtggaaaacctgtcacctcctgttgggcaggtggaggtcactgacccctttctgtctcttgtgatctatatttagagcctggggaggacatgaaaagggtgaggcctggacacgctccttggtcatttcccaacactgacgtcaccattcctagcctgcctaggtcctggggtggccctctgtgggcgggtgagcacacaccttggcaggaggtgacgcagctggaccacgcgtgggaactcccggcacagcgggcgggcctggctcagccccacctcccctgccactgggttcctggcaacctctggtggcttcttcctcctccttctgccgccaggatgcaggggtccccacaggcgagaggctgaactcagagctggccaggtgagaagcgaagcaccgaaccactgaaatctccaggagaccacactgggtggcagatgtgacagcaaccctctgacctcacggggcgctgccgtcccagcacaaccagaacaaggtgtgccgatgccgggagcagtgcaaacggccctggacggggatgcagagggctccggatcagcctggggctcgctgtggggccctgctgtcatcccttggaaatgggtacacccccggcatattgagggggaggcacgcagaggaacaaacgtgataaatgcatccatgggctgcaaatcgggggccgctcggacagctgtcccccactcctgcagtgctcgctgcctggcactgtgaggagtcactgccacccccgaggggccaccaattcaacatgtgacaggccgaagtggagggaagcagaggagagaggaagacatagagggaaactgaacccaagacccaaaagtgagccggaggaccacagcgggagagggaggcagcaggcagacggaagcgaggagacagggcgcagaggggctgcggggggtgctgggcacacctggctgaggaagggaccaaaggcccagagggtcccatagtctcagcctagtacctgtccccaagcccaggggccctgatcacaaggcagcaacgtctatcccacagctgtgataggtggggcacatcacaccccgaggggccccggcatccatgatctcccctcctggagggtggtcagccgccatcctggccccggactccttggaaatgctccacaaagtgccagctggaaatgtcacagcacagggggccttgggatgagccagccccaaggggccattctttcctgtgggtttggggaactcttttaagatctggagtgcagattcgggttccagtgcctgctctgtgtcttcctagccttagtttcacctcctggggcctcaatttctccatcagtaaaatggggacagtaaccgtcatagcaccagctctcaggcttctcaggggagcagacagtgaagcagtgcacagaagtccttggtaatccaagaagcaccctctggacggagctgccaggacagcccgcagccaccctggactgacccgtggggctgggggcagctggggaggccaagcgtgtgcacacgggcaccagcagcagagcagacccccagtctcctctctcatacccgagatgggagatgaagactcccctgtgagttccaaactcctccaaccagttctggcagggaagaaagggagtcctgggaaagcaactcccatgcctggggctcggcggtgacccacccagcccctccccggcagaggcactggttgccctggaaactcacctcggtggtggccggtgctggcagaggtgccagccaaggtgtcgggctttggagagcggcacgacgggcgacggcccttctcctggcggtcaccacagagacacaggcaaagaacacagagcccttcctccccctgggcacggcaggcctggcacaaacctggcctgcttcccgggccatggtggggcgagagccaggtggggagtgggccctgcgggaggccctctgccagtgtgctcgtcgcctgcgtgccctagtggagtggagcacccgagtgcctgggcctggtgtcacccgcgtggctgtcatacctgctgctgtgacaggcaggaccaggaattcccgcttgtaccaggccatgggccagccgaggacgagtggagaggctgccccaagctagcctagctttctcccttaattctccaagtccccactcccattccccctgtgtcgggggcctggaaaccaccacacagagccagaaaggtgacagatacaagtaaccaaatcaaaacagggttcggtcagcagagccaccaggcggatgtgagtctagccagaggcactgggaggcaggcaggagaccccactcacttgttctggaaggcttccctgccccctagacctgagctcttccatccctggcacccaggcacgagatttcctttcttctttttttttttttttttttccctgagatggaatctcgctctgtcgcccaggctggagtgcagtggtgcgacctcggctcactataacctctacctcccggttcaagtgattctcctgcctcagcctcccaggtatctgggattacaggcacatgccaccatgctcggctaatttttttttgagacatcgtctcactctgtcacccaggctggagtgcagtggcatggtctcggctcactgcacctctgcctcccgggttcaagcgattctcctgcctcagcctcctgggtagctgggactacaggcgcatgccaccacacccagctaatttttgtatttttagtagagatggggcttcactacattggccaggctggtctcaaactcctgacctcgtgatatgcctgcctcagcctcccaaagtgctgggattacaggcatgagccaccacactcagccacttggctaatttttttgtatttttattagagatggggttttgccatgttggccaggctggttcgaactcctgacctcaggtgatccacctgccttggcctcccaaagtggtaagattacaggtgtgagccaccgcacccggccacaagatttcattttaactgggcgcaggggtgggggatgccaatggtttgtttcattaagtagggtggtaaaaaataataatattaccaccactactcccaccattcagaaaaaacaccaccaaaggtaacaagaaagggctgccatcagaaagaagggcaggcttgaaatgagtacatttggcttttagaataatttactagagtgactactggagttgtaaacaaccaccaccaccaccacaacaatacaacaacttactaccttgtccctgtttttctcattttgctgcaaaccagacattggaagccatcagacgcatccaacacacccgtctgacaagtggaaagactgagccccagagagagcagggacttgcccaagatctcacaggaaaagtgtctgtccagctgctctgcaaagcttgcagacgctccttccatcctgacctgggggccagaacactcagagccccaaccccaaagcccagagatgccagggcgaagtcagaggccaagagtctcagctacttccttaccttcctgggaacctggccgggtggatgcccagtccctggctgcaagtggagggcacagggcagggagcagaacagcagaggcggggaggagagggtgtgggcaggggctgtggagtgcccccacaggcacatcaggccctggggcccggcttcccgcccagacactgccccagcagcacctcgctcccagccctgctcctctgagcatctcacatcctcttccggtggctttgtgggccttaggggacccagctgagcagacagttcagggcctgggagctctgccaccctcagggtggagactctcaggggatgtgggtgggcatgtgggggtgggctgggctggggtgggggagcatcagagaaatggagctagagggtttcaggggggccctgaaacctacctccctgtactcaccctgtggccagaacaagtcacctccactaaaatccctccaccatttctgtcccacccagaagagaatcccaagtcctcacctgcccacagccccctcctactaactccagctgccagtgtcctctgctgggaaccatgttcttcccccttggtctcaggactcggcccccagtcagagcagccttctccaacacccctgtcttaatgcagcaacaccatccctgccccagccacccattccctgttctttttcatctggcacacttcctcctctgtgccaggctccaaggccctgtcccctgggaaagtcaggcatcaccactggcctctcttgcgcacagtgactcaaccttgaccttcgaggaacagtagagccaaccaggctgtgaattggtcagcccaggactgaaattctgatccccagggactctggaaccctgggccaatgatttagcatctctgggccttagtttgctccttataaaatgggcacaagggcgctggaggattccacaagaactcagcatgggctcggctcatggccgtgcttggcggatgtgcaatgatcatttccagtggggattgaggagttcaggtgccaaagggttacatgcctgccccggtgccaggcacataacagacatttgatcaatgttggtggatgctgcccctgtgccaggagtgccatagcctgactccatccctggcagcaaggtccagatggcagtccggggtctgcccagtgctcagagtgtggcttgtaactggatcctagcagatagcttggaaatgtttgctgatgtagaagcacacacagatgggtactgcaaggcaggcccggtcccgggagaggggaccagcgaagaggtcactgtctgggtacacactattaacgggagagacgccctgtgcagacaggcaggatctgggtgaggcaggcggcaggggttggtatccgagcagggatccgaggctgtccccagcctcggcctctcaccccggtgttgctgactgcctggccatgtgactgtgggcattgtgtggtgtggttcggctgccactccaggtttaacagggagcttaccacgtggtttgagggggtggggagggctttccctgagcctcggtttccttgtctgcaaagtgtgacctcgcagcctagccccgtagaagggctcagtggccgagaaggtgtttcctacagtgtgcgcatgtttggttgggtggggggcttaaagaggccctggaaagaagcgctcaactttctttttttcttttttttttgtttgagacggagtctcgctctgtcacccaggctggagtgcagtggcgccatctcggctcactgcaacctccgactcccgggttcaagcgagtctcctgtctcagcctcccgagtagctgggataacaggcatgcggcaccacgcccagctaatttttgtatttttagtagagatggggttttacatgttggccaggatggtctcaaactcctgacgtcgagatccgcccgccttggcctcccaaaatgctgggattacaggcgtgagccaccgtgcctggccagaagcgctcaactttcatagtgggggtgggggaccagtagggaagtggcagggaaccaggccaccctgctggtgtgtttgtgagctaatgcctttgcttggacaagcagctcccgggtaccaggccctctgcagggccttgcatctctcacacaagctttctgtgctattcttgaatagcccactccagcccagcttcccaagcctgttacccccatatctcccctgcccccacctccagcacaggtcagcctggcctcagggcctaatcctggggctcctcctttcggagccagggtgggcagggctacccggggcagtgggcactgagcttgctggaaaggccatcgagggactgctgacacagtcaggctgcaggaggagcagcaccagctgccacgcagaaatgcaggagtcccgaggaggtggtgctggcaggaggggagcagcagggccatgcacccctcctcccacccacgtggtccctggccctgcctctgccgccagcctgggggagagcagggtctttgttccctgctggccaggccgccacgtgatgcgccacatcactgtcactgcctggaacgaagactgccatggacagccgaggcgctggggcctgggggtgaggccagttggaggagctccacctgcagcctccccaccgcaactctggctgccttcaggagctgggcctagtgagggccatacatggcacaaacatttccagctactgtgcatgaagcttacgacgaccctgaccccaggcttctcccaggacacacgacctaccagtggtcccacgatgctctgcccagcacgccgggtggcctgggataatgcacctggccacacacacaagcccaggctagcaaaacccaacccacaggcacctttctaggtaggggcaggccctggctgggtgtgaggcccattgtttacaaacactgtgcagctgtcgctaggagctgtgactcagagccagagcagtgactcctcgcgaagctgtttactcggcaccacatcctgtccaggaagcagatagcagaggccgaggcctggcttttgctcctctttcctgctgctaacttgactcagggagctgctggccagactcggtgtccagctggggggacactccagctcccctccccctggcttctgggaacctgaggccccgtcaagtcgctcaacacacattcaggcccagccggctctgctaggtagtgatgctgtggtcgtgcaggagacagatcctgcccctggaggctgcacctatgcctggcatcccctccctctttggctctgactaggagactcccagggacgggggcatcactgacacctgtcactgtgcagcccagaggcaaattcttgccacgttcagaagcctggcaggcaggatcaactcctgacaccccttcgtaccctagagcctagtctggcgccgcctttagcacacctcaatggggacaaagcacttttccagacagcctctgccagaaagatgaggccacagtcatcatctctgttgtaaaactgagaaaactgaggcccagagagggcgaacaacttgcctgatgtcacacagcgtgtcagtgccaaggcagggtgtaagtccggcccccaaggctgcttgctttcctctactctgttccaaattaaggatcacaagtagatttgttccaggcagcacacagacttgacgctgctgggaccctgtccctggggtgggtggtctgtcccctgtaggaggcctaggctggggactctgacttccatttctgctgatcactgctgcctccaacctggcgcctaaaccagagtcaacaaccctctgataatttctactacgcactgccatgccaatgcgggtatcatttcaccatcatgatatgtgacgcaggttttgcaggtgagtttgaggatgaagctcagagatggcacaaagctcatccaaagccacacagcagagcagggcttccaatcctgtctgactctcaggtttgcgctcccagtcactccttcctgcaaactcctagcaggaagactctttatgacttttcataaagagtcaaaggtgattttatcctcacggtgcccttctaagttcagggtgcaagtatctcaatgacctccagttcacaggagggcccctgtgtgtggtggggaggcagagccgcagaatgacttgtggaaggctacacaccccagtggggaggacctttcccctgctccaggctagggagacccggggactcccaggagcagcagagccacaggacacacctgccaaggcatgtggaaggtgggccaccctggagtggggagagaaaggcaaagaggggctgtgcttattttggcagttggggcttggcaccaccccaggcaggacagtaattcagcaactggctgattcacccaccgcagggctcccctgcactggctgcctgcccgccggcccctattaccagcccactgagtcacgcaggttgccaagaagctgaggatccaagaatccaggccctgccccagccgctcccattggctttgagcccagcaggacccagccctgccaagggcaccgcagctcccctccccaaccctgcctgcccccaggtccagctccaggaggaacccaacgtctaactgtaaggatccaagcagtggctgggagctggggcctacagtgtcaggagtcttgggccaaaccctcatcctgtcacttcctggctgggtggagctgggtgagccaggcaggttcctttcccttgctgagccttggttctagcccatcaacagggaacatctctgcctcaaaaagactgcatgctgaaatgaaacactggatgggaagcactcaagatagggcctggcacatgctccgtgtcaaaaaaatggcaccccaaggtggcatcctctgcagggaagaaccagagttcttattttgaattcaaggccagctgatacttctgtaaaatgcaggtgaaatgttgcagcaatgtcaactgccatagagtttctaaacaatgtccatttctctactgaaggagatgaggatcagtaacagagtttgtagcctgcactgtctgcagaccacagagagggcccggggcacaactatattcacacagccagaccacgcgaatttactgaacacctactaggtgccgggcactattcaagtgccagcgatagaccagggaaaaacacaacacataaaaatcacctttggcctaggtcataataagtaaaatgcatttttgaaaataagaatgctccagaaggcaaaaacagaacagggaaggctgatggggcccatggggcaggagcaggtgctacaactgcagacaggccaggagggctgagggggcagcgcgggtatggatggaaggagggacattaaaacatttcaccttggccgggcgcggtggctcacgcctgtaatcccagcactttgggaggccaaggcaagtgaatcacttgagctcaggagttcgagaccagcctggtcaatgtggtgaaaccctgcatctactaaaaatacaaaaaaactagctcgggtgcggtggctcacgcctgtaatcccagcactttgggaggccgaggcgggtggatcatgaggtcaggagttcaagaccagcctggctaacatggtgaaaccctgtttctactaaaaatacaaaaattagccaggcgtggtggcggcgcctgtaaccccagctactcgggaggctgaggcagagaactgcttgaacctgggaggcagaggttgcagtgaccaagatcgtgccactgcactccagcctgggcgacagagcaagactccatctcaaaaacaaacaaaaaaactagctgggcatggtggtgcgtgcctgtaatcccagctactcaggaggctgaggcaggagactggcttaaatccaggaggtggaggttgcagtgagctgagatagcaccactgcatactccagcctaggcgacagagcaagacttcgtctcaaaaaacgaaacaaggctgggcgtggtggcttacgcctgtaatcccagcactttgggaggccgaggcgggcggatcacttgagctcaggagtttgagaccagcctggccaacacggtaaaaccccatctctactaaaaatacaaaaaatagacgggtgtggtggtgcacctgtagtcccagctactcgggaggctgaagcgggagaaccacttgaacccgggaggtaaaggttgcagtgagctgagatcgtgccactgcactccagcctgggcgacagagcaagactccgtctcaaaacaaaacaacacaattcacctaccacggggtcctttcatgccccccatggcggggagtttgtaagctccttgagagcagggactctgttccccagggtcctgatgcctagaacagcatctagcacacagctggctctccataaatgcctagatgaacaagtgagctcgatgggccagactctaaaatattcggaggttcttgtgggaagatcaccaggagagctccttggaagaggtgatgaggctggagaggagcctgagggagggcagggggccggagggccagggaagggcggggcgcctctgctcacctggctccctcccattaaagtgctttccccccaggaaccaggctgagaagagaggcagaggcaagccaggcgggggaagagcgaggaggaaggcagccaggctttctgggaagcaagagccctttttcttagaagcagggccctggagtttcccagaagccagcctgccctgggacggtggaggcggtggtaggtggtcaggttggccctggtttaacctagggggttttcccttcctaaattcctggcccaggaacaattcttggggaatgggtctctgttcacaggtaagtagaagttgctctgctgtgggcagagacccctccccaaggcacagccgtggctggtgaggatgggggatgggggctgagcccacagtcaggcccctgtgtccagcaggccctggtcgcccagtgcgctcgggccaggggaaccaggacaaacgggcccttgtggttgggaggctgcctgccgtgccagggacactgtgtgcccggtgccgccaccagcctgctgcctgcctgaaggggctgagggcctgggaagtggggctactgtttccaaagggaacctcctaagctgccctggcctctggagagggcacagggccttggctggctgccaggaggtggcagggctggtgcccgctgccctctttctcacagtcctttgcctgcaagaagttccccagggctagagaagcgcaatcccttgggactctagggccctgggtctgagggacactgctgtgtcccaccctcctgccacccactgtcccgttaatccctgggcttggctccttccttggcttctcccctggaaggcgaggctcaagggcctctcctatctgcctcacctgggatgcctgacaaaggacagcaaggtaccagctgccctcccctgcccagggaccctccaagagctgttcaggtctccatgccagcatcatggtgggcagctgggtgtgccaggcagtggctgagcagttcccagccaccacaaccctgtgagctgggtccggctgtcaacccagtgacacatgagaaaactgacactcagccctcctcatggtcacggctccggcctgggcctggtgctttgtttgtttgtttatctgagacagagccttgttctgtcacccaggctggagtgatctcggctcgctgcaacctctgcctcccaggttcaagcaattctcctgcctcagcctcccgagtagctggaattacaggtgtgcaccaccacgcccggctaatttttgtatttttagtagagatggggtttcaccgtgttagccaggctggcctcaaactcctgacctcaggtgatccacctgcctcgacttccaaaatgctgggagtacaggcatgagccaccgcacctgtccaggtctagtgctttaaaaaggcaaaatgcaaacccccactccctcccacactcactgtggcaacgtgctgtccctccccaggcaccagccatgtgtccccacacgcagccacacataccccttcatatatgtgctccctcagccactgtcaagcttgtcacatctgagcacatgcatgctgcagacatacagggtcacccaaaggcagagagatgcacctgcccccaacacacgtgctagaatgcacatgtgccccaccgcatcccacagcacacagccgctgcccctgcaggcccagaggccctggatacacaccctgctccctgcatatctgccagacagcaatctcctcagggctgcggagaggggaggaggcagggctccatgcagggactccccgaccccagaagctgggaaggaaacacctcatggagtcctgaagaacggcaagcggctatttcgagggggcagggggaccaggcaggcggtgccgccagctgagaccttccacactgggcactacccacctgcccactacccccagctgtcacctccccagccacccagggcctggggccaggtggactgcttcacccttgaactccagtcctgtcaactgggcagcagggcctggaacttggcctcagggaagaagggggtcgggggagagtgggatgcgtggcctgggcaacttactcgcctcctcggggccgtagttcccctacctgaaaaaaacctgtggattcaacttagggcctgcaagtgtccctgccctccacccacaccctggctccccaagggcagcgggagctggtgggccatcggccatctcccttctgcgaagcggagcagacattggctgccatctgcggagggcctgcccatgcggtgccaggggcctcaggaacatctcatactcccccacatccgtaggcccacagaggaggcaatgggggtacagaggagttaaggaacccacttgtctgggtcccctgaggccaagccagggctcccatcccacctcccaggcttctctccccttgacctctagacagcccgaacttccctgcggctgctgttcctggtgaacatcgtgacagatgacagcactagtcaggtgattaatcagctgatcacttgatcatcgggacagataagtgctgctgcagctatagcccagcaggggtggggtggggtggggtgggagcgggaatccctttggaatggattcaggtcaggtggtggcagcccccaggacttaaataccttctgccaccctccccatggtcccaccctccccacggtcccaccctcccagttttgaacttacattacaggcaaagggcacccccccacacacacatctgggatcaggacaaagtcccaagaggggcgggtgccagaggtgggggaagttcctggactcagggcctctggttggccaagggtgctttcttctttctctccactggacaagcccacccctccctgccttcctccctcggaacacaaaggtcagatgggcacacctgacctctcgggtggtgtccagcagagaggtcctgcacccttcccatgggagccctttctggaccctaacctagaaagagggaaggactggggtgccctccagcaggcagtgggtcccggccccccttatccttcccagaaggactgggcagctcaattcagttaattatgtgcccaccatgcagtgcagggaggggaggccaacgtgggggagggggtggggaaggtccttagtgcagcacccacgcagggtgggtggggctgtgtgcctgaatcttccctcccaccaactggcttcctgcagcctgttccttggtgctgggctgggggctcgcctcatccgcccgccttcttggcgtggcatccggcaagaacgtgggccggggctgcacgcaccttgggctgtgggccggcagctccccgccactgtctgtgctgccctctgccctgcccctcctcctgtggcactccagctgggggtggctgggcagagtccccatgggatcaccctgagcccagccgacgacccccaagtgaacatacgagcccagtacccaactccggaggtgggcacaccccttgcccatttgacagatggggcaagggaggctcagaggggtgaaatcatgacccagggtcacacagtgagcaaatgaccagggtcagactggcatcctggctccatgagagcaccgggagttcctgcagagttgtcaccaacagtcctaccctcactgccatccccagagagaacatctgaggcaaccaggtctcatagccttcccatccccaaagtccaacccactgggcagtgtggccccacctgccttttcccaccattctactgccccaccctctcccagggtctggggctccacctcgctccttccaggctggacacccctcatccatgttctcacctcggctcccgcagtgcccaagtctgggtgcagggtgggtgcccacaaactaaggcagcccctatgggagcccaagggcagggctttcttacaccctcacagcaactgcggggacctcagggcagacagggaggctcagaggggacctgtgctgcttctaggatgcccagcaataagcgctgagctggaatttggacccaggtgtcctgctccaaagccacctgcctcacctgaggaccaggggcctgatggccgaggtggatgccgacatgtgaggaggaagggcagtggcggcctggtcctggtcccctcactctcctgccccaaggccccagtaggtgacataattcacagggcaatgtttatgcactgaacggtaaacacacaggcagaggggtagatgggccaccaatggggaaactgaggccagcgagaagggacacactaaggtcacatagtcagtcggtatcaaagttggcccagaaccacagtcccctgttccaagggctgtacccagcccaaccacaacctggcatgccatccagccccaggccagggagcccacggctgcagggcggcaaagcacacggtaccacacgtggtaccccatggccccacacactctggctggcaccgagccatcgctgtgctttctgaccttgcgttttctgacattctgccactgtcaactctcactcaggtatccaggaagcggcctctgttgctaggggactggcttgatgccgggtggctggcagagtggggagatggggaggggggagtggactggggtgtccctcaggaaggatccaggggcagagtctactgggtcctgtgtcagggtggagggccatgagaagtatctgaggaaactcagcaggtcaggccccttcctccccaggctctaatgaaggtcctggaccctggtctctgcattttctctttcagcctcagagtcttctttttgggccaggggtgggtgtgcgctggtgggggttggaagtgagccatcggaaagcccatcggaaagccccagcccggagccttcctgcaggcaagtattttgggggccagcagttgccaagcaactgctctgggttgccacgggaacactcccttttttctggggcttgtcattcttagggggatgccacaatgcttcccgttccctttcctctccacttcctcaccctggcttggctgccctgggaggggacactgggagtccataagctcacaccccacccctatgggggggcccacatacccctggccctaagactctttgaggctccagaatcaagaacccccaaaatgcaaagcccagagtccaaggccttcattagagcagggagacgatgaaaggggctcattagctctgtttatgtctccttgccgccattaaccaccacttggggcctagggcctcccagccccgccctgcccagcagccgggcccagccctgaccgttggaaggccactgtaattggaaggaatgtggtcctggtgcctggcccttcccaggcttgtgtgcacacggggaggcgccattgccaagctgccactacctagctgtgggagttccttccccttccagtgcctcagtttccccacctggaagtgaggatggcagtggcacttatcttgcagagtgctgagcagatacaagggacactttagcacaaggcctacaggctggctgtcatcaccaggcacctctgcagcaggggacagagggaaggactctgtggagaatagtcctgtggctagcgtgcaatggtgactgaccacgccactgatggcagagtggccactgaatccaggtccccaggctcgcagcccatgccttctccacaagatctgtctgccccatacccctgagccttccacagaagccagggtgcttcccacaggccaggcacccagcgccagccaggtgtacagaggccagtatctgctgtgtgaatcaatcgctgaaccaactgtcaaggaccagcagcctcaggggcgggcctggtagctcggtgagcgaggaggtggtgggagggccttgtgcgggtagggaggtgacagtaagaaatggcctcttgctggatgcagtgtctcaagcctttaatcctagcagtttgggaggccgaggcggggggaatcccttgagcccaggtgtttgagaccagcctgggcaacatggtgaaactgtttctacaaaaaaaatccaaaaattagctgggagtgttggcgtgcacctgccgccccagctactctggaggtctgagcccaggaggtcgaggacgcagtgagccgtgatctggcccctgcactgcagcctgggccacagagcaagaccctgtctcaataataataataataataataataataataataacaacaacaacaacaataataataataataataataataataataataaaataaaggaatggcttccactcattccactcctgggccagcggcccgctgtgcactccgctccctttcgctgatgccatgtgagcagctccatggcggggacctgacccctgctcctcagccccacactgcctcgcccctttgtatatcaaaggcgcctctgaggggctgtgctgacccccaccaggagcagcaggaccacctcaggcatcccagctcccctgaggcagggtctggggctggggttggggggaaggacccctcaagtctctatctgcacagacagcccacccgtgcccagggctgccttccgagcacccgcagacctgggcctgcagtaacaggagagctatctgcaaaccgcagtgtcatcagccgcacggcctctggagaggcctgagaaaggccggctcagcttgcaggcgaggaaccaaacgaaaggcaaactcctggcccctgcagcctcgcaggtcccctatccctcctccctgccttcctttccgccccgctgacaccacggtctgcaaaccatggtcctcctcgccacccctgtcacctcctcctccgccccccgccggcctccgacgcaaagtcgccacccagtcaccccgcctcggccccgcctggtttgatttcctcccgtgtgtgtcacccatgaggtggccgtgcccctggcctgtttacagctgtgcgcaagctcctcgcgacccgaaagcgagacctttgtctgcggcagctccgcgccgggctgggcggccgcacgggagggcacagcgccacctgctggtgctgccgccagagcgcgccaagctgaggagcaggcgggctccgctcacgcccccacaccccctggctgggggctgggttcctgcgatgtcttccgactccccgctgctcccctagtccccgtaggcacgcgggtacccggcctttgggagggggatcattcccaatactcctgttacgggttgaactgtgtccctgaacaaaaagatctctggtacccgtgaatgagatcttatttggaaatagggtctgtgcggatagaatccggatgaggtcatactggattagggtgggccttaatccaatgactgctatccttatgataacagggaaaattggacagacacgcacaggcggacagacacgaactgatgaaggcacagtttgcagtcacacgtctacaaaaccaggaacgaatgccaaggaaactggcagccaccagaggttggaagatgcaaggaagtatcctctcctagaaccttcagagacagcatggccttgctgacccctggattttggacttctggcctttagaactgtgagagaatacatttctgttgtgttgagccacccagcactttgtgacagcagcccaggaagctgacccgatagacactggtcccagtcatcaccctctgtgccatcaccacacctcccctccacgaatcaaccacgaccacaggacacctccttctggaatctctctgtgcccacgcactccccagatgagcacttccccttcccctggcaactccccggattcttgttacccccaccccccgccccggcatggcctgggcccaggagacagatacgaaatgaatgagtgaatatccacctttgctacttcgtcatattcagatgttcgtaaaaatctgtatgttcgtcatattcagatgttcgtaaaaatcaagtggcagcagtgctgggggttaaggaaatggggagagtgatggcagatgtgtgaggggagacaaggggcacttccaggtactcacagccaccctgggagctgggacagccaaccagtgtgttctcatgctcccagcccctgaggctcagagaggggaagccatctgggtcaccaagctcctgcctcttgccagttctgtgaccccaaactagccattgtgcctttcagggcctccccagtctcctgacctgcacaatggggatggttctaacgtctacttcctggggacatcaccacgctaatgtgagacaatactacaaaacctgttagctgcctcacagacttagagatggaaggattaggaaggaaaagggccttcagagactgcagggtcctgctgacccctggattttggacctctggcctttacaactgtgaggaaagaaacttctcacaggggcgagacacagcccggaatacaagtcggacaggctgggcactggtgctgtgatctggggaaagtcactcccttcttggtctggtttcctcatttgcaccatgaacgggttgaaaatgaagcaaaaatcagatatcggccccctgtggcatatgggagcatcttccaatgggaacaccttccaatggctcccatgatgtttgtttgtttgtttgttcgtttgtttattgagacagggtctggctccgtcgcccaggctggagtgcagtggcatgatcttggctcactgcactcatcacctcccaggttcaagtgattttcctgcctcagcctccggagtagctgggattataggcacctgccgagacacccagctaatttttgtatttcttttttgtagagacggggtttcaccacgttggccaggctggtgttgaactcctgacctcaggtgatccacccgcctcggcctcccaaaatgctgagattacaggtgtgagccaccgcgcccagcctccgttatgtttagaatcaggcctgactgcctcctctcagacactgtcccaggcagcctccacactggccccagagatccctgcctcctggtacataagttgctgagtgatccccttcctccgagggtgattggatttagtgactggcttctcaccaacagaacacagcacaggtgatgtgaggtcacttccaagatttacaaaaaactatgacttctgtcttgcttgtttgctcttgttttcctccccaccttcacccctcactctggggaagtgagttctgatgccgtgagctgcctgccctacagagagacccacatggcagtgaaccaagggagggcccccaccaacagtcacagaagaactgatgccctcagtcaaaactgaatcctgccaataacatgagaatggcctgggggcgggtcctgcccagtccagccatggatgagaccccagtcccagcctcccttgagacctgggggcagaggcacccagctgagctgccctggatctgggtccacagaaactgtgtgatgatcaatgtctgttgctggaagctgtacattagggtagtgttgtcacatagctgtccacaggcccctgggctgcccctcccacccccagctcacttgggccacactggcctcctttctcactcctctctggccaaactcatttctgcctcccagccctgcctgctgagccttctccatcacactgtccagactcgtgcagggctggcccatgctttgtcttctggtcacagcacagatgtccccttagcgagacctctcagatccccacccagcaggccccagccctccatggcagccccggcattattttcgctgcagcactgctttttcctttctgtgcctgtttgcttttgtgccctgtccatcgccccctccagactgccagctctggagggcaggcccccctgggtcactttcagagccacacccaagcccaacgctgcccccccacaacccagggtgagtgcttgggcacacctgctgaagggaaagaggaagctcttggagccccctcccgcctctgagcagctaacattgtggagagggatgctagtaatggggggtgtgcattgggtagaggccggggtcccccagagggaccctgccgggctctccctgactccagttgctccaatgagtacagtgggcactgcctccccctggtggccggcactagcacagcagcagcagcctcaggcagaaaacccagaaaacaaaacacacacctttgtttgggtgttgtcaaggtagcagctctcctgagtcccagggggtcaaaggagcagaacctgcaggctccaggggtaattcaaggcgcctcagaagcttcatttgctcccctctttccctctgctggtcctggggtgtccagttcactcgtgaggcctcctcactccaaccagggcaacggctctggccccacttccaaataagaaccctgaggctccaacaaggacagtcttgtcccacaagagttgtccagtgcttggccacgctctgcaccaccccaggccctcagcccttcagcccccccggcttctcttgctcagaagaacctccaagaagaaggcattttccacagacctcggtgggtagtgggggcatccccagtggagacctaaggccgacagacacgtctacgagcctgtgggacccttggagtcacccaggccaaacattccaatttatagagcaggaatttgaggcttcctttcctacagccccgtccacactgaaggggtcttttcctgcttccaggtgatcacagcggtgaacacagaaccccacaatctgtcctctccaggctgccccagcccagacagatcctgggaaccttggagaatccccgcccatcaagctggcgtgtcctccccttgccccccaccccgtgccatggccccaggcatgttgctgggtactggatgcccctgcccgtggcagagtagcccccgccctctttcttctttcccccagtcacttccccagcgtcccgtcctactctgagccccaggaagtgtgtggtgtgtgtgtctgcgtgtgtgtgagcatgtatgcgcaggcctgcgcctgtacgtgcgcggagaagcccaggcaaatgagcccacatgggagatgggcaggggtccccaggatcttagaggctgtcattcccaaagcaaaccccacgggaagggtgagccgagcccttcctggcctaagaggccggaaccctcccttcatctctggactccgccaacttcgtgtgccccgggcgagtccctgcccctctcctgtcctcagtttccctactgtcccgggcggggttggacgcggagctgcgtaagcgcacgctcagcgtggacgcggcgccgggctccctccccccggtgggtgtgggctggggcatacggtcctccctccacccgcgacgcgaggctggggacggcgcgcactcacctggcaatctaccatcatcctcagcctcggtggcacatcgccggccccagggcgggacccggggctcgcagaggccgctcgcctgggcccgcgcgcggcgcaggggtgcgcccggctgcggggctcatggcgcggcctccggtccccgccgggcccaggactctgcggccctcggggccgccccggcagccgccagcgccgctcccattgtctgcgccgcgccgcgctccggccgctcg

SEQ ID NO: 2022 - DNA, 20069 bp, Homo sapiens
tgtgtctttctgtgtgtgtctgtgtatgtaatggtgtgtctctgtggcggggaggggctgcgtgtgattgtgtgtctgtgtgtgtctttctgtgtatgtgtgtgtaatggtgtgtttctgtggccggaagggcgtatctgcgattgcgtgtctgtgtatgtaatggtgtgtctctgtggcggggagggtgtgtgtgtgattttgtgtctgtgtctttctgtgtgtgtctgtgtatgtaatggtgtctctgtggcggggagggtgtgtgtgtgattttgtgtctgtgtgtgtctttctgtgtgtgtctgtgtatgtaatggtgtctctgtggtggggagggggtgtgtgtgatttgaggtggggacggggcctaggcttcagttactcacaacaggacggacaaaggaaacagagtttacccgttctgctaaaaccaagggcgggagggggacggggctgccggcagccctcccagagcccctggcagccgctcacgggttccggaccgcctggtggttcttgggcaccgcagtgaacctcagcttcctcaggacggcgggccagcccagcagctgctggtcccacaagtactcgggggagagcaccttggtgggtttgtggcgcagcaggtacttgttcaggtggctctcgtcgtgccacacggcctcgatgccgttggcctggtcgaccatcatggcctggtggcaggccctggtgagccgctgcacctcttgcaccgaccccccgaagaacccccccaggtagtagaaatcgccctcgtccttggggatgtaggcctgggactggggccggcgctcgtaggtgaaggcctcccggctgcttccgtagaagccggggtgcagggtgccgaacagcggagtcaggatctccacgcccacgtggtcgcggaactccatgtccacgtccacgcacaccaggtaatccacctcgctgaggaagcgccgctcgcagaagtcactgatcatctccatgcggcgcatggacacgtcctgccagcgcttgtaggcgcgcacctccagcactgacagctgccgaccggtccccagcgtcacgcggggcaccgcggccggctggtcggtgaagacatagtagtggacacggtggcccaccatgaagtgcttctccgccgtctccaggaacagcttcaggaaagccacgtatctgcaaggcaggcggacgggggctgggggagccgccggccgtgcacccctgggctgcaggaggcccgtcctgcacccgcccgccagcggccattggaaggcttagagcagcagatgcaccacgttctcctgccctgtcctgagcgagtcctcgggctgcgattcacttcatcctcttcccagcgatgggggaccaccagcaccccctcttactaaggagggctgagggcaggtggctggaggctggtagcaggccgcaggctggcgtctgctcactccccctcagcctggcctgagccacgcctccccacgcagctgcccctcttatggccaggccggccacgtgctccctcattataagctgcacgcgaggcctccacacacccgcctctgcaccctagagcttcctccctccaggcttgaactgcacctattcctaagagtaagtcattcctggcctccgccactgtcgctggcccagctgcccacagctgccgagaagtcaagtatgtgtctgcggttgcctggctagctccctctctggcctggcccagagtcccagggccttgtgggtcagccacttcctttggtgtctggggccaactgctttgcctgccccacctacatctgacagagaagtgaccacggctctgccagcatcctctttctagggtccaaggacagcaaacaggtgtccccctcctgctatctctggtcagtgagcaggaaacatctggagccttgtattgagggggtggctcagcatgacggccggccacagttacagagaggagggggcagcagaagccaccatccctgggtgagacgcagcctctggagaaggagctgggttttaccgacctggcgagcccacgagcccacgagcccacatgagctcagtaagatgctgcatgaatgacctttcccatctaccctctgggaggacaaggctggccgccaccccactctgtcttgaacacaaggagagacctcaatgtccacagtcactcgccactgcctgggtctctaccctcggccacctcactgacttacttcttgatggcaaacacagttaacccaatggtggtgttctggagcctgaactgctcgttgaggatgtcgatgttgaatgtgccctcccagacaatgggagccagccaaggggtaccacgaggacatccttcctactgcacatggagagaggcgtgcggtcacatggagctggcagggtgccacccacatgcgcctctggcacacggccgcccccacctggaaactccactcagcttctgcctcctctgaccacccttccagaggcagccgcccttccccgggaaaccaaccagaggcaaatgcgactccaaccgggcaaatcattcccagccctccctcaacattggacctgtgggaacacacagcaagctgagctttgctggcaaagagataggaacaaaccctccccagcacccaacccccgctgcccctccccaggtaggaggtacctatcaggcctttgcaggggctttggagaacaaagggacaggaaacaagagacgcaagtcagagaaagcaaagggaaagaggacagccatgtgggcctctgaattcagatgtcaggagaatctgagaggagagaacggggaagcagccccaactgagatttacatcaaggaaaccgccctctaataccttcagaacagccccttgagctgcgttcagtttcagtgtcagtaactttactcaccacggtgtcagcacctttgactgggggtagaccatcctgcaagcacaaagcgccgccacgtgagtttgcatggaaagcgtgggatgcaggtaagcagggggtgtgcacagccgctgaaccatgactgggcattgaccctcccgccaaggccacactcccaggctggaatcactgtggttgcttgggggctgtgtcagctcataatcccgggacctcgggaaagggccgaagctcagagtctctgattcagcacttataaactggcaagagggactaagtgacctcaggggccattgctttccacttgacttaaggctgggagggacgtaaggggttgtgtctcaattcactgtgggcagagaggaggctgggtgtgtggcctctgtccctggttgttcccagggaaaggccctgagatgtgcagacctccccacctgggcccgaagcctgctgggcctccttgtgggctgctggcttccagagcccggcttcctctctgagaagtgggagagtgacacctgctccacagtggcacaaagcactgtcaagtgtcacacgcagcctgtggggacgtgtgggccgcagtactgtccccacctaaaggattgtagaggctcaggagacatgagccggggccattttaactgtcagtaatggccacaatttgaatgtccaagatggcctttaaaagcagggagtcagcagaaaacaggaaggaaattctgacacttggtacaacctggatggaccgtgaggacatcacgctcagtgatttgagcccgacataaaaacacaggtaccattgactccacttataaaaggtagttggagtagcagactcataacaacagaccatggaatggtgagctgggggagggaaaatggagttgctattttatggggacagagcttcaggttggcaagatgaaaagagttctggagatggatggtggtgatggctgcacagcaatgtgaatggacttaacgctactgaacactccaaaatgactaagatggcaaattttatgttaagcgtatttcatcacaatttaaaaaaaatcaaaagcagtgtggccagcttggccttgattgcctaggtcagcactgataaaggcccacatcctgggaaacagccctccaaggccccagacagaacagaccagctggtcatcttctttaaaagccaatttgaaggccaggtgccggggctcatgcctgtaatcccagcactttgggaggctgaggcgggcggatcatttgaagtcaggagttcaagactagcctggccaacatggtgaaacgctgtctctgctaaaaatacaaaaattagccaggtgtggtggtgggcgcctgtaatcccagctactcaggaggctgcggcaggagaatcacttgagcccaggaggcagaggttgcagtgggcagagatggtgccaatgcactccagcctgggcgacagagcgagactccatcacacacacacacacacaaaagccggcgacacgcagctggtcaaaactgaagctccagctccatcgtgctctctgagtggctgcaggatgagggccaagtcagggtagagactggggaaggagcggccccctccctcagagccacaggaggaaagaggacctgccccagctcccacatgcttctgtccacacgcacacatgtgccagggctgcaggacaattctgtgacatgggaggcactgaagggaggcactgacattataccttggcaacgagacatgctgcagatggtcaggttccctaacagccatgctgcagaatgagaacacaggagatgaagtttagtctaggagcaggatttagggcacaagtgcatggaagccacccgagggtcccagtggaagggacacagcgtcagcctggagtgtggagcagaggccaccagaaacagtcacagaacaaccatcactgtggcgatgggcctggcgtgggcccgtgtgccagaccctgtaacggccaacgttgcagtctgaggtctacgttcggggagcctcacagcccacacattcaccagacacgtcgaagccaaggccgggcagagtggagtttcagaacatgtctacaaaccatgaggccccctcccatcaagagatggggtctgatattctgtgtttctaagaaataaatgcagcagaagtgacgctgggtgacttctgaagccaggcccaaaaggtgatctggcttctgtctcatctttcttgggatgttggtcttggagcctcccaaccaagctgagcaggagcccaggccccagggagaggccctgggtaggtgtctcagatgacagccagcatcaactgccagagatgcagggaagtctttgcagtgaccccagccactgtctgcccatgactgctgaggccccaaagtgaaccacccagctgagcccagtccaccccaggaagcccagggagagatagtaatcaatgattgtgattgttttccatggatggagtggtgtgttctgcagccatggatcactgacacgagtgggaattagcagacacagcaggggagagacaagagtggtcccaacagaggccatagcacaggcaaaggcctggagtcaggacagtatggcaggtggacgagtgacaggccacgttggctggagcacagagggcgagggcagaggagggagagatgaggctggggaggtcaggaaggcaggatcagaacatggagagcctcctaccttatgttctggaaagatcactccagctactgtgagaagaagggggacagggctgatggggatggggagacaagtctgaggctgtcacagagatgagggcagccccaccggagccctggagcaggacgtcgaaggcagggaggccagtgggcacgcgagctgctgaagagcagggctggcaggatttgggaacccagtgtaggggtgagagcaaagggagagttgaggatggctggtggaggaggggtggggatgggggagcagagaccatgcatgggaactctgggtaagcctggagttggagactggaggtcagaagggaggtcaaggctgactccagaggtatccaggtgacccttcaaggccacagagttgagcatgtctacactgggcagagcatagagagcgggcccaggaaggggagggggagttcccagagtgggacccccgcccacagccagcaccccggccagcatggatgctccacctgctcttccctgcactcaccagaacccccgttccaggcttcctggcattagacttctggggcttaggaacccgtaactgcagaaaggaagtgtgccaagactcaggacacagaacgaagactgcctgttggtcccttcctccaaaaagtgcatggtgcggccagcagcgtgagcacaagagttcccggtgaagctgcaaggcctcgaggcaggtagggcaagttctcagcaaagctcaggcgcctcgccacgtcccacaccgggaggtgggcaggagggtggtccctgggatattgctcacgtatgggcacctgctggagctccagagccccagctccctcaccccccgccaccagtgccttgatcagtgcagtccctgaggccacgtcagggagtgtttccaggccgtgtccagagatgccccagtagaggtgacaggtgacttcactcttggttctgggaccttctgtgtctggaagcgactaacagcttgggacccagaattgccttccccacccccagccacgcaattgtgggcaaggggcttgctctcccagccccagactccacacttaggaaaattttaaatgggagtgagatgagcctgttgcccaggtgaggctaaaataagggagcaagtaagcacaccctccgccagagctggacgcaggcaataactgtccttaggaccctgataactgtgatacttggggagctcagggaggccccatgggtctgattggctgctgtggtcacttctccccaaaccaggccagcctcgatggtcaaatgtgtcttacccaaacaagaccaagacaagcattattaggaaaaggatcataggtcgaagtgcgtggcattttggttttcctggaaaacaggagtagaaaaatcacatcactcaccctccttctctcacctgccccactttacctgtcccgccttgtaattcaggcatcacaccctgcgacgggccttcatctgccaagatggtccctctgccccacaggtgatgctctgagccccacctgagcatctccaaacccagtccagatctggccctcctcccactcagagaagagggaggcggtctgctcctcccagctcatcagcccgactgctcctgcagactctgagagccaccccggcttcccagtgacctccttccactcagcacccccttcccctgggagaccggaatgaaccacactgaaatgagcacgtcgaggtcactgtcgaacccaccgagggaggccaggacagcctcatggccaggctgagccaggagcccagaccagttcctgccagggagaggagccaccaacttcccctagtatctccctgctgtctcagaggctcatgttctggaaacaatcattgtctttaaggtgattttatgtatattaaagtcacgtacagtagtgcccttatccacaccttcgcttgctggagtttcagttacccatggtcaaccaaaggccaataataggtgagtacagtacagtaaaatattttgaggacaggcatcgtggctcgtgcctataatcccaggactttgggaggctgagccagcagaattgctggaagccaggagttctagaccagcctgggcaacatagtgagaactcatttctatcaagaaaaaaaaaaaaaaaacaattagctgggcatagtggtgcatgcctctggtcccaggaggctgaggtggaaggatcacttgagcctaggaggtgaaggctgcagtaagccatgatcacaccactgcactccagcctgggtaacagagcaagaccctgtctcttaataataaacaaaactacaacaacaaaaaacccacaaactaagatatatacacatttttttttagagagaccacattcacgtaacctttattacagtatattgtttttgttgttgttgttgttttgttgttgtttttgagatggagttttgctcgttgcccaggctggagtgcaaaggggcaccttcggctcactacagcctccgcctcccgggttcaagcaattctcctgcctcagcctcccgagtagctgggtttacaggcgcccaccactacgcctggctaattttttgtatttttagtagagacaggtttcaccatgttggccaggctggtctcgatctcctgacttcaagtgatccacccgcctcggacagtatattgttataattgttctattttactattaattatggttgttaatcccacccggtgcctaatttataaattaaaccctatcataggtatgtgtgtacaggagaaaacatactctctgtagggtttggtactatctgtggtttcagacatccactggggatctcggaacctatcccccgcaggtaagaggggactatcgttttcacaagggcaagcctgaaaggcgtctatctcctggcccagttcctattccttcccccgaaatcagtccctttcaactaattcatctgttacttcttatcttataatgcttgtgtgtgtttacctccacctttctaagtcctgtgaccacggagcgatttatctcgaatagcttcttgaaaccgaaacgtgggaggcaaaacatttgaactttacatgtcctaaattattttttccatttttgtagttggtagatcgtttggctgtagggaaatcttggtggaaataattttccttcaatgtggcaaaaatggttccattttttaaaactttgaaaattaatttaatttgagggataacttacatccaataaaatgtgcccactttaggtatacggttttgatgagtttcacacaatgtatgtacacatgtaatcaccccagtaaggtccctcctgaccctgacaaccatggatctgattccctggcgtttcccatacacggaatcctctgatacatgctcttttatgtctggctgcatcacaccgcatgctgttttgaagattcacctatattgtcacgtgtatcaatcgttcgttctttttcatttctgagaagcacgccattgttaatccgccacaattcatttattctgtctcctattgacagacactgtggttttttcactgttcggggccactagcaacaaagcttctgtaaacactcatgtgcaggtatttgtggacctgtgttttcatttcccttgagtaaataccaaggaatggaaaagatgggtcatatggtaagtgtatgtttaactttgtaagaaactgccaaactgtgttccaaagtggtgactgaattttccattcccgccaggaatgtacgagaaccacagtccttgccaacacttgatggtcactcttttatcctttagccatgctagtggatgaggagtggtatctaagtgtgtccaatgactaaggaggtaaatcatcttttcatgtatttattggccatttgcttgcttcttatgaagcctgtccagatctttagctcattttattatttatttatttatttatttacttatatatatttttggggggcacagtcccactccagttgcccaggctggagtgtggtggcatgatcatggctcactacagcctcgacttcctgggctcaggtgatcctcccacctcagccttttgagtagctgagactataggcatgcaccacatctagctgattttttgtggttttggtagagatggggtttcaccatgttgcccaggctggtcttgaactcctgggcttaagcaatccacctgcctcagcctcccaatgtgctgggattacaggcataagccacctcacccggccctctatttttattttttttagacaggatcttactctgtcacccaggttggagtgcagtggcacgatcacagctcgctgcaacctcgaactcctgagcttaagtgatctttccccctcagcctcctgattaggtgggactacagacatgcaccaacatgcccggctaattattctactttttgtagacactgggtctcattaagttgtttctctttttattattgagcagaatttatttctatattttggatacaagtcctttgccaaatacaaatattacaaatattttctcgccaggcacagagagacagacactgcatgttctcacttatctgtagtatcaaaacatcgaaacaattaaactcatggagatagagaatagaaggatggttcgcagagacttggaagggtagtggcaggggtgagagggtatgtagggatggttaatgtgtacaaataaatagaaagaatgaataagacccagtatttgatagcataacagggagactatagtcaataataatttaattgcacatttaaaaataactaaaagagaggtcgggcacagtggctcatgcctgtaatctcagcactttgggaggccgaggcaggtggatcacctgagatcaggagttcaagaccagcctggccaacatggtgaaacctcacctctactaaaaatacaaaaactaaggccaggcgtggtggctcacgcccgtaaccccagcactttgggaggccgaggtgggtggatcacgaggtcaggcattcgagtctagcctgaccaacacggtgaaatcctgcctctactaaaaatacaaaaaattagctgggtgtggtggcgcatgcctgtaatcccagctacttgggaggctgaggcaggagaatctcctgaacctgggagacggaggttgcagtgagccgagattgcaccactgcactccagcccgggcgacagagcgagactccatctcaaaaaaaaaaaaaagaagaaaaagaaaaaagaaaaaaaaagtttaaaaatacaaaaactagccgggcgtggtggtgggtgcctgtagtcccagctactcaggaaactgaggcaggagaatcacttaaacctgggaggcggaggttgcagtgagttgagatggcgccaccacactccagcctgggtgacagagcgagactccatctcaaaaaaaaaaaaaaaaaaagaataaaaataactaaaagagtatagttggattgtttgtaacacaaaggataattgctcaagaggatggataccagttctccatgatgtgaattttccattgtatgactgaaccacaatatctcagggaccccataaatatatacacctactatgaacccataaaatgaaaaacaaaatacttcttagaaaacaaatattttctctcagtcggtggcttatttattcatttttccttaatttttcttttgaagggaagtgttaatttttataaactctaatttatccttataaaaatgaaaccatttttatggtttgggccttttttttttttggctcatctattaaatttttgcctaccccaagttcatgaacattttctcttattttcttcagaattccataatttttgtgtattgtgtgaaaggctaaagtccctttcttccctcaatggatatccagtcatttcagccatttgaattgaaaatactttcctttctctatcacattaccttagcacccttatcaaaaagcaactattaaaaaatcaattgactatttctgtgtaggtctatttctaaactctgcattctattccattgaactatctgtctatcctaatatcaacctattctgattactatgtaaaattttagaatcagctgtcaactttacaaaaatttcttctggggttttaagtgagattatgtggactctgtagatccatctggggagaagtgacagtttagcaatgtaagtcttccaatccatgagcatggtatatttctccatttatttatgtcttctttaatttttgtcatcaatattttgcagttttctgtttttttgtgaccttctttttcttttttttttttttttgtcagggtcttgctgtgtagcccaggctggaatgcactgcaatctctgcctactgggctcaagtcatcctctcacctcagcctcctgagtagcaggggctacaggtgcatgccaccatgcccagctaatttttttttttttttgtagagacagggtctcactatgtcacccaggctggtctcaaacttctgggctcaagtgatctggccaccttgacctcccaaagtgctgggattacaggcatgagccatggtgcctggtttatattgcagttttaattgtatagacatttctcctaatttggtaaattattctctaaatatttcatgttttatgatgctactgtaaatggtatttaaaatttttcatggttcaattgattgtggcaagtattatagaaaaataattgatttattcttgtttttcttttttctttttttttttttttttagactgagtcttgccctgttgcccagtctggagtgcagtggtgtgatctccagtcactgcaacctctccctcctgggttcaagcaattctcatgcctcagcctcccaagtaggtgggattacaggcataccaccacactcaacttttttttttttttgtatttttgtaaagatggagtcttgccatgtgggccaggctgctctcaaactcctggcctcgagtgatctacctatcttggcctcccaaagtgctgggattgcaggtgtgagccaccacacccagcctgatttattcattgactttgtatcttgagaccttgctaagctgacttagctgatgggctcacagcataaacatatataatatatatgacaataacagcataaaggagcaaggaggcaatgaagttattatatatactggagcaaggaaaggtcaccagacaataacttgaatatacaggaagaaatcaagagtaaagtcagtgataaatatacagtgtaatataaaagacttgaaaagtgtttttctccttacttgtcttactgaattgaaaagaaataagattgtgtgaaacaataattataacaccatgttgttgagtttataacatatatagatgaacatatacgacaataatactacaaaccacaagcaaggagggaggaaatggagttatactggagtcaagttcctgtattttactaaaattagtattaatctgaagtagatcctgataaattaaaatgcatattgtaatccctggagcaaacactaacaaaataactttaaaatatacacttaaaaagaaaaagggaatttaaatgctacactagaaaatacttaatacaaaagaaggtagtaaaagatgaacagaagaacaaaaaggcataaaacatagaaaacaaattgtgaactgatagatggaaatccaaccacagcaataataacattgaatgggaatagaatgaacatgccaatcaaaaggcagagatcgttagactggattttttttttaagctttgactatatgctgcctgtgagagacatacatactttagaaacaaagatacaaataggtcaaagcaaaaggatagtagatttgctatgcaaacagccgtaagggagcttgaggagaaatgctaacgtcagactaaataatttttttgtttttttgagacagagtctcactctatcacccaggttggagtgcagtggcacgatcttggctgactgtaacctcagcctcccgggttcaagcaattctcgtgcctcagcctcccaagtagctgggattacaggcacacaccatcatggctggctaatttttttgtattttcagtagagacggggtttcaccatgttcgccaggctagtcttgaactcctgacctcaggtgatccacctgccttggcctcccaaagtgctgggattacaggcatgagccaccccatctggccaacttttttaagatcaaaaatcttactaaagagaaacattctgccatgatataaagtgaatacatcacgaaaatataacagacagaaatatatacatacctgacaacctagccccaaaatactagaacaggaattaaaagaaattaaaaactgtgtaagcaaaaactcagttgtatgtaaaaaaccaattccccttgaggaagagaaagggctggagtcctttaaaaattaactgtctgtttttctgtggctagtgagccttatctctccctttcccaggcattgcgaagactctgtttctctagctgtgcagctgcaaggtcactaaacagataatcttgagtcataaaacgtgttgttccttgaaaagtaagaaataatgtaatgcatgtcttaactgaataactgtctttgtttctcgcttctgtaatactcttccccctgcacaaatctccccccaccccacaaaatgcttaaaaggtagcttgactctttgtttggggcccggtcctttggatgttaatctgattgggtcggtgcgcctaaataattaaataattcctcctcaaccccatcggtctctctgattccttaattatcccgcagcaatacatgaagcaaaaactcacagaattgaagggtgaaacagtcaattcaccagtaacggttgggccaggcatggtgactcacgcttgtaatcccagcactttgggaggccgaggtgggtgggtcacttgagcccaggagttcgtgaccagcctaagtaacatggcaaaaccctgtctacaaaaaatgcaaaaatcagctaggcatgatggtacttgcctgtagttgcagctactcaggaggctgaggtgacctaagccttgggaggtgggggctgcagtgagctgtgatcataccactgcactccagcctgggtgacaaagtgagactccacctcaaaaaaacaaaacaaaacaaaacaaaaacaacaaaaaaacaataattggacaccaaaatcctaccccactctcaataatggatagaaaaattagaaagaaaatcagtagatacaaatgacttgacatcactggacaccaactgacatctctagaacactccacctggcaagagccgaagtcacgttctcctcaagtgcacatggaacagtgtccaaggtcaatcatatgctggaccataaaacaattctgagaaattcgaaaggactgatatccacagagtttcttctctagccacaggggaatgaaatcagaaattaacaaaagaaatttgggaaacctataaatacatagaaattaaacaacataattctaaataagcaatgggtcaaagaagaaaatcaaaagatacactgagctgaatgaaaatgtaaacacaacataccaaaatttatgagatataactaaagctgtgtttcaagggaaatttatagctgtaaatgtctacattagaaaaaaaatcttaaatcaagtgtgtaagcttccattgtaagtaactacaataagaaaagacagaacaaattaaacccaaagtgagaagaagggaaattaataaatattagagtggaaaccaatgaactagagaacagagagaaaaagataaagtaaaaaaaatcaaatgtcagttctctgaaaagatcaagagaattgacaaagctttagctacattgaccagagagagagagaacacaaataactaaaatcaggactaaaagaggagacagcaattccaatcttacagagattaaaaggatttcaaggaaatactatgaacaactgtttgccaacaaattatgcaacttaggtaaaatggacagattcttacacataaactagaaagcggttagaagaaaatataagattaaatctttgtgacactggattaagatttcttagatatgataccagatacacaataaaagaaaaagttaataaattggaatggatcaaaatgtaaaacttttctacttcaaaacaccaataaaaaagtgttaagacaaactattgatgattgaaaatatttgcaaatcatatatctggtatatatatatatatatatatatatgatactgtgtatgtaaagaactctcaaaactgaacaaaggagacaactcaatttttaaaaaggcaaaacatttcaacaggcatttcaccaaaaacatatacaaatggctaaaaagcacaagaaaagccacttgccatcatttgtccttggggaaatgcaaatcaaaactataatgagataccaccttttacccacaagaatggtatgtattgctgcagatgtacagacagtggaaccctcagccaggcgcagcggctcacacctataatcccaggacttggggaggccgaggtgggcagatcacttgagcccaggagtttgagaacagcctgggcaacatggcaaaaccccatctctaccaaaaatacaaaaattagctggatgtggtggtactcacctttagtcccagctactcaggaggctgaggtgggaggaccaattgagcccaagagattgaggctgcagtgagccaagatcatgccactgcactccagcctgggtgacagagcaaaaccttgtctcaagaaaagaaaaaggaaaagaaaattagaaccgttatacactgctgatgggaatgtaaaatggggcagtcactttggaaaacagtttgctagtttcttaaaatgttaaatcagacttcctgtatgacccagcaattcctctgctgggtatcaacccaagagaaatgaaaacatgttcacacaaagtcttgtacacaaatgttcatagcagtgctgcgtgcagtttaaaatagctaaaaaagcagaaacagccgaaatgtccttcagctgatgaatggataaacaaaatgtggtctatctgtacaatggattattcagtaataaaaaggaattaaatactgatacatactacaacatacatgaatctcggaatcattattctaagtgaaggaagtcagatgcaaaagaccatgtaacacaggactccattcataggaactgtccagaaaaggcaagactggagagacagaaagtgattgtctgaggccaggtgggaatggggaatgactgcagaggagttccagggagttttggtgggctggggatggaaaagttataaaatttatttcacaactctgtaaactaactgaaaataattcatttgaaacaggtgaattttatggcatatcaatgacacggcaataaagctgtttctttcaacggtgccatcaaccccagccccttgaccctaagctgaaggaagagagatgctaggtgtgttcagtagggctccgtcaaagctgattttttgaagttatgggcagcattccgagtaagatgttttgtggcaggtcaggtctcactaacgcaggcctccctaacaactgtttcagtactgactgagtggttaaattaaatattaaaagccagtgcccttataaaaaggctggaatataacaaaatcccaccaagagttttgcctagacctttcctgggccttcaagcatgacaaaataacaaaggaattcttaacaggacccatttaggattaaataagttttattggggatctgaagaaattccccaggactccacaaataagtttactgggggtctgaaggaacttcccaaacccccatgatttaggagacaagataagggttttagattaagtaaatttactgaggatccagaggaaggtcttcaggactcagaccttagttatagattaacataagtcaattacttacgtcttgagatgaatgcacacttacacatagacatatagcttagaaggtatataagctctggaaaactttgtaattttgagttggtctggagataatttccaggtcttctccttgtaactggttacagaaataaaaagtctctttctccccagttcatctgcatctcgttattgggccacgagagatagcagccccaccctcagtttggtccaggaacagtttgatctcttcttggccaatctctggtgagacccaccagaatggaggagagccgggactgggtgcactgccagcttccaaaactcctgcacgtggtctcagtcctccagggattatgatgggtgtgaaggagctgagcattctctaaggagccagcacatgacacccagctcaccgcccaccaaccacatcctcatggtcatctccaaggctctctcatgtcctcttcctgcctttcgggggatcactccctctgactccactaccctgctctcctgcccgccccaacaagcctgactgatttgtggagccgggccttccccatgtgagctcttctccctggcatgcttgtcccccagatttccacacactgggtccctcgccattggtgtccctaaggacaccagctcaccagctcctggctgcaggcaccttctagcacaggcctgcttgttctcatcagtgttcaaccaacattggttggatgactaaatcaacatgcagaatgtgggtaacctgagaatgggcactcatttgccaggtttctcaaagacctaacctcttagtcttcaagacgtttgtcttgggtgcggtcatgggccagagccagtgccagaaccccaggagtatagagaccaactgcccagtccctggtcctccaaggctccctgacatgagaccaactaagacagcataacccgtggggcaggacagactcctggggtggcagctgtgttcatcatcttgactgggtcaagatgtatccagctgtaccttttatgtgcggtttattgtatacatccgttgaaacatattaagacaaaaaagggaaaacaaagaccacaaaggagggacagggaagaacccggaaggcgctggcagcacagggaggaggcaggtgtttgcagtcagacctgagtcccaggccccactcagcccttcctgcctgggaccagagcactgtcccagatctctccaaacctgttttcccgtgggtgaaagaatgacccgggaagtatttaccgttccttcctgagaactcagcgatattgaacacagtgctgcctcacagtaaacactgacaaatggtgagcattactgagggcagggcctcgacctacaccatacccagttttcttcatgaattttccactcctctgcctcccgctcctccagggctgcacctccggggcaggagccctcaccaagtcaggcctcagtatgccttatccgccacctgattccaaatcaaagtaaaacatctctccccaaatgtgtacacagcactcctctaaattaaagggctgtgtgctggctctgggtaccccacccggctctccctggcctttggcgttggggttcactggcctgcagcctgcgccccgtggccctgcgttctgcatccctccctctgaagcgacgttgttgtctgggtaaatactcaattcatcttctggcgccaagaaaattaaggacaggtgatccaccctcggcctcccaaagtgctggggttacaggcctgagtcaccgcatctggttgcctcaataatttcttcttaactcctatatcacctgagggcccggggcacagttcccccgtcacgcttggcattgaacttgcccacctcgccttcccgaggcgcctccgcgtttggggtatggaggctgttcccggtcaacccgggcgcctggccgccgtgcccgagggaagggctggggggcgggcagggcagcccagagccttgtcctagtccagggtcgggcggtaggtgctgaaaatagcagctcatggaaggcggggagcgtggaggggcgaggagaggctggagaccgccacggcgtcgagggaccccgctctcaccaggacccggggaccccggagacgagccccccgccaggccgcgccaccgcgcccatcctccctgcgggtcccaggcacccacagcgcggccaagcccacctgcccgccggctccccaggacgcagggtctcggaggctggggcggcggccggcccgaagcctcgcagccctgagcgcccccaccccggcccggctgtcgggtgcaccccgcattccctgcggtagcggctccctcgcgggcacccggggccgaggcctgcactcaccggccagcgtccgcaacacctcggccatggctccgcgtctggtctcggcctcc

SEQ ID NO: 2023 - DNA, 27830 bp, Homo sapiens
ggattctcattggctgaagtcgagggaggtttgtgtcttattatcctccgggtccctcgctggctagtaggagagactggtgcttgccccgcccggtggactaactcgcttaattttaaataaaaagtcgaggacacggcggtcgttttcccgaagacatgggccctcccatgggccatttgctccctggaggccctcgcgtcttgctgagcccggggagttaggatgacgcgagcggtgagggagcccggaacgattccttcgcggaacaattgaggcgaggcctttgggagtactttgtgggacggaccctggcgggccctgccagacgcacagggatggcggcggaggcggccgatttggggctgggggccgccgtccccgtggagctgaggcgggagcgacgcatggtgtgcgtggagtacccgggagtggtgcgtgatgtggctaagatgctgccgactctgggcggcgaggaaggcgtctcccgggtaaggggctgggaatctcggtgttggaataagagctcggagtcgcaaagaaaacgagcactcaaaggatttctcagcaagggaaatttagcaaatttacttacgcagaagggtgctgctcgctcttctggccgctgcaagagagccaacagaacaaagaagggaaggatttttgtttttgtttttgtttttttgttggtttttcaggcggagtttcgctcttgtttcccaggctggtgtgcggtggtgcgattttggctcactgcaacctccgcctccagggttcaagcgattctcctgcctcagcctccagagtagctgggattacaggcgcatgccaccacgcccggctaaatttgtattttttagtagagagggggtttcaccatgttggtcaggcttgttggaaataaattttgggtgccgcaaagaagaatcagcactctggcaaacagttttctcagcaaggcaaatttccttctatagaagggtgcatcttgcggatggagcaatggcgagagcacaccgacaaggaaggggaaggggttcctatctcttacacagctagtctctactgctgtgtctttcccatattggctagggttggaccgcacagtctaagctaattccgattggttatttcaaagagggcaggggcacaggcctgagtggcggggtgagtagttttggtgggaaggatggttacagagcaggtgactcaggatgactaaggacagagcaggtgatagaagctaggaaggggttgtttactgaaactaggggcaaggaggcgtaaagaacgaggggttaaactttaaaatggagaacaaagaacagggaagctgaacatactgacatattggttctttgaaatggaactcataactcattgtatttattaattttccccctcttgaatttaaaggaaggtaaaaggctaaaatctttgaagtggaatttactgtgtcctataggctggtcttgaactcctgagctcaggtgatccacccgtcttggcctcccaaagtgctgggattataggcgtgagccaccgtgcccagcctggaatgggtttttatccctaaggcagtcagtccctgtttttgtgtcctgtccctgctggttggagttggaccacacaatctaagctaatctcaattggctattttaaatagaacaggggtgtgggttacagtgacgggacgagcgatttcggtgggaagactagtttcggcgggaagggcagttaaacagagcgggtaactaagggcaaggaggcacaaagaacaaggaagttagactttgaagatggagaacaaagaacaagggagttgaacaagctgaacctttgaagaagaattcactgtatagaacagtttccccctcttgattttcatacttctttctcttcaaacctttttagcatgtctcgactttgctgttcttggttttctaaaagtagaagtttgtctgaataaggcggggggaaattggaggttagtgagagctgtctccgtaagtctttgtattaaccctcaggcacagggtatgatacaacatcctacgagaataaacacgtttattacaatggcaagggacataaggatcgaggacataagtcctttccacctgccgaacaatcttcccgttagatcagtgaagagatcgtttatcccagaattttaagctagctcattggataaagcagtaagaccttgcagtgcctttgttatggttccgtcaggaacagtattatttgggataaaagtacaacattgggttccaagcatgacacaaacgccacccctctctgctagtatcatttctaatgctattctattttcccaagccatttgactggtgggtcctagttgttcagctgttcctttgatagcattcctagtataattaacaaattgttgctggttgtaatagatgtaacttatccaatctacatttttatttatagttaaccaccagaaaaacatagactcaaatcccgcagctatttgattacaagccttaaattcatcaggtacccctcggggaactccagtggcatctgtataaacacgagggtcaaaggaaccacggggggcatctcttactctacggtgtcttgtttttacttcttctggttgatgaaatgccagagtgaaagggatggccaattggatcagagcacaggtaccgctccagttacttggcagagtatccagttacggtccaccacaatgccaccatacatctgctcaggataaatgactaggggcagattcatgggtaagctcttggaagggcttaagctcactgcatcctgttaggtccccaaggaatgccaaattttccctgtcacaagagacacaaagtaaaattggcactgggagacagaagctggatagccctcaggggctgacccgcagggtgttgaacctcagggaacagcagagagagagctcggcacgatttatcaccccaggctgtggggtcctggaaaagagctaccgtacagcccatgcccactcgtctggaggaccatccaagtggaaaggggacagtctgggcttctggtctactgtgtgcacaagtgtaacaatcacttttgtttaaagtgcggacagaatatttaatccattccatccaggcgtttgcatctcagtaccctgtttcaattgctagagtttgctttaggtctcttacttctacagctgctactttggctgggtcgttgtggagaccggaggggaacactgggcctgatatgtttggggagagcgttgggtcccatacgttccctggactctgggtctgggtttcttcattgtttttaaccgccgatggtccagtcaaccttagagagggttcctatgggatcccgtcctgtaacatctgctcctaacccgtaccgtccgaatacagagggttcttgggccattgtttggggattatctataattagcaataaggggttacaccgcagtggcttacaatttggtggagtggagcgatggataagttagagtttttgtttgagtttccgcaacttatttaaaggaggggggttggctgtccgcctcccatattgactggtccaccaaacatttgcccagtcaccacaggggccctttaaggctccatacttatacttgtttgactgtctgcgatatggacatggatacttaactacatcggatagctgcctttgagcttgttcgtatctgcacggggtaagaacaagtgtcgaactgaagggtcaagggatggttagcctgagtcacattgatgacaagatgaccttatgttggaaagaaaaggaaaaatagacaagtgattattaagccctttttagggttagtttggtaggggtgggtcccggggtgacagcccatttttccctgtctgtggacattactcctttcacctggcgtgtagtgtgcccatcccttttcagccgttcgaatcgctgtttcagtagttaagagtaccagataaggcccttcccaagctggttcaagttttccctccttccagcttttgatgagaacgtgatccccaggctgatgctggtgtgctggaaactctagagctggcgtctgtgctcagaggccttcagtcctgagggaagaaaaagtggaggagagaccaagtttatagtttttaagaaactgatctttgtttcaaacgtagcaatgtcagcaatggagtgtagataaggcaacccatatagcatttcataaggggataagccaacatctttccaaggggcagttcggatttttcacaaggcaatgggaaggcatttagtccatggcaaccgagtctctaagactaatttggttaagtgactcttcagagtttggttcattctctccactcttcctgatgaaggtgggtgccagggagtgtggtattcccctgctatgtctagtacttgggctagtttcttgacggcatgtgcagtgaaatgagtcccattatctgaatcaatattttgtattaatctgttaaacctgggtataatattctcaatcaatgctttaattacattattagcagttgcacttgaaaagggaataggttccctccagtgcgtaaggtgatctactatcactaataagtactttaggcaaccgactgggggcatttcggtgtaatcaatttggacactttgggacggtcttaaccctggactcctttcccccagggagtggttttcttagggtctgcttattagtctttttgcatattagacaactatctgtaacttgtctttccagagtataaattcctatacatccctaaaccctgagaactgcatcacacatggcttggggtccccagtgaattccttgatgcagctgagataagacttctctcttgaggggtttggataacatttctctttggtctggtaacacccatttcccttcagaattctctttggcccctatttttattaatttccctttttcagtggaagagaagatgggaactgcggtcgggggaggaagacaaggggttaggtgaaaagtgagcgttttgaggaaatggcagcttgtttggctatttgatctgcaaggttattacctcgactttcacaagaaagacctttctggtgtcctgggacatggacagtagctatttcttctggcagctggaggttacctaacacttgggtgattaattccttgtgggcaaggtcttggcctttgctattaatgagacctcgttcggtccaaatttttccaaaggtatgagctagcccgaaggcgtacttggaatcagaataaatagttccttcttggttttgcaagtgctttaaggcttgattcattgcaaacaattcacatgtttgggcagaccaatgactgggcagccttcctgaccctccttctgcaagggcttccccatagactactgaatatccattatgtctttttccttcagttacctgggaagagccatctataaataagtgctgccctgtttgaaaggggtctcccttacatcgggcctgaatctaaacactcatgctcaggtccttttagatttggattccctgttaggagacctgctgggttaagtgaattatcagtggttagtgttaaatcatctctctaataggatagcttcatactttaaaatttttgagtcagtgagccatctccctgctttctggtttaagatagttctaacttgatgaggcgtgctcacaactaaatctcccccaaaggtcagctttctgctttcttcagttaacaaagccgtagccgcaatggattgaatacattcaagccatccacaggttactggatctaaaactttcgacaggaacaccacaggttgccagtgacccccgtgttcttgagtaagtacccctaaagctacccccttctttacattaatgaaaagatgagatggcttttctagggaaggcagggctaggacggggcagttatgagcatatgttttagttcttcaacctggtggatttcttcagaggtccacagaagagggtcaggcttttcttgggcaagctttaggtataaagattttgtttttagggcatatgagtcaatccgtaagcggcaatatccaaccaatcctaggaatgttacgagttcctgcttagttttaggcaaagttaagaaggacacgatcccttcgacgtgttcagttcctgtccttcgtatcaagtgtcctaggtatttaacttctggctctacagattgaagctttccctttgaaaccccataacccttttccttgcaaatggttaaggaggtggacggagagggcagctatccgttctgtagcttcaccagataccagcgggtcatccacgtattggagcaggcatgtgttttggggtagaaatttgttctagaacttgttctagaatctgaccgaagaggttagaggagtctgtgaagtcttgggggagaactgtccgtcgatactgttgcttccgtccggaatggggatctttccattcgcaagcaaaaatgtctcggctgtcctcagacaaggggcatgcccaaaaagcatcttaaatatattactgtaaaccactgatggtcgtatggaattttgctgaggagggtgtaaggattagggacaacagggtgagtagtctggaatatctggctgatggcccagaggccttgcactagtcagtatgacccatctgactttcttacaggcagtattgggataaggggacacaccgggttcaaggagcccgtccctaatgagactctcaatgataggttttaggcctattctgccttctaaggggatgggatattgcttccttcttactatttccccccggggtttttaactttatatgtatggtgggggggtgggacttggagtcttccccaattcccttcccttgaccagagatcgggatgaatgtatttttcttcatggtggtaagtaggtttaatgaggtgaggaatccttctgggctaacatgtaaacctatacctaactttaagtctcttcctaacgggttagttcctgcttcagggattagcagaaatttaacgtgggctgttcgatttttatgtttgaactctgcgtcttctaagatttttgctctaaatccttctccctttacccctgaaacaaaaagctcttctgaggagcagctgacgctagacggaagggaacaaacagaagagcgagcagcacccttctgcagaagtaaacttagcacatttagttctgcagaagaaaggtgctgtgctgctcgctcttctggccaccagagcacacggaacaaaggaggaaaggttcctgtgtcttgtcccactggctggagttggaccgcacaatctaagctgatctcgattggctatttcaaatagaacagggatgtgggttacagtggctggatgagcggtttcgccaggaagaatagtttcggcgggaagggcagttacagagcgggtaactaagggcaaggaggcgcaaagaacaaggaagttagactttgaagatggagaacaaagaagaagggagttgaacaagctgaacctttgaggaggaactcactcaacctggatatctaatatccgggacactgagagagggacggagttgctggacggcggctgaaggggagagtctacccgggcgtgtggtttccttggcaacggagagtgtggtggactctgggtgcccaatgggcagggctttggtatctgtaattgccaggaacagcctttttctccccaggggacagaggggaagggactgtgggggagacccctaggagcttttttttttttttttttgagacggagtctggctccgtcgcccaggctggagtgcagtggcgcgatctcggctcactgtaacctccgcctcccgggttcaagcagttctcctgcctcagcctcctgagtagctgggattatagacacccaccaccacgcccggctaatttttgtttttttttttttagtagagttggggtttcaccatgttggccaggctggtctcgaactcctgacctcaggtgatccacccagctcggcctcccaaagtgctgggattacaggtgtgagccactgcgcccggctcctaggggcttttttttcattccatccacaaatgtgagccacagcctgggcactggtgccaggaatgcaactctgcagccccacagggtgtgttgcactgccgtatcctcattacccggggtagaaaactgaggcacggggagatgaagctctgttgacttacctgagagggatagactgttatgttgttaggattagaggtagtgatggttgacatcttattctctgccacgtacggctctaggtgccttacttagagtccgtcctctttagaaccctaccaggtaggaactgtcagagtctgtattttacgggggaaggaacttgttcgaggtcacacagcaagtggggcagctggaggatgctatgtgtaagttctttacatgtaccagaacttgaagtgtctctttagagaagttttccctgattgccctaactaaagtggccactggcaattatctgcctcctcatcctgttaattccaatctgaaaatgttttaaaatgtttattctgacaaaggcttatacatataaaacatttaagaaaaaaggaaaaaaaaatttactgtctctcgtcctcttgaccctaagactgtcaactccatgagagtggggacttcttttgttcacttctgtacttctttatttttatttttttattttttgagacagggtttcattctgtcaccaaggctggagtgcagtagagcaattatggctcactgcaacctcaacctcctaggctcgggtgatcttctcacctcaccctgccaggtagctgggactataggcatgcaccaccacgcccagctagtttttggtattttttgtagagacgtggtctccctaagttgtccaggatggtctcgaactcctgggctcaagcgatccgcctgccttggcttcccaaagggctggaatacatgcatatgaatctgccgggatcttgctaaatgagccaccatgcctggcccagttctctgttcctaacatccataacagtgcctagttctgtaaatacttgtcaaatgcacgattgagtcttcacagcaatctagtgagttagatgccatttttattcacatttttcagataaagacacaagaaagtttaggtcagacatctacatggtacaaggggatttgaactcatgctttgctctagagtctgaacttttacctgctgcttcctcatcctttatgaatatggaaaagccctgaattcattaagcacgggctgccagtagagccccagttaatcacgttttcttcttttatattattctcttgatttatggctttgacagaatccttactctcgctaacctcagggattattacagtgtgagcactttgggaagggaccttccttactcattcactcttctcatgtttcttgagcacctcccctgtgccaggcctacgtttgggttcattcccgccccatcgggactcagaggtgtgtgttttatgaggaggagattcctgagaaccaagtcttcttcattctctcccgagatagttcctgatcacttcctaagggacagaccctgtcctgggtgttgggaaccagctcactagcacgtaggtgaccttgtcccagttcacgttgttggtgctttcatatgcacacatccagtgctcgttgtgacccagcattgggcaagtattcattcatatgtacgtggcacatattgaatgtctaccatgagttaggcaccaggagctgtgctttatagatatttaatcataacagtcgtatgacatagatgctattcttggggtttttaaggagagggaccaaaaagagtgttggtattcagtttcatgtgcttggaaagctagaggtaacagcaagtcagagcccaaatggttgttactgattgatttaatctcatttggacctcgaaacatttgcatatgagactaaataccaagaccctttatggtgggtagttgttagagtaggtaaccctagacaagccactccaccccgcaccaagcctgagttacctccaagattgtgggtggcaagccacccaggtgctgaggcaagagaccgagggcatgagctgttccagtataataaaatacataaaacaacaagttatactagatctagatcatagacatgattatatatgaatatcattaatcattagtttgtaggaattactctttattccaatattataataatcctcgctctataatcataacctaagaaaaaccaggtcatacagagataggagctgaggggacatggtgagaagtgaccagaagacaagagtgcgagccttctgttatgcccagactgggccaccagagggctccttggtctagcagtaacgccagtgtctgggaagacgcctcttgccaagcggaccatggtctagcggtagcatcagtgtcaaggaaaaacacccgctacttagcagacctgcaaagggagtctccctttccctgggggagtttggagaagactctactcctccacctcttgtggagggcctgacatcagtcagacctgcccgcagttatccgggggactgtctccctgtgatgctgtgcttcagtggtcacgctcctagtccaccttcatgttccgtcctgtacgcctggctctgccttttagatagcagtagtaaattagtgaaagtactaaaagtctctgatatgcagaagtaatggcataagctgtctctctctctccctctctgtctgcctcggctgccaggcaggtaagggccccctgtccagtggacacataacccacgtgaccttacctatcattggagatgactcacactctttaccctgccccttttgctttgtatccagtaaataacagtgcagccagacatttggggccactaccggtccccgcattttggtggtagtggtcccccgggcccagctgtcttttcttttatgtctttgtcttgtgtctttatttctgcagtctcgtctccacacacagggagaaaaacccaccgaccctgtggggctggtccctacaaagataagggtgatagtatctcccctcaagtgttgccagaaggaccaactaatgccccacaccgagcaggcacttgatggatgatggcatttacttagaaggaaggagacgattctcattttttccaccagataaaaactaagatacatgggtttaaaaaatgggccttttgggaattaagggcccagaatgaaacatgagcctcctggcctttcctggatcaccgtcaggcttttattgagagaggagcagctccccactggctgcttggcttgtcattgcttcactctgtctcctttggccttgccacagatctacgcagaccccaccaagaggctggagctgtacttccggcccaaggacccatactgccacccagtgtgcgccaaccgcttcagtaccagcagcctgctgctccgcatcaggaagagaacgaggcggcagaaaggggtgctgggcactgaggcccactccgaggtcacatttgacatggagatccttggcatcatctccaccatttacaaatttcagggtaactgaaatctgctcttgcaatgtctggttatttcagggctggccatcctagctgcctgcaggagctgtgtgggtcatctgcaccagtggagggggccaggatatgcccaggggctgtggggacacagcagggcacaggccccatccaggaggcagcctttcttccctccagccaacagttccccagagactgcaggttcattgctgcccaatcttcagcattcttaagctagaaatctcctaatttttaatgaaaccattgtgtgggaccaaataaaactggtcagtagacctccagtctttcccccaccacagtgttttgaaccttctcttgtctcggctgctgttggtcttgccctcctagctcccgaagccccttgggacctcctcctcctctgaactctcagcaggttgaacgtccctcgtggagccctcaatcaggtttcccacctaccaggaaccccagtgaggaagcaataaagcaagggagggagacgggtgagaaagacagactctggcattgtgcctgcctgagccctgccagtttctttgggaggtggcttggcttccctgagcctcagtgtccttgtctgtgcagtgcgggctacagagcctgcgttccttaggccctcgtgaagattccgggaggcaatgcttgtgaatgggccagcctctggcccacaggaggtgcctggcatattactaacaaggcttagagatggctaagttacatctgcagttctaggcagaatctgaagagtataaagattgagaagggcaaagaggactagaaagaaaagaggggaagaagaaagtgaaatgaaggagaagcaggacctggggtcccatgggttgggcatttttaatggcagtcattctggtgggtcatggcattcaccaaagagggctgttcttttgggacaaggtttcccaagtgattcataaaacataacacctcatatttttcatcgaattgaaccagcatcttgctgctctgtgtgtgtctctggactggcagcatcagcctcacctgggagcttggtagaaatgcaccaggtcagaacctgcatttagcaagatcccagcagattcatatgcatgttactaggttggtgcaaaggtaattgcaggttttacagttaaaagtaacattcatctaagaagcactgacctggactccatcctcacctatcatgtagctccccacctccccaaaataattttcatgtaagtgacttagactgcatggagccaactttgcagaggcatttgggaagggtgtgttttcctgccaccctcaccctgcagcctccaccacatggcccactcagcacctccctaagcagatgtgggtgtcggtgtgtggcagctgcccattcctggactcaatgtctgccatctgcccacctctctttctagggatgtctgacttccagtacttggctgtgcatacggaagcaggcggcaagcatacgtcaatgtatgacaaggtgctcatgctccggcccgagaaggaggcctttttccaccaggagctgccgctctacatccccccacccatcttctcccggctggacgccccggtggactacttctaccgaccagagacccagcaccggtaaggcccccctccatgcagcctcggttctctatcctgaaaatgggatggtccgggcacggaggctcacacactgggcgtggtggtgcacacctgtaattccagctactcgggaggctgaggctggagaatcacttgaacccaggaggcggaggttgcagtgagccaagatcgcgtcactgcactccagcccgggtgacagagtgagactttgtctcccaaaaaaaaaaaaaaaaaaaaaaagaaaatgggatgacagtagtactacccaacagacgtattgggattgaatttaaaaagtgtgtgcagttctcagcacagggctgagtacagaacagggccttagtaagcggtggcctgtgtgatcgccaggttggcctcagtcctgaggacagtgcaaagaacgtgactgtgggacatgtgggttcctgctgagaaatgtcctttggcttaatcccctggtcattgctgaccagccagtctctggaccttgctgtcactagtaatgacactacctaagcaagcctcgtgggaatgtcccactctctgaccccagctctttcctacttcctttgctccccatggcctcaccgtccctgtccgtggcggagattttgcagcctctttatcatctgtccctgccctgccctcctctctttgccacactcacctgccaagccttggtcctacttcaccccagctgtttaccctttcctggtctgccctgtgcggctggaggtcgcttcagagaacccctgaccctgcccatcgcccagtgccatccttctcaaggcatctgtgactctacacagctctcgcctgctctgtacttggttatggactgcgtcccctccagaacacggtgcctctcctgaggacaggcgctcactctctctcatcagtagtgggtttctcctacaccgagagctatgaaaagccacatggacgtgactcatagtgcacccaccgccaccccctgccacccacacacaggctccgtgcacagcctgcccaagcccacatgcaattcagatgaaatgaattctgtaactcagaggttcttgacataattagagacctcagcggctgttggaaaggcaggcctgggcattgtcaaatgtagtcaaattgtcaaatgccatacattgacataaaagaataggatttcctttatataaaatccaagattgaatactgtgaaaacaaaatgaagaaaacaagtttgacagtatccaactggggatgaataacattgaccagccacactgccagttatttcacgtccctgtgcagcagcgctgtgagtgcatctcacccaagcctgggagcaattccccagggttcctgacacccccatcgtacacatgaggaagccgagacatggggtcagcgccacgtcccgccggcagcaccgccctggtctctcccactctgcaggctttgctcgtggcccagtgccaacggtgtcctgatttttgtatgctctactttctaaaatgacgcacaaaaagacaacatggaaaaaaactttgcattgtaatggatgctccccagaagtagcgacttggcctgcttcggtctctgtcatagccccggtgcccagaacagagcctggcctgtgagaggtactcagcaagtgtccatgggccccacacagatttaggggagcaagattactgccaacagatgagcaaaatgaaagggcctttttttctttttctttttgaaaggcggagtcttgctctgtccacccaggctggagtgcagtggcgcgatcttggctcactgcaacctctgcttcctgggttaaaacaattctcctacctcagcctcctgagtagttgggactgcaggcgcccaccagtacgcccagcttatttttgtatttttagcagaaatgaggtttcaccatattggccaggctggtctcgaactcctggcctccagtgatccgcccacctcagcctcccaaggtgctgggattacaggtgtgagccacagtgtccagcccgaaaaggactttgaaaactgggccagaggtgatggtgtttgttgaataattgttccatagcatgttttaagcttccaaaaatgcagccctcaagagaatgggcttgggcctagtgtagtggctcacacctgtaattccagtgatttgagaggctaaagtaggaggatcacttgaggccaaaagtttgagaccagcctgggcaatatagcaagactctgtctctacaaaaaaaactaaaaaagttagctgggcatggtggcgtgcacctgtatagccctagctactcgggaggctgaggtggaaagattggttgagcccaggattttgaggctgcagtgaatatgatcacaccactgcactccagcctgggtgacagaacaaaaccctgtctcaataaacaaaacaaaaaacaaacagaaaaaagagcggactctgtggactgatgggacccatgcccaggtgcctcccttgctctgtgagaaaggcaggtgcaagaccagattctgtggaatagaaataaatggtggtgtgataacagaagcctagaaaagtctggaagatttggggctcagagcagttttctttgaaggggtgggagggctttctcattcctcattatgtgtttcctttatgtcctgactgagcacctgtggtggcccagggcactccctggagcctggtgtccacggacagcacagcagctggggtgcagtgcaggggcggggagctagacggagcatgagtacatggctgggagccttaaaggagatcatggggagtgggccacactggtggaaggcagtgggccggggctacaggtagcagcgagggccctcagaggagctgacatctggagctgagacagagccagccaggtgaagatccagggagaactttccagaccaggggattggcgcatgcaaaggaaggctggggaggctgctgtgccccagagcaggtgagccagagaatgggggtggggagtgaagaccagtgcctaggcttcatcctcaagagagagtgtgttattctctgcctccggaaaagcattgcagaaaggtggagagaattggattgtctagtagcccccacgtgcccatcaggagcgtccagtgagcaacattctgctcctctccacccccagtggcacagtgctgccttcagaaacaagcagtgcggatctctgacagggaagactcatgtttcagacagactcgcaataccagtctcctacgcaacagaattaatagcactccccaacatcacccacaaccagtccttgttcactttttcccgattgtctcaaaagccactcaggagccaaacaagggccacacatgttgcttttggttgctgtcccctagtctgtaacatcctctaccaccaccaccccctacttttttctgattgtaagaataaattgtacctgttagaaaaaaacaaaacattgtggaaatgtattaactaaaaagaatcaagtcactttgcctccctgcagaaaactgttgcacatagaatgataccattttctgtaagtgtattgtactcactataagagtttgaagcagggggtgacatgatccttcctttttttttttttggagacggaatttccctcttgtcacccaggctggaatgcagtggcgcgatctcggctcactgcaacctctgcctcccaggttcaagtgattctcctgcctcagcctcccgagtagctgggattacaggtgcgcgccatcacgcccagctaacttttgtatttttagtaaagacggggtttcaccatgttgaccaagatggtctcaaactcctgacctcagatgatccgcctgcctcagcctcccaaagtgctgggattacaggcgtaagccaccgcacccagcctattttttaaagttacttattggccaggcatagtggctcatgcctgtaattccagcactttgagaggctgaggtgggaggatcgcttgagcccagaagtttgagaacagcctgagcgacatagtgagaccctgtgtctacaaaaattttttttaaatcacccaagtgtggtggcacgtgtgcctgtggtctcagctacttgggaagttgagatgggaggatggcctgagcctgggaggtcaaagctgcagtgagctgtcattgtgccactgcactccagcctgggtgacagagtgggaccgtgttttaaaaaaaaaaagtggttttttggtttgttttttcttcaccacaagcagcatactcttgtcagaaacaaaaatacataaaagaaaacagactgggcacggtggctcacacctataatcccagcactttgggaggccgaggcgggtggatcacctgaggtcagatcaagaccatcctggctaacacagtgaaaccctgtctctactaaaaatacaaaaaaattagccaggtgtggtggtgggcgcctgtagtcccagctatttgggaggctgaggcaggagaatggcgtgaacccgcgaggcggagcttgcagtgagccgagatcgcgccaccgcactccagcctgggcgaccgagtgacaccccatctcaaaaaataataatatacaaaaaattagccgggcgtggtggcgcatgcttgtaatcccagctacttggggggctgaggcaggagaatcgcttgaacccaggatgtggaggttgaggtgagctgagatcgtgccattgcactccagcctgggcaacaagagtgaaactccatctcaaaaaaaagaaaacagcacttgtcagcactgccgcccctggcactagatggcagcagcatctgagttactgctctgccctgtgggccagtgggaagctgtttccagcccctggggtaaaatgagggaggagggccagctgccctcgggccccaaggcccccctccctccccatgtggtttatcagtttccagcacctggaaagaacctgcattttctcccagggctgctgtcgattctcctgccctgctcacgttgctgggtgcatgaggactggcagggaggagacctagccactgcctccttggccccttcctggggagattgagcttcccacaaaccaggtgggcaagcagaggctgctgggtggcctgacggggtcgtcctaactggaggatggtgggtccctcctgttcctcagggactctccaaggtggtcctgttgactttgccatcagcacccttcgacccctgccagcagttccccacctacttagaatcatggtgacacagaccacagcctgaggccaccatggggagcggtctggggatgcagccaaggctgccgcagcctctccctacagggttgggcacaggtgggctgctcttgcaggtgaccacccggttttcctggggaacatctttgaaaacgcgatagtgctgacctgtcccgtgcggtttctaacgcaggcactttaaaaagaaggcccaggctcgatcccgtctttctagttttgtttcacaatgtgaaaattactgctattctttgtaagtgtgcagatgctatgtactcatgtagaaaactaaggtaaaatggaaacacattttaaaaggtaatgatcacccgagtgaatttgatgatgtccgagacctactttaagatgcacttcgatgaaatgcagttaaccatgtgctgatcattgctgaagctggtgacgggcttgtgggggttctttacactggcctgcctgcttttgtgtcagtttggtgtccaaccttaaagacgtaactactacaaatattttgagaaatacctacctaagggtgttctgtgccaacatacagaggtagttctagaatctctgctttgtatgtgtgtgtatgtgttttaagactttatttttttagagcaattttagaatcacagcaaaataaggcgcagcgatttctcctatgccccccagccacccccactcagcctcccccgtgatcagcatctcagtagagtggggcgcttgttaccagtggatgaacctatgctgagacgtcgtcacccagtgtccgtagttgacattggggttccctcttggtgttggacattctatgtgtttggacaaatggaacccttggctttaacccctgtgtttcatgacaatgccatttggtgaggttctttgttcattcatctacatgtggtcgagatgcttgtgagccaaagagtcatgctctgttgggtggcaggacaggtgtgtgatgggacctttgcagccagccttctcgatgggagtcccagctccttcccaggagctccgtctctgggcaaatttcccagtccctgtggtttcagctgctttattagaaaatggtcccttctctgtaggattagtttgagcgttaaataagtgaatcgcatgtaagcagatgtgagtgagtgcagctcttgtccctgttttgacaacggattgcgttctctcatgcagctgtgctgggtgatttcaccattgccagctgctggacattagactctgtccagtttttcactggctggacagtgctgtgcctgactcagtgcacttttggggccaccagccccatgacaggtgccctttcctgcactccagcctctaggaccttttggcctttccccagtttgagagctgcaggccccagggtttctctgagttgtcataggcagttgtggctgcgtctcttcctctgtgaatacaggttcctttagcagccaactctggggtcctttcccagcacagatgtccagagagaggcacacggtggctgtgggccttggggggttctgggctccctgcctggtctggcccagcgggtgcctgggatggccttggtgctcctgttctcacctgtactctctgcccccagggaaggctacaacaatccccccatctcaggtgagaatctgattggcctgagcagagcccggcgcccccacaatgccatctttgtcaactttgaggatgaggaggtgcccaagcagccactggaggctgcagcccagacgtggaggagagtctgcactaaccccgtggaccggaaggtggaggaggagctgaggaaggcaagtcctgcgctgcgcctggccccggtggctccagcctctctgttggcttcccgtgtttacccagctgctccctgttcctggctgtggggttggctgcactgacctttacccattccttagtgcatgggaacttctcaccttcagatgccatgtctaaaggctgtgtcggtataagttctacattcccaaggttgaaaatgcttcttagagttcttaagaaaaatatgcgtgcgttgttcagatgtgacataaacgtggagctctgggatccactgagctcttattcttccattcactcattgcagccaagccagtggggcacctagtgtgccaggcccagcactttcttaccgttagaactggaaccgtgctgccaggcagccctccttccccgggcttgcgggtgccgtggagtcctgcgtccccactggcatgagcatcaggttcacaggccactgccacctggagcccggcgcttcccttacgcagtgtgcctgtgggagaccacgtggatgtcttgttgatttccagcagtcactggggcacactgtcagtggctccttattgcccaccaggcacagcccacattcctgacctgaattggctcgtgaggcccgctgccccagccccctggccctctacactccggccacactgacctttgcagtcctccccgggccaggctgtccccttcagccctgacgatgtcccacctcaggcacctgttctgtagattggggcagcatggggaccctgggactctagcatgtgccccctgagccgtactccccaccgcgctgtgggctctatgaggacagcgaccatgtctcttatcgtttgagagacccagccccacaactgcacttggcacaggctgggcatgcagcccaggcttctgagggaagggatgaattagtgagagcaggaggtcctagggccacgccctgtgtgtccagcccctgtcctctaccagctcctctctggaggggccgctggggcccagaacatgttgggagttcagggccgaagggtggaagctgctggtgctcatctcagcctctgcccttggcctccccagctgtttgacatccgtcccatctggtcccgaaatgctgtcaaggccaacatcagcgtccacccagacaagctcaaggtcttgcttcccttcatagcctattacatggtaagtgtcagctgcccacccacctgccttggtttccacccatgtggtccctggtccctgctgtgatgtcttagagccacagtaagagcagccaaccccctatcctggctccccatccttcctgccccacccccatcctggcccatccttcctacccacccctggcctggccctcatccttcctgccctgcccccaacctagcacctcccccgtcctggcacccccatccttccttcccccctgtcctggccccccgatcctagcatccctaagacagcttattaaagccagctagaaaagtttcagctccctgagtccagggcgccctccacagcctgttgggctgcagaacccagcccctgaccacagcggccccatgtcgtcctctacctgtgttgagtggggttcagtgggaggcagatccacctttgatccacaagcatgtaaagacacatgtcattactgaggttccaaaggtgctggttggaaagggatcctccccgctgccaggcctcacagagcattaggggaggccagcgtaagacatgactgtgagggtctgcaacaggcagtaggacacaagaaagactcatttcttctgccttgttggacttccggctcaggagagcgacctgtgctgcttggcgttggcattttattttattttatttattttatttattttgagatggagtctcactctgtctcccaggctggagtgcagtggtgtgatctctgctcactgcaacctccgcctctgggattcaagtgattctcctgcctcagcctcctaagtagctgggagtacaggcgcacgccaccatgcccagctaattttctttttttgcatttttagtagagatggggtttcgccatgttggtcaggctggtctcgaactcctaacctcaagtgatctgcctgtctcggtctcccaaaatgctgggattataggcgagagccactgcggctggctggcattggctttttagacataagccattcaaaagctccgtttagggacagaagatgtctcatcgattaggccagtagtaacattgggcacttaatatgtgccaggaaccatggtaaaggctccacgggcgctatctcatttaatcctctgaaaaaccatgggaggccaggcatgatggctcactcctagaatcccggtacttcgggaggctgaagcgggagaatcgcttgcatccaggagtttgagacgagcctaggcaacataatgagaccccatctctacaaaaaaattaaaaattagctgggtgtggtggctcgtgcctgtagttccagctacttgggaggctgaggtaggaggatcacttgagcccaggaggttgaggctgcagtgaaccgtgattttgccactgcactcagcctgggcaacagagtgagaccctctcccccaaaaaacaaaaacccacaggaaagggtgctccttttccctccatctgacaggaagaccaaggtttggaaaggccacgtgccctcaccaaggtgacagggcctgcatgtggcagagcagggctgggcatccagagccctgtccccagctcctgagctcttctgctgcctcactgtaggctctggcccgtccagggacctgggccttcacctcacctcacattttccccacttttctgtcccagataacaggcccctggcgcagcctatggattcgatttgggtatgacccccgaaaaaacccagatgccaagatttatcaagtcctcgatttccgaatccgttgtggaatgaaacacggtaaaaattcctgaaagctttgcttcctgcctttctctctctttatctttcagtttctagcattctcttttgtagtaagaatcttttcatttggaaagaataaaaaaaccttttgcccccgttgctgagactcttttgaatgcagaatggcgtggaaacgaaagtcctagttctgtgctggccccaccactgaccgcccgtttctgaaccacagtccctcattaagtgactccacgtgccctatggtcctgtgatgcaggccaggcacttgtgagagcatcagtgcccgccctgcctgggaagtgctgagatgtgttggtgaccgcagtggcgtgcttggcagtctggggttgccctctcaggagctggccccatggacccaactcccatctccagtgtgaagccagtgttgtgtgccgacgggccctgtgcccgcccacctgacttgcccgccctcgcctacaggttacgcccccagtgacttgccggtcaaagcaaagcgcagcacctacaactacagcctccccatcaccgtcaagaagacatgtaagcgtgccaggcgccttttgtgggtcatgagtgatttgccaaggaaggcggggcacctggacccagacggggaggtggttcctgggggtcactccagggctctgccggtcattcctcccctaggagggggtgggctggcaggagggcagggcatggtggttgggagagacacctcctccccaccctgcacattccaagcactgctgttgtccccacgcagccagccagcttgtcaccatgcatgacctgaagcagggcctgggcccgtcggggacgagtggtgctcggaaaccagcttccagcaagtacaagctcaaggtgggcgcccctggaggccaggaatggaggggaggacttccctcttggggccgggcaccttgtgggtgacacctggggggctgtgattagggcagctctgcccaccggggcctcggcaccttgcttccttttaggtcagccttcagacactgagggtgagaactcgggtgcaaagccccagggctgtgtgtgttggggacatctggcgaagaggtggtgacaagtctcagggaagtctggcaccagcagctgcatgtggttgtccttctcgagccctttgggagcctgggcccccactgagccacgtgaccactccgggaatgatcggaattgggcacacacaggaggacagagccagagcaggccatgtgggctgcagctgtggcaggagcctcactggctcacgtttccgtcagtgcggttgcccagcgggggttggcggtttccagagctgttcccacattcaggctcccgcaagccgctccacagccctgggggaggccgagaagggggcatcccgcacggtggaatcacctgctgagggagtgggtggcagagatgagtgcagcagagacgggtgatgcgagggacttgctgtcccccagtgtctggggccctgcctattttctaggttttttagacctttgctgccttcccagtgaggggcgatcatgccacagcctgtgcggccttccttctcgaggcctctcctaggaggccgttatccttactctagaactacatggctgggtacggaaaggagagagcaaacactcactaagccctgcttttcccagaaaagatgtcagggcagcccatagggggacatagggtgacaaattagcagcagtgggtgagggataaggtcagagtgcaggagggcacagagagcagagcccggcacaaggctagtgccagccccatgccatgggcgccatggcctgctgcacgggcgggctcaccgtttccagtggccccaggagggcctgggtgctcctctgcctctcccagagcctcctggggagttggacattgttttttccccaactcctccgtggccttccagcctgtctgcccaacctgctcctggtgaccagccagctccctggagagaccccatgggagcctacatggagtctgcaacactggcagccccagggctctggctcaccttccctgtctctctccccctttgtcaccaggactctgtctacatcttccgggaaggggccttgccaccctatcggcagatgttctaccagttatgcgacttgaatgtggaagagtacgtatgggaggggccctgagacactgaggggggcccgtgggacccagggaccaaagcggtctctgaactcttccacttcacgtcggccttcatctccggcaagagcactcgcctgtctgggagtttggtgctgccgagagccctggcatgctggtggccctcgtagaggcggtgccctatagaaagccgtggctccaagctgcgcagagacagttcttactgttatgtccttgctcctcttccactgtccacataaaggccccatgaggtggttctcaatcccaggacccatcagatcccagaaaccttttatcgacttgttctcagtgatgtttaaagaattgcagggaaagggcactcactgggatgagaggagatgggaacacatcaaatacatcttgaactctgctgaaagccatggttcaccagaagcatgtgcagtggtaacacggccagcttcatgtgtgtgaggcggtccagggagcacacaggtttagggccccagctgggaacacacagcttgtgtttccagttcctctctgtagacttcgctcacggggctgcctttgatctcagtacagctctgcctctggcaaaaaccaacactggcatctcttagcagagacccgccctgggactttatgtcccaaccctctccccacccccaggttgcagaagatcattcaccgcaatgacggggcagagaattcctgcacagaacgggatgggtggtgcctccccaagaccagcgacgagctcagggacaccatgtccctcatgatccggcagaccatccgctccaagaggcctggtaagagccgcttggggtaaagggggtccaggatgcctggtgatctcctttgagacagaggtgtccctaaggggacccattcctgggaaatggcacccaggtggcatcatcttgcccctggccctggtgggaggaggacattgtgagccagagcccagcccaggtgctggcatcaccccagctgcccagaggctgcctcagccgaggccctcagccctgcggtccggggcaggagacaagcccagaggggctgggtgcagcagcctggcactgccatcggggcctccacctgacgccctcacaccagcccatgtctttcagctgtgcatgcgcaggctctgcctctgtcttcttcctgttctgtgtggcccagccccttcctggaaccaggcagccctggcaggagtgagggccagctgcagggaaagtgaagggggcaacacctgccaggctgtgggtctcacgaggctcgggggagttataagaggccccctctctcagggaactcctcccaggcttggggaggaggcatcctggacccagccacgccccacagatctgaccgaagcaggggttcttggtcttgcttggaacccagattcagccccctttgggaatctaatcaagggtgtggaccctttcccagagaaaatggtgtgttcactcctgagggtccatgggcccttgaagctgctcatggctcccctgctgcaggattcccctgggtgcccgtcaaactacagcttccctggggggcctccaccccatacttacccaccagcttcttaagagctcgagctcggacccttatagtagtaaacaggctccccagagcctggtggcctttctggggccacccggcagcctgcatgggacacccatggccttgtctcctccggccccagctctcttttccagctcagccaaggctgatggcggaaaagagcagctgacgtacgagtctggggaagacgaggaggatgaggaggaggaggaagaggaggaggaggacttcaagccatccgacggcagtgaaaacgaaatggagacagagattctggactacgtgtgacagggcccaaggctgggcctccctgacccggccagactggtgtctggcctaatgagggagccggggctccccattgccacccacagtgcccggaatggccctaggaggccctctgaggagagctagagtcccagcaaagggtgcagctgaccctagcactggctgtgacatgctgcttggtgctgcctctggtcctgaggggttagggacatccccaaagggtataccctggctctgccacccatgaaccagcccagcatccagccagtgagtgggcacccaatgcctctcaggatgagaccagtaaatgccggaggtggagctgggcagctgtggagccccaggccacaggccagtctcgcttggctctcatgactgtggtggtggagatagcgtggggagcctcgcccatggtctcacgtggcaagaagtgcctttagctctggatcccaaccgtttggcacagctttggccacagccaggcccctctggaattgtccttattaaaccagtttcccgagaa

SEQ ID NO: 2024 - DNA, 27830 bp, Homo sapiens; identical to SEQ ID NO: 2023

SEQ ID NO: 2025 - DNA, 23456 bp, Homo sapiens
gtatagtagaaacaggattttaatataatattcaagtctagcatttgctatttacaacaaataaatattgcccctccccaatcagtaaacaaacattttttttttctttttgctttttatacaaatattcaatcaccccacccccaccccaaatcctccttcctcactaacccccgtcttgcatggtctcgtaaagcccaggacgcagtggtgaatggcacttgcagtggcatgagattcaacatcgatgggactcagctgggactgtcctcactcaccgggtgcagagtctggtccatgaagagggtttctctctctgctcccaggggagggctggggtaagcggtgggtgagactccctcactctcagttggccctgatgatggaatctttggtgcagcctgagaaaggctagagtggtgggaggggccgggacccctgcgaaggtcacaggccagtgcctgtgggcatgagagaactgcagtggtcacagtgggtgctctggggtgcccatgggcacaggtggcagtgacccacacctgggaaggtgtcagggaagtgtacagaggtggcgcccgggggcaggcagggcaccatgccatgcccgttggcactgctccttggcaaaagtcagctagtcctctggttccagagagcagaaggcacctaaggcagcgagtggtccacgggaggccaggtcagcctgaccaatggcaggcgtcaatcccagcagcgggagaggttcaggatgaaactggagtctggggtaccctgggctggcaggtgggaggaaggcgcccagctggcctgggccactctggtccataagtgcttggctaccagccagccagaccctgggaggatgccctcagaagatgcccttggcaatcttgagtcctttctgcttcatgcgagggagggtggagctggctccgtgcttgaccttcactcccttggtgaaggtccgcttcttgaggacaaagtcatagttggcggtagagttcatggcatagaagacgttggcgttttcagggatcttcagctctggtggggaggggcagaggggtgatcagggatgctcctgggggccctgcaggatacccctaccgcttgagagcccatacaaggactgtcttgagccacagacctcagatcccctccaatacagctccagaactccaaggacccctctcaatgactcctgcctgaggacagactctgctgaggtcctcacaaaacctgatgactcttgtttaaacagggactgactccagaaccccccggcttggcctgagctggcagagggtcaccccgtcctgcccatactgcagtgctggctgcccacctggaacaggctttctagaatccaggtcacctcccagaatcctgccctactcaggacaagggatccaaggaccaggaaaggacaggcctgccccagggctctggcgcccgttccagggaggcctgtactccttgaaccctggcacccggcaagcacttccttttggctccatttcccaccatctcctctggcccacagcctgctataaaccagagctgggctcgatttgtgctcctgccgacatcgtgtggcttttcgtcatctttaacctctctaggcctcagtcttccttttctgtaagatgggggtcccgcctaccctgcccacctaaccgaaatggtgcaagaagctgccagaggatttagactgtaacttctagggatcacaggagtcattgcttactgtctgggctaatggtgggaggtggtgttcagctcactggaaagaaaacagcgatgatagtatttatagttaacttttatggtgcacatagatgctttatatatacatgcatatatatacacacacatatacatgcatatatatacacacacatatacatgcatatatatacacatatatacatacatatacacatatatacatacatatagatttttacatatatgatgaacacactggctactttcatttccatttgggggatgagaagacaagcacagagggcttaaggagcttgcccagcgtctccaggcccaggataccccactctgagcctgcactggttcttgacactttcccagtttctagaatactgagttggcctcctagtagcctgttctgcttttagaatcacacactcatggattttaacacttgacactttggtccacagctgtcaccattctttgtagagcacatgttttcttgtcttagccagaaagagtcccttccagtgggccacgtggctaacctgtcccagtgaaaaatgccttttctctttgctcctcactgatgtgagctttgaactgcctgttcacgcctagggaagggcacacactggggaggtccagtggttgctggggacagcaagcagacaatgggggcagccagggctgccctgtccacagtgtctacccacactctgctggtgaattttctggggccaaaggcttccaacctggggctggggagtggtgtggacctgccccctctgccatcgccctctggtcttctgacttactccggtcatctgagagaatctgcagcagctcatagtcctccggctcctcctcctccaggttgtgtttgtccatggccttgcggattacagccggagccttatcttggctggtcacctgcatcgcggcgggggatggaccatcagggaaaagaccctggagcggctcccccagagtgcagtggccaaggaccctctggagtcccctcagcaccaagcacaggcactcacagcctctggccaggtgctgggtccggagagggccttgtcacattctcctactccccaagtgaggcctccgtccttctgttccccatgtgaggcctccatggaatgaggaggggtctgtcccagcagtgcctaccctgcttctcctgtaagagactgttccctcctcccacacttccttgagaagcacttgcccctccaggataacagcatcactgagcctggggaacagacagtccctagtccaagccctggaggtaagaaaggaggggccggccaggatgctcagtgtggtcagcataggccaggcccctgctaccttgaccctgagggccagagcacaggcggaactcggacatagggccacaggtgactgcttaatgacaaccatgctagctcctggcaatgaggggtcaggagcgtgtgtgaataatggggcacctgacccagggctggggtacagagggtgggggttacaaatggttcatctgtcgcaggacacctggaggatgaagaaagagcccccaggcaaacccattctgtgagcaattcccatctgctgtctccaaatcctgtctagactctgaccctgctggccccttccagggctcccagcctggttgccacagcggcctcctaaccaacacccctgcggctctggtaccagcccacaccagacagagaagccagccatcattgctcctgtcttcctccccgagaaagtcgaggtcctggcagggctcagggcctatgtggccaggccctggatacttccctgacctcacctcccctacagcaccgccccttcagctcctgggggctttgcacggctgctcctttcctccccctctgccctcaggccagccttgtccctgatcactaccttcttcatttctgtacctggctgacatctgtccttccccgccaactacaaggtagaccccgggagggcagggatggtgcactgtgttcagggtgcatttgccgccagtggagggaggcacccaggccacccccgccggcttaccaggatgctcttgtacatgttgccattgtccacgtccaggctgacgcggatgatacagcagtcgcccacctgctggttgtagagcggcagcgcggagctggagttgcagagccctgagacagagcgcttgtgggtgcgtgtggcagccacgggcgtggtggaggctgaggaggacgaggtgctgctggaggctgagctgatgccggaggtctccggggatgactgtgaggctgattcccagaactgagggagacggtaagatcagcagatcccactgccctgtgggggcaccccaggccagctgccagatggggaaccttctagaagctgtgttcaggatccagggcttcctggccccatgcatggatttggagtggggagatgggaaaggatattggggagaagggcaggcagtcaccttcttttcctggccatcaggagactccgggacgaagctgatgttgatctcctccacgtcggagctagaggagccggccgagtgcacgctgagcgcgtcagcgatgtccccgctgctgaggtaggggccacacctgagctggtcacaggacttggagtgggagctgccactggtactgagctcagtgctgggggcctggcggctgggtgaagagttggcttagttaagggggctccccaaggacacatcccaaccccacagcccctgcaccctgcgcccaaggactgtgcaaagtgctgggacagttgccagtactccattcaccacagccatctgggagagcatttagtatcaccccatttcacagaggaggaaactgaggcccaaaaaggtgaggggactcatcccagtctcagggccagtcagcagcagggtaggattccagggccagcctccctgactccctgagcccaggctcagccctgaagcttctgagccccaaggcagctgcccctaccacccttggccaggcccttactcgctccagcgcttgacaatggctgtgttcttcttggtcctgagggtgttgctggctgactcggatgggggctccagctcgcacgacaggttgtagctatgagcagaggggcagtggtgtgacaaccaggggccatgctccggccttcccccagcacctgcccagaagctggagtcggggtgccccggccatcctcaggcaacaggggctgaggctgaccatgggtcatagctgctggccctctggagctggccccctaggacagcctgcccccactgtccccatttgctgccccggcctcacctctcagtctcgctgagccgctccacggcccggaaccaggccccaaattgctcatctggcgcgatgctgtagttgttgcaggccgactgcagcagcttgatctgggcgatcacctcgaactcctggggccagagggaagcacagggcggtgacaaggccccccgggcagcacaggggccagtctctgggtctttgttcttggggtcccttcctcccctctactcccatccaggccttcctgttctcaaagttgggctcagccactccccaggaggtggtcctggattataacctcctaccctcaccctccagtgggaggggacccccttctctctgtgtccaaatgtcccatgtcccatgaatctaaggagagggtaggagttgaaatgtcctaccctggtgggtctgttttccacccctccccaagtcagggctgcctgcagctgcttaccttcctcctcttctcaaagttgatgagtctgccctggaaggtggacacccaatggccgtcagaaagtgaccccttgaccattacagtctccccacctcatgctgcactatcaagagtgcccaccagggggcagggcacgcacacccctggattgaagccggtgctgggcaccagggcaaggggacatgcgggcagaggcttggggacttcttgtccagcactctcggaggacaatggactgaggccttgggtgagaaggccctgctcagccaccacgtgccgcctgaccgctgagggcctggcttccctctgtgctcagggtcactgcctgagggatgggctgtgtcccactcagccaaaccctgctgcagctctgtgtttgggcagccctggggtgtcaccagcagggcactgagctgtttactcattgctgggacaggtgtggcagcccagcccccagggctcagggaaggtctctcctcccgggccctactccagccccgcccggcacactcacatacagatagtccttcatggcagtgtccagcatcaccaggtcggtgaggaacgtgcccaggtagggaacggtgccctggatgatgccctgtgacattggggtaggaggatgagcaaggcccctcccctgaaggctttctcagcccccagccccaactggtctcacttggaacagctgggggacctctgggggcctcctggggcccactgtctccctggaccccagactccctctagccatctccctggctggcatctgggaaatgccaggttcccaagtcgtgtggcccctggccctccccagccccacacccgcctgagccggctctgccaggcctgtcctttcgtggctgcagctggtcttcccagataccagctgatccaggtgtggctctgctagggtccagaggaggctacctctaatggggcccataggcaccgtggctagagaggaaagggccctcctccctacccccaggccagccccctgcccctccgcggccttgggcactctcaccgtctccttcggccgtttctgggctctcttggggttcatctccagggtggcaaacttggaggtgccctcctgccagggtagaggacagggtcagcaaggccctatcccctcagccctcaggcaccctgacctggggtgctgccagtgtggtcgggttccagggctgaccctgtatcaatactcactagtgtggggtcctgggccggtggcctggccttcctgagcctgcctccccctctggaaagtgcggatgagaactccgcctgctgcatggtgcggtggctcacgcctgtaatcccagcattttggaaggccaaggcaggtggatcacttgaggtcaggagtttaagaccagcctggccaacacagtgaaaccccatctctactaaaaaatacaaaaattacctgggttggtggtgcacacctataatcccagctacttgggaagctgaggcaggagaatcccttgaacccaggaggtggggattgcagtgagccgagatcacgccattgcactccagcctgggagacagagcgagactccttctctaaacaaataaaaaaactccacctgcctcgcagggcctcagagactctgcgctacagtcctgttatggctgcacactcctttctcccttgaaccttccataaggtcagcaccccagggctggcattcctccattttctagatgaggaaactatggccctgagatgggcagtgacttgccctgggccccccagggactcagaacaggctcttctgtcctagccagaggctctgccccatctgcctttacccgtttggtcactgatcagggtaccgtcctctgggcttctcgtgcatgccagggcccccagtggagctgtgccacggagggagagggacaggtgtcccaggagccccctgcgatgctcccctgtagggaactctgtgtgtgtccacgcaggaggggggccctagatgccatttcactgaccgggtatgccaggggcaccaggcagtgacacttgactccctctgaggcctcgtgaatccattagtcactgaaagttctcctcagtcatctggggtatccgccacagctaatggggtgccatgggaagaattctacagggttctctggtcagtgtctcttctcggggcagggtagggaagccacatggggcctccaaatctgcctcccaggtctggccacctggcccctggcatcccctgcagctcctgtccctggggtaggcaggctgccctctccttgggtgtgtagagcagacagaggtagcgtcaggagcctggcctcccggggacagactgggccggtgtgggggcaggagccgcatccccttcccacccagcaggagggaccggcgaggaagccagaggcctgctggtcctgatgcccatctactcctcctggaacctccactgctacccttactgtgtccaattaactggggccctgtccctcaaacacccaggggccaaacagatccctcttcccccttcacgcacacgggaaaggaactttcccagcaagaagcgaatgccaccgcccgccgccccagcccccgccccagcccccgccccagcccccgccccagccccagcccccgccccagcccccgccccagcccccgccccagcccccgccccagcctgccgccactccaccttgatgagcagctcccggctcaatgagtagttgttctcatctgagaagatctctgacagcttctgaaagatccggaaactgtccctgtcagaagggcaaagaaggaaagagaaagctgggaatggtagggaggggtgtgagtgcaaatccgttttattttagagctgaaagaccccagactgcctgaacgcagcacacagggtaccccagagcactaacgctctgcaggtctggggagggggccttcatgttggtgcaacaggaccccattcccgtttccactgagcagctatttccaaaggggtttttttctttttttggagacagtttcagtcacccaggctggagtgcagtggccagatgtcgactcattgcaacctctacctcctgggtccaagaaattctcctgcctcagcctcccaagtagctgggattacaggcgttagccattgcgcctggcacaaaggttttgatttcaattggatgagggttctgtggctacaacacgaatacctgaaaatctctgatgtggctcaacccaccatctgacagcttaggaagccgagctctgaggcagagctgctgccaactcaggtcagtgaagggtccctgccctcagggtttgtggcctcccatgggctcactaagggggtgatgccagccctgtgggaggtccctggtgcaccaggagctcctacagaggcatgcccacctggaaacgtcttcccacgtcttcttcagacggtggatggagttgctctgcagggcagagaggatggcatacagtgacgagaagttcttgaggatccggcactcctggggcgggaagagcaggaggcatgaggtggggctggagctcccagcttgcctggcctcagtcccccttggccaagcctcccctcctaatgagacagacacccagggagtccccagagggcacgcctgcgacccgggggtgacaggaggattttagctcaacccaaggaaagagtgtaaggaagacgtgagcatccaggcagtgggctgggagagtcaaggccagcatgcccctgggaagggtagactggggcctgtacagggccttggactgcagaccacaacctgagaacagatgaagccaaagtgggggcccaggcccctcctctggcataccctggccacctcgatccagtgctccaccaccctggccctgtctggggctttcgtgcttcggttcccgaggcaggtggtgatgacacagttggccacactgttgaactgggtgacagtggcgcggatggtgggcgccaggtgctccttgcccttcttgtcccgctgggaccagatggagcccaggcagtggtagggcaccaccttcttgaacagttcctggggaggaggctaaatgtcacctggtcctgccccagcagtctgggctggtgctggggaagctgaggatgcagcttgagccttgtggggatctctgggttttatcccgtgtccatgcagggtgcccagcacacaagtgacccgggacagaacgctggtgggaagaagaggagcaccgcctcgcgcagcctcaccaagccccagctccaacaggcggctcacgcctgcccaccccccatccccccgcctcagtctgctccccatccagacgcacatctgctgtgggcgctacaactaagggctttgtccagtgtctgccataggctccaggacacaccaagtgcctaatgagtgctgaggctggtgagcctcctgaacagatgggggtgacccatggatgcaccttggtgagcaccctccgctcccacaggccaggcctgctgagcttcctgtctgttccatctagaatctgcacagtcactctggaggataggggtgacctcatctctactgtccagaggtaaactgaggacttggggttaaggaacgacctggttacttggtgtgtagcagcagagctgggatttgaccagaacatcagctctggatcagcaaatggtaggtctgggacagcagatgctgccagaaggcaggcccacccctgccctgccaagctgagctgctcaccgcatccatcagtgtaaactgctctgccaccagatctggagggaacaccaagaggtgaggcttctcctcactcagcccgttctctgcaaccacaggtgaaggccaggaaggctgtaatgatggaactggtgctggagctggctccagctctagagtttgtgagggagctggatcctgttctggagctggctctagttccagagctggcgctggagccgattctagtcccacagctggctctggagcctgctggagctccggagctggtgctggagctacttctagctctgaacctggagctggtgttggagctggctctggctccggggctggagccggcactgggctgggtgctcgagctggtgttagagctagctcgagctctggagttggttttagagctggcactggtgacagagctgcaagaggagaaaagttcaacaacatgccagcctttcctgtgcctttccaaagacacagaacagccccggcttccagagaagcctctctccccgaacccacaaaacgtgtaccaggccactctcctgcctgtggtccctgcctgtgtggtctgaggctcatctgggcccctgacccagcaccagaccctggagcctcctcttcgtgtggcccagcaccgacccctcctcattcaccctctggcacccaccccagtcctcctcaccctcaggctctgcctcaatgggttccgagtgctccagctgggccaggagaaggtgggcacggcgctccaggtctgagcctggcatgttgagctgcacgtaggccaccagctgcttgaggcagggaaagtccggaggttgacagaaatcctccgagtactggtccagccaggtgcccaggatggaggagatggcactggggacaggtgggtggcagcagagtcagaggcctgggctcccctgagccaggctgggctcctgagccggcccctgtccatctgaaggccacctgccccggcccaagcccccttggctgtccagctaaaagaaccaaggaggcccctggtcagtggcgaacacctctcccctcctccaaggaagccccgcccacagctctgcatgtctcccagcaccccctcctcgctggaatgtaaactccatgagggatcggtcctcctgccgggcatctgcaggtccctggcggctcctcaacttgtagctcagtgctggtgagctgccttactctctcagagctgtgtgtgggtctcatcttcccactaatcctgttctcccagagggtggggtgcagcctgcccactgagcactcactattgaggggtgaggcaatgtgagagcagaggctcaccccacctcttgccaggggcccctagatcagggcccactgagccaaggccagctgggatgaggctatggtgggatgagttcccgccgggggctgccccgagccccagccaccccaggacccctccacagctctcggtcgtctttcttcctgcaggcgaagcccccagaccccagccctctagcaggaaccacaagaggtgtgggagccagggttctgcccagccagccccggctccggccccagccccatgtactctcccactgttcggtggggacagggtcccttcctcttggctcaaagctcactcactttttaagttggtcctggggtccaccatcctcgtcggaataggggaggatgcagccgtatctagaggaggccgtgagggcgtcacatctaccgtacctgcttatgacgtctagtgttactgtctgactctccgactagaacggaggcccaggagggcagggatttttttttttgctttttttcatcaaattatattaaatgcctagaaaagggccagcacacagtaggtgcttcatatatatttgttcaatgaataagtcccaaccagctccttcccagctatctgagcgccccttgggtccctccaacagcccccagatagaatccggaatctccttgacaagtgggaaaactgcttcgcccaaggccacatacaagagaggcttggggcagagagcttccccatgggggacaggaaaatcataaaaacgagcaccacagccccgcagcccattccctacagggccaggcgttgagggagcactttccacgcctcatcccgcccaggcatggtgacaaccccatgaggtcctcttagcactccagtttctctttcatatgagcaaagcgaggctcagagaggtgaatcagcattgccaagacccgcagccaggtgggggtgggggcgagggcccctgtgcaccctgtgcagtggagggctcatgctcaccttttgaacagcaggtccaggacctgttgggtggtggtgaaggctctataggtacacaggaagatggtgacgtaggagaggtcgctgccctggaaggctggcaccaggtgctccaccagcttctccagcgtgccagccttcacggtccgcaccttgcaagtctcataaaggttcagggccgactcattctcatactggggtgggacagaggagggacagacagtcagtggcagcacacgaatctcctggagctcagatggaaccccgagccctcagcagcttgtggcaagaggcaggactgagtatctctagcagaaaaaggttatcagctttaaaagtagaatttcaggccaggtgtggtggctcacatcagtcatcccggcactttgggaggccaaggtgggagcatcacttgaagccaagagtttgagaccagcctgggcaacaaagtgaaatcccccagctctacaaaaaaattgtttacaaaacttaaaaattagccagggccaggcatagtagcttacgcctgtcatcccagcattttgggaggctgaggtgggcaaattgcttgagcccaggagtttgagaccagcctgggcaacatggcaaaaccccatctctacaaaaaatacaaaattagccaggtgtggtggtcccagctacctggggaactgaggtgagaagatcgcttgagcccaggaggtcaaggctgctgtgagctatgatcatacctctgcatggcagcctgggtgacagagtgagaccctgtctctaaaagagtgaaaaaatttttaaagtagaatttgaggtgcgggaatgatttaaatactgacaccttcaggtccgttgttagctgagtaatggtagctgccctgtgggaagagcgtcatctgagagctctaacaaaatatccccattctagagatgaggaaacagaggcttatccaggggctgggagggactggcccgttaggacgcacagcatcttccccgtggcactgttttgttttgttttgagacagtcacccaggctagagtgcagtggtgtgatctcggctcactgcaacctcagcctcctgggctgaagcaattctcatgtctcagcctcccaagtagttgggattacaggcacacaccaccatgcttggctaatttttgtatttttagtagagatggggtttcaccatgtgggccaggctggtctcaaactcctgaccttaggcaatcctcctgccttggcctcccaaaatgctgggattacaggcatgagccactgcgcctggctcctgcagcactgttgaagtgtcctcagaggactcacagtggccccacagtcatgaggagctgaactggggcagtggctccagcctcccttctggaatattatgcagctgagtcaggccccggctctcaacctggaggaaccccagggatgtgttctgggagatggcaacttgcagagacctaacagcctgaagcccttttgtccttgggtgaagacagccccactactccagatggtgtgcacatctgggagaaggcatggaggatggtgaggctgatggctgcacacccggggaagggaggtcaaacatgaaaacccgattaagcctgggctggacagtgggggtcgggaagggagtgaaggccgtttcctttgggatcagaactgggggccctcaagtgaaaaagtcctgggagggatccccagctgcgtctcccagtggagaccccgagcgcactcaccccgagccagcgctgccccttgttgcctccgtggtgcagctgcaccttgcgcagggagatggagtagatgactccgttgatcagctcctcaccgatctcctgcgtggagctctgtgaagacaacgcccggcagccgggcgcggggacgtcaagggcctgcctggccaccgtgcaggggatgcacctgtgtaacctgtttcccagatagggcacagactggcggctgcacagacctacagcctggggtggaatgagatcacagctcgagagccactgtcccggcactccacttccccaacccggccagccacgacctgggacgtgattatgatgagtccaccaggcttccaatcccctagtaactggcttctgctcctgcccaggacagacccaccctcaagccatccccttccacacaggggactgttattcagccattgcacagatgggtaaatggaggctgagagaggaacaactggtccaaggtcatgctgcctcgggtaagtggtgaggcagggaccccagggctctgacacggctgactgcatccaggcggctatgccccaagagaaggtccccctacctccccagggccagaggcccatgggcatcctcacactcacccctcctctacccagcctggggggccctggctgacctagcaggaacgcacagctcctctgggcccagccctggtgcgttggcagcccaggtctgggcaggtgtggggcaccccagacagccacatcccagccacttccttcccctctgctcattcatgccctcgtgcctgcttgggcaatgggagttcccagttccctgaccatcatcacgtgaggggacgggtgtgagaggtgacggtgctggtatccaggcagatgctggggttccacagagccctaaaccacaggcctagactggaacaggaagggggcatctggccccaggcagtaaggaaaggccgttgtcttaggagacagacttcccccacctggcaggctggcctaggtcacttagccacaattacccccggcctcacagccccctatgccacctgctctgtccagggacggaatgagcttgcagcgggtagaggagccggggggttaaggacatcaacctcagaggttaggaaggagctaagaggtactggcctggcccagggtcattaaccgcccagtcagtgccccagcccaggtaggcgtggagctcagagaaggcctggcagacagtgctgactcaggcccttccctcaaccccagcaggagccaggtagactgtccagcatgctgtggacgggaccctggcctcctgcctcctgcgcaccctcagaggcccaggagccatcctggaagtccacttcctccgacctgaggtcgcctcccacgctgggctttgtacaacaggaaagctgcgggcattgtgccgggctcctgaccgccaccgcctctggacagagagccagccccatttcttggaagttagcagggaacccacaggcacactcacacccacaccccacaaacagccccgccaggggaggtctggcccttccactgacaggaaaagagacatacgctcaccccccttttcctgactcacacatctctcccctgcctagaaagttgttcctttgaaaagaaaagcattagaggttacagcgaccagggcccccaaccacccgggcctcctcaggggtcccagactgcctcctgtgaaggccgttggctcagctgggagtctctctctctcccagggattttagccacatctggaccagctgggaggcagacagtatcctgagtgtccaagtcaccggcagtggctctgagatctcgtgcaggacaagcccgccacaggggactaaacattaaccctgggggagcccagcacagcacccaggtcctggctgagcaccatcagtgcctgctggacagaggtgtccccaggcaggccaatccccaggaggggctgaagccaggtggcctcggctgtccctgagcaggtctagagagcggctcctccgtgagctggcaggccagcagctggcccagccctgcttggtgtcatgtgatccctgcacccttcccccacccccggggggccctcttctgccagccgggtggtggggaaggatgcaggcccaacactgagagccatgcatgcttggggtaagggagttgccaccctgtcacacagtcggggagacgctctagcccgcgtggagctggcctgtcttctctggtcgcttcccgtcacagcagcagcaggcatggaaccagaccatagagctacgtggagtacaggggctgtttaaaccatctgctcagatggtggaggtgcaggctccagagagagctgccctggggtctgggaacaaagtggcagagtaaggcctctatcccttgccccctcacaggacagagaaagaaagcagccaacagccctggcagctgccccagaaccctctgcagcaagaaaggcagggttccagcacccacaggccaccctaggtcactctgttagcagacagcccatctgggcagcgcctgggccccagggcactctggccgggctgggagctcagagcgggaggagcaggaacggcctagtgaacagctgatgcagagaaaacgctttcccctgagggcaggtgcccaggcagccgctatgagctgactgctaggaggagaaaagaacaccacgtgcttggctgtgtcctcaagggacactcctgtcccacccctagcaggcatgctgatgtccctgggctctgggacccagtcggcagctgtgcctgtaaacacactgtctggccttctaacatttgggtcagtgcagtgagggtggcatggggtccccggtgagcaggggcccccacaccccaatgtctccagggacacagcccagagccctgaagatgaggatgggaaacagggcctggtggtgtctggtgagtgtgtcacctgatcagccttctcagagtgacaggccagcaggatgccgtgtccctggctgacagaaggaggaagccacaggccaaacccagactccctctgggtagaatagtgagggtcttgaggaaccctacggggcctgccccagccctgccatctccccgctcaggccaacggcacctcctcccagcatcagccttctggtgcagctccggactcagacgcctttccttggaaaccgtagctagtggccccctgccccatggatggctccaggaactcaccggcccctcccaaggagacctggctgagggctgaagcggagtgaggagagggctctagcctgcacctcggcctgctccgcccctggtcctccccgggcctgtgtgtggaaaggctcacggcagagcctccgtgtgcgtgagattgtcctgggggacctcccaagcccctctgagctgctgctcaggtcccagtcaccagaggtcaccccggggtgcttgccacccccctgccagcacctcacagttctggcccaccagacagcagctccctgtctctcgctggctctgcccagcccctggccctcggccttggtgtgtcatctggggagggcagcactacctgtcacaggcaacagtgggggtcaagagagaatgcacacagctcggtgaccggcactgggacctgatggcgtggtaccggacaacacctgacatcatatccccctggggccggcgacggatgctgggctgtaaaaacctgagggaaacttgtctgaggcctgcctaaggctcagggacctagccgagggacactgtaaagagaggctgagtcaccctgaaacccagtgggtgggagcagctttctgacttcagctttccgctccaatacagaagccaaacgtaaaacgcatcacagaaggctgctcgctctctacagagcccaggctcctgcgacagtgcggggcccacgctgctgtgcccttctccgtcctacagaggtggggacccatgcccgaggacaggagccggtggggcgtgtgctggctgagccagaggtgagagcccaggacttctcaagtcatgagctcggaccatgagccccatcaagggaggtggaacgcaagggcctcgtgtccgtgtccgtgaccctcctgccctcgggcctgccctccagctccaggtgggtggacccaaccctgatccccagcgcacagacaaagcatcaagatgacaggaggccagcccggggtgtgggtgggccacactcctgatcctgggcatggcagcccacagaggcggcctcagaccgggacgacacgcggtgcctgcccaccaggatgctccctggcctcagaaagtggaggctgggaaccaaccagtgctgagccccgcaaaggccggcccatctctccagaaaccctccctgccggcctgtgccctgctactcactgatgggaaaatcgtgcctcaagcaggaggagggagaaccagacctccaggtcagccgcaagccttgggcatccagggtccctgtccacgcccagcccctgacagtcaggtgaacacagggccaggcccgggaggggcgtggctggtggcagctgaggaggaaggtgggctggtcccaagggggtgcagggcagccccaactttaaccagctacagtgcccagcacatgcgggcacttcctgggtgcaaggccctttggacacccatcacgtttaatcctcctaacgccctgcctgatggacaaggaaacagcctgagaggaactcgcccaggtcaggagccaggacgtggcagccagaacagggatttgaaccctggcctgttgggacccacccaggcctggcgctgcctctgccatggtctcaggcttggagcagagtccagccccttgtggcacagatgtggaggaggggccagagacaggaaggatttcctcaggtcacacagcaaattcgcaggggagggtggcagggccagctttctagcacctgcatctccgagaggtttgtggacgtgccctgggcaaaaggcctacaagacaccaggccagggaagtgccatgctgaaggtgccaggtgacgcacccgaggagcccagggcacttggaagggtcaggccgctcccctggcacctaatcagaaaacctcattgtggcagctgctacctgtccactgtgccaagtgctgtgcaggctgctcctcaggtctcttgtctaactcgagggtcctcaccagaaccctaacaggagagctggcatcatgtccattttacagatgaggaaactgaggctcaggagcacgtctacatctgctagggggctgagctggcatcccagcatagctctcttctctccagagcccaggctccctgcccctcggttgagatggacaaaagtctccaggaatgactacaggggaggctgccaaagcatgcaagcttccccatggaggaaaacgccaaaaccctccaacgcaggtgtcctgccccgcccgccaagccactgttgggctgccatcccactgcctcccccgcccgtgggcagccaaggtgtgcggaactgggagaattgggtctgctcaaagctcagcttgtcctgcatgaggctgcatgcatcagtgtctgccccttaacaatcaaatggggaacactgctctgctgttgctgtatatctgggaacacagtgattctgggcctgcaaggctggaagtccaaccctgggactgggtggccacagcatggtggcaccacgccatgggagccatctgggcggccaaccagcagctcttgggaaccagtccttgactgcctgggtgcagcttcctgaaaccgctccactggctcgttcagagcctgcctgcagagggccagtgataaatctccccactcttttctcattggcaacgcagacaggtcctggaaatgcccaatttccaggttaagaatcagaccccagctctggcaacgagcagcttgatatctcccagggccattcctgagcctcccgggaaacaggccagcatgcctgagcatcccccgcctggagaaggaacaaagacccaggaccagccagcctggtccccctcttctgggggaccctcccgagtagagcaagaggggaacctgagggtcctgggggctgccccttcagagtcacccaggaagctctcctggaagaccacagtctgtacacatgcatgcagggacacacacccacacagggacaggccctttgccttggggtcttcagtgtcaaagtgctcatgagccctggggattaaaccgaagacctgcacacagtgtgatcaagagatcaaacagtgggaagacgcgggaggctgaagggagatgctccctgtgaatacagagaagccctcttcactccagcccacctgcaactgccctcaggccttgggtcagaatcctggccctgccactgaccagcttggtcactctgtgcaatctaattcacctctgttgcctcagtgactttatctgtcaagtgagctcttaacagtcttgaccccaaaaggagatgatgcaaattacttagccaaggacctccccaaaacctgctggctcttattagctgttatcttaaacctgtggggtccagttctgggcttgcttcctccaggtagctctccccagcgtcctgtggcccaaagcacttttgccttcctctgagccataagcttccctactgctcacctgacctcagggcttctgggctgcctgggcttcctctgactcctggtggctcctgcacacagtaggtgccacagagaacacagcccatgcttaaatcctggctgcggcccttgctggctgcacgggtgtttaggtcagagacttcccttctctgaccccctagcttcctagaaggtggtgttggcacctactctgtagggttggtctaaggcagatgaagtgagggggtggcccacaacctgcactttttgtctggccaaagcaacagcctgtccagagatgggggcacggaccaggtcacctccagaaagcaagaactgtgcaggccaagctgggtcattggtggcttggcttagaatcgggaagataagcggaagcccagatgtgaggagatctggcagcccagagggaagcaccgggtggaagctaggtagggaaacagggatgcgggggaaggcagaaactgtctggtggtttccagagaggacagggaccaagtgcgcagcgtcagctctggcaggccacatagacaccaggaaaccagccccaggacggggggtgttggcaggagggacagggacttccccgccccctcccttgggcccttggtaaatggtcattgtgttcagtttccggcagtggcctcctctcctgccaggatcctggttttcctgacccagccagaagcttcccctttgatttctaaatagcagtcgaggtctggatctcagtgctgaggctgggcaaggagcgccagggccagagagagggaagacaagacccccaggcaggggtggggctcagctctgcctctccctcagttcctcagggacggagagagggaacctgcacggccactgtgagcgctccgccggaccctcccagcacacaaagcccgagctgctgccagaggtaatgaaagccagatgagcgctgggctggtgtcagcctcccacccccaccctcccaggggtccctctccagccgccaatgaggaccagagccctggatagatgagggttgagggaacacgtctggtccggccatctgccaagctcaggaggaaagggtctctcaggcgtgtggtgttcccccaccaagagctctgcccaacactgggcggagaaacaagtcgcatccaggccctgtctaggtaccgggacaccaagaggcacgagactcaggctaacaatcgccagcaatcacaacgcgccacagtctaaagccatgaagcgactggagacgcagcaaggcaacacgatgccgcacggggactcaggaggttcactgtgaaggctgcagcccagccaaagctctgatgggccctgagcccccgatccaggaatggcctctgtgcaggccctgtgcccaggcagagcagggcgaggggggcatctctggattccactccctctgctgtgtagtcagcagcagtcaggtgggaggcagatggcaccacccagagacccagggcacacgagaaacaagcccccgccctcacctagtcaccctcccctccatccatcacaggtacaccactcccttctctgaatcctacccagtccttaccgattcagggtgttggcactctttccagttaagcagaaacaagtcttgcccgccctgggcctgggccaccctcctcccctcaccaccaggacatctggtcccacgtgttggaggcctgctgctccaccccatcccccgaccccccccccaccccgctctgagcagccccgatgtccctggtcaccagatccacatctgccccaagtagggtctgtctggaaggcccctatggtctcatcacctctgaggattctaggatttggccttcccgaccacttgttccacacctgcatcgtaaaggctaacgacgcgctgcgggccctgggtgggaactgagtgaaataaggcacaggccaccgatgtaaacagggacagtgccgcagaaaaaggtccacctgggctgcagcggccttggtgacagcaggccctggaacggtattgaggggcgcaaaaccccagccgtggtccctactgttggacggggcgcggcggcagcccccactgcccaccctgctggctgatttctgcagaaggccccgacccccacctatggaggagagaggagggaggcggcccgctgggatcgcccggccccgtccggggctcgccccgacctgcccagctctgccgcgggtggggaggctccgacgcaccccccgcccgaccgccccagctcacccacctccgggcgcggcaggtcggggtctagctgcgtgaagctgtgcagcaccaccgggcagctgtcggggacgcccacctccaggcgcacggcgtcccacacgctgcggctccgccgggagcccggaaacagcggctcggcgccgccagcaggcccggccgcctcggcccacatgcgctgcaccatggaaggctcgcagcgcgggc

SEQ ID NO: 2026 - DNA, 4554 bp, Homo sapiens
ccacccagaggctgatgctcaccatggggcgcctgcaactggttgtgttgggcctcacctgctgctgggcagtggcgagtgccgcgaaggtaagagcccagcagaggggcaggtcctgctgctctctcgctcaatcagatctggaaacttcgggccaggctgagaaagagcccagcacagccccgcagcagatcccgggcactcacgctcatttctatggggacaggtgccaggtagaacgcaggatgcccaattccatttgaatttcagataaactgccaagaactgctgtgtaagtatgtcccatgcaatatttgaaacaaatttctatgggccgggcgcagtggctcacacctgcaatcccaccagtttgggaggccgaggtgggtggatcacttgaggtcaggagttggagaccagcctggccaacatggtgaaaccccgtctctactaaaaatacaaatattaatcgggcgtggtggtgggtgcctgtaatcccagctactcgggaggctgaggcaggagaaccgcttgaagctgggaggtggagattgcggtgagctgagatcacgctactgcactccagcctgggtgacagggcgagactctgtctcaaaaaatagaaaaagaaaaaaatgaaacatactaaaaaacaattcactgtttacctgaaattcaaatgtaactgggcctcttgaatttacatttgctaatcctggtgattccacctaccaacctctctgttgttcccattttacagaaggggaaacgggcccaggggcagggagtgtggagagcaggcagacggctggagagaagcaggcaggcagtttgcccagcatggcacagctgctgcctcctattcctgtgcaggaagctgaaagccgagctactccacacccgggtccgggtccctccagaaagagagccggcaggcaggagctctctcgaggcatccataaattctaccctctctgcctgtgaaggagaagccacagaaaccccaagccccacaggaagccggtgtcggtgcccggcccagtccctgcccccagcaggagtcacacaggggaccccagatcccaaccacgctgttctgccgcctgcggtgtctcaggccctggggactcctgtctccacctctgctgcctgctctccacactccctggccctgggaccgggaggtttgggcagtggtcctgggctcctgactcaaaggacaggtcaccttcttcttgggcgagctcttcttggggtgctgagaggccttcggcaggtcatcacgacccctccccatttccccaccctgaggccctcaggatggacaagcccaaacaaagcaacccccacggccccgctagaagcaaagcctgctgtgctgggcccagtgacagccaggccccgcctgcctcagcagccactgggtcctctaggggcccgtccaggggtctggagtacaatgcagacctcgcaccatttttggctgatggactggaacccagccctgagagagggagctccttctccatcagttccctcagtggcttctaagtttcctccttcctgcttcaggcccagcaaagagagagaggagagggaggggctgccgctgaagaggacagatctggccctagacagtggctctcagcctggggacgtgtggcagggcctggagacatctgtgattgtcacagctggggagggggtgctcctggcacctcgtgggtcgaggccggggatgctctaaacatcctacagggcacaggatgcccctgatggtgcagaatcaaccctgccccaagtgtccatagatcagagaagggaggacatagccaattccagccctgagaggcaaggggcggctcagggaaaactggaaggtacaagaacctgctaacctgctggctctcccacccagaccccatgctgcactatgtgggcttcgtccctgtcattgatggagacttcatccccgctgacccgatcaacctgtacgccaacgccgccgacatcgactatatagcaggcaccaacaacatggacggccacatcttcgccagcatcgacatgcctgccatcaacaagggcaacaagaaagtcacggagtaagcagggggcacaggactcaggggcgacccgtgcgggagggccgccgggaaagcactggcgagggggccagcctggaggaggaaggcattgagtggaggactgggagtgaggaagttagcaccggtcggggtgagtatgcacacaccctcctgttggcacaggctgagtgtcagtgcctacttgattcccccagggaggacttctacaagctggtcagtgagttcacaatcaccaaggggctcagaggcgccaagacgacctttgatgtctacaccgagtcctgggcccaggacccatcccaggagaataagaagaagactgtggtggactttgagaccgatgtcctcttcctggtgcccaccgagattgccctagcccagcacagagccaatgccaagtgaggatctgggcagcgggtggctcctgggggccttcctggggtgctgcaccttccagccgaggcctcgctgtgggtggctctcaggtgtctgggttgtctgggaaagtggtgcttgagtccccacctgtgcctgcctgatccactttgctgaggcctggcaagacttgagggcctctttttacctcccagcctacagggctttacaaaccctatgatcctctgccctgctcagccctgcaccccatggtccttcccactggagagttcttgagctaccttccatcccccatgctgtgtgcactgagagaacactggacaatggtttctatccactgactctcatgggcctcaactttgccaccttacaaaataatttcagcccaaggcctcattaaagaccttcatgtaataatagccaattagaaggaaaaataaggccgagtgcagtggctcgcccttgtaatcccagcacattgggaggtcaaggtgggaggatcacttgaggtcaggagtctgagactagtctggccaacatggcaaaaccccatctctactaaaaatacaaaaattatccaggcatggtggtgcacacctgtgatcccagctactcaggaggctgaggcagcagaatcagttgaacccaggaggtggaggttgcagtgagcagagattacgccactgcactccagcaggggcaacagagtgagactgtgtctcgaataaataagtaaataaataaataataaaaattaaaaataaattagcaatctgaaaaagataggaagataaaagtatacctagaagtctaggatgaaagctttgcagcaactaagcagtacatttagctgtgagcctcctttcagtcaaggcaaaaagggaaacagttgagggcctataccttgtccaatctaattgaagaatgcacattcacttggagagcaaaatatttcttgatactgaattctagaaggaaggtgcctcacaatgttttgtggaggtgaagtataaattcagctgaaattgtggaacccatgaatccatgaatttggttctcagctttcccttccctgggtgtaagaagccccatctcttcatgtgaattccccagacacttccctgcccactgcccgggacctccctccaagtccggtctctgggctgatcggtccccagtgagcaccctgcctacttgggtggtctctcccctccaggagtgccaagacctacgcctacctgttttcccatccctctcggatgcccgtctaccccaaatgggtgggggccgaccatagagatgagatccagtacatctttggggagccctttgccaccccactccgggctaccggccccaagacaggacagtctctaaggctatgaccgcctactggaccaactttgccaaaacagggtaagacgtgggttgagtgcagggcggagggccacagccaagaagggcctcccaccatgaggccttgttccctcacttgccagtggagggactttgggcaagtcacttaacctccccctgcatcggaatccatgtgtgtttgaggatgagagttactggcagagccccaatcccgtgcacgtgcacagccagtgcccagtatgcagtgaggggcatggtgcccagggccagctcagagggcggggatggctcaggcgtgcaggtgcagagcagggcttcagccccctgggagtccccagcccctgcacagcctcttctcactctgcagggaccccaacatgggccactcggctgtgcccacacactgggaaccctacactacggaaaacagcggctacctggagatcaccaagaagatgggcagcagctccatgaagcggagcctgagaaccaacttcctgcgctactggaccctcacctatctggcgctgcccacagtgaccgaccaggaggccagttccatgccctccacaggggactctgaggccactcccgtctcccccgacaggcaactccgagtctgcccccgtccctgcaacgggtgactctcaggatgcccctgtgcccctcacaa

SEQ ID NO: 2027 - DNA, 10963 bp, Homo sapiens
gttgagcacacgccccctttattataaactgccccaaaccctcttaagaaggaggtggctagtcccctgagagtgcggctcactttggggtgcaggaaaccgagggagcctagacctgttccatttcaaaggctcactctgggggcctgagtgaggaattggctacatgtggttgggagacatcaaaggacccaggacccctgtgaccagagaaaaggggtctagggcgccttcacaccagggtattagaaatgctacgttaagggcaatatgcaataaacgggggactggcgcggcagggttcaggcactctgagtcgggctgaggcttcagagcctgccccgcaaaggcacggctgcagaacgtggcaagcctgccgggccctgcctttgtaactgcgcctcccctccccctgtctcactgttcccatgccgcgttactgtgagatcctgtgtgctactgtgtgcacagccctctgcagttcacagtggcctttccacgtcccttttccggttgaattcgcctgactgacagggaggcgggacagggctggtctgcacgctagtgaagcactggtggctgcaggtctttgggtccccatccatggcaacccccagctccgtggtcagctcctcaggcagctgatatccttgtccagtgtagaaaagcggatcagcttcaggctgggtggctggggcttcctgtcgtcccagaggtactcgggggacagcaccttggacggcttgtttgagatgaagtgacggttcaggtggctttcctcccgccaggcagccatgatgccattggccttgtccgccaggatggccatgtggcagcccctagtaaactcatataccctggccacctgccccccgaagactgccccaccataatagaagtccccttcgctgtctgccacaaaggcagtggaaacacgcctgcgctcataggggaactgctggcggggaacggcgtagtagcttgggtgaatggcagccaccaggtctcccaaggtctcagggccccacgggttccgaaacaccatgtccacatcaaggcagaagaggtagtccacctcccggtgagccctcttagcaatgtgctggctgatggtctccatccggcgcatggatgtctcctcccagtgggagtgaccctggatggggatggagctgagaagccggtggggacccagcgggaccccgggaacggctgcagggttgtcagtgaagatgtagtagtgcacccggtacccacgcatgaagaactcctcggctgactccaggaaggactggatgaaatgagtgtacctagtgatgatcacccggtcacccactgctacaccagcagcctgccagggtccccactgtgtgctggggtcagccaggctggggtccacttaccagctccccatctcaagatgtcactctgctctggccctctgggtcctcatttgtccaattcccaaaatgctagtaccagcctcttacggctgttgtaagcatgttcctggtagagattcttatgctcctaggccaggtgaacttttactgagcaatttctaagtgcccagcgacgttctaagaattcttatgatctttgatctgcataagcatgcccattttacaggcaggaacattgaggatcacagagaagaaagtagtgaagaagcaggtaagtggacgaatcaagggaaggcaagttgagctagatgctgggggcatggaggggggtgtggttgacacagccctgcccccaggccaaaactcattggacaagggggtcacctgaccctaggtggaccattcatcatctggtcatgctttagggccccaggaagttccaggaaggagtcccagaggcccagaggaaggctgccaagcggcagctcctaaaggaaggccaggtggggtcatgggagagacaagggcagaggaggggtctagatgaaacagggaggggcaagggggcctcctgacaaaggctcctgctgtcccctcacctggactctgcatcctgtctatgctagagccagatcccctactccaggaagctcccatcccactatcacaccctacactgtactttctatctgcttggcacctggttccgagcctcccgggtgcccagcagggtcctgtgtgcacgtctggtctggtctcttcccaactataaactcctgtggctcagggagacctccctccccttccccagcccactactcacttccccacggcaaacaccgtgaccccaatggtcaggttcagtggctggtagatgtgctgcagaagctctgggttgaaggttccctcggagacgatgggcgccaaccagggtgtgagtgtcagcagctgtgtgggcctggcagcaggggggccgtgggcactgagaccctcccctgtgaaagcctaagtctcatcccagccctggctctcacactgtgtgacccggggcagcttcgtccccatctctgggcctccctttcctcatatggaaagtggggataatgatagccacctcccagcagggttgggagtaccaggagttaacgcacaccaaggagaagcctggcattattcatatgtgccaagcccctaataaatgagggtcattaaaaagggcaagaccacgttgttatgaacaatggcctgagcacctcctgagtgcaagcacggtgcagatgttacaatacctctcatctgctcctccaaactccagtgagctaggcactactatccacctgcacagaaaaagctcagagcagttgggtacgctgcccagggtcacacagcccaggtccctgactcccagccctgtgtctttccacagtccctaactctctgggccccaaggccaccctgatgttagcacctccactaccccaccttataaatcagagctcttttgtccttttcccccgcccccatcaggcctctccatgacacctacctgtgctccagcagcttgggctgagggtactgtgacctgcaaccaagaaggaccagtgatggaggagagccaccaccctcacggccacaaaagaggaaatgccagtctccttaccataccacgggctggagtggcttctccctcttgtagtgcagcttcatgttgctggtggcagaggcaagaaagagccatcatcatgggtctggggacagagacactcagcacaggaagaaggaggagtcagaggcccctgcgggtgggcacccagggtccatgcaggctccctctgaccttcccccacagccccacccgactctacagaggagctggggacccctacagaagtgatctgtccagggtcactgagagagtaagtggcagggcagtgattcgaacccagtgccgcttgctcccaaggctgatgcttttccaaccatgtcgctctcgttgtcggaaagaagatgtgaaaacctgcaaagggccaggcgcggtggctcacgcctgtaatcccagcactttgggaggcggaggcgggtggatcacaaggccaggagttcaagaccagcctggccaagatggtgaaacctcgtctctactaaaaatacaaaaattagctgggcatggtggcgggcgcctgtaatcccagctactcgggaggctgaggcaggagaattgcttgaacccaggaggcagaggttgcagtgagccgagatcgcaccattgcactacagcctgtgtgacagagcaagattccatctcaaaaaaaaaaaggaagaaaagctgcaaaggcctggtgactgggacctcgggtgagctaagagctaattaacctgagcccactgtaatggtcagttgtaggcaatcctcctgccttagcctcctgagtagctggacctgccaggcactcattaccacccccggctgattttttaaaattttgtagagatggggtcttactatgtcgcccaggctggtctgtgaaagtattttgtagatgtgattaacattctatatcagttgattttacataaaagagagtatcctagacaacctgggtgggaccgatccaattggttgaaaggccttaagaacagaactggtggccagcccaggtggctcacacctgtagtcccagcactttgggggcccaacgcgggcaaagcgcttgagcccagtagttcaagaccagcctgggcaacatggcaagacctcatctctacaaaaacaacaaaaattagctgggtatggtggtgtgcacctgtggtcctggctacttgggaggctgaagcaggaggatggcttgagcccaggaggtggaggctgtagtgagctgtaatcacactactgcactccagcctgggccacccacaaagtgagaccctgtctcaaaaaaaaaaaaaaaaaaaagaacttcacctgtgggctgtggtgtctgctcctatctgagtttcagctgcttagccagcctcaccatcacataagtcaattttcctaggtatgttggccatctgtctaccttcctacctcttactggttctgtttctctagtggaacactgactgccatttctctgcatctgcaaaatgggcaaaaccatccttagccttagcgatgtggtgagagttacacaaggtgtgtgaggggctcttgaccatgtccagcatggagcaagtgctcagtaaggtgagggatcctgggcaagtcttggcaggcagcctccatggtcagtttcaaggtcaaactggttggagaagaaagaagggggtccatgaaggaggtgccagggctgtagggtcagacccctgggctcacctctggctctgccactaactggcccagggacctggagccagacagttgaccctgtgaactttagtttcctcatccacaaaatggggacaataaaaccatccacttagagtgtttccagcaggtggaagcgaggtgcagagaagggaaagaccggccgggcgtggtggctcatgcctgtaatcccagcactttgggaggccaaagcgggcagatcacaaggtcgagagatcgagaccatcctgggcaacatggtgaaaccccatttctactaaaaatacaaaaattagctgggcgtggtggtgggcacctgtagtcccagctacttgggaggctgagggaggagaatcgcttgaacccgggaggctgagggtgcagtgagccgagatcccgccactgcactccagcctggcgacagagcaagactgcatctcaaaaaaaagggaaaggccacccagccagcagcagcaacaaaaggcccgaggccgactgtccccaggcagaagctcataaggatcccacccactgatgacacagtagtctgccaggtccttgtaagtttcttttctttctttcttttcttttttgaggtggggtctatctgtgttgcccaggctggagtgcagtggcacaatctcggctaactgcagtcttgactgcctgagctcaagcggtcctcccacaccagcaccctgaggagctgagaccacaggtgcccaccaccacacccagctgtttttgtattaatattttttgtacagactgggtttcaccatgttgcccaggctggtcttgaactcctgagctcaagtgatctgcctgtcttggcttcccaaagtgctgggattacaggcatgagctgccttgcctggtcccctgtgagtttcaatacatcatgtatgatggggtggctgaagcctccttgaactcttccacctctaggctatgctcttttatttgtggtaaagtatacaaaacacaagatttactactttagccatctttaagtgtacaattcagtggcattaggtacattcacattgtcatgcaaccatccaacatttgtgtccagaactttttcatcatcccaaaaggaagctcggtcctcattaaacaacagcttgccgttgccccgcccccagcccctgggaaccataattctacttctgcctctatgaacttgagtatggaaagtacttcctataagtggaataataaagtttttgtccttttgtgattagtagctacttttttttttctttttttagatggagtctcagtaaccttgtcatcccagctggagtgcagtggtgtgatcttggctcactgtaaccttagcctcctgggatcaagtgattctcctgcctcagcctcccaagtagctgggactacaggtgtgtgccaccacaccccgccaatttttgtatttttattagagatggggtttcatcatgttggccaggctggtcttgaactcctgagctcaagtgatccaccagcctcggcctcccaaagtgctgggattacaggcataagccgctacacccagccaagttgctactcttgaatcaacaattttttaaagtcagttcgtcaaattggccctctgccctagtttcctacaagaaagcatgtttcagggccctgctcagaaagccctgggattccaagaagcggtcaggagttagaaggggtaccaaacagcccagcattctgtgcctccctggcagcgagctcctcttttctctccacaagcccagacacactccagctgcagtgaagagttacatacaagaatacaaaagcaggccggtgtggtggctcatgcccgcaatcccggcaggggcgagttgggacgaccccttgaggccaggagttccagaccagcctgggcaacatagtgagaccctgtctctacaaacaaataaaaaaaaattagctaggaggtgtggtggtgagtatctgtggtcctagctactcaggaggctaaagtgtgaggatcacttgagcccaggaggtcaaggctgtagtgagctgtgatcgtgccactgcactccagcctgggcaacagagccagaccttatctccctccgccacgcacacacacaagatagacaaactggaaagaaaaaaaaaagttgtaggtatacttagccaagagtgatgatagagaacccacaaacggaccaaacagagaaggtggggaagaagcacttcacacaagaaaaatttcaattaacgggaagacgtagggaaatgagagtctcactagtaataataaaaaaaaaaaaaaattaaggccaggggtggtggttcacgcctttaatcccagcactttgggaggccgatgagggggcgaagcctggccgaagggggcaaagaccaacctggccaacatgatgaaatgctgtttctactaaaaatacaaaaattagcgtgtgtgcctgtaatcccagctattcaggtggctgaggcatgacaattgcttgaacccgggaggtggaggttgcaatgagctgagatcacgccacggtactccagcctgggtggcaaagcgagactctgtctcaatataataataataataataataataataataaataaaatttataccaaagaggatagcattttccctctcccaatcagcaaggtaggttcatttttgttttcataacctctggtattcccagcagtagcccaggtgtactacacggtggctttgctgggtactgcttgggcagggcacatgaatgagtgactgatgtgctgtggtccttctggaaataacccaatgagttggatcagaacctatccacatcctccggccactaagggaacatatctgaacaaaatgatctttgaaatggagaaagggttatgctgctcatcacaaactaactgagagccctgggaaattgggagcaacctaaatcccgagagcaattggtggtgggaaagagagagaggctcaaaaattatgtgtcagtccctgggtggaataagatgatggtgaccggaccgatgcagtagctcatgcctgtaatctcagcactttgggaggctgaggcaggtggaacacttgaggtcaggagtttgagaccagcctggccaacatggtgaaacgccatctcaaataaaaatacaaaaattagccaggtatggtggcgggtgcctgtaatcccagctacttgggaggctgagacaggacaatctcttgaactggggaggtggaggttgctgtgagccaagatcacgccactgcactccagccagggcgacagagtgagactctgactcaagaaaaaaaaaaaaaagactccttagttgaggaggactttggtcacatgttcatttgttccttgaatccatggaacacaaaattgagcaacaaggtcaagtcctaaaagcactgaacacaacccctgctggtcaccgggagcaacagcaggctgtttatgggcatctttgcactctgtgttctcagtggccagacacagcaagcaaggctcacagctgtgcaacatgtggacggtcagaccatgcagggggctgcaaggatgctggaagaccgaaatgggaatttcacttcacgcttgtcacagcccttaaattacataaatactattgcatttatcagaaacatgaacttaggaatcaggaaccggcagatgaagtgaacttaaatactctcctgtctccccaactgtgagcagccctcagggcccccagttctcctagccacacccatacttacaagatctctgggcaggggagataataggggacataggagactggcagccagttctcaagatacaccctgtgaataaaaaaaagaaaaaaaatctgttgatccactctgcaccagaggctgaaaacgcacctcatgcacgtcattgggagtgcaggtctcccacagtgcattaggaggccaggtcccctgtcattctgtaggtctggctgaccttggaggacaaagcctgctggtattcctggcatgtgtcacagggcctgccatgcagtcattcattcacccatagagtcattcattcctagggagtgtatattcttgatgccaggccccccacacaaacagcagggtgaggggcagccccaggagcttcatggaaggacagaaacagagggtgaatttgggagcgtgaacggggattccccatcaacattggttgaaggatgatccaggcagagaaaagagcaagtcaaaggccaggaggccagtacaaggcagaattcagaagccggagacactagttgggtcttgttggggctggggttggagaacaggtgagtcaggaggggttggtgggatctggaatcctatgaggagatcaaggttttggggttgatctgcagagacagggggagtcctgggtggggatagagacagggagagtcctgggtggggatagagacaggggaagtcctgggtggggatagagacagggggagtcctgggtggggatagagacagggggagtcctgggtggggatagagacagggggagtcctgggtggggatagagacagggggagtcctgggtggggatagagacagggggagtcctgggtggggatagagacagggggagctccgtggggcagactcaccacaggacactgaggcttgtgcccgccaacaggcagaaccccagacccagggccagtctccggcgatgcattgctgggggctgcacctgagcctgggcacttgtagagacccccactggcctgggcggatgaggctgtcccctcgcagggatgtcaggctctgagcctggtctctgaggtcccaggaacacctgcaaaggaacacttttgttgttttgagatagagtttcactcttgtcaactgggctggagtgcagtggcgcaatctccattcactgcaacctcttctcttgggttcaagcgattctcttgtctcagcctcctgagtagctgggattacaggcacaagccaccatgcccagctaatttttgtatttttagtagagaagaggtttctccatgttggtcaggctggtgtcctgacctcaggtgatccacccgcctcggcctcccaaagtgctgggatgacaggcttgagccactgcaccgggccaggaatgctctttatggggagacggtgaccccagccctgcagccctgccctccctcggtcacccactgcggtcatgtggactctaggtcccgctggaccccgggctcagctctggcagctctgggaggcgcacggtggcagtggctcggtgctcagctgttgcttccagctgtcctttgggagaggggctgggaccgacttcgcagaggccgcgaaggcggatccctgccttggctcccgcgtctccgtactaggtccattgtcagaggtgagccgaggccgccgggaggggtgcatgggccagtccaccgtccgctggaaatcaagcaccgaggcacagcgaggacacatgcagtcccagcgcaggatgcgcgggaaggggcgcccaggattccccgaggggagcgaggtggccgctgtccacctctccgggaggcagggcccgggttctccacggaacgatgggaacgcgcctcaactcgctggctcgttgaccttgggccagtcatcccctgctcccggcctcagtggatggggggcggcacgcggcgcccggggggaggacacgcgggaacggctgtaaaacgctgggcgcagcccgggccacagtgagcggagagccggggtcctggggattaggccgctgccactcgggagtgtccggcaagccctctccctctctcttcctctggggcctcagtttccccactcgggcctccaagccccgtctcgcccccgcctcccgcgaacgcagagcccagccccgagcgccgccggccccagtccgtggtcgggacccgggaccctgggtccgagatgcgcacctcctgggctcagggccctcctccttggccccttgcgtggcagggactgggtggggccaagggagcgcgactgtccctacggggtgcagacttactccttgctgccggcccggcgttaggacggttggaggggcgccaccccggcgcggaaaacggactcagctggcctgggcccccgcgatacccgggcgatcggcggcgcaggtggagcctggagcagggcaggcagcggggccgcgggccagacagaaaagag

SEQ ID NO: 2028 - DNA, 3964 bp, Homo sapiens
ctgggggagaaggactttatttggagtcaggtgggtgggagcagggaagggtcatggctggagggtaggtccaggtggtccaggctctgtgtctggtggtagggtgggctctggaggtgcagacccgggggctgctgtgctgggaagaggagcagaggtcagggaggctgcagggtagggcagaggccagggccagagctccctccccaggctctgcagcccccacatcggccactgctgggcaacctcggggctccagagcgacctcagctcctccaatgactgggcaggcctctgagcatccttggtgggtggatggtggggagtggaccgcgtggggacaggtgcagggggcgatgggctgagctgacacctgagggagccggagggaggcctcgctgtggaaaggccgaggaggaccctcactcgggctggcaggtgcaggaatgataaaacaaaggacttcccgaatgtcccaggaactgtgggtgggcagactctgaggtgccaacctcgtgcctgaccctgggggggtctccctggctgtgtgggatgggaggggccagagcagatgtaccctcgaaccccgggaacccaggactctgggcttgtccagtgccctcctaaaggctcactcaccctagtgttcgggaacgcagcttcctgcagagaccaagaaaaacccagggattagaaggcgccctagaccagggcccagaccccatcgcagcccagagctcagagccccagagcccatcgcagcccagagcgcggagccccagaccccatcgcagcccagagcgcggagccccagaccccatcgcagcccagagcgcggagccccagaccccatcgcagcccagagcacagagcctccaatgaggaggacgctaaacagggcccgggagcccctgcgaggagactcggggcacacggggaatgcgggggacatgggaggacatgggggtcatgggacactggagatagcagacagacacagcagagggacacaggggactgggcacagccatcctcacccgtctgcaggggcgtgaaaatgtcctcctccgagagtcccttgcgctgcaccaatttcttaaattcttccagggcctcccggttggtatcagaattcctacctgcaggtgaggtggccaggtgagccgacgtggggacagcggcacggccctgcagggagcagatgccgaaaggagacgaccacggcccagcaccaggacagggggagaggcctgagagtggatcagagctcgggggtggggctggggacagaggagatggccactgcccagcaccaggacaaggggagagacccaagagtggaccagagctctggggtggggccggggacagaagagatggccatagcccagcaccggacaagcaggagaggagacttgagaatggatgagagctcaggggtgggactggggacagaggagacagtcactgcccagatgagaggtccccaggaagggggacagtggcggggactctccaagccactcggcaaccccaggggacctgggcagctcccaatgccaccctgcagggtcacagccctcacctggagggaccttgtctcccagaggcaccggccaccctcctgccctggagggtccctgccccatgaagagctctcttaggacgcttaaggtgaccctcccccttaaggtgaccctcctacacccgagaccccagaagtggcccttggcaggttcatgtcaccgagggccatgtctgtccctgcctggcccatcccattcccacttcaggtacttggaccggctgcccagcggtgcccggcacatgaaagccggcacagggggcttccttttcccccatgccagggcatggtggtgctggttccaccggcttccagaggcagagaccgtggggcaggacacgcagaccccagcaagcccctcacccacaagctttcccatgtggagcaggcccccatggtgctggtctttgcagtaaaagatgtagtggtccctcctgggcagctcctgcaggtacatgagcttcctgcccccatctgtagatgacagagaaaatgggtcattcccagagagaacactcggggccacatgaagaaacactcgggaatgtttcagcggtcacccaggtgccctggacagcctgagccaggcctggctgctccgcacagtgtggacccggacacggaggcaggagcctcctctcaggaaggtcccaatgcaagtaatggagccacaaggccagagcacgtccaggactagagtccggccttcccagctccagcagctgctcctgccccacttccctgtccctaaccctcatcttccccctcagcctccccatctctaatcctcagcttccgcagcactaaccctcggcctccccatccctaaccctcggcctcctcatccctaaccctcagcttcccgatccctaacccttggcccccgtccctaaccctcagcctccccatccttaaccctcagcttccccatccttaaccctcagcttccccatccctaaccctcagcctccccgtacctaatccttggcctccttgtcccaatcctcagcttcctcaatgtgtcaatggctagggcctcccagagggcaggcgtgatctggtccatctcgactgcggacaagcctgtcacacccggtgtctgatgtcagggccaccagccccccaggaaggagaggccagcccctccttggaggtgggcagagctggggccctggcaaaagggcagcctgggcactctctacctgtggaggctggtgcactggggttggcggtgggggagggtgggggtgggagtgggggaggggctcacaggcgctgtatttgccaggctcctccgtcttccgcatcaggattttcttctggatgcacctatcctccctcctggaaaacaggagacacgcgggcagcggctcccaggacacccatggcccatcctcagctcacctggtgcatggccctgacccggcaacctgaaaattccactgccccccaccccaccgagcttcaggatgcccaggctgtttccctccaaggcagggggtgactcttcccaacacccgaaacgtggatggggcaatgggcaccaggtggatctggggaggggagcgaaagtggcctgaggggccctgcagtgggcaacactcacatgaaggtgaacgtggcttccaacttcccaccgcccagggctgtcaccttcactggggacaccttcctgggcctcctgtcctccggaaagtccttatcgaccaccatggccttcacgtaccaggtccctgtgatctggagcaggccaaggccgtgagcccaccatgggtggcccagattctactctgaccctggcactcaggcctgcagctataaccagacacccatggtgcccggctgctgcccttaaaggcaggctgtgttcctgcaccttagttagagctcagctggagtgagttagagccagccccctgctcagggctcccagcccccagtggaaggagggcatgtctgcaccccatggacccccgggccccagcaccaggtgagccctccctccacagggcccaaccctgcgagaccttcgggcttcaggcgtcagtgcagcaggaacccctgagacgagcctgctccggccctgggcctcggggggccgtgtctgctggaggaacaataggacccctccaccaccaccccaggctgggagcacggggtcagaagccagccttcagtgacacctcctaaagcagggcccctggcactgccccctgcccaggagtccgcctggctcctccatccgcccacgccaacccagctcacatcctcctcctccagggtgaaggacagggcagcggccaggccgagcgtgacacccaggaacagggtcttcatctccagagctctgtgctgccgacctcggcaggtcactgggcg

SEQ ID NO: 2029 - DNA, 8493 bp, Homo sapiens
attcattccacaggcatttattgagcatctactgtgtgccagatgcaaagaagacagtgggataactgggcaaggagcattccaggcagagggaacagccagtgcaaacatgggagatgcgggtgcagtgagaaggagcagaggagaccaggagttgaggcgactgcagagcgattgcagagctcatagacgtgatgaagaccagctgggcactgcagcggctctggcttctgctgtgagggacggggagctgtggagactccctctgtttggtcccatttccatattgctgagcacctgctgcatgctctctgtcctgctcagagccagtacctggatggaggctgtgtgttctgggtggactgggggagaatgcattctttgcagaagagacaaccaggtgctgaggcctgaagtcataaccagacctggggcactcagacaaggactggtggccaggccagaggagcagagctcagggtgtgcacagaactcagaagtcagaccactgaacagtgacagaacctttcagcccattggcaatgaggctgcccaggcagccagaggcctggtcaaatctgaggtctgcagagatggagctgtcattctgtgtttcctttggcagtcccaacaccagcctcgttgcaccctcctcttagcttccctgggttctccagccctaagggtggtagcagcttcctgcaagtatccagctctgagattctgcaacatccacttttgctctctgagccttgcaaaacctgcacaatcagtccctaacttatatcccctctgtttgaaatacctagtgtggtttctatttcctgacttgactctgactggtgtggtacttggtataaagaaggttccctggccaggtgcggtggctcacgcctataatcccaacgctttgggaggctgaggcaggaggatcacttgagcccaggagttttgagacccgcctaggcaacatggtgagacactgtccttacaaaaaattttaaaattagccaggtgtagtgacgcaagtctgtcatcccagctgcttgggaggctgaggtgggaggatcacctgagcctaagaagtcgcggctgcaataaacagtgattgcaccactgcactccagcctgggtgacagagtgaaaccctgccccctcccccaaaaaagaaaagtcccatgaaacagacctacacaggtgagattctgagattgatctggttctgacctcggtcaggaatgcagtgctgagcttcttgccaacagaatatgagacactagaaagccatagcatgcggtttcatcatgtttaactgtcacctgtggttgcctgagatgaagtgctgactgaagcgagcaccttaggagacacagtggccactgcactgagcagctggtagcagcagtggtgaccatgtggactggggggtgggttggctgcttttgacagtgccagagaactcaaagaaatagccacacctgtcggagaccccagttcttgcccacctctgcatggacgaacctctcgccgaagtggagcctgccgccctccctggggtaagagcccatcctacatgtccccagacaggcctgggtggccggtggactatcgtcaaagggactgtgcagccagggttctccacacccaaggccgcccctgcactcccagcaggagggcgcccgcaccggcggcccgaaaaagtctgggccagcagacagcgcactcacgcccgagaccccgcaatgccgtgtgtccgcgacctcccgctcagggcgtcctcgggtcagggcgcagcgcggcccccgtgccgcttctggtgctcgttgaggttgcaacggtggctgaaaggcttcccgcactcgccgcaagcgtagggcctctcgcccgtgtgcgtgcgccggtggcttaagagctccgacttgcgcacgaaggccttgctgcagtgggcgcagacgaacggcctctcgccagagtgcaggcgctggtgctggcgcagctcggagctgccgcggaaggccttgccgcattctgcgcaggcgaagggtcgctctcccgtgtgcgaaagccggtggtgcgccaggccggaactgccgcggaaggccttgccgcagtcggcgcaggcgaagggcttggcgcccgagtgcgtgcgccggtggctcagtaggttggagcgctggctgaaggccttgccgcactgggcgcacgcatgaggcttctcgcccgtgtgcacgcgccggtgctccgccaggtaggagcccatgacgaaagcctggccgcactcggcgcactcgaagggccgctcaccagtgtgcgtgcgctggtgctgcaggagctgcgagctctcgcggaaagcctttccgcactcggcgcaggggaagggcttctcgctgctgtgcgtgcgccggtgctgccgcagccccgccacacgcacgaaggccttgccgcagtcgggacaggcgtgtggccgtgcgcccgcgtggatcttcaggtgctcggccaggttggagctctggctgaaggccttgccacagtcccggcaggcgtgcggccgcgcgcccgtgtgcacgcgccggtgctccaggaaattggagttccagctgaaggccttgccgcactccgggcactcgtagggcttctcgcccgtgtgcgtgcgtcggtgctgcaccagcgtggtgcttcggccgaaggacttgccgcagtccgggcagcggaagggcttcaggccgctgtgtgtctcctggtggtggatgagctgcgagtgcgcgcggaaggccttgccgcactccctgcaagcgtagggcttctcgccgctgtggatgcgctggtgctggctgaggttggagctccaggcgaaggccttgccgcactcggggcacgtgtacggcttctcgcctgtgtgcacgcgccgatgctgcagcaagtaagagccctggctgaacgccttgccgcactccccgcaccggcagcccggctcctctgggagaggcgaagggcgcaacgcccggtctgcaggctcgctcctgggcccagccccgtcccgcccaccgtctgcggggcccagctccctgccggggcctccctgttcgtccgccgcccccagtgtggcttgctgccgctggccgtcccctgcctccctcggaacctccgtggagttttcccaggccccccagcctccagacacagccccctcagagaggcccctcgtggcagtcttcacattgcagaggacctggccttcctctggggccacctgcagggtccaccctcttggggactccatctcgcgcctgtgacctaaaacaggagagaaaaggcaagtaccttagagaatacaaagaacaccagacagagggcctgagggggacacgacggtgggtgggctgtcatcccccactcttctcctccaggtccctggatgcccaatgccctctggagcctggagcaggaaggccagcaggcgggctagacactcgggggatgggccagcactctgggcctgcctgacagggccacgtgcacatccccacacccggcccggcccagcaggaggggagggggcgccagcatcgcagaaggactcaaagttgcccacgcacctgcactggccctactgtggcaccactctcctctccttgcttcacagggtggggccccaagtgtcaagaaggtggagactccagtttgtgaggaacacgatggacccgtctccattcctgaaggctggaggacaccgcctgacccaaacacagctatgtctgcctcacccactccaccctggccggatccctgggtagtcccctccacacagtatgggcagcatgtccaggctggaggatctcagtggctgttacccaggcaatgtccacaccaggcctctgtgcaggtcagaccaggtggtccaaggcatggggtggctgtgcagcccagatccctgagagagagagaggccaagggtgggagggcctccttggtcctaaggccatgcctgcctgtccagccgatccttcccacagcgaagtctctacagcgagcaaaacccatcctcatttgccctgagcaccttatcatccttgtgtagtctccagccccgctgccaaggcagggcagggacaagtgtgtagatggtgccatacctggaggtggggcctggaaggggcccaggggagcctcttgctcctctccctcctctgtcctggggaccagctcctcttggggcctgggggctggcacctggggacaggaaggcagcagggcagggtgaggtgttcagcctagcagatctgagaaaacaaggggcatgcggtggcatgacccacccttctctgcaccttcagttctcaggacacaatgcggagcacacaggtgtggactggagatctctgactctgccgtccaagccaagaccaccaaactcccacctgtcaccatcactttcccacagcccccaggccctctcagccaccaacccacgactggccccagtgctggctcagctggggtcgtgagcaggggaagcacacccagcccccagaccagcccccactcatctggagtcctggcccagctgactcctgctgtagccgctctgccagggcagtggcctcctcagggctgcctagccactgctcctgcgtgtaggcctggatctctgggagcagtgtgcccaataactgctccagcaccaagagctccagcatctgctccttggagcaggcctcaggcatcagccactggcaacacagctcacgcagctgagccagggcccctcggggccctgctgccttctcatagcagaacccccagaagcactggccagggctcttggagctgggctcacccaccatcagttccagtggactcgggaagacctggggggccagggctgatgcctcactcatctgggcagccatcctgcccctttcctgggaggggagtgcagctgcatggcccagggtactttctctgcagctggaaacacaaaggtgagcctgtgagcacagcaaggccacgaaggtcccctccttgggaccacctgagactgagtaaaaatggaagaatgggggtatcggcgtttctggcccccagtgtcagcatctttgcccacctgtgtgtccaggtgcctgagggacacactgaggtgccatggctgcttgtaccatcccttccccccgcctccccgcttttcttgagggtccctgccctgccctgtctccttggcacccttcatcccacacacagaacaactaagacagagactgtgaacaggacacccagagtcagaccagcagatgggtcctgtttgtcccctccaggaagtgttttaaaaatttaagttaggccaagtgcggtggctgacggctgtagtcctagcactttgggaggccgaggtgggtggatcacgaggtcagcaattccaagaccagcctggccaacatggtgaaaccccgtctctactaaaaatacaaaaattagccaggcgtggtggcaggcgcctgtaatcccagctactcgggaggctgaggcagagaactgcttgaacccgggaggtggaggttgcagtgagccgagatcgcgccactgcactccagcctgggtgacaaagtgagactctgtctcaaaaaaaaaaaaaagagaataaatactgatacatactacaagatggatgaatcttgaaaatattatgctaagtgtaaatgaaaaaattcagacacaaaagacttcatattatgttattccatttatgtgaaatgtccagaacagataagtctgtaagagacagaaagtagatcagcggttgccaggatctgcagggaagagagaaatgggagatacagccgtgggagtgatgaaaatattctggaattagtggtgatgactgtgcaacactgaatataccaaaaaccactgaattacacactttaaaaggatgaattgtatggtatttatgttttttaaaaaagttaccacccaatcccaaaagcttaaaaactgtatgactccatttctttttctttttctttttttttttcttttgacagggtctggctctgtcatccaggctagggtgcagtggtgcaatctcatctcccaggctcaagccatcttcccacctcagcctccgaaggagctgggacatcaagtgcgtgccaccatacccagctaatttttttattttttatttttctatttttgagacggagtttcgctctttcacccaggctggaatgaagtggcgcaatctcggctcactgcaacctctgcccccaggattcaagcgattctcctgcctcagcctccccagtagctgggattacagatgcctgccatcaggcctggcttattttattttattttattttattttttagtagagatggggtttcaccatgttggccaggctggtcccgaactctttttttttttttttttttttttttttttttttgagaagagtcttgctctgtcgcccaggctggagtccagtggcgctatcctggctcactgcaagctctgcctcccgggttcataccattctcctgcctcagcctcccaagtagctgggactacaggcgcctgccaccatgcccggctaatttttttatatttttggtagagccggggtttcaccgtgttagccaggatggtctcgatctcctgacctcgtgatccgcccgcctcagcctcccaaagtgctgggattacaggcgtgagccacggcacccggccggtgggccggtcctgaactcttgacctcagatggtccacccgcctcggcctcccaaagtgctagtattacaggcgcgagacacctcgcccagcctatgcaacattcgtaaaatgacaaaatggtagaaatgagaacagattactagttgacaaaaagaggttaacggggagcagaggtaggagggaagggtatgcggctctgtaagggcaacacggggatccttcgtgatggaaatattctgcatctcagttgtgatattgtactctagtttttctttctcttctctttttttgagacagagtctcgctctgttgcccaggttggagtgcagtggcgtgatgtgggctcaccgcgacctccgcctcctgggtacaagcgattctcctgcctgagactcccgagtagctgggattacaggcaccagcctccacacccgcctaatttttgtgttttcagtacagatggggtttcaccatgttgctcaggctggtctttaactcctgagctcaagggatccacccgccttggcctcccaaagtgctgggattacagacatgagccaccgcacctggcctctagtttttcaagatgccacctttaggggaattgggtaaagcgtacatagggtatgcattacttgttactgcatgtgaatttataattacctcaaatcaaaagttaaattttaaaaaaacgacatctgatttcaataaaaatccatatttgtgtattgaagtatcagaaatccgggtcccccaagggcccatgtttcttaaggcggagccaggcaccgctgcccctccatcctgtggtgtgcgaccccgacccgccagcccccagccgcatctatcagggctgccgtcctgagtccgtcctcgtcgtgggatagcatgtgagccccgtaaggtccttcctgtcggcctcactgctccagcctccccgacgtcctcacgtccacgctgcgtgccctttctgagcctcaacgcctcctcctcacctcgacatgatcagagccacctcccgcgtcagtcccagcgcccacgcccccaacaacgggcacttgtccgaccagtcacgggtacttgtgtctcccccacaacccccaaggcctaggctggacaaacaaatacggagtggataaaggggaggaagctgcggccaggtggcgcgaggcctgtgcgggcagctccggaggctgggaggcgagcccagcctggtgagctccgaaactacccggggctggggactgatgaacgaataaatgaatgtgggaagaaatgatggcgcggcagggcatgagtgaatgagtgaaagaataaacgagcaggaggaacgatgccacagaactgatcgccataaggctcgcgttcaccgagagaacagcaaacgggagccatttccgtcccgaccacggtcgcctctggcccgtgcagggccacttccgggccgctctggacggcgcggaggcctatctctcggtggtcccagagggcccagctcagggccgaggcccgtcctgccccgcgcggcgggagtggttggagccggagggcggatctgtgcctggccgagggtgtccgtcggcgtcactcaccgtcctcggcccgcctctgcgtccactaggagcggcctgaaagaggcccgcacgcgggctcgagccgcgtggaatggtaggagggcgggcaccgggtctcctgggggcgcggttgcattcggcagagcggcccaaggcgtcgcgtttctccccactgcgcctgcgtaactat

SEQ ID NO: 2030 - DNA, 16938 bp, Homo sapiens
agttgtagtcgccgcgtcgccggtgcggccgccattgtccggcgttcggcgagtcgggtggtccctttggctggagtgcctctctggtctggggatcacctcaggcgctgtccttcactgggcgatccagcatggaccccgaggacgaaggggtagcgggagtgatgtctgtggggccgccggcggcccggcttcaggtaacaataacaacaataacgacggcggcgggctccgggcaagcgtctcccgcgcagactgaccctttcacctcgcggcgcgatgagagcggcaccgctgttaatgcccttgacacgtggggaaactcagacgcgggtcggggcgtggtgaccgtcctggctggtcagagagggggccgggattccaaccaggcgcctggcccccgaatgcgcatgctccacgcggctctgtcctccccagggctggggtcggtcattcccgagagaatcgagcaggcccatctcctgcgttctgctccgccccgccgacacccttgcccattccaggaaggtctgtcctcgtgttgactgataacagtaattgtagcgttggccgggtgcccagatggcaagaatcatcgaatagagatgctttaacgcgtggagtcagcggacacccaccgggaccccagcaccgcggagcccctgccctggggcttgggcacaacctcttgggggcaatgatgggtcaccacgcactgagtgtgatgagagtgaccaccagggtcgtcccctgcgagactgtgggagaactgcagtgcagggcggtcagtgtttgcagggccatctggccatcagagctccactttctagacaaagtggttgcggcctgtgttctccataaagctgcctcgcgtggcaggaaacaacaataattatccttcctcaagctctgcaactttgaaattatacttttttttattttttgtcgttggtttgttcatggggatttgcattatttcagatttggtacacaaagtgagacttgataatcttaggttgcaggttttcagatgtgtgttgctccaaatttgcatgaaatgctaccacgttttattttgttcttgctgtggatgggggacaaggaatgagtcgtaagaaaggcttgagagaaagtgtattagttacctgttgctgtgtaactcaaaacttcgtgacctggaacaacaataaatatctcacgagttctgacaggagtaatggaatgtcctagctggtggttctggttcaggcccatgaagttacagtgaagatgtcagcatagctgttgtcacctgagacctgagtctggaggatccacctccaggatggctcactcacatgtctgttgataggagacctcagttgttctccatgtaggcctctctttggaactgctagggatccttgcaacatggcatctggcttcccacagaacaagtgatccaggagagggcaaggtagaaactgtaacaccttccatgacctggattcagaattcacactcttgtcacttccacggtgtcttactggttacaaagtcaaccttgttgagtgttggaggggaccacaccagggctggaggtcattggcagaggtggtgggggagcatcttggagactgtccatcacaggagacaaggaccagaatggagagcttcaaggtccagtgttttatctggttatctgtgtctgctgtaacaattcactacaaattttgtggcttaaaacatttgttcttaggttctggaggtcagaagtctgaaatcggttttctggtctggaatcaaggtatgagcagagctaccctccctaccaaggttctagggtagaatgtttcctcgtcttttccagctgtgagaggtacagaccttctattccttgcctcatggccctttgcctgtcttcaaagcctgcattgtagcatgttgcttcagtgatcatattgccttatgtcttctatagtcatagctccctttgtctacctcttataaagacacttgtgattgcatttagggcccacctggataatccaggataatttttctgtttgaaaatcctaatcacatctgcacagttccttttaccatatatagtaatattcacaggttctaggaactaggacctggatatccttggaggccattatatatctcagtctaccatagccaggctgagaggagccatccagtattcagtgatgagaaggagccattcacgtgttttaagcaggactggcatagggttgaaaaaatccacttatgcattaggggctggtgggaagggagatactggcagctcaactaaggcagtgggaaaaagagaggagtggttaggcccagtgaccaggtgttggctgatgctggggtgaaaagaatatgtaaaggagaaacatcagagcacagccccaccccttcaggctccagaagtgcaagacaagagggaaggctgcagggatctgatgtagggcagaaagaacatcatgagacaacaaggagtgggcttctgctagaattccaagaaggaagccaagaggaggcatgaaggacttgtatgatgccactgagaattctcatggcttggacagaccagtactcagtggacgtggtgtctaggctgtcaccagtgactcttgcagaatgggtgatgatgggaggtgggggcaggaggcacgggaagcacaaatcaaaattggtgggcattctgagtggaggaaagcgaagacacagagacaggagcagagacctcagttcccaaccaaaggcatctttctgtatgtttcctattagagccacctgctacctgtactaaaatttctttcttattttttaatctactcatgtttttcttaaaaggaaatgtccttttaaaattgaagtatttggggcctggtgcagtggctcatgcctgtaatcccagcactttgagaggccacagcagatggatcacttcaggttaggagttcaagaccagcctggccaacgtggtgcaaccccatctctactaaaagtacaaaaattagctgggtttggtggcacatgcctgtaatcccagttatttgggaagctgaggtgggagaatcacatgaaccagggagatggaggtcgcagtgaaccgagattgcaccactgcactgcagcctggtcaacagagtgaggccctgtctcaaaataaaaaataaaaaaattgaagtatttagtatatgtggttttgttttgttttttaacctagcagcaacactggtggtgtatagttttgatttttcatttccctgatgactaatgatgttgaacatcttttcatgtacttatttgccatttgtgtatcttcttttatatattcttcaaagaaataactatacagattctttgcctattttaactgggttgtctttttattactgagttgtatgtgttcattacatattctagatacaagtctcttatcagatatgtgattcccaattattatctcccattctgtgagttgtcttttcactttcttgctaatgtcctttgaactacaaaagtttttgttttgatgaagtccaattgattacatttagttgcttatccttttggtttcatatctaagaatcccttgccaaatccaaggttacaaagatttatctctctgttttcctctaagagttttatagttttagctcttacttttaatttaatttaatttttttttttttgagatggagtctcactgtgtcgcccaggctggagtgcaatggcatgatctcggctcactgcaacctctgcctcctgggttcaagcaattctcctgcctcagcctcccaagtagctgggactacaggagcacgctgccacgcccggctaatttttgatattttagtagagatggtgtttcaccatgttgcccaggctagtcacgaactcctgagctcaggcaatccactcgtctcagcctcccaaagtgctgggattacaggcgtgagccactgcgcccagcctcttacatttatggctttgtttctattttattttatttcttttttttctcttcttttttttttctttgagacaggatgtcactctggttgcttaggctggagtgcggtggcatgatcttggcttgctgcaacctccactttccagactcaagcactcctcctacatcagcctcccaagtagctgggactacaggcagcctggctaatttttttcaaattttttttgtagaggcagggttttaccatgttgcccaggccagtcttgatctcctggactcgagtgatctgcctgcctcagcctcacaaagtgctgggattacaagcatgagccactctgcccagccagcctaatttgttttgagttaatttttatatatgatataagatagaagtctgtgttagtttgaatgtgtctcccaaatttcatgtgttgatagtatttgaaggtggcgacttttgggagaaatttaggattagataaggttatcaggattggactcccttgatgggactagtggctttagaaggagagagagacctgagctggcacactcttgccctctcgccatgtgatgccctccaccatcttatgtcataacaagaaggccctcaccagatgccagtaccatgatattagacttcccagccttcagaactgtaagaaataaactcttttttttttttttttttgagtcggagtctcactctgttgcccaggctggagtgcagtggcgcaatcttgactcactgcaagctctgcctcccgggttcacaccattctcctgcctcagcctcccatgtagctggaactacagacgcccaccaccacgctcggctaattttttgtatttttagtagagacagggtttcatcgtgttagccaggatggtctcgatctcctgacctcgtgatctgcccgcctcggcctcccaaagtgctgggattacaggcatgagccaccgctcccagcccacaaataaactgtcttcatcaaagttattgaaagagagagagagaaaaaaagcaactttctttataaattacttcgtccttaggaggacaaggcgagaggatcacttgaggtcaggagttcgacaccagcctggccaacatggagaaaccctgtctctactaaaaaatacaaaaattagctgggtgtggtggcgtgcacctgtagtcctagctactcaggaggctgagccaggagaatcaactgaatccgggaggcagaggttgcagtgagccaagattgtgccactgcactccagcctgattgacagagtgagactcccatctcgagaaaaaaaaaataataaattattcagtctgtgatattctgttacagcaacagaaaatatgctgggacagggactatctttactcttttccatgtggctatccagatgtcctgtaggaagtgtttgtaaaccacttaatcattatacagcccccaaggggtgatgctttgttgacatggaaactgggaagcaaagatgcttcttggggacgaagtgactgagccaagactctgatccagaaatatctggctttcaagcatggctgcagaagggctttgtttatgggacacattttaggtaatgttgcatcaacttataaaaatcagaatttttcacgtaaaggccaggcgcggcggctcccgcctgtaatcccagcactttgggaggccgaggcgggtggatcacttgaggctaggggttcgagaccaacctggccaacatggtaaaaccccatctctactaaaaatacaaaaattagccgggcgtggtggtgcgctcctgtagtcccagctactacggaggctggggcaggagaatcacttgaacctgggaggcagaggttgcagtaagtggaggtggcaccactgcactccagcctgggtgacagagcaagactctacctcaaaaagaaaaataatttttcacataaaaatctgacctaattttcagcttctcttcagagatgagcagttctgacaaagggacctgtattttcccgtaatcagtgagttctgagtccctgctgctccttcagacagggtccatgctccccatcacctccagtcccaccactcataggtaagtgtccttgtgggctcttaaactggcccacttctgtcatgtgagcctgccttgccctgaaagcaggcgaatttctgaccccagccctgtgtgcttctcttttcaggaaggatggtgaacctgtttttttgttttttttttttgagatggagtctcactctgtcgcctcagctggagtgcagtggtgtcttggctcactgcaacctccacctcctgggctcaagcgattctgctgcctcagcttcccaagtagctgggattacaggcatgtggcccagccaatttcactttgtatctaagtattagtgagtgtattagttagctgctgtgtaacactgtcctaaaacagtatctgttttacttaaaacagtaactgtttctttagctcacaaacctgcaaataagtggtttaggccagtctctgctggtaccctcgtctgtcttgttagatgtaggtcagctctgcctggcgttgttgatcttggtgagtcctctcacatgtcctcactgtacaacccacacctatgtgtagtggcctaataggtgcccagtgagacctgactcccatcattcataacgtgcagtctctcgtgacacaggcctgcctgttttctccttttccattcttcctctgccagaaagcactgatggagatagtccagctgattgagaatgtgtgtgatgtttcaggaaccagtgaccttccgggatgtggctgtggactttacccaggaggaatgggggcagctggaccctacccagaggatcctctaccgtgacgtgatgctggagacctttggtcacctgctctccataggtaagccctgcttcgcaaggtgtgatagctgattctctctgggttataagtcatggggcctctggtgtgaggacctgaccttgggtcctcactccctatggggagtgcatgaagagggaggtctgcccttttccatcaccatgcagagcttcaccatgttgtgaggtgcccacgtgtcctcacagtcgggagtctggtctggagcctgggcttgttgtttctctcctgagcagcccctcacctcctgtgtttttccccatttccaggtcctgagcttccgaagcctgaagtcatctcccagctggagcaagggaccgagctatgggtggctgagagaggaaccacccagggctgccatccaggtgagaacccactatgtgggagcagctaatgggagcagcctagcaggtcactggagatgcacttcatggaaagggtggtggttggtggtcctgaagaccaccccattcactaggagtatacaggactcagcatagagtcatgctgacagctctcagtataatgagaccaacaaaggggaaaggcgcgtggggataagttcagaggaagccaggcatgagcctccagagtcccctcactgtggagtcattcaggatgtgccaggctcccccagcactcaggtgtgacacctcatgagacatgagctctaccagggaatcttgttaagagactcagtgctaggagttttgactgaggctgccacatagacactctctgcctagcacagaccaaggttccagactaccaggagaaagccagtgtttggaataaaccacatagtgtgtgcagtgtgggtgtagtaaaccactctcatcagttagggttgtgggaaccatccccaaatccaaattctcagttgcagccaaaggctaaccttgtgaataggcttctcctaagaatgctggtttcaggcctgccctgttaaatcttttctgcacagtgctccatagccttctcacctgtgctccccatcttctaagctcagaggtcatcacctgtgctccagtgctgagaatcccaccccttcctccctctctgcttcatcttcccttataggttccaggtcattccctctctcaccatccttctcagcatgtcctttctgtggcatcatttctaatatgtgaacctgcccttcatcttctccatttcattcttgcatgtccagattctttgtgttttgttttgtttttaagacagggtctcactctatcgcctaggctggagtgcagtggcgtaatcacggttcactgcagccttgacctccctagttcaaatgatcctcccacctcaccctcccgagtagctgggattacagacatgcaccaccacgccctggtaatttttgtatttttagtagagatgggattttgccatcttgccaggctgggctcgaactcctgggctcaagcaatccacctactttggcctcccaaagtgctgggactacaggcgtgagccaccatgcccagcttttttttttttttttttgagaccgtctctgttgcataagctggagtggcagcagtgtgatcatggctcagtgcagcctcagccttcctgtcacaaatgatcctcctgcttcagcctcttgagtagctgggactacaggtgtgtacccccacacctggctaattttctttttaaatttttttgtagagacacagttgcactgtgttgcccaggctggtctcaaactcctgggctcaagcaatcctcctgtcttggcctctcaaagtgctgggattacaggtatcagccactgcacctggcctttttttttttttttttttttttgagacagtctcactccgttgcacaggctggagtacagttgcattatcttagtctcctaggctcaagtgttccacctacctcagtctccctagtagctgttactacaggtgtgtaccaccatgtccagctgatttttttgatttttttctttttcttttttaaaaattattttactttttttctttttttttctttctttcttccttttttttttttttttagagatggggtctcgccatcttgtccaggctgcaggctgctcaaactaactcctgggctcaagcaatcctgcctcaacctcctaagtgctgggattataggcgtaagccactatgcctgactttttgtttgtttgtgtgtccttttttttttttttttaatagagatgagatctttctacactgcccaggctggtctcaaactcctgagctcaaacagtcctcctgcctcagccactgaaagtgctgggattacaggtgtgagccactgtacctggtcacatgtctagattctgtaaacttgttccccacacccttctttattctcttatgaggaagaattgtgtttagctataaataccctaaaaccaggttggagcagctcaaaataaagaagcatttttcttgtaaaacaggagccctgagtctgctggtactgtcttggcatctcagaggtgccagggctgattgttctgtgattttcccaggctgtccttgggattacagtgcagctgcagcagctccagccatcacagttgtgctccatgcaggaaggaggggaagaggtaggaagaattctgccagccacatctgtccccttttggcagaactctagatgtcacctgctggggtctctttagccagaactaggtcacctcctcttgcactgaccctagttgctagagaggctggaaagctaggggtgtctagattgtcataattggcttgggcgagtcatggtccccttgctgtggcttgtgtgttggtaccctgaccacattctagagtaaatagcatctggccatgggatgtacaaccagcaatgcctgcagattagcctcccacccaaatacttctgatgccacccagggctttctgattctgcagaaaaacacatatgcccccatgatagcgtatgacctatcaactgggagtcgggtgaatctgctgcagaccctgttttcctgcccctttcatcggttgtcactgctgttacttcagacatgtatgtcggaagcaaattctcatcaccctggacatatgcctgtcactcacaagtcttatgccataaccaaatccaggatctaaaacgtgtgcccataaatactaagcaaaatgttgtgcttgcatggattaggagtatggggtcaaaatcatgatggacagtttcaataacttaatacctagacagttataaatactccagaagcagaaggttttcaaggctttatgttaagacagaaacatattttccatgtaatgctttgtattagtttcctgttgctcctgtaacaaagtaccacaatctaggtggcttgaaaaagcaccgatttggctggacgcagtggctcacccctatcattccagcactttgggaggccagggcagacggatcacttgagtccaggagttcgagactagcctggccaacatggcacaacaccgtttctactaaaaatacaaaaattatccaggtgtggtggtgcatgcctgtaatcccagctactcaggaggctgaggcacaagaatctcttaaacccaggaggtggaggttgcagtgagctgagatcatgccactgcactccagcctgggcgacagagcaaaactctgtctcaaagaaaaaaaaaaaaaaaaaggacagatttattttcttatagttgtggaggtcagaagttcaaaatggttcatcagggctagttcctctgacggcgcccagagagaatgcatttctgtctttctcagcagctggaggctgcccagactccttggttcatagacccttcctccatcttcagagtgcttcactctgacccatttccattatcacaaccgcttccctgactcagacccttctgcttccctcctatatggactctttggtcagatttagggccccaggataatctcccatttcaagattctttttttttttttgagacagagtctcgctctgtcacaaggctggagtgcagtggtgtgatctcggctcactgcagcctccgccttcccaggttcaagcgatcctcctgcctccacctcccaagtagctgagactacaggccgtgccaccatgcccagctaattttttgtatttttagtagagatgggatttcaccatgttggccaggatggtctcaatctcttgaccttgtgatccgcccgcctcagcctcccaaagtgctgggattaaaggcgtgagccaccgcgcctggcccatttcaagattctttttttttttttttttttttttgagacggagtctcgctctcttccccagactggactgcagtggcgcaatctcggctcattgcaagctccgcctcccgggttcacgccattctgccttagcctcccgagtagctgggactacaggtgcccgccactgcacccggctaattttttttttgtatttttagtagagacggggtttcaccgtgttggccaggatggtctctatctcctgacctcgtgatccgcccgccttggcctcccaaagtgctgggattacagacgtgagccaccgcgcccggccatcaagattcttaatcacagctacaatatcccttttgccacataaggttccagggattgggatggggacatctttgaggggccgttattcagcataccacatgattaaaatagagagtaaattttttttttattatttttaaggaaaagaagcctagtcaatagaagaagaccgcgtctctacaaaaaaatttaaaaattacctggcatggtggtgtgttcttgtagtcctagctacttaggaggctgagcggggaggattgcttaagcccaggagttcaaggctacagtgagctacaatttgcaccactgcactccaggctgagcaacagagcattaaaaaataaaggaaaagaggccaggcatggtggcttacgcctgtaatcccagaattttgggaggccgaggcgggtggttcgcttgagtccaagagttcaagaccagcctgggcaacctggcaaaaccacatctctacaaaaaatgcaaaaaaattagctgggtgtggtggtgcatgcctgtggtctcagctgttcaggaggctgagcccaggaggttgcagtgagctgagatcatgccactgcacttcagtctgggtgacagagtaagaccttatttcaaatataaaataaaataatggtgaagaatccctgtccaggcagatcccactcccagtgcactcacaggggtttgtgggctcagggatggctgggcgatctcaagcccctccttggcccctgtcactcgtctggcatcattccttactggttccctcttgcggttgctcagcttcacctgctgcaggtcacctcctggctgactacagtcccagctcttctcccatttcctctcttcatcaactgctcaccctctctctcggagactccatggcttcccatgtgccaggatcagtgagttgttctgggcagccaggagtcaggctggagttggagcctgtctcaacctcagtgctctttgctgttcctggccaggccagttcactagtgttctcaagtccccctcctccggatgttcttccgcactctcccagcaggcagcgttagtcttggctggggtcacagtgttgtctttagtctctgtgttttcgtccgtgttgtctctcaggcagtctcccagctcacgagcctgttccatggatgttcctgaggacctgccatgtgctgctgtttgtgctgtggatgcagcaaagaatgacaggaaaggctgagccctcactcagcatctgggagatggaagtcttgagagatggatgccagtgccaggcagtgatgaggccgtaaaggaaatgcacctggggagggcaagatggggtgctcatgccccgggactggcagggaggcctctctgagaaagtgactcaaactggggcacagggagcaaggtgggcagatgtctggggatgagggttcttggcagagggagcagcaggtgcaaagggccccaggaaggagtatgggggatgcattagagggatgtgaggagccatgtggagcagagtgggcgtggggcaagagtcaggaggtgagacgagccagggcatggtggagaagggcacagggtcgtgtccatcctcagaagtgactgcagagtgaatggaggagtgaccagggctggcttgcagtggggaggagggtgggtctgtttggttttgcataatagctttatcaagataaaattgacataccataagttcacctattaaaatgtaccactcagcggttttgagtatattctcagattgtgtgcagctatctttactatctaactccagaacatttcatcaccatcttagtcagcttggggtaccgtgacaaaataccaccgcctgggtgtcttgtacaacagacatttatttctcacggttctgtaggctggaattctaagagcacagtgccagctgattcgggccctggtaagggccccttcctcaattgcagaaggccgccttctctctgtgcccttatatggcagagagaggaagcaagccctgtggtatttcttcttataagatcactaatctcattcttaaaggccccaccctcgtgacctaatcacctcccaaaggcctcatctccaaataccctcacaatggggattagggtttcaacataggaattttgctatcgacattcagtccatagcagtcactctccgtctttcccatcccctgccaaccagtaacctactttctctctctatggatttgcctgttctagatattccatacgaatggaatcttacaatttgtgacctttgtatctggcttctttcactcagcagaatgttttccggcttatccatgttgtagcgtatgtcagtactttgttcttttttgtggctgcataatatcccgtcgtatggatagaccatattttgtttatgcatttgttgaggggcatttgggttgtttctacttttggctattaattaatagtgccactatgaacattagtgtataaatttttgtgtgaagtgacttatattttagaataaacctctgggtgctatgtagagagtcagtttttttttttttttgagacagagtctctgcttggtcgccgaggcgggagtgcagtggtgtgattttggctcactgcaaccttcgcctcccaggttcaagcgattctcatgccttaggctcctgagtggctgggactacaggtgtataacaccacacccgaataatttttgtatttttagtagagacagggttggccaggctggtcttgaactcctgacctcaagtgatcctccagcctcggcttcccaaagtgctaggattacaggcatgagccaccgggcctagccagagagtcatatttgggggccagaggtgacagagcaggaagcctggcacctggccagcctcagctcctccattatctctcccgttgtcaagctctcattcattcattccctcgatacgttccttcagcattcactgagagatatttttgagcttctactacttgtcatttctaggcactggctgtgaacattctagtgcggtgaggtgtacccagaatgaatgaacacatgacctgtattttggtcaggacaagagcagatgagggggcttgaagagggcttggggaaagcgggaagcctggcttataacagagtccctgtcctaatccccagaactggttatcttggatactgggtgagcaagagggtcagaatcagacaaggagatgtgacagcagaagcagaggtgagtgagagagatctgaagatgctgtgctcagctctagaggtgaaggaaagggccaggaatgcaggcagcctctaggaacgggaagatgcaaggattttccccagaacctcccgaagagaaaccagccctgccaacaccttgattttaggacttctgtgttccagaactataagataataagtgtgttttaagttacagcagcaaacagggaactcatataccttgacttcattgccagtgcatggcccacagcaggtgctcaataaatgtttgttgaatgagtggagccgtgtctgagggcacttgatgttaaaataagaggagaatcaggggacttgccagggcagctggttaggaccccatttcaatatcaggcctatggtgttggaggcctgtcccccttccgtttttttctcccaacagctcagagatctttgggttttctttcagcctgggagcctcgatctgaaagccaagcatcacgcaaggaagagggcctgcctgaagaggagccatcccatgtcacgggaagggaaggattcccgacagatgctccttatcccaccacgttagggaaagacagggagtgtcagagccagagtctggcactcaaggagcagaataacttgaagcagttggaatttggcctcaaggaagcaccagttcaagatcaaggctacaaaactctcagactcagggaaaactgcgtcctgagttcaagcccaaatccattcccagagatctctagaggggagtatttgtatacttacgactcacagattacagactcagaacataactccagcttagtcagtcagcagacaggctccccaggaaaacagcccggtgaaaacagtgactgtcacagagattccagtcaggccattccaattacggaactcacaaaaagccaggtgcaggacaaaccctacaaatgtactgactgtgggaagtcgtttaaccataacgcacacctcaccgtgcacaagaggattcatacgggagaaagaccttatatgtgcaaggagtgtgggaaagccttcagccagaactcctccctcgtccagcatgagcgcatccacactggagacaagccctacaagtgtgccgaatgtgggaagtctttctgccatagtacacaccttaccgtccatcggaggattcacactggggagaagccctatgagtgtcaggactgtgggagggccttcaaccagaactcctccctggggcggcacaagaggacacacactggggagaagccatacacctgcagtgtgtgtgggaaatccttctctcggaccacttgccttttcctgcacctgagaactcacaccgaggagaggccctacgagtgtaaccactgcgggaagggcttcaggcacagctcatccctggcccagcaccagcggaagcacgcgggggagaagccctttgagtgccgccagaggctgatctttgagcagacgccagctctcacaaagcatgaatggacagaagccctgggctgtgacccacctttgagtcaagatgagaggactcaccgaagcgacagacccttcaaatgtaatcagtgtgggaagtgtttcattcagagctctcacctcatccggcaccagataactcacaccagagaggagcagccccatgggcgaagccggcggcgtgaacaatcctcgagcaggaactcacacctggttcagcatcaacacccgaactccagaaagagctctgcaggcggagcaaaggcagggcagccggaaagcagagccctggctttgtttgacatccaaaaaatcatgcaagagaaaaaccctgtgcacgttattggggtggaagagccttctgtgggtgcttccatgttatttgacatcagagaatccacataggagagaaactttgctgatgacttttaaccacaagtaaaaaatgtggtaagtccacatagtgtactcatggaaggaggggctgggggtagaaatgtcatgggtgacttctgactttctaaggaaatgatgcttcccaagcacccgaggttggttggtcccaaatctatcaaactcagtgccctctttagcgacatattttgtgacattccttccattacaccacagtgagttcacaggtaatataacctacccacctgtgtaatgtcaaaaaaaatcaatatgcggccccattttgtaaaggatcattaaaatgaaagtaatttatggtagagtaaattgtagagtaacgtgt

SEQ ID NO: 2031 - DNA, 3215 bp, Homo sapiens
tatttttagtagagacggggtttcgtcatgttgggtagactggtctcgatctcttgacctcatgatccgctggcctcagcctcccaaagtgctgggattataggcgtgagccaccgcacccggcctcacccttccattctttgggcatcctctgcccaaactcctttgcaaccatcagacccaggcaaccgtgtggccagcttcctggacctggtcctgggcaaggacattcagcatggaggtcaggatgaatgtggtcatgccccctgtatcctcctcccccagcagcccccagagatggttcccacagtcaccgagctcctcaatggtcacagtagcgctgggctcagagagggcgccttccccatcggtccggtagctgcagctgtagttgccaggctgatggactggaaaggtggcctccacatcctcctgggcctcaggcacctccagaaactcatggtcgccctcccgcctcagcagaaaagtcacaccccgcagcacacctcggcacactgctgttgttttcaggccgggggtgatccaggacactggcgccatcgagagccagggagcaggcaaggactctgtgggtggggtggagttgaagagtgcttctgcataacaggagacgtgggaagcccagcagaacctgggccccacactcataagactgtgaaggagacagggatggagggcattgctgggaaaaggcaggcaggcaccagtggaaacaaggcatacggcaagagaaaaagagtgtgtgggagctgtacggcatgccgggcctgctggggacacaaccatgtattccttacaacacagacatcatccccatttgacagatgggaagattggggcttggggctcagagacatcgggtgacttggaggaagggagaccccccagtcaacaacctacccactgcctcctggcccccaattcatgccccggctcacttggccctgtcagctccaggagcttgctcagctgggtccatcctgtggacaagcccgagcggcagcggtagcggccctgggtgtcacccgtcagcaggaactggtgcttgatggcaggtgagtcaaggtgcacaggctcctgggccaccccattcttgaacagctggaagtctggagtctccaggtgggcctggcacgtcagcgtcacattggccaagggtttcagcagtgattcggactctgcccacaggctgggctgcgtctcataaactgcaaggggtggctgggatcagctcagtgccacagagacagggctcccccccggcctgggcccaccattcccagacctcacccctgcactcacatatggctgcttctgtcactgggccccaggtgacacctgcggagacagcccccgtaaggctcctgttcccgccccctcccgccccagggacccagaccccaggaggcctcaccccacagcaagagaaagaccacgagcatggacatgatggtcgcgctcactccggtgcagtgagtgtctggggtgagcgtctgcagcaatgaggccccaagggagggcggtggggtggctcgggcactgacctcttcccgtgtttgtccttcccggaaggcgggggcagggcccccatggggtcagggcaaagggtgaacttctgaggcctcaggatgcccagcaacaattataatcaataatcatgtatgattaataaactaaatcaagagtgataaaatgatgttaaaaccacctcatcctcatttcagtgatggatcctagaacctgttctagaaggagacgctgagttctccccactctacctggagctgctgaggtcaagtggagagtgccggggctgaagcccagcgagcccctccctgtcacaccacactgcacatgtgacaccaaaggtggggttcacctcttttcagactttctgcggttgccctcacatgggctgtctggaggtgcaccctcactcttcctgaggactgtggttccttctccatcactggttcattctgcatggtgtgacccaccacggctctggagtcggatttccacccaggtcattcagctgagacctgcgcttcccaggcctacccgtgacatgtgctcagttacctgagctgctggtggtcactcatgtggctatagcctgctgcctggaggccaggcctcccgcttcccctgcctccccctctcctcaccacagcctgttgggatggaacaggacaggggtgagaccgtggtgctttcacactcagcctccatggacatcctgtcattcccacccggggaggtctggtccccaccctgggtgtcccagcctagctccgctacgagtgtgagggcccagggcaaccgcctagccctcatctgccccctgcactgcatcctccccactcattcattccacaggcatttattgagcatctactgtgtgccagatgcaaagaagacagtgggataactgggcaaggagcattccaggcagagggaacagccagtgcaaacatgggagatgcgggtgcagtgagaaggagcagaggagaccaggagttgaggcgactgcagagcgattgcagagctcatagacgtgatgaagaccagctgggcactgcagcggctctggcttctgctgtgagggacggggagctgtggagactccctctgtttggtcccatttccatattgctgagcacctgctgcatgctctctgtcctgctcagagccagtacctggatggaggctgtgtgttctgggtggactgggggagaatgcattctttgcagaagagacaaccaggtgctgaggcctgaagtcataaccagacctggggcactcagacaaggactggtggccaggccagaggagcagagctcagggtgtgcacagaactcagaagtcagaccactgaacagtgacagaacctttcagcccattggcaatgaggctgcccaggcagccagaggcctggtcaaatctgaggtctgcagagatggagctgtcattctgtgtttcctttggcagtcccaacaccagcctcgttgcaccctcctcttagcttccctgggttctccagccctaagggtggtagcagcttcctgcaagtatccagctctgagattctgcaacatccacttttgctctctgagccttgcaaaacctgcacaatcagtccctaacttatatcccctctgtttgaaatacctagtgtggtttctatttcctga

SEQ ID NO: 2032 - DNA, 15329 bp, Homo sapiens
tgaggtgtgctgggagctgtggtccgggtcggcgggcgcgcaagttggctagtctctgcggccacctccggaagggtccgccggctgtgctggtgaggtgggtttcgggggtgttctccgtcctgatccaggctggagaggggcacagcaggtccagaagccgcgaacctctggggcggccagagcgagatgcggggtaccgcccagcgggtagagagtgagaggctgactaggggacgtgagtagacggactgcgagtgccggacacacgcgcagaggatgtgacggactgacggaccaggcgtggacggaccgtgtgtgcacggactgacggacccggtgtggacagactcacggaccgaatgtggtgcggaatgacacactgagtgccggacggaccgacggagaatgtgtcggactgacggagtgtgtgtcggatggactgattgaccgggtgtggggcggacgaagtgtggagcgggcggacagataacagataaaatgtaggaccagtggcctgggagggtgtggggcggacccgtttatgtgtctgataggcggttctgtgtctgacacctcttgggtgtgtgtatctgacgggttggagtgtgtgattctgataggttgagtgtaacactaaccatggagtgtgtgactgacagagatggttgccgtttgagacttcctacgtgggttgtgagatactgtgagagggtgagcgtgtgacggtgggatttcaagtgtgactgattttctttgtgtgtccttgagatggtgactaagattatgaatgactgtgatcagaataatactgtgtgatggaaatgctgcgagggcctgtgtttatttttgagacggagtcttgctctgttgcccaggctggagtgcagtggcgcaatctcggctcactgcaacctccatctcccgggttcaagcgattatcctgcgtcagcctcccgagtagctgggattacaggcaccggccaccacacttggctaatttttgtatttttggtagagacgggctttcaccatgttggttaggctggcccggaactcctgacctcaggtgatccacctgcctaggcctcccaaagtgctgggattataggcatgagccaccatgcctggccaggcctgtgtttatttgactgattataggtgacattgagatatttcctgtgtctgggtattttgaaggctgtggctgacagactgtacctgagataatatgtgttaatatctgattgactgagatttttatcagggagactaaaacttgggtgatccacaaacagtttaccaagcatatgagagaggatttgtgctttgccatgtctgcagctgaaactgagtgactagtggtcattcagctgggcttatggatatgtcccccagtgtttgcttacgtgtagcagggggctatggtatccatacatctactgcatgtttactgtgcaccaggcctgtgctggacacttataataaatcacctcacataatctcatagcaaccctctgaggtaggtaccattatcaggcttggtataatccatgtgtgagaaatgaaaagaaccaccctccttggttggtaaagcagctgtggatggggaacctcaacctgataggagttgaggttggctgaggaggctgaggaagtttcacatacatgtatttcagagaccgtcatgagggatttctccagaacaggtgttccaggggtgcaaaagagaacttggaagctgttgcagcatctattgtcatccctgccacccttgctcctccttcccctcatgattccctacattcttgggtaaccatgctcagcctttactggtcattccatttgcttaatgcctgcttattgtgaacctgctatagggcaagtcctgtgtgctgtggctccaggacagcccagcctctctgaggaaacagtacagaactagcaaagagttacccagggcactctgggaagaggacttagactagtaccaggtatctgggatgacacctgaggaaagtggcagctaagatgaggcctagagagcccagaggaatccgtcagagacggatttcagaactcgagagcagcaggggcgacaaggggcttagaaaggccacaagagacccaggagaactttacagtgcggcgaaggggcttaaacgcagcttggccagaggccaccagaggtcaccagcggtcaccaaaaggtttcaggattggggtcttgttttagagtaacgttctcttcttcctgtgcccaaggccattgctctttctcaggcctcctgcatctctgtccagggtgacttccttgagcagagactccaggcacactgagcgtcctggctgacattgaaggaaaggaaaaagaactccaaatacttaaaactgtgggagtcgtggatgggagagggagaggctaagtctttgagtaaggagtagtatgtggccaaagcaaagtgtcgaggtctcctaggagaggttacacttaatttagggtattcttcctgactataagagaaaacaaattcactgtgggaagtagagaatgtcaagaaaagtaatacagtagtcacccctcatcttcagttttggtgaatatagtacaataaaatattttgagagagagagaaagaccacattaatatagcttttattacagtgtattgttataattgttctattttattagtcattgttgttaatttcttactatgcctaacttatgaactttatcaagggtatataataagaaaaaaatatagaatatataaggttcagtaatatccatggtttcaggcatccactggagggtcttggaacacatcccctgcagataagggggaactaccatagtataaaataccttggtaaggatgtagagaaattggaaccctcatccacaactggtgggaatgcaaaatggtatagccaatttgcaaaacagcctggcagtttcttaaaaagttaagcattgcctacatgcggccaggcgcagtggctcatgcctgtaatcccagcaatttgggaggctgaggtgggcggaacatgaggtcaggagatcgagaccatcgtggctaatacggtgaaaccccgtctctactaaaagtacaaaaaaaaatagctgggtgtggtggtgggtgcctgtagtcccagctactcgggaggctgaggcaggagaatggcgtgaacccaggaggcagagcttgcagtgagccaagattgcgccactgcactccagcctgggcgacaaagcaagactccgtctggagaaaaaaagaattttttcaaaaagaaagtattatctccctctgaatgtcggtagcacccccatctagaaatggggctagattctgagaagtagaattaatattgaggcagagagcacagtcattttaaagctcttacaacatactgccaaattgtttgccaaagatattctaattgattgccctcaccaatagtacatgaaagtagttttttgctgtccctgaccagcattcagtgctcacagttctagaatttggaaaggctttgagtgtggaggaaagatcgcagatagcctgagctcaaacactagctttgttcctactgaccagatgactctagcagctgactttccccaacttggaaaatgggagtggtaatactgactcacagggtggagctaaggcttgaatgggataacagatgccaaaggctagtgtggcctggtagccggtaggttcccactgactgtctgttcccattttcttttattcctgttgcacactatacccatatccatcatcataattatcttatcatgtgttggtcgctgtccttccgttgaggccattgagcccagcacccatgccttccccgtatttgcattcctagtacagtgctgggcacagagtaggcacctaatggggctgtgctgaacaaaagtattattattgatgtatgtgcccagcaatgctgtagacactggggataaagcaaagacctaaacaaaaacccctgcccttaatgtgctgatactccaacagggacaagtaaataataaacaagtaaccacatacgtgtatcacacatcaggtggtaaagagcaaataaagcagtgtagaagcacagagacttactgataaggcgtcttttgtgtagaggcctgacttaaataagggagagaacacccaacaattatcaaatgcactttttttttttttttttttgagacagaatctcactctgtcggccaggctggagtgcagtggcacaatctctgctcactgcaacctccacctcccgggttcaagcaattctcctgtctcagcctcccaagtagctgggattacaggcccccgctgccacgcctgtctagttttcatatttttagtagagatggggtttcgccatgctggccaggctggtcttgaattcctgaccttgtgatccacctgcctcagcctcccaaagtgctgggattacaggtgtgagccaccgcgtccagctgacgttattattattattattattattattattattattattattattattttgagatggagtctctgttgccaggctggagtgcagtggcgtgatctcggctcactgcaatctccacctcccgggttcaagagattctcctgcctcagcctcctaagtagctgggactacaggcacacgccaccacgcccagctaatttttttgtatttttaatagagacggggtttaatcatgttggccaggatggtctcgatctcttgaccttgtgatcggcccagcttggcctcccaaagtgttgggattacaggcatgagccaccgtgcctggccaacattatttttttaaaagctgtatttttattttattttattttttgagatggagtttcactcttgttgcccaggctggagtgcaatggcagaatctcggcttactgcagcctccaccttccaggttaaagggtttcttctgcctcagcctcccaagtagctgggattacaggcatgcaccaccacgcccggctgattttgtatttttagtatagatggggtttctccatattggtcaggctggtcttgaactcctgacctcgtgatctactcgcctcggtctcccagagtgctgggattacaggcgtgagccaccgcgcctggcctccagaacatttttatcatccccaaaagaaattcccaaacctattagcaaccactctcatttttgtctctcttcagcctctgacaaacactaatatgctttttttttttttttttttttttgagatggagtctacctctgtcgccaaggctgtagtgcagtggtgtactctcggctcactgcaacctctgcctcccaagttcaagagattctcctgcctcagcctcctgagtagttgggattacaggtgcctgccaccacacccagctaatttttgtattttttagtagagacggggtttcactgtgttggccaggctggtcttgaactcctgacctcaggtgatctacccacctcggcctcccaaagtgctgggatcacaggtgtgagccaccgtgccctgccgtgtctttcttcttttacttagcatcatgttttcaaggttcatccatgttgtagcattaatcagtacttcatttctgtttatggtgaatagtgttccattataggtatatacagcattttatccattcatcaggtggacatttggattgtttctccttttttgctgttatgagtaatgctgttatgcacatttatgtataaagttttgtgaggacatatactcatttctcttgggtctatacgtaggagtagaattgctaggtcatggggtaactctgtttaagcttttgaggaactcccagactgtacttcccacagtggctatcccatcttacattcccagcagcagcatatgaggattacagtttctccatatccttgcctacacatgttatctgattataggcatcccagcaggtgtgaagtgctatctcattgtggttttcatttgcagttccctggtagctagtgatgttaagcatcttttcatgtatttattgcccatttgtgtatcttccttggagaaatgtctagtcacattctttgctcattttaaaattgtattattcatctttttactatggagttgttctagatacaggtcccttatcaaatatatgatttgcaaatattttctcccactctgtgggctgcttttttactttcttgatgtggtccttcaaatcacaaaagcttttaattttgataaagtccagtttatttattttttcttttgttacttatgcttttggtgtcatagctaagacagctttgcattattttcaagtattcatggaacattaaccaaaattaaccatacactgggtcacaaaccaagtttcagcaaattttaaatgatcgaaatccattgtagcatgttttctgaccacaacagacttaatctagacatcagtaataaaaagacaactagaaaacccccagttgtttggcaatgaagcaggagagttttaaataaataaccaatgggactgggcatggtgactcatgcttgtaatcccagcactctgtggggccgaggcaggcagatcgcttgaggtcaggagttcgagaccagccccgccaacatggcaaaaccccgtctccactaaaaatacaaaaattagcctcacatggtggtgcacacctgtagttccagctacttgggaggctgaggcaggaggattgcttgaacccgggaggcggagttgcagtgagccgagatagcgtcactgccctccagcctgggcgacagagggagactccgtctcaaaaaaataaaataaattttaaaaaataattaatgagtaaggtagaaattgtaacagaaattagaaaatatttttaactaaatgataatgaagatacaacatatcaaacttgtgatgtatagctaaagctgtgtttagagagaaatttatagccttaaatatgtgcattagaaaagaggaaaggcgaaagtcaattatgtatcaatctcaaacactacaaaataattagcaagtaaagtgagagaatgaccatgtggctacctggggaacagagggagaaagacttggctctgttggggaggagcacgccttaaacaggctggctgtaggtttgcgtgggtttgtagcttagctctctgttaacccttcactagctgagggactttgggcaaatattttcctcctgagtgtctgtttttccatccataaaataggtagaaagtcccacctcctgagtttgttgtaagttttttgtttgtttgtttttgttttgagacagagtcttgttctgttgcgcaggctggagtgcagtggcgtagtctcggctcactgcaagctccgcctcccgggttcacgccattctcctgcctcagcctcctgagtagctgggaccacaggtgcccgccaccacgtctggctaatttgttttgtatttttagtagagacggggtttcaccatgttagccaggatggtgtttgttgtaagttttaaatgagtctacatgcaagcagtagtagcttagaacagtgctcagcaccaagtgggtgctgtcctaattatgaggattgtctatgtctttgtgagagtctttcacatctcacgggccacaagcctgtgttttccctgctctgtaggcatgaggcagggcccaggttccatgtgatgctgaagctctgacattcctgcaggcccagttccaaggctccggcatcctgtgtctcactgagcactgctgcccgatggccatccccaagcactccctgagcccagtgccgtgggaagaggacagcttccttcaagtgaaggtggaggaggaagaggaagccagcctctcccagggcggagaatccagccatgaccacattgctcactctgaggctgcacgcctgcgcttccggcacttccgctatgaggaggcatctggtccacacgaggccctggcccacctccgagcgctgtgctgtcagtggctgcagcccgaggcgcactccaaggagcagatactggagctgctggtgctggagcagttcctgggtgcgctgcccccagagatccaagcctgggtgggagcccagagtcccaagagcggagaggaagccgctgtgctggtggaggatctgactcaggtgctggacaagagaggtaaaggggcgccgtgggcagcttcacggcacaccagagatacaccctggacaggaacatgggagcacagggctctggtttggggttgctcatgcacccattctcacatttgtactttaccgtaactctcacacactgttgtagacaggtgtgttttggttgcaggtgaccaaaagcgagctgaaatgggctgaagcaaagaagggtaaggaggcagcagatacggctatatccagaagatctgttgacagcatcagaactctcttcttcctctcttgttctgtttctcagttggttttttctgtgttagcttcattcttattttaggttctctttccaaaggggttaaagatagccaggaaccccaggcttatgtcttaccaatgtagaaaccccggggtaataacaataagaggtccctggtctgagcccccactggcctggttgggatcttatgtttgtgtttggccaaccaaatcccagggactaacagtgagcaactggctgtttctcagaggaaaccagacgagggcctgggtgcctggggtggctgttgggggtgacggaaataccagatgtccctgtgtaccttctctatgcccaccctgggctggcctccaggatttgggtgggtcagacctgccccaggctcagctgggcactgttactcacagagacccacacaaacatcccaacccagggaggtccagtgggatgcagggaagacccagccttgggacaatccagagcagggagtggtggctcgtctcagatgggcttggcctggcctattggcaacagataggaggtgggcataccacacactgggaggaaacgtgcagtgtgcaggaggaatgtggagtctggatacagctgcatcatcaaggctcagtagatccaaccgctgctgctcttcctggccatgtgactcccttgtgcctcagtttactcatgggtaaaatggggattgtaataaaaacgcccaccttagtggtgttgcgagatacaaggcaatacccgtgcagcacctgaaatggtgcctggcacagattaaataaatggtaactgcaactgttaggataatttgttcagctctgggagaaacaggcctctctggaacagaggttggtctatgcccaagcagatgtcacagagacagggagaggaaggagggagtggccccatcctcccacagggttggccaaagctcagagaaagggtaaaatgcagagggaatggtggggtcaaaggcctggcagtgtgatttgcactggtgtattctggtaaaagcaggtggtgtgatgtttctggatagaggaaggaagggggagacagggccaagcagatggctgggggagcaggggagactgcctgtggacctggaggagaacattctggagctgaaatcccaactgggccactagctaactgtgatcctgtaccagttactcaacaccttccctcagctggatttcagtttccccatctgcaacagaatcacagcagtacctccttctgagagcaggtcgaagctgaaatgaggcgatggaagtcacccactgtgcttggggcccagcacgacaagagcctgatagtggttagtggccctggaaggccagcggcacagcatccatggcttacagatggggagactgagtcccagatgagggcaggactgattaaggtggtagacctggggtttgagtccagtttctgcactgctgagccccactgtggacttgagcagtgggtattccacctgtctctgcctcctccctggaatccatccagtagatgtgccagattatgtgtcctttgcacccatgcagggcaggtcagtgcgagcattcctctacctcatgcacactctgatctccaagagcacctccgccacactctgccttcatagtactttacaatgtaggggcttgagaggccagatgggtacctcatgtactcacccccagcagccatattctacctggggttctacttgcagaaattttcaccatcgtgggcttctggatggattccctcattcagccagaattcactgagcacctgtggacacatccaggcctagaggcaaggtgttgagtgtgagggacagaaccgcaacctcacagagatcagagcctgcaggggacacatccaggcctagacgcaaggcgttgagtgtgagggacagaactccaaccccacagagatcagagcctgcaggggacacatccaggcctagacgcaaggtgtcgagtgtgagggacagaactccaaccccacagagatcagagcctgcaggggacacatccaggcctagacgcaaggtgtcgagtgtgagggacagaactccaaccccacagagatcagagcctgcaggggacacatccaggcctagacgcaaggtgtcgagtgtgagggacagaactccaaccccacagagatcagagcctgcaggggacacatccaggcctagacgcaaggtgtcgagtgtgagggacagaactccaaccccacagagatcagagcctgcaggggacacatccaggcctagacgcaaggtgtcgagtgtgagggacagaactccaaccccacagagatcagagcctgcaggggacacatccaggcctagacgcaaggtgttgagtgtgagggacagaactgcaaccccacagagatcagagcctgcaggggtgcatgtgctcagggtcctgacaaggacagaccctccctctctctctgtctccagatcagttccacatcagggtttctcctcttgactcttgagccaaaattgggagccttgaaagatggcgagtttggtgggaggaggagaaatcagaacccatggtgtagttttggatggtgtgggaggacagccctgcaccctttgtcatccaagacaccaaatgagaaacttccccttggaactggggccagatgttaggaacgggccacatctccccttacaaagtgtgaccggggccctcggcagagtaggggaggcttggtgtggtaggaggagtgacagtgtggttcggactgtttcaggatgggatccaggagccgagcccacagaggcaagctgcaagcagagtgacctgggagagtcagagccatcaaatgtcactgagaccctcatgggaggtgtttcccttggacccgcctttgtcaaggcatgtgaacctgagggcagctcagagaggtctggactatcaggggagatctggacaaagtctgtcacccaacagatccacttcaagaaaacttcagggccttacaaggatgtccccacagaccagcgtggccgtgaatctggtgcctcgaggaacagttctagtgcgtggccaaacctcacctcccaagagaagcctccttcagaagacaaatttgatctggtggatgcttatgggacagagcctccatacacctactcagggaagaggtcctccaagtgtcgcgagtgtaggaagatgttccagagtgcttcggcgctcgaggcacaccagaagacccattctcggaagaccccatatgcctgcagcgagtgtgggaaagccttcagccggagcactcacctcgcccagcaccaggttgtccacacaggggcgaagccccatgagtgtaaggaatgtgggaaggccttcagccgagtcacccacctgactcagcaccaaaggattcatactggagagaaaccctacaaatgtggggaatgtggtaaaaccttcagccgcagcactcacctcacccagcaccagcgggtgcacacgggggagcggccctacgagtgtgacgcgtgtgggaaagccttcagccagagcacgcacctgactcaacaccagcgcatccacaccggggagaagccctacaagtgtgacgcgtgtggccgagccttcagcgactgctcagccctgatccgacatctgagaatccactctggagagaagccatatcagtgtaaggtttgtccgaaggcctttgcacagagctcctccctcattgagcaccagaggatccacacgggagagaagccttataagtgcagcgactgtgggaaggccttcagtcgtagctcagccctgatggttcacttgcggatccacatcacggtgctgcaatgaccggaagtcgcccctgggggcgtagcacagcgtcttctcggaggctcgaggtctaagagaaacgctgagttcctgaagagccacagacagggtgggtgattgatgagttgtcaaaatgataggtgcctgagggcagactcgggctgtctaggaaccactctgcatttgaggaaccctgatgagcacaaggtgattcaggccagctggagaagcttccagaagggccctgcactgctaccctctatttcccactcagggctgtcccagagagaaggcagccgaactgaggatttagactggttctgagggccagggcaaatgaaggcgcatgtctctcagaactcagcgtcccaagacgctctgggcgggccaactgtagcttgttctcatgtggttcttcttgcctgcttttctgctgcttagcccagaacggacacctgccatgcccacctctgtgccttggcacctactatttccactccagactattttgtgcctaactgcaaggctgacttttgagactgcctcttccacgatgccttttctacactctgcctctctcatggtttcctgtcgtaatcagtggtgctgcttgacacctgcccagcatgttcctgtctctccttttccttccacatcccaccagtcaccagcgctattgttttaacctaaagcttatctgtaattcacctccttttccaccactgctaccttatgtgagccctcattgcctcttgcctggattatagccggggtctccttcctgaccacttcctgcctttattctctgcccctgtatcactctccaggggactcttgatattacttagatctgactgtgtcactccaaggtggaaagctctccaacccatcttctacagcacagcttcctgaacagggtataagtatgctgagatgcaggctgctctgggccccgagcaacctctccagttatcctcatatgcatgtatgaatactgtcatttttctgtgcgtgcagtgaaaatggcctcatctcataccatggctccaccttccatacaccagccacacggaactactgtggtccctgaaggagccatacattttcccacttatgtgcctttgtacctgtgcctggaaccctcctcttctttttctttttcttttcttttctttttttttttttgagatggagtctcgctctgtcgcccaggctggagtgcagtggcgcgatctcggctcactgcaagctctgcctcccgggttcatgccattctcctgcctcagcctcccaagtagctgggactacaggcgcctgccaccacgcccagctagtttttttttttttttgtatttttagtagagatggagtttcaccatgttagccaggatggtctcgatctcctgacctcgtgatccacccgcctcggcctcccaaagtgctgggattacaggcgtgagccaccgcacctggccctcctttttcatctaaggtgtttcaaatgttgcccaaagaaacctccctgctctccgggagcagacttcagcttgccctctctgcttccagagcacctcctagatacctctcttacaactcctgccaccttgttttacttatttgctccttgtagagctgccttttccaaggataccataaactcctgagagcaggggccatgtcttactctcagtatctacaacacacaagactcagtaggccctgactgatgtctcttacatgaatgtgactggtgcccccaggaggcagtcaccgtgctgtctctgccccacattgtccttatgtatgtttacatggatgtctccccagcagcttgaaccctggagagcaagaataatctgattttcctgggggccagcacccaaataagcctggcatgcagtggcctcaataaaatgtgactgtattgagtcattttctagggccccagatcccctggtgtcatggacttagtctttgccagcattctgtccatgtgttctctggtcttctctcacaatgctgcatccctgtcccatttttagggtccctgtctatcactggatgctgcagcttctgttcattactgttagtgtatcattcttcatgcctctgtttctgtgatggtctcatcatatgtgaaccatttgacctggcgtattgtgtactagtcaccgtcaccatctctccatatgtatctccctgtatttcgggcccattccctctatgtcaagagtaaatagaggcacagagactgatgagaaacgttcataacatgaaggtaagactcagggagacagagactttgtggaagtatctctgagggagtcccagacacaggcagagagggccacatatcgtgtgccagaggctgagagactgagagggatgacaggcttaggggaaaactcagagaggagagatgcacattcctagtgaaattgcacaggcttccagcatgctggagggaacagaaaaggcatgggcctgaattcaggctgcagagcctgactcctccctgtggctacttttgggacctaagataagtgactttcctgaacctccatgacctcctcatatgtaaaccagggacaggacccaccttgtgtagtgcctgacccaaagcctggccctgcacactgtctctgactcacagcaatcatcagcacctctctttgcctcctacttgctcagtctctgtcacaagaactggatctccatccccttgatgctctgagcatcttcacccatttggtcgttgagacatatctgtccatgtctgtctaaaaggggaggagatgagggagaaaaaagggaatctactcagagcctgtgtgtgctgcccagtctaccaaataatttatatacatctcagtcctcacacaaccatccctgttttatagaggaggaagtggcttagagaatgtaactgaccaaagtcacactgccaggaactggaagcactaggatttgacagcatatccaaatatgtcagcaatttcaataaacatgactgtactcaacaaaccaagtgtaaagac

SEQ ID NO: 2033 - DNA, 6695 bp, Homo sapiens
tttgaggacacgagatcccagcccactcagccctgggagtccaaagacattttaaacagagcctctcttcacatttattaattcctgggaggaatgagggaggcttctccagccccccagagaccccggccttgtgctgcaacaggaggggagggagccagtccagaatccccggcacttctgaggacaccaacagcaccctgggcccgcggctgcatcagctttctagacaacgggagaaaagagaaatggtggaggaggggaaatcctatgccctcctcctcgcggaaatcaaggccgacctccctgacgcccccccggaaggaagcgcgtggtcggctgccagccgagacccccatctgcgcctccagctgcagggcctttgctgggcggttcctcgcccgcaattcccccacgagccctggggagacccagcgctaaccaggggtgcccaagggaggagccgggagaggccctcctggaggtgggcacagcccaggcaaacatcagcagacggaaccagcacccgggacccagggaaacgtcacctgccaccaggagctccacagggtcgctgagctccgattcgaaggtgtggggcacccaggagcggtagcggcacctgtagttgccggcgtgctggggccccacgaagatcagctcgaggttcgccgcggccccgggggtgcggaccgtcttcacggccttcgtctcgccctcgcgcagcagctcgaaggtgacgtcggggatgggtccctcgcagcgcaggacggcatctcggcccgccaggaccgccccactccacgtcgcccggagctgaggcctgggagggggtcctgggcggagcgggcgggtggtcgggccaggccacgccccaggccacgccccaggccacaccccaggccacaccccaggccgcgcccgcgcctgcgcctcagccccggcttcatcttccctgtcttgttcctgggcgcagagggctcctccggcgccgccgagctgcgcccgctgccttcacaccccggacatccgcgccacacgtgagtgtccccgcacccctcccccaggaccgtggaagtcccagattcgggcctgctctggggcttctggggtccccagcctcggtcactctgacgggtgaagggaagaagaaatgatggagaaaacggtgctccttcatggagggaccaaaaaaggacatacaatctatgtcaatagatgagggttttccctccataagtttaactttaaaagtgtatttaaggtgccgggcgcagtggctcacacctgtaatctcagcactttgagaggccgaggcaggcggattgcctgagctcaggagttccagaccagcctgggtaacacggtgaaaccccgtctctactaaaatacaaaaaattagccgggcgtggcagcgtgcgcctgtaatcccagctactcgggaggtggaggcaggaaaattgcttgaacctgggaggcagaggtttcagtgagccaagattgcgccactgcactccagcccgggtgacagagtgacactccgtctcaaaaacaaacaaacaaaacaaaactgtaaggaatcaaatgttacaaaatcctggaagattttggtaatgctgttgataatttcagggaaattaatgaagtacatgtaagtgcttgatttaaatgtgtattttattcaatagtttgagtatcttgccatggaagatactagcccagcctagcagaaaagtgcaatatgtataatatactttcgcattttaaaagttatattccctatccattttgaaatgctagccaaactacatgaagttatttgcaattaattgtaagctaatcaggaattttgaaagcttgattggattaacaaactataatgttgaaatttggtaaaatcataatgttaatttttactgtgaaacgttttcttgtaagatagatatacacatcctagtttaattttgtgtcttagtgtggatttacaaatttactacagttattctgagcccaggaacccaatcagatttcaggccagtttgatactggctgttcttaattctaacaggagagtaggacatcatactaaatgttatgtcagtgggactgtgttgtctttggagcttagtaaattaatcattttcttcagactttaaggagagtgataaataaaatttggagtcataggatatagatgtacaatttaaagattaaacattttttttttttttgagatggagttttgctcttgttgcccaggctggaatgcagtggcatgacctggactcactgcaaactccacctcccgggttaaagcaattctcctgcctcagcctcccaagtggctgggattacaggcatgtgccaccacagctggctaattttgtatttttagtagagacagggtttctccatgttggccaggctgctcttgaactcctgattttgtgatccacccgccttggcctcccaaagtgctgtgattacaggcgtgagccaccttgcctggccaagattaaacatttttcatcaattgtggatggtggcttataacactgcaagaataggctgggcatggtgactcacaagtgtaatcccagcactttgggaggcagaggcgggcagatcacaaggtcaggaggtcaagaccagcccagccaacatagcaaaacccggtctctactaaaaatacgaaaattaggtgggcatggtggcatgcgcctctaataccagctactcaggaggctgaggcaggagaactgcctgaacccagaaggcgaaagttgcagtgagctgagactgcaccactgcactccggcctgcaagaataaaagtaagttatccaaaaaaaaaacaaaaaggagaagaaaagggaggaatgaaggagagagatggggttggggggcagagatgagagagagagaaagaagaaaaaagaagaaagaaaagagagaaagaaggaaggaagaaagaaagaaggaaagagaaagaaagaaagaggaaggaaggcaggaaagaaaagaaagaaagtgaaagaaaagagaaaacggtgctcccagcaaagggtacgacctcaagatctggaggtcagacctgtgccctcacgctctgctgggctctgagtcctggagacgtcgatgaggaaatcagagggacaaacagagctggggacggcggggatggggagaaggacacatcagccgtgcgcctgcgggaccggggccggggcggggggtccagtatgacgactgacatggccagtaataaaacaaggcagccacagagctgcagggatctgaacaagaaaacctggggccagcctccctgctgccgaccaccacgctacacgtgacctacgggcttgcgtccgtgggaaataagccgaaattccaggcgtccccagaccctcgaccaccgatcgcctgctccccgccggggtaggcgatgggggctgaaccaaggcccagagcgccgccgtcggacgcccaaggaaagaggggaaagacaggaggccccgaggggcactgaacccgcgcccgccctcgctggtgccccgccagctcaccgtccacgtgcagctccaagcgctcgctgggcgcggagcccccgaaaggcggcttcaggtccacgtagacgcagctgtagttggcggagtcagccacggaaatgttgtgcagctcgaagagcgcctcggtcccagcggggctctggaaacggtgcacgcggcgcccgcccctgtcctcgcgcaccagggcgaagcgcgcgccctccaggggcgccaggcaccgcagccgcaaggccctgccggactccggctccggggagaactccggcgcgggcagcgtctctgcggagcagcacacgggctgacccgggcgcccagcggctggctcggccctaacgcgtggtctggcctcgcgctctttgccttggctgagtcttctgcccgcaatgacctggccagcttcctccctcgcctcctccgggcccgccccacctttgcatcccagtccttggatatctcacacgcaccctttcactgtttcttagtaatttgtttgtctacagacacagacgggaagcggggacggggacatgttttgtgcatggcttgatgcctggtgcacgatgccgctcagtagtggatttgctccacgagcgtcttctgagcaccgccccaatgcccgccccacggaggggcccctgtggtccgctgggcatggggttcgctgtccggtgctcagagtttgctaaataccatcaggtccaaggcaagcgagcggaggagctgcctcagcagaggccctcagtgctcacctagacctggcagctgggatgggacctgccaggtggtgccccctgtggcctgggccagacctgttcacccagttattccctgtggggcctgaaggttgtcacgctcatcatcatatttgcagtttaggaccctgaatcggcgggtgggcggataaagttggtattggaccctggcccagagcactgcacttccccagactctacacctggtactgctcctgctccccagggacccagccgcgtccctgtccctgctggccccggctcaccatcgctcagaatcagctcgaccggcgcgctgtccccggaccagccgttttggttgtcatgcagccggtagcggcaggtgtagtgacctccatcccccagggccaccgcgttcaggtgaaagaagatgcgatctgggctggtgctgctcctgggtaccagcagctctttctccccgcgccgtagctggaagtccactccactcaggggagccacgcaggtgagggtcaccttgttgccagggtgcaggacctgggaggactctccatggtgcatcagcacaggcggtggtggtgcagctgcaatgcaggcagcattactaggctgccccatccctggagctgccctctgcccagtccccagacctctgccctccgggtggcaatcccaggaacacccttccattcttttttttttttttttttgaaacggagtttcgctcttgttgcccaggctggagtgcagtggcgccactcagctcactgcaagctctgcctcccaggttcaagggattctcctgcctcagcctcctgagtagctggtactacaggcacctgccaccacacctggctaatttttgtatttttagtagagacggggtttcgtcatgttgggtagactggtctcgatctcttgacctcatgatccgctggcctcagcctcccaaagtgctgggattataggcgtgagccaccgcacccggcctcacccttccattctttgggcatcctctgcccaaactcctttgcaaccatcagacccaggcaaccgtgtggccagcttcctggacctggtcctgggcaaggacattcagcatggaggtcaggatgaatgtggtcatgccccctgtatcctcctcccccagcagcccccagagatggttcccacagtcaccgagctcctcaatggtcacagtagcgctgggctcagagagggcgccttccccatcggtccggtagctgcagctgtagttgccaggctgatggactggaaaggtggcctccacatcctcctgggcctcaggcacctccagaaactcatggtcgccctcccgcctcagcagaaaagtcacaccccgcagcacacctcggcacactgctgttgttttcaggccgggggtgatccaggacactggcgccatcgagagccagggagcaggcaaggactctgtgggtggggtggagttgaagagtgcttctgcataacaggagacgtgggaagcccagcagaacctgggccccacactcataagactgtgaaggagacagggatggagggcattgctgggaaaaggcaggcaggcaccagtggaaacaaggcatacggcaagagaaaaagagtgtgtgggagctgtacggcatgccgggcctgctggggacacaaccatgtattccttacaacacagacatcatccccatttgacagatgggaagattggggcttggggctcagagacatcgggtgacttggaggaagggagaccccccagtcaacaacctacccactgcctcctggcccccaattcatgccccggctcacttggccctgtcagctccaggagcttgctcagctgggtccatcctgtggacaagcccgagcggcagcggtagcggccctgggtgtcacccgtcagcaggaactggtgcttgatggcaggtgagtcaaggtgcacaggctcctgggccaccccattcttgaacagctggaagtctggagtctccaggtgggcctggcacgtcagcgtcacattggccaagggtttcagcagtgattcggactctgcccacaggctgggctgcgtctcataaactgcaaggggtggctgggatcagctcagtgccacagagacagggctcccccccggcctgggcccaccattcccagacctcacccctgcactcacatatggctgcttctgtcactgggccccaggtgacacctgcggagacagcccccgtaaggctcctgttcccgccccctcccgccccagggacccagaccccaggaggcctcaccccacagcaagagaaagaccacgagcatggacatgatggtcgcgctcactccggtgcagtgagtgtctggggtgagcgtctgcagcaatgaggccc

SEQ ID NO: 2034 - DNA, 8493 bp, Homo sapiens; identical to SEQ ID NO: 2029

SEQ ID NO: 2035 - DNA, 13401 bp, Homo sapiens
gtgtacaaagtgaagtttaatcaaagttacaaacgttggtgggttttccgggacaaaggcccctcctcgacgcagggttcgcttgggcgacgcgtcgactctcggctccctgcagtcaaggcgcggcgcggcccccgtgccgcttccggtgctcgttgaggttggagcgttggctgaaggcgcggccgcaatctccgcacgcgtagggccgctcgcccgtgtgcgtgcgcaggtggcgcaccaggctgcagttgcgcacgaaggccttgccgcagtcgcggcagatgtagggcttctcgcccgagtgcaggcgctcgtgctggcgcagctcggagcagccgcggaaggtctttccgcactcggagcagccatagggccgctcgccggtgtgcgcgcgctggtgttgcaccaggcccgagcggcccttgaaggccttttcgcacagtgggcacgcgtagggcttggcgctgctgtgagtgcgctggtgccggctcaggttcgagcgctggttgaaggccttgccgcactcggggcacgcgtagggcttctcgccggtgtgcacgcgccggtgctccacgaggtgcgagaacagcccgaaggccttggcgcagtcggcgcactcgtacggcttctccccggctcccgacccccgtcggggactccgctcgctgtagtccccgcagggcgggcaccccagccggaaggcgcgccgcgccaggacggggccacgccggtggcgctcggccgagtgcgtcttctggtggcggtacaggccggagcagcgcacgaaggccttgccgcactcggcgcactcgtagggccgctcgcccgtgtggatgcgctggtgctgcagcaggctggaggtgcgcgtgaaggccttgccgcactcgtcgcaagcgtacagtcgctgggccggggggtcggggacaatagggcgaggtcgcgaggtttggccgcactcaggacacactgggggactcttgcccgcctgctgctgctggttggggcggaagcgcttcccgcaccgggcacacggacggggctcctccgtcgcctgcagcctctcctgggggatccgcagggccctccacgcaaaggcctcgccgcacgcgcaagcccggggctgctccaccaaggggttcctcccgcgggaggtcggctttggggtcctcgggcaggtcggagcgccagtccctggttggcacggccaacagtccgtgtggacctcacacagttgagtccgggggtggttctggatccgctccggacaggggtcacacacgggtggcgtctccccagcgggcgccccgcgatgccacgccaggcaggagttcctgctgcagtccccgccacgcgctgggctcctacaggggccctcccgggcttgcagcccctcggggataaccagctcagggttctgagaagaggtggggccgcacggctcccgcacgaggggtctggtcccggcgctgtgccgggtccccgggccggggctcaccccgaggctgcagccccgggagcccccgcctgggggagtcgtcctaccgcccgccgctccacgcaggtcccccttttgagtggggcggctcccagctcggtcctcttcgaggggcctcggctcctcgggcctcttctcccgggccccggaggcaccctgggcatcggccttggggagtcctccctgcccagccttctgggctggagcctccatcctggggcgcagagttctggttgtaggatctggaagagcagagaagaaatggaggttggcggttcccaggaggagagaagtggagaactgggccaacgagcgaccaccccacagctggcacctactgggcggcccccagctctctgcagatgcgaaagggtaaatggagtgacataggcagcccgtcctgcccctcttcaaattgtcaccacccagaccccagagaacagcttcccaggctctgcctgcccgccatcaccgttcctccccaacactagctcctaaaacactgtgcccctggctaaggccctccctggtcccccttccccaagcaacagggactcccccgttgctcagctgccagctccccaaaatctcacttactcctgccctccgtttctcagtggcaagccgacactccgggtcctcctggctccattcactgccattgtccatgtcttctgagaggtgtgaggtgagactcacctgacagctgagagcctggccgggagatccacgctgcagaggccaatgctggacttcccctcccctcttcaaccaggtaacggtggtgctctcaaggctggcagcctcatctacaaaatgggtatgataacggtaagtataaccagctgagtagggagacaggcagcccagatcattcaagcaagtgtgaacattagcaacgcctggcgcctgctattactattttaaaattacactgtggctgtattagttatctattgttaaagctgctttaacaaactgccaccccatagtggcttgagacagtgcaaacttgttatctcagagttctggaggtcgtaagtcctaagtgaaggtttcagtagtgtgggttccttccagaagctcttggggaggacgtttgctgaccatttccagcttctaggtgccacctacttttctttcttccatcttcaagccagcagtaagacatgttcatctctctctttctgggtttgttgtcaaatctccttatactccttataggattctgacccttctgcctcttgtgatcacactaggccaaccacacataatccaggaatctccccatctcaagatccaaaacttcatcacactcagttcttttgccttgtgaagtaacatagtcagaggttctaggaaacaggacgtgcagatctttcagggggccattattctgcttacaacagtggactttgctgagatacacacacgtgcatatataaatattcatctcctaagcaagcaattgaatagcaagtgaaaacaaaggacggccgggcacggtagctcacgcctgtaatcccagcactttgggaggccgaggcagatggatcacctgaggtcaggagtttgagaccagcctgaccaacatagagaaaccccgtctctactaaaaatacaaaattagccaggcatggtggtgcgtgcctgtaatcccagctactcaggaggctaaagcaagagaatcacttgaacccgggagatggaggttgcagttagccgagatcgcaccattgcactccagcctgggcaacaaaagtgaaactctttcaaaaaaagaaaaggaaaaaaagaaaagagagagagagggagggaggggtgaaggccggggggggggagccgggcgcggtggctcacgcctgtaatcccagcactttgggaggcctaggtgggcagatcacgaggtcaggagatcgataccatcctggctaacacggtgaaaccccgtctctactaaaaatacaaaaaattagctgggcgtggtggcgggcgcctgtagtcccagctactcgggaggctgcggcaggagactggtgtgaacccgggaggcggagcttgcagtgagccgagatcacgccactgcactccagcctgggcgacagaacgagactctgtctcaaaaaaaaaaaaaaaaaaattgccgggcatggtgatgcatgcctgtagtcccagctactcaggaggctaaggcaggagaatcacttgaacctgtgaggtggaggatgcagtaagctgggattgggccactgccctccagcctgggcgacagagcgagactccgtctcaaaaataaataaataaataaatattttcctcattgtgatgtgatgtgaggtttctcagcctcacacgtgataagtgcacaatcctcctgtcccctccctagatctcattgtttccagaacaaagatggatctgtccagcacagcctttagactctgaatcccggatggctaacatcatatgcagagcgtgagatggacacacttgtggcaccctcgtaaatcactgcttcactcggcacaggagctcagattcttctccttttgtcctgtgttccctattctgtgcaaggcagatatcctcttattttattttatttattttggtgttttttgagacagaggctctctctgtcacccaggctgcagtgcagtggcgccatctcagctcactgcaacctccgcctgctgggttcaagcaattctcctgcctcagcctcctgagtagctgggattacaggtgcctgccaccatgtctggctaattttttgtatttttagtagagatggggtttcaccatgctggccaggctggtcttgaactcctgaccttgtgatctgcccacctcggcctcccaaagcgctgggattacaggcgtgagccaccgtacctggccagatatccctttatttatttgtttgtttgtttgtttatttttatttatttagagacagggtttcactcttgttgcccaggctggaatgaagtggcacaatctcagctcaccgcaacctccgcctcctgggttcaagcaattctcctgcctaagcctcctgagtagctgggattataggcattcaccaccaagcccggctaattttgtatttttttcttagtagagccggggtttcaccatgttcacggggctggtcttgaactcctgacttcaggtgatccacccgtctcggcctccccaagtgctgggattataggcgtgagtcaccgcacccagccgatatccatttattaaatgtctcagagggccgggtgtggtggctcatgcctgtaatcccaacacttggggagtccggggggggcggatcacgaggtcaagagatcgagaccatccttgccaacatggtgagacgtccttgacctgatgtcactttttctgtctgttttgcagatttctaacaggcagttgccctgggccacctggtggcctgaaataacttgaccgggaactaaaaggactcacgaagcatttaaccaagactctacatgttgacttttcagccaaggacacttcagagcgactggctgcagttctccaaaggaagctgctgccagttgcccctggggggttatttccttcttggacatcatgaccacaatggcagaaatgcattgatggccagcactctggggatgaatgtttttgagtggaaatgaaacataccaaactggttaaagacaaaaatgcagagttggacaagttctgcaggtcacgaaaggcctttgaagcagccaggcccggttcctgctctgctgtatgggaggctgctggcctgagctggagagcagaaaggcccagtgccaagggttcagcaagtaccagtcccaggccaggcatttgctaataagccagggtgacagtaaggacaaggggactctggtgtgatgtgaggtttctcagcctcacttgtcacacgtgataactgcacaaccctcctgtcccctccaggcctgtgtgagacaggaaaggtgaggctgcctctccctctgcaccttaaagccactcggggtctgggttttcctgagacttcccggagccagatgcagactcccaaaggcgccgatccttcctcgatctccctccctcaagagtggcactaatcaggtctaatttagagaaaatccatcacctccccccactgtgggctctgccacttcatgccttggtctctccacctatcagccagctggagcctgggactcaaggaggcatgcttggaagtaaggaacttctctgagtacgaggacatctgggtggtgctgaacaccagcatgctttgccccgtggcctggactgtgcacagggcacctagagtgacctgtcacctcccacgcaggtggaagggtgtgagagagaatgggcactcagttacaaacatccccttcccaaacacttgtggatctgagtctgaggctactccttccaggtgaggggttggctgctgttgtagcttgttactctctttctgtcccttctgccctcaggtcttgaccatgcagcttcccaagaacaggatggggaatgatatgggcacatggggaggcaagcagccacaggcctcacctgctcatgggcactgaccgtcccaacagcaggtggacatgaatctaacccacagacaccagagtagagggagctgggctccctgagtctggatggggttctcacaggcccccacagggagacaagggaagctttctccagaatgtggagtacggactcactgtgtgaataaagtaaatgagctggagggggcgggacaagatttcaaaaagcaccactcatacacccaggactggcaaagctgctggcagtaagctctatcatggggctcccccactgcaggtgagctgattggcctcagctggcaccatccatgctcagtgtttgccctgaggacaagaagacatggcaaaaaagaggaaagtacagaacacactcccacctggctggtggggatatagatagtgcagctgctgtggaaaccttcagctccacagaaaggtaaagatggagctaccacaccccgagtaattccacccctaggtatccacccaagagaaatgaactcaggcattcaagcaaacactggctcacagatgttcagagcagcgctgttcacagtagccaaaatggagaaacaagccaagtatataaaatgacaaatgcataaataagatgtggtatatccatagaatgggatattattcagccataaaaatggatgagtactaacacatactgcaacatggactttagaaaacatggaaagtaaaagcagtgagtcacaaaagaccacatattgcataattccatttatacgatatatccagaataggcaaatccacagagacagaaagtagactggtggtcgccaggggctgaggggaaagagtggggagtaattgctttacgggtatcaagttttggggtaattaaaatgttctggaaattatagtggtgatggttgcacaacatagtgaatatattaaaacctaaaaaatatactaaaacctggccaggcggtggttcacacttgtaatccccgcactttgggaggcgaaggtgggaagattacttgaggccagttcgagaccagcctggccaaaatgtcgaaaccccatctctgctaaaaatacaaaaattagccgggtgtggtggcacattcctgtagtcccagctacttgggagactgaggcagagaatcactggaacctgggaggtggaggctgcagtgagccgagatcgcaccactgcactccagcctgggcgactgagcaagactccatctcaaaaaaaaaaaattatatatatatatacacacacacaaaaacatggccgggcacagtggctcacgcctgtaatcccaacactttaggaggctgaggcaggtggatcacttgaggtcaggagttcgagaccaccctggccaacatggtgaaaccctgtctatactaaaaatatgaaaattagccaggtgtggtggcaggcgcctgtagtcccagctacttgagaggctgaggcagaattgcttgaacctgggaggaggaggttgcaatgagccgagatcacaacactgtactccagcctgggcaacagagcgagaatctgtctcaaaaaaaaaaaaaagtatatatatatatatatatatatatatatatatatatatataaaattacatatatacttaagagtatatatttatatagaatgtaaatatatattagagatatatatatactaaaacccaacctgaattgtaaaatggttcatttgttacatgatttatatatttttgttttgttttgttttgttttgtttttttgagacggagtctccctctgtcacccaagctggagtgcagtggtgtgatctcagctcactgcaacctctgcctcccgcgttcaagcaagtctcctgcctcagcctcctgagtagctgggattacaggcatgtgccaccaagaacggctaatttttgtatttttagtggagatgggatttcaccatgttggtcaggctggtctcgaactcctgacctcatgatccgcctgcctcggcctcccaaagtgctgggattacaggtgtgagccacctcgcccagctgatttatatctttttttttttttttaaagcagaatgcacccatgccacagtgctccttcctgcagcctgtcaggcgtcggcccaccctgcaacatccaggatgtcatttgagccctggtcacacgaaagcactgcatgggatgaaggtggtttatttatttatttttattttattatttatttatttttttgacacagagtctcgttctgttgcccaggctggagtgcagtgacacaatctcggctcactgcaacctctgcctcccaggttcaagcaattctcctgcctcagcctggcgagtagctgggattacaggtgcctgcccccacgcccagctaatttttgtattttcagtagagatgaggtttcaccctgttggcctggctggtctcaaactcctggcctcaagtgatccccctgcctcagcttcccaaaggtgctgggatcacaggcacaagccactgcgcccggccgaaggtggtttcttttaagcaatacatttgtattgagaaaaacaagttcttggccgggcgcggtggctcacgcctgtaattccagcactttgggaggccgaggcgggcggatcacgaggtcaagagatcgagaccatcctggctaacacggtgaaaccccatctctactaaaaaaaatacaaaaaattagccgggtgtggtggcaggcgcctgtagtcccagctactccggaggctgaggcaggagaatggcttgaacccgggaggcagagcttgccataagtcaaaatcaggccactacactccagcctgggtgacagagcaagactctgtctcaaaaaaaaaaaaaaaaaaaaaaaaaaaaaaaaaaaaagaaagaaaagaaaaaaggaaaaaaaaagagaaaaacaagttcttttaaatctctaggtaaaaataaaataatttctcacacacagccaagtcaactgcataccagagtaccaagcatagtttccacatcagaggcttaagctctggggtaaaagcattttctttaaccaggtgtctgttaattcactcatatcaaagagaaaacttggctgggtgtagtggcttatgcctataatcccagcactttgtgaagccaaggtgggtggatggcttgagcccaggagttagagaccagcctgggcagtatggtgaaaccctgtctctattaaaaaaaaaaaaaaaaatggccggacgtggtgactcatgcctgtaatcccaacactttgggaggccaaggtgggtggatcacgaggtcaggagattgagaccagcctggctaacatggtgaaaccccatctctactaaaaatacaaaaaattagccaggcgaggtggcgcgcacctgtaatcccagatactcgggaggctgagacaggagaatcactggaatccgggaggcggaggttgcagtgagccaagatcgtgccactgcactccagcctgggcgacagagcgagactccgtcaaaaaaaaaaaaaaaaggctgggcgcagtggctcacaccagtaatcccagcactttgggaggtgggcagatcacgaggtcaggagattgagaccatcctggctaacatggtgaaatcccgtctctactaaaaaatagaaaaaattagccaggtgtggtggtgggcgcctgcaggagaatggtgtgaacccgggaggcggagcttgtagtgagccgagatcttgccactgcactccagcctgggtgacagaacgagactccatctcaaaaaaaaaactatccaggtgtggtggtgcaagcctgtagccccagctgtcaggaagctaaggtgggatgatcgcttgagcctgggagattgaggctgcagtgagctacaattgcaccactgcacgccagcctgggcaacacagtgagaccacatctcaaaaaaagaaagcaaagaaaactcttcattagaaactgaacatgctcgctgggaatgatattcagggcacagggcaattccttacaggggcacacacccaagggcactgctgccaccacatgggaagttgtgacgggagggaggagactgagggcaggacacaagacatggagacacacattctggtctgtctgaccatggagctctgtccacacccaggctgcctgctggctcccaaccaccacacacagtatctggcgtttctcacaggtgtcggcttctctctctcgagtccatctgctggccgtggacctggctattcggggcaggcccatcctgcccacctccccacactctctcaagcctctgtctctgagcactgcaggttttgtagtgttccctcgtctacctctgagaggccaggctgactgaagagctcctgagaaagccaccaggacccactgctaaaggggttggtccagggtcattgccaggctgggatctgaggtccccacacatagggcagggaactccccagccatagactctgatgggggtaccagtgtggactccagccctttacacggaggagggagcatgccactatggatgctgagcagcaggaggtcaggggccccgctttcacaatgtgccatcccagaagccccacagccaggatctggacctctctgacacaactccaggtcacagagacccagatgtcagggatggagggacttgggcacctgccttgctattagctccaaggctgctggcttcatgtcacagtctgtacaacagctggtggcatgagcagggctaggaccagcactcagcatgacttcctagaactctagggacttaggggctgaggacttcccagggtgaaagaccatacctgggacagcctggccaaacagggacaattgatcaccatggaatcagtggacaggcccaagaatggatgggcacatgaggtcacccaggatcaggcaggttccactgaaggaggctgcaaaagatatatccaatgtcctaaccccggaactctcagaatgtgaccttattaggtctttgcagacataattaaggatcttgtgatgagatcaccctgaataacctgggtgtgccctaattccaatgacaggtgtccttatgaaggaggcaaagggagttctgacacggagaagagtggtccatgtgaagatggaggctgatattggagtgatgcagccacactccaaggaacacccggagccgccagaagccggaagaggcaaggaaagacccccacccagagccgtcagagagcacagtactgctgacaccttgatttcagacttctggcttccaggactgtgagagtaaatttctgttgttttaaactgcccagtttgtggtagtgtgttatagcagccacagaaactaatagagactggtctagcaccctcgacagaatgtgtgtgttgtaaggggctctcctgatccctagtgatggggagtcagaggactgcttagtgtctgaacagagggttggggaagctgggttgtcctgaagaaccagcagtccccacttggcagaaagggaccctgaacttgtgggaggtgggggctgaggggcacctgctagccatgtgctaacagcatcttcggattggtccccagatgccctgctcccaggggtggctcctctgctgcaacaagaacctgcctcccagcaccagacacagcaggtgggagctgtggaccatggccgagtctcttcgtctccttgatctgctcccaggatgcactgtccaactatcccacctgtaggtgggtggcattccagccatggacccatgatctgaggctgagcacagcaaacacaatcgaggctctgggtcccaggtcccaggagcccgtccttgatggtgcattacagctctcccaggctgttcttacagtgacctcccacctgccccaggtgagcatgcttgcacctgggtgctcgcccagcctttctagttgtccttagggcttctggtgttgggaacaggatgcagagttaccaatttagggggactgagaggttaacgtggccaaggctgagccctgcagaactgcagagcaacagcacacacaggaaagctagtgaggttcaacatcctcatggaggttgcacacggcacaatgaggtcttatttgcccaagagaatgtgcagggaagtcgccaggcacggtggtgcatgcctgtaatcccagctactcgggaggctgaggctggagaatcgcttgaacccgggaggcggaggttgcagtgagccgagatcgcgccactgcactccagcctgggcaacaagagcgaaactccgtctcaaaacaacaacaacaacaacaacaacaaaaacagaatgtgcagggaagtcaacgttggtggctctgaggtgtggaggacacaggctagtgcccagctcagcgtggctccacctctctgagccacagaccaacctcacccacactgacagtcccaggggacacagactctagcccctatgtccaattctacactgtgcacgcaatgggaagaacagtgcatcatgcactgtacagcagaagaaatgtcctctgagtgcaggcacagctcccttctgtgtctgtcctcccgacagtgcctccaccctcaaggattagcaagcttcaaccctcgcaggacatccactgtgtcagggccaaacggtgctgcatcctgctctaatagtgagtgaaggaggggaccgcagacaagaagaaatgaacaagagaccgtttaagagagaaaaagacgtgaagaacatcagacagggagcagcgcgagggcgccagggagggaggcagcggattcttcgggcctctgtgaagagggggcatgaaaccggtctgcagacaaggaaagagcaaagtgcaaaggccaggatgcgggggcagagacggtagggaggccggcgtcggcctcggctagcaggtgggcttgactccgagagccgcaggccgccaggatgggtcccgggcctggagcctcccctcgcgggcttcaatgacacccagcacggaaacgcgggggccagaactacagaagcccgtcccgcccggaactcaaggtcgcgagtgctgtgtggccggtccggacccggagcgcgaggaccggaagtgcgcggcgtcacgcctctgccccggaccccgcgcgcggaggtggagaggggactggggtggtggccgcgctatgcgccgggaggtccccgcctcgcaggccgaggttgcgggtccgcgcagaatgccacttactctctggaggcggcccgcacgggtccctggtccccgccccgcatgcagcgcggagccgtcctcccgccacctccgggccgcc

SEQ ID NO: 2036 - DNA, 7410 bp, Homo sapiens
gtgacctgatcaataaggtctttattatcaccagttagtgcaggcaaggtaggtgattccagtggagggtgatttgtggcctcaatggacacatcttaggggttaaacacagacttgaccacatccacaaggaatgtgcatcttcctgagctcaaattagatttccctcaaggcccctcaaccagcatcggttcagctgagcacagtcctgaatccctagagaacacaggaaggaaggctcagggtactgttttccccatgcatgaggacaggactgctgcaaatttttggatccaggcaagatggaaagtgactatggcttctgccttatgctgcatgggtgagatggccctgcaaaggttcctgggctggtcagaaacagagtagcttctgaaggcttttccacattagcagtacatgtaggtaatttttctggtatggggattctgctgcatgaagtttgacttggctgaagattttctcacaaagaccacttccataaggctccactcaggtatgaatctttttatgctgtgcaaggttacaaagatggctgaagagtttcccacactggctacactcataagtcctttctctggtgtgaactttctggtgccgaacaagtgtagatctttcactaaaggcttttccacactggatgcactcatagggcctttcttgtgtgtgaactctctgatgacgaaccaggtgggagttactgctaaaggctctcccacattcactgcattcgtaaggcctttctccagtgtgaactctccagtgacaaataaggctggattttcggctaaagaatttcccacattcactgcatttataaggcttttctccagtatgaactttctgatgcttaatgagaatggagttttggctaaagaatttcccacattcattgcactcataaggcctttcttttgtgtgaactctccagtgttcaatgagagtggagctgtgagcaaaggctttcccacactcactacactcgtaaggcttttctccagtgtgaattctccagtgctgaatcaggctggagctgcggctgaaggatttcctacattcgctgcactcataaggcctttgcccagtatgtactttctggtgctggatgagggtggagctattactgaaggctttaccacaatcacagcattcaaaaggccgttctccagtgtgaactttctgatgtcgaaggagatgggagctttggctgaagtctcttccacattcactgcactcaaaaggccgttctccggtgtgaactttctggtgctgagcaaggttggagttattgttaaaagctcttccacattcactgcattcatacggtctttctccagtgtgaactctccagtgctgaatgagagcagagcttcggctgaaggatttaccacattgactgcactcataaggtcttacctgtgtgtgaactttctgatgccgaaggaaattggagctttggctgaaggctcttccacatttcaggcactcaaaaggcctttctccagtgtgaactttctcatgccgaatgaggtgtgatctgttactgaaggctttcccacattcatcacactcataaggtctttctcctgagtgaattctctgatgatgaacaaatgtgagtttgtggttgaaggttttcccacatgcaatgcactcataatattttacttcagtgtgaaatttctggtgcttcctcagcttagatgagtgactaaaggccttcccacactccttacacacatggggtatttccccagtgtgaaactttttattaccaaggattgatttctcctctaagaaatttccacctgttgggcatgtaaatggtatctcttcagagtgagttctcagatggttggggagagtggagctcttcaggaaggcttttccacagttgctgcactcgaagagtttctgtgtggtacagacttctggaagctgcccaagattggaatatggcttctgcccactgtcaacagcttgaagctggaggaggtcacagctgcccaggatgaccttcccaccttccctgcaagtgaaggggttctctgacaggtggactttagagctcttcataagtgcgtccctgtccttgtaccatctaaagggcttccctccactgtgctccttctggtgctggtgaaggtttgcattcaaccaaaagtctctcccacatgctccacatgtgtagggtttctcctcagactgtgttccctgatgctcagccaggtgcaaaatgtctttcaagaatggcccacacatgtcacaggagttagctttcttggtggaaggatctgcattagggatcctgacctgtaacacttctacagaaacattctgcttgggatgggccccctcaccctctactccatgccaagaacctgaaagtagagaaatgccagttaactaagaattccacttggtgggaatggttgacttcattagaaatgttacccaggaattcacacccaagaagaggtcccagggattgctgacaggccaacagggccatcatcagggtgaagaagggcccattactattggcaggatagggaccagccaagcaacagaataagggagacctcaccaggggtaaggacacagaaatgggtcaaaggacttaaatagacatttctctaaaagaagatatatacacaaatggccaataagcatatgaaaagaagttcagcatccttaaacatgaggagtatgaaaaccaaaaccataatgagataccacttcacatccactagcatagctataataaaaaaaaataaatgacaacaaatgaagtagaaaaactggagcacttatacactgcagacagggatgtaaaatggtgcagccaatttggaaaacagtttggcaagtctgcttctacagagctacacaagagaactaaaaacatccacacaaaaatgtgtacaggactgttcatagcagaatttttttaaaatttgagatggggtcttgctatgttgcccaggttggtctcaaactcctgggctcaagtgatcctcctgcctcagcctcctgagtagacggattataggcaccttgcccagcttctatagcagcatttttttctaacacctaaaaaatggaaacaagccaaatgctcatccactggtaaatggataaacaaactgtagtctttctatacactggaatatttggctataaaaaagaatgaaatattgatacatgctacaacattgatgaacttcaaaaacatgctaagagaaagccagtcacagaaaaatacatagtattctataaaatgtctaggaaacgtaaatctatatagtcagaaagtagattagtggttgcctaggaccggggggaaagggataagggaacatggggagtgacagctaatgggactgctaataggacctacagtttctctttaggtgatgaaaacatgctaaaattacattatagcaatgattataccatgtgaaaacatatagaaatcactagactgtgtactttaaaaggtgaattgtatggtttatcttaataaagctgtttttaaaaaatatctcactgggggctgggcgtggtggctcacgcctgtaatcccagcactttgggaggctgaggtgggtggatcacgaggtcaggagattgagaccatcctggctaacatggtgaaaccccctctctactgaaaatacaaaaaaaattagctgggtgtggtggcaggcacctgtagtcccagctacttgggaggctgaggcaggagaatggcgtgaacctgggaggcagagcttgcagtaagctgagatcacgccactgcactccagcctgggggacagagcaagactccatctcaaaaaaaaaaaaaaaaaaaaaaaaaggaaaaaaaaatctcattgggaaagagacagaatctgggcatgacctcatactgggtaacccgaccagggattggtgaatctcagtgggatctgttaggcagactggaggtgtctgatccccaacctttgcctccacaaggctcctgggcaacagctattaggaaagctcatgaggctgctcagagagagacaggggaagtacacacagcagaacctcagcaccccagcacctacaacaggaaacccgagaaggaagcagtacccatgatctggctttgggatgaacagagctttctatggggaaaagacacaaggcataaggtagtcatcaccatgctgagacagggcattaccaagtgaggtcacaagctcaaggttttccagcatcacactgtggtacaggtgcctctgggctgcatcaaggagctcccactcctcttgggagaagtatacagccacatcttcaaaggttaccatgctcttcaatgtggggacagctgagccacagggccaagaagtatgctgacaaagaaacaaacaattggtcaaatggaaatatgcaggaccttgctgtgtgactcagaatcctgatacatctaccactaatatctctttttcttatgatcctctcagtccacccactactcacccatccacagcttatcttcttcctcagggcccccacctaacatgccctggaattaatggtgcccctctctcctagtagtcccactggtcactgtatccaggccaacccaacctagaggaacaataggcaggtgggcagatggatgcttcctcctccctcctgctggccaattttccttgtgtcttctggctcatacctcccaaacataagaaaatttgggcttccctttcttaagcctcttgtaccagggccatgggcccaatggttcacattctctcacctttacatgtcactcctcagaccatacagttcttatatttccaacccctccctgttcacactgtaggcattctccctagcatctcaccatgcacatggcatacctgacagatgcaaccgggatccattcctggtccaagccagctacagagctccaaaaaccccactgcaagaggcagtcatagcccctcaagtcaatgcctcccctgccagccctgttccttcaaccatcagctgcccagaaccataagcagatctcaaatatctcttccctctgatatctttgcctttgtatgtgttgtctcctccccagtcatagctgtccttgctcttcctaacactcaaatccaagatccactggcccccaccttggcttggggactcagcttaggctgaccctttctgatcttgccactccaccagcctgacaaaaaccccaggaccctatttaagaagagataacatgccctgaccacaagaaggatggccgcaacaatgtagtgagctgtagagaagcaaatcaacctaaaccaaagcccaactctcatcctacttttgccgctatgcttcactgttgtcctagacctactctctgctcaggaggctcagccactatcttgaacccaacccacaactgcatgcagtgtccacacacaagcatccatcccttggatgtttccagcctaaacccgacataatttcataatcacatgtttagtggtctacttggcacctcaatttggtagtgtctgggacatctcaaatacaacatggccaaaatccaactctttatcttccccctgaaatctactcctcacaccaacttccacatctgaaagatctaaggtcaatttttttttttttttttttgagacagagtctcgctctgtcacccaggttggagtgcagtggcgcgatcttggctcactgcaagctccgcctcccgggttcaagccattctcctgcctcagcctcccgagtagctgggactacaggcacccaccaccacgcctgactaattttttgtatttttagtagagatggggtttcaccgtgttagccaggatggtctcaatctcctgacctagtgatccacctgcctcggcctcccaaagtgctgggattacaggcgtgagccaccacgcccggcaatttttttttttttttaagacagagtctcgctctgtcactcaggctggagcgcagtggcacgatctcagctcaatgcaacctccatctcccagattcaaacagttcttctgcctcagtttcccaagttgctgggattacaggtgcacactaccatgtcctggctaatttttctgtatttttagtagaggtggggtttcgccacgttggccaggctggtcttgaactcctgacctcaagtgatctggccgccttggcctcccaaagtgctgggattacaagtgtgagccactgcactcagccttaggtcaatcttaacatttcactttctttcactgtcccacatcaggtaatccatggcccagtttgggcagattcagaagccaaccatctgtcctacctccacgggcacccctctgtccagctacccaaagcacacatctggaccacatctgtcagctcctcactggccttcctgctccaccatcaccatccctccagtctgctgcccactaggcatccatagggcgtctgttaagactggagtcagagcacctacttcctctactccaaaccttccatggctcccaccaccatcagaatagaggtccagctcctcaggctgccattccaggcctaactattggtttcccttccctgtttccaccagactaaatggagaccggcagtccccagaatgcttccatttcatcaccactaaacaaggtacacatgctggtcactgtccctgggacagccttccagatctcattccacaggattccagaaatgggaatccctcgatataaccccttgcctggattcaggatggtaagggtaagtgactcccagggcagggcccaggacccacgtgtgaggacaggacacgatcaagagtcccaggacaccaacatcccctctatctgggcttcaggatcctgagggccggaatcccagcgggtgagggcctggggcacactccacttacctgcgccgggcccatcagcaacgctggcaaccccattagaacctgtgggctgggcagggccataacaggaggcccagggctagccctgccgctgggccgaaccctcacacttccgctgggtgacggtcgcactcaggacctgtcttcccaaatgcaaaatgcgcgcaaggcctctgggcaccgcagggacgaaggctgggtatggagaccctggagacgcgtggcgctggctccactttcgggaacaccttggctcataaaagcagagtaattagccgggcactatggtgcgtgtgaaggcgcggtgacggtccctgcacccactcccgtgccctggtgtggctccagaggcctgctgtagcccaacccaccagcagcaaaatgaggaccgcaatggcggcgccggaagtcccgcctctcaatgacagctcggacttgccactggtccgagctttcattggctc

SEQ ID NO: 2037 - DNA, 6535 bp, Homo sapiens
gaaccgaagggctggacttccggcggtgggactgtcacttcgccgcccgcgtcaggccacaccggtggtctgggctggggaccgcgggtcgggtccggtttccagggggttcctggtgctcgaggctggcggcgaggaaggtactggctgagggcccgcgtcgggcccgccctgcgcacgcgtcgtgatcaagggcgccggccgccggccgcgcccccaagcctctgtttctcagagtgcgtcgtgggcgtccaggggactgtcgggccgcggcgggagccatgcgctctcccaccgtgcggcagcccaggaggctgcgcgctgggcgttccacgtccatgatggccggggagactgaggcgcggggcggccccgggacgctgctggcggggaaaggctgggtggtccacgcctttcttccctcccagctgcgggttccgctggcggcggtggcgctgacaagcccgcgtcggggaagcaggggagtccctgctcacacagaccgcgccctcacggagggaggccgcttcctagacctcgcctagtcgtctttcctctccctgccctgggggggttgcgggggtcagtgcaaactcctgcgtccagggcactggtgagctcccgagttcgggcagccagggggctgaggtcccgaaggaggctccgaggggagagtcctgcgtgtgcaaaacctgggaggggagccgaagcccaggtgcttctgggactgagctctctcgatgtggagctggagtagaggggatgtgtgcggctgcagtatcaggcgagggagtgggctttatctcgagggcgtcgggagacatagaagttttgaacagaatcaggacatcctctgaggactttaaaacggttccaccgtttgttgcgtggagaacagacatgcaggggtgtcggcatgaagggaagaaccgactgccacagtctgggcagcagtggaggtgggcgaccaggtgaattctggtggatctgcggatgcatcaggtgtgggctgtttgaagaactaagtaccccatgttgttcagcctgagcgcctggaagaagagagctgctgtagatagaaaggagaattgaaaggaaagcaggtttccttcaggggaaagatcaagagtctgggatgtcccaggttggtcatgtcactggacctgacgttgttggcgtcctgggctgtggacagggcctatgaattggactgaggaatgggcagggactcagccaggtgtgggcagttatggcttgagggtaaagaagaccagctgggatgcctggggctattgggaagagcctagcacctaactgaggaggggagggtggcaacagagaggggaagaaaggggacaccgggtgaaaggaggaagggattgagttcctctgtgttcacaggttgttgaggctgctcccctgtggcgactggtgagaatcatccagtccctcaggctggatgagcagcctggaaatgtcaggcaagcaggctcagcaggggagggtcccagtgatgggtatgcctgggaagcccctgctgggactcacagtttcttgctacaagagcaggaagggtgcatctggggagggtcatgagtggtcatgctgagtcacgagtggacacctggggctgctcttggtgtggcagctgagggcccagccaggacttgttctagcttgcttgtgtatggcgttgccagtggggaggccaagaaggcatctggggtctggtcagggagggcagaggggaggggtcccagacatgtgagggaagtgccatctgaagatggtgggggcagaacccagggaaggagggtgagtgtctgagggacatcatggaaggtggctgttgggatggggagcttggtcctggctcacagccataccttaaactaagcttgtccaacccactgcccaggatggctttgaatgcagcccaaaacaagttcgtgaactttcttaaaacatgagatgtttatgcaatttttattttttttagctcatcagctgttattagtgttaatgtattttatgtgttgcccaagacaattcttcttccaatgtggcccagggaagccaaaagattggataacccagccttagaccatggctgtctcttcctccctgctcttttaggaccagatggcctttgaggatgtggctgtgtacttctcccaggaggagtgggggctcctggacacagcccagagggccctgtaccgccgcgtgatgctagacaacttcgcacttgtggcctcgctgggtaaggtcctagatactccatgaaatgggcaactgataacaagctgactggccagggctgccccctcacctccctggtggctgacgagcaggcctataccttgcagccaggagccatgtggaataggggtctggtcctatagacatgcagtctggttggctcaaccactccctgtggcgctgtccggctgtggcctctccgagccttggctcagtccccttcctttggtgccctgggcacagttgctgccctggggatgaatgagctattcctgtgagccccttgccctgtgccatctttagattctgcagttgcacagatgacattttctgtttccgtgaagccctgactcctgccctctgtttggaggtgggttatcttgagctggggctggactctaacctgcacctcctcctcacaggactctccacctctcgacctcgtgtggtcatccaactggagcgtggcgaggagccctgggttcccagtggaacggacacaaccctgtccaggaccacctacaggaggcgcaaccctggtgagagggagctcagggtggggtgaattcaggaccaacctgtggtcatgcctctgtccctggttcccagactccccagaagcaccctcctcccctccctcccacccgattcccttcccttccatcatcagcccctcctggaggctgcagccttagctgcccttgaaggtggagctccaagggcacaggagcggggttgacacagaagggcactcaggctatggtgagaccatctcagagtcctgctatcagctgggctggcctcaaaccctccatggctagtcactgccataattgatgggtcatttttttcacccttcatctttgtgttcagcaaacatttcctgagtgctcacagtggtcaggcccagtccaggcaatgtagacacagcctcaatcaggacgaccctggtcctgcttttctggggctcatggtgtggtgggagaggcagtcggtaagcaggattcaggagtatagtctagagcactggatggaggtcattgcaggagcaggttggggagtgggtgcctgagaagggggacaggggcggggggaagggggtaagcaatggaaagagtgtgggtggaatagccagtgtggagatgtatgcagcatacagcagccgctagttttcctcagcttcacatcctgggtgtcggggggctgccaccttgatcatgggagtgcccagtgtagtcagtgccatacctatcagggcagattgttcctccaaaccccagcccctcctgcagggccagcctcacctctacttttcccctaagcttttgtgccagctccggggttccttcttgcctgtccactcagcctgccctggtcctctcctaaccaggatgccccaggcaaccactgtttctctgcctttaggttcctggagtttgacagaggatagagatgtttctggagaatggccacgagctttcccagataccccacctgggatgactactagcgtcttccctgttgccggtgcctgccacagtgtaaaaagcctgcagagacaacggggtgcctccccatctcgggagagaaaacccacgggggtgtcggtgatctactgggagaggctcctgctaggctcaggcagtgggcaagccagcgtcagcctgcgactgacctccccgcttaggcctcccgagggcgtccggcttagagaaaagacactcacagagcatgcgttgctggggaggcagcccaggacgcctgagcggcagaaaccatgtgcacaggaggtccctgggagaacctttgggagcgcccaggacctggaggctgccggcggtcggggacatcaccgaatgggtgcagtttggcaggagcctcatagactcctcggtggccaggagccctcgacctgggacgagctgggcgaggctcttcacgctggggagaagtccttcgaatgcagggcgtgcagcaaagtgttcgtgaagagctccgacctcctcaagcacctacgcacccacaccggggagcggccctacgagtgcgcccagtgcggcaaggccttcagccagacgtcgcacttgacgcagcaccagcgcatccacagcggcgagacgccctacgcgtgccccgtgtgcggcaaggccttccggcatagctcctcgctggtgcggcaccagcgcatccacacggccgagaagtccttccgctgctccgagtgcggcaaggccttcagccacggctccaacctcagccagcaccgcaagatccacgcgggtgggcgtccttatgcttgcgcacagtgtggccgccgcttctgccgcaactcgcacctgatccagcacgagcgtacgcacacaggcgagaagcccttcgtgtgcgcgctctgcggtgctgccttcagccagggctcctcgctctttaagcaccagcgcgtgcacacaggcgagaagcccttcgcctgcccacagtgcggccgcgcctttagccacagctccaacctcacccagcaccagctcctgcacacgggcgagcggcccttccgctgcgtggactgtggcaaggccttcgccaagggcgccgtgctgctcagccaccggcgcattcacacgggcgagaagcccttcgtgtgtacgcagtgtggccgcgccttccgtgagcgcccggccctcttccaccaccagaggatccataccggcgagaagaccgtccggcgatccagggccagcctgcacccccaggccaggtctgttgccggggcatcatcagaaggtgcgccagcgaaggaaaccgagcccactcccgcctcgggcccagccgccgtctcgcagccagcggaggtctgaggtcacaggttgcagccctggccttctgtgaatcccttccacagctaaagggcatatgtcctctgcagatccacagcagagaaaaagtcccgtgcttgctagtcagggacaagggaggccctttggctgtgatttcatttgcacgtggggacaggatttgccagttcacccacagatcacacctccatccccaaagaggtagcactgcagcaacatcagggggaggacgtggtggctgaactctagtggggccgagactattcagagccagtaggaggccgacagtcacagcactgcactgtggtgcggcttcatgtgatatgacagtggatgctaaggtgagagggatgcaggcatgggttgggggtggcccagagaaacttatgacagctgtacacaaactggccgctggagagatgcccgctgagggtattctcccctcaacccactgcctctgttcatccaagacttcctaggggccagcctagcagacaagagaccacaagggactggggatcagggtctgggctctgtcagccgccacctctgggaaagagaaaaggtttgggtccactgaacatcatgtttgtagacgctgacaggtggggtcctaatgagagccaacacatgctcactgccagctcctgtcctgagtactgggaagtttctcctgaagccctgtgagatggctctgtggctggtatcccgacttggaagatgaggaaactgaggcacacggcctggcctggcttcacacacatagccgactcaggagagggatgcccatgggggaacatgtgactctcagcattggaaggacagagctaggatgatggctttccggtggcactcgttcaggtttttgcccaagtctcagcttggccaaggcctgtcactgactggtttaccaaagtcgatgtgaggaggaggctttatacctgaggggatgatgttaacttcagacaagatggagctgctcacttttgccgggtttggtggccacttcacccccaaccctgtctcacccccattatccctcctcaattggaggctggacagagctgaataggaaagacttgctattgcctaaggctatgtgtgacaccctcctgaggacctccccaccccagtgtaatggcccttcatggcagggacagaaaggtggactgggggccatttgcttcctgtggccttcagcagaccaggccctgtccctacctggagcctcacctccaaggaaattcatgttctccttaatggaaaaaaaaaaaaaaagactaccatctgcaactcagagtaggtgttgcagtttcctgtacagcagtttggacctccagagcacagcctcttgtccctactccagagcatggttcagtcttaatagcagttcaagagcttctctgataaaggtttctttttaaaca

SEQ ID NO: 2038 - DNA, 90 bp, Homo sapiens
caggcacatgcgcacggcaacctggacctgcggagggcggcggtgaccactgggcctcactccgctaacccaggtccgcatcaggcgcgt

SEQ ID NO: 2039 - DNA, 4804 bp, Homo sapiens
cttttggggacagatcccgaagttcgagcatccctcggataggccgggtgtcaggcctggtctctcaggcccgtccaggtgggcgtctttcactgcagaccttcagggccgggatgctgtggccatccctcgactccgcgcaacgtggagctttggccccgtttttcttggcctttgcttttcgttttcacatgcacgggccccggcagtgtgagtcgcccacggctcgctgtggtcagcgagcacgatgtccacgtgccccctccccagagccattcctaaaggaggtcccacccagtcaacctccccgagattgtggagggcgactcgtccccgtacattacagcctggccccaccttctacccgcccaccctggtccactctcctcgcacctcggctagacactgtggctcctcagcctggcgctggaactctgtgatgactgtctttctccacctctttagcgtcatctcccagcagtcccctgctggacccaactgtttgcaatttccaggaagctccctggacaccttgcgtccaagcatttgtccctgaggcttcctcctgctctcatttgccatcattgtttgggtcctgtgaccctcctccttccatgaagctttcttggccttatctcttctggcctcagagtacacttggtcctggtctcagccccctgggctgagcctggtgtctgccttcccctggccagattctcttggctgacattccgacccttccttttctgtaggcccatcttgacgattccaagaccacccccttgagcaagaatgccatcccctctgggtcccccatgcctgcccgtcatggacccagagaccacccttgaggagcctgagactgcccgcctccgcttccgagggttctgctaccaggaggtggcaggtccccgagaagccctggcccggctgcgtgagctgtgttgccagtggctgcagcctgaggcacactccaaggagcagatgctggagatgctggtgctggagcagttcctgggcacactgcctcccgagatccaggcctgggtgcgcggtcagcggccaggcagtcctgaggaggccgctgccctagtcgaaggactgcagcatgaccctgggcaactgttgggctgggtgagtgtggctggcatcagcttcttggagggatagaccctggctagagccattgtgacctacctcttctcctcagatcacagcccatgtcctgaagcaggaggtgctccctgcagcccagaagacagaggaaccacttgggagcccccacccctcagggacagtggagtcccctggggaaggtccccaggacaccagaatagaggggtctgtccagctcagctgcagtgtgaaggaggagcccaatgtcgatggacaggaagtgggtgaggttggggtcccaccagagatgagggactcctggaggaagtgtggacattcctggctagggtgggagtcccaggagaggtgtgtcaaggctgggactcctgaagtgaatgtggatgtccctgtctgggatggggacctgggaggcaggagccaagggctggctacgtgccatgtcacacagcagaggagctcctcatctgccatggctcatgtgggcagcccctgacaccacccttccatctgccccacttttcagcaccctccagccctccacttgcagcacagtcccctgaggggaaccatggacaccaagaaccagcctccacatccttccacccacccaggattcaggtgagcagccccaagtgggaagtataggccccaggtgtgagaagggactgtccccatggctgccctctgcctggtggttttccaggctccttgactagtggctctttgcttcccagaagtggagtctgtaaaagctgtacccctccacaggacctggggcagagggacagactggtgatctattattgaaaaggatttggggctggacatggtggcttacacctgtaatcctagcactttgggaggctgaggtgagcggatcacctgaggtcaggagctcgagaccagcctgaccaatgtggtgaaaccctgtatctactaaagatacaaaaattagccagaagtggtggcaggcgcctgtaatcccagctactagggagggtgaggcaggacaattgcttgaacccaggaggcagaggatgcagtgagccgagattgtgccactgcgctccagcctggtcaacaagagcaaaattgtgtgtcaaaaacaaaaaaaaaaaaaaggatttgggcctcaagccatggaaacccagtttagagtggctggaactagtgggcttggcttcctcacctccagagaagtcagctgggaggtttgctgctcccagaggtcctgagccagacctggggatttgaacttttgtgtgtagctggggaggggagaagatgaccagctgtggcaggactccccccacacctgagaccagatggagacactctccctgggaaatgcccgaagtcccttctctcctaggggtttcttcagaggccacctgttaggcctggaagctcagcttgaggcctcttctacctggatcgcttggttcccaagtgtgggtagcaaggtcttttcctctcccggctcctctaacaactccactggggagcttcagcagcaacattgctggttgagatgtgtttcgaggctaagaagtccttccaggctccctccacagccccatggcacagtcagaaagtgaggcagggtgggtaggctgcacttcccagtgtcctcacctccagccagcaccatctctagctgtggctcctcacagctgccgccttcctgcccctggacttgccacagcttgtccctcaggattatttttcccaacccagcaaagccccagatgatgggactcaggcagcaaggagggctgacccccaatcagggagttcattcctcgataaagtcactcaggtccctgtgatgctgccaaacctgccctctgagcaggatggtgtagtagagggggatgagtgctggcagcagcactggtcaggtgatctgaaggagaacctctgcacttaacaaacacacaccttgagatcattctcagcaggaggggcagatgaggcgtaggtaacctgctgactcttccgggtaataggtaagaatgtgaaccagacagggcagggaaggggtggaaagacgcctacagtgatgggccacatccgcaggaggagtgggggctgctggaccggtcacagaaggaactgtactgggatgcgatgctggagaagtacggcacagtggtctccctgggtgaggaccagccagccccaccccgcccctctccctggggcctgcacccaccctgcagcaggcctagctgggcagggcctctgtgctaccagccctacccagctctcccaccttccagaggaacaccctgtcacctaccagaaccgaccccacccctccttcatgcaaaccccatgcctaactgtgccccccacccgggcagggttaccgccccaccagccagaggcacaggcccagtcagagctggggatgctgctcacggggacaggcgtctgcagaagcctgcgctcgggtgagtgccccacaccatccagcctgaatcacccctcctgtatcggtgggacctgagccacccactcatggggggacgggagcttgtgccacggccacaagcctgagggaggggttgctgagtgccgggactcacctggtttgcccctgcccccaggaaatgagagtgagggtccacctggctgcccagaggcccagccgccccagggcccagggccggcagcctgggagggcttgtctggggctgccactcctgcccccactgtgcgcccagggacaccgccagtgcccactcagcccacacctgcagagacgagactggagccggctgccacccccaggaagccctacacgtgcgagcagtgtggccgcggcttcgactggaagtcagtgttcgtcatccaccaccggacacacacgagtgggccaggtgtgcagtccccggggctagccaccggggaaagcacagagaagccaccacaaggggaggtggcctttccgcaccacccccgacgctcactcacaggcccccggagttacccgtgtgaggagtgcgggtgcagcttcagctggaagtcgcagctggtcatccaccgcaagagccacacaggccagcggcgtcacttctgcagtgactgtggccgcgccttcgactggaagtcgcagctggtcatccaccgcaagggccaccggccggaggttccatgagcagccagacagcacagtccctcggggcctcggtgttctcggggcctggatacagcctctggggcaccagcagaagactctggaggcagcaggggatgccagagtgaacaaggggtcccaagccagttccctgcccctggtctggtctcccccaaaagacctgggtgcaaggaaaaggagctgctctctctcttcttgcccctgcctcctagagggaggtctgggttcccttctatggctgaccagtgcctgtggggtgactgccaagcaccaggctccctccctccctgtgacatggcctgggctgacaacactccctctcctgggacctccttgcctcaggtgggtgttcaaaaactgtgccttcccactcgtctgtgcagaggctgggcctgaggtctcagtgtggagagcagcagaagacccaggaaagcacagttggcttccgtttctcctgctccctgtgtgtgttagaattttaacataaattccactttcataata

SEQ ID NO: 2040 - DNA, 991 bp, Homo sapiens
gatgccctgccctcggccgttctggctccgccattcccgggccccccagggctcgggtcccagctccccaggctcgctctctgcgccccgctccccaagcagaggggaagaccaggaggaggaggaggaggaggaaggggacggcagcccaggctccggccctatcctgccccccgcctccccggtggagtgcctcatctgcgtgtcgtccttcgacggcgtgttcaagctgcccaagcgcctggactgcggccacgtcttctgtctcgagtgcctggcgcgcctatcgttggccacggcgggcggcggcaacgcggtggcctgtccggtgtgccgcgcgcccacgcgcctggccccccgccgcggactccccgcgttgcccacgcagtccggtctcctgccccgcgacgcgcgcgcaccgccctctcgccagggctccgtgcgcttcgaccggcgccgcggccttctctacctgcggccgccgccgcccccgcccgggccgcgcaaggcccgcgccccgccgcccccgccgcctctgcgcctgggccgcccgctgtcgcgccgcttgtcgctggccagcccggcctgggtcttcaacgctgccgtggcgctggcggtgctggtggccgcgggcctcgtggtctcgggcgtctacatcttcttcctcatcccgcacgccacctcctccggccccccgcggccccagctcgtggcgctcgctccagcgcctggcttctcttggtttccgccgaggcccccgccggggtcgccctgggcccccgcctggacgccgcgccccacgggccctgacctggacacggccctgccaggaactgcagaagatgcgctggagcccgaggcgggccccgaggacccggcggaggccgagaggacgctggacaggcgatcggatggcacgtggggcacagaggctggccccggctgggccccgtggccacggggcgcgaggaggctgtggggctcacaataa

SEQ ID NO: 2041 - DNA, 7537 bp, Homo sapiens
cctcttcctgtctgtaccagggcggcgcgtggtctacgccgagtgacagagacgctcaggctgtgttctcaggtgagaccgccgcggggccggggatcctagggacggttcatggtctttcggggatagtgccccgcggcctgggccttttctcattaggtctcatttctgtctctggaaaagaaaatgtagaagaaacgggcgcgggccgagttactcttgacttctttctggtgctccgccgcttctagcttttccccatagcggggcttggggaacttggtttgaactatgcggttgtactctgagataggaagtttccatttcttagggacacgatgccctcttttgctctgtgtaactttccccccgtaatagcagcccctagagccttcatactgtcggtcaagaatcgaaacctttgggttgattgtgccacacggtacctaccgtggtccttgatgtcatataacggtcccgcctcacggccaaagaaacagtccgagacggaacgttgacttgggtcaaagaccatgtaaatcgcgagattgtggtttgaattacagcccatgcagtgtgaggacgtatggcatctgctgagccattataccttggtcccagtgcagcagctgttgactggtggctgccaagtcttgggcccaggggttctaggtgaaagacagatgcttcttgctgacagctgagtaatttttctagtgcttgaaaacacgttcacggcctttcttggtcctttgcgaccccccagttcatcactagatggcggctagcctcagagttgggaatgagtgcgcctttgctccatgctagctgagctctgacgtttttttcctgtcatcaccctgtcccaggatgaccgagtgggagacagcagcaccagcggtggcagagaccccagacatcaagctctttgggaagtggagcaccgatgatgtgcagatcaatgacatttccctgcaggtgaggggaacttggtgattggccttcctggctgggggcggacattattccaggaaggcacacatcaaacttgttgctgtgccattaagtcaagaatagagatcataacaggtaaagaagggatcccttgaccaccacatctaccacatctgctcttacgtcctgttcaaagatgactacaacttctgtcatgagaggactccttcaccagaaggagcatcacatctcacatatggtatttttgttactgtttttgtagtaaaatacataacatccagtgtcattcttttgcatgtgaatatccagttatccagtaccatctcctaaagagatgttttttttccctcaattgaatggccttggccacttgtcataaatcagctggccgtagttttttttttttttttttttttttgagacggagtctcactctgttccctgggctggagtgcagtgacgcgatctgcctaccgggttcacaccattctcctgcctcagcctcctgagtagctgggactacaggtgcccgccactgcacctggctgatttttttttttttatttttagtagagacagggtttcaccgagttagccaggatggtctcgatctcctgacctcgtgatccgcccgtctcggcctcccaaagtgctgggattacaggcgtgagccaccgcgcccggcccagatgtatgggtttcattacagactttcagttatattccactggtctatatgtctgtctctatgccagtaccacactttcttgctttgtattaagttttgcaattgggaagtgtgagttgtcctactttgttcctactccgtacggttttacacataccctttttttcccctccccatgaaggcatcattaagaattttgtgggccttaagaactttagcttttgtgagcccttcctccattaaaagaaagtgtttgaaattatattttgtgactgcattgatataaagatgaatataacttgggttgcactttattcactttcctcctctttttttttaatcattaaagttttatctttgagataagatcactctctgtcacccaggctggagtgcagtggtgtgatcacagttcactgcagcctcaatacacctgggctcaggggatcttcctgtcttagactccaactagctgggaccaaagatgcatgccaccaaacctgctaccttttgttttataaagaatgaaaacttttttgttgtctgtaaagatgtcaggggacttaggcactatgcctaatggataattcagccttgtttttcactctgaatatcttgtagatcttggcttttctttccttcaggggtttatttcggggggtccaaaaacattttaaatattattattattttttgtttgtttatttatttatttatttttttgaaacggagtttcgctcttattgcccaggctggagtgcaatggcacgatcttagctcaccacaacctccgcctcccgggttcaagcaatgctcccgcctcagcctcccaagtagctgagattacaggcgcacaccaccacgcctggctaatttttgtatttttagtagagacggggtttcaccatgttggttaggctggtctcgaactcctgacctcatgatctgcccggccacattttaattatttatttattttttgagacagagtttcgttcttgtcgcccagtctggagtgcaatggtgcgatcttggctcactgcaacctctgcctcctgggttcaagcgattctcctgtctcagcctcccaagtagcggggattacaggcacatgccaccgcacccagctaatttttttatttttagttgagacagggtttcatcatattggtcaggctggtctcttaactcctgacttcaggtgatcagcctgcctcagcctcccaaagtgctgggattacaggcatgagccaccacgcctggcgttatttatttatttgtgagacagagtctctctctgcctcccaggctggagtgcagtggtgcgatctcggctcactgcaacctctgcctccccagggtcatgcgactttcctgcctcagcctcccgaagtgctggggttataggcatgagccactgcgcccagcccacaaacattttcattataggcccagataatgttttagactttgtgggccacactggccactgttactttttttttttttttttttttttttttttgagatggagtcgctctgtcacccaggctggagtgcagtggcacgatctcggctcactgcaacctccacctcctaggttcaggtgattttcctgcctcagcctccctagtagctggaactacaggtgcatgccaccacacctggctaatttttgtctttttagtagagacagggtttcaccatgttggccaggctggccttgaactccttgatctattaaacgtttgttaagtgcctgttccactagggaaataaacatcaatgggagttcactgtattttaaacacctgtgcagggctccactgttgggccaaacccttcctggggaatttggtgtttgcaattttttgctgcatagtgaaagccctgcgtgaatgcccttcacgagactgtgagttttttttttcttgcagccagactatgaaatagtactgagagtttcagtgtcctgtgttcttttcccatcattccttgtatttgtagaaacaggtattttgtgtatattctcagaggcaagtgatagaatggccttgggtacattttgtaatggaactatcaacagcagtctccttcgaatgcacatagctcctttcttcccctttacatactcaaggttaactttttggcatttttctagatttttgtgtggggatggctatgtaagtataagaagacttgttaaatgattgttttaaaactgtggttctgggccgggcgccgtaatcccagcactttgggagactgaggcgggcagatcatctgaggtcaggggtttgagaccagcctggccaacatggtgaagccccgtctctactaaaaatacaaaaattagccttgcatggtggcgtgcacctgttgtcccagctacttaggaggctgatgcaggagaatcgcttgaacctgggaggtggaggttgggatgagctgaaatcatgccattgcactccagcctggccaacaagagcgaaactccatctcaaaaaaaaaaaaaaaaaaaactgggctgagcatggtgacgcatgtctgtaatcccagcaacttgggaggctgaggcaggagaattgcttcaacccaggaggtggaggttgcagtgagccaagattgcaacgttgcactccagcctgggtgacagagtgagactccatctcaaaaacaaacaaacaaaaaacccaaaaacaaaaaagttctcagccaggtgcagtggcttatgcctgtaatcccatcactttgggaggctgaggcggacggatcacctgaggtcaagagttcaagaccagcctggccaacatgtccaaaccccagctctactaaaaatacaaaaattagcctggcatggtggcatgcacctgtagtcccagctactcaggaagctgaggcaggagaattgcttgaacctgggaggcggaggtttcagtgagccaagattgcaccactgccctccagcctggaaggcagtgagactccatctcaaaaaacaaaaaaccaaaaaactgtggttcctactctggggtggttggtttcctgtcttagagaacacttagcaatgcctggatacatttttagatgtgaaaactgaccggggtggtgccaggcactgtggctcatgcctgtaatttcagcactttgggagcacaaggcaggcagatcacttgaggtcaagagttcgagaccagcctgctcaaaacagtgaaaccccttttctattaaaagtacaaaaaatttagctgggcttggtggcgcgtgcctgtaattccagctactcaggaggctgaggcaggagaatcacttgaacccaggaggcagaagttgcagtgagccgaggttgcgccactgcactccagcctgggtgacagcaagactcagcctcaagggggggaaaaaaaaaactaggccaggcgcagtggctcatgcctgtaatcccaacactttgggaggccaagacaggcggatcacaaggccaggagttcaagaccagcctggccaacatagtgaaacctgtctctactaaaaatacaaaaaaactagctaggcttggtggcaggcccctataatcctagctactcgggaggttgaggcaggagaaccatttgaacctcggagtcgtaggttgcagtgagctaagatggcaccactgcacaccagcctgggtgacagtgagagactcaaaaaaaaaaaaactgaaggggttgccagtggcataccagatggctgttaaacatcctatagtgtgcaggacagccccccagacaattatctggtccaaaatctagtctccttagattcccactcttccattacgaaggaagtgtactttttagcgacttggtaaagtcacctgttcagggtttttttcctcatggtggatggggcttacatccaagtcccctgttgaggcataccaggatcccagacagctgttggactaccccgaatgggtacttgatctctcctctggtgtctggccaacgcccatgctgctcctgaccattttcccttcatttcctgctccctgctgccccaggattacattgcagtgaaggagaagtatgccaagtacctgcctcacagtgcagggcggtatgccgccaaacgcttccgcaaagctcagtgtcccattgtggagcgcctcactaactccatgatgatgcacggccgcaacaacggcaagaagctcatgactgtgcgcatcgtcaagcatgccttcgagatcatacacctgctcacaggcgaggtagggctctgtggcctggtgagggcaggctgtgccctcagtacacccgaaagccccacggagtgtatgtcaggcttatcccctgtgtggtgtggtcactcttgttttaggtatgaggaaaggggaggaatgcatggggctggatgtcaggctcatatcccccttctctctagaaccctctgcaggtcctggtgaacgccatcatcaacagtggtccccgggaggactccacacgcattgggcgcgccgggactgtgagacgacaggctgtggatgtgtcccccctgcgccgtgtgaaccaggtgagcctggggcttatgcacgtggcagggtggacacagccacgggagtgggtggggtcttgcctggggcaggaaggctcctctctgtctgcatgttttacctgcagcatcacttcctctaggaagccttcctggattcccaccctgcataggggctgatccaggctctgggtcctcttcgggaacacatttggcagaggtcttctttctttcctttgggtgtatatttttacactgtgtgtatatgtactttttttttttttcttggacattttgagaatcagttgcagacattttgattgtgttttccctgaacactgcaggtgtctttaaaaacaaagatgacctacccccgtcgtcacccccaggaaggaatttatattcacagcaatagtcgttgttccatttagcatctgtccccagaatgccagaatgccctttatagtggcgcattgtcaattgggtccaagttaaaagcaaatatattgccttgttttttagaaataattgagatggaatctcagggtgttcttgaattcctggtctcaaatgatcctgtcccctcagcctcccaaagtgctaggattacaggcatgagccaccacacctggccgccttttttgttgtcgtcggtttttttgtttgtagaggtggggtttcaccaagttgctcaggctggtctcaaactccctgccaaagtgttcctcctgcctcagcatcccgaagtgttacaggcgcaagccaccgtgcccggccgtctagcagtttgctgttgaggcaggtctcaatctcctgtcactggggacgcaacttcagcctgtgtgtgtgtgtgtctggacacttgctcttgtgaccctctatctgattgcaaatcaggcatgatgccaccacctcttgtctcagtgggcctatgggtgacaacgtggctggcagcatcagttgggagtggccccagggtgctggaggaccgcagtctgtccttctagcctgacccctgctgtcttcctaggccatctggctgctgtgcacaggcgctcgtgaggctgccttccggaacattaagaccattgctgagtgcctggcagatgagctcatcaatgctgccaaggtgggtgagggcactccggttggggggtcttaagttgggcatttgtgggggtccttcagaattcagagctgtgtgtctccttgcagggctcctcgaactcctatgccattaagaagaaggacgagctggagcgtgtggccaagtccaaccgctgattttcccagctgctgcccaataaacctgtctgccctttggggcagtcccagcca

SEQ ID NO: 2042 - DNA, 9631 bp, Homo sapiens
ggtcgtggcgtgaggggcgccgagcgaggggaggcgcgggccacgggagttccgggagttccggcgttgcccggcagtccgcagtcctcggcgggaaggctgtcccggcgcctcaggcagctctgcgtgggccggggtgacttcctcgcgatcccctgcgcgaggtgaagggcagggacctttgccgcgccttccacgcgccgtgccccaccggcgagtggctccatcttcctcagacttatcgctcgcggacaggcgccgtgggtctcccgggcctccgtaccgtcctccttcccagcggctccgggaagcggttccctgtcttcggacgcatttcacccgcgcggggagagcttcccgggaaggttccacggcggccgagggtttccgcgcccgggacgcgtttcggctgaggccgtgggtccagtccacgggttctgcccgcacggtccaatggccggggaggcggaggtgagcagaggatgcctccgaggaatgagggggcccaccaggtggggggcggcgtgtgccagggcagagttggaggagggcaggagatctgcgtatgattccagggggaggtctttgatgcacggctggggcatgcccttggcagtgggagccattggagatgtgccgcaggactgggacaggatggggtcgtagttgctgtgccaggccctctggagacgcatgtgcagaacggcgtgtggaaggccaggcaattgcctatagggtaaactggggacgttgtgctgggggtgtacagttttaggcattctgttgtccagttttgtgcctgttgagcaggaggcaaactggaccctgggaccaggtacttgagacctaagggagaaggatgagcataggtttggttgcgtctgagaggtatgatctctgggactggaattggcaggcaggagatagagtggagcctgtgcccttggccctgcacatagatggcatcagtctggtcaccaacctgatgtcgctttgggctggacacagtttccagtagtaacaccagaagcatcaataacaccagcagctctgatattcctctgggataggagaaggaaggtataagggtatgtgtagggagtaaggtggggaagagtttagagctcatagggaaagataatgtcagggggagatgtgataggaccctgagatacaggtcaagggcctgaatgtgtccatctgtccatattttggttgtttttttctgcccatcattgaccccaaggctcagttggacccatcattgcagggcttggtgatgtttgaggatgtgacggtatatttctccagggaggagtgggggctccttaatgtgacccagaagggcctataccgggatgtgatgctggagaactttgcactcgttagctcactgggtaagtctcttacactgtcccccagcacactgactaccccctcattttccccatgcgaagttctgtccataacgaagccagaccatgggggctctttccttcccagattccctgttgtaggtattgtgggtggtgggactcggtggtgggactcggcggtgtgctctttccctgcctttctctgagcaatgctgttggcagcctcaacacctcttgccccaggagctagtggagcaggttttgggggtcagatgtttcatagtttgcccaccaaatcccaccaagctctgccttttcctggccatgtgactctcttgaagacatggcttctctgtgctctgggttttgcctccctacaaaagaaattttacagggacctccctgggccaggcttgagccatgaattttaatcagaacggtttgggaaatatatatatatatatatatatatatatatatatatatatgtgtatatatatatgtatatatatgtatatatatgtatatatatgtatatatatgtgtatatatgtgtatatatgtgtatatatatgtgtatatatgtgtatatatgtatatatgtgtatatatatgtatatatgtatatatatatgtatatatgtgtatatatatatgtatatatatatatgtgtgtatatatatatatatatgtatatatatatataatttttttttttttttttttttttttttttttgagacagagcctcactctgttgcccaggctggagtgcagtggcgcaatctcggctcaccacaacctctgcctccagggttcaagcgattctcctgcctcagtctcccgagtagctgggactacaggctcgcgccaccatgcctggctaatttttgtatttttagtagagacagggtttcactttgttggccaggctggtcttgaactccggacctcatgatctgcctgccttggcctctcaaagtgctgggattacaggcgtgagccactgcgcctggccacaaaggtacttctttcgttaaatttattcctaagtactttattcttcactgttaagtatggtgttagctgttggttttttgcagatgcccatttcaggtgaggaagttcccttctctttctagttcatttaatgtgtttattaagaaaagtcatggccaggtgcagtggctcatgcctgtaatttcagcattttgggagggcgaggcaggtggattacctgaggtcaggagttcaagaccagcgtggtcaacatggtgaaaccccatctctactaaaaatagaaaactagccaggtgtggtggcacatgcctgtaatcccagctactagggaagctgaggcaggagaatcgcttgaacctgggaggtggaggttgcagtgagctgagatcgcaccattgcactccagcctgggcaacaagagtgaaactacgtctcaaaaaaaaaaaagaaaagaaaggtcactagattttgtcaaatgcttttccaatgtctaatgaaatgatcatgtgatttttgtcctctcttctgttaatgtagtatattagaataattgattgccttttctttttttgagacggagtcttgttctgtcgccaggctggagtgcagtggcgcgatctcggctcactgcaacctccacctcccgggttcaagtgattttcctgcctcagcctcccaagtagctgggactataggcgtgcaccaccacgcccagctaatttttgtatttttcgtagagatggggtttcaccatgtttgcaaggatggtcttgatctcttgacctcgtgatctgcccccgtcggcctcccaacactaattgttgattttcatatgttcaaccttgcattactgggataaattccctgtcatggcttataatacttgtttttttttttttttttttttttagacagagtcttactctgtcgcccaggctggagttcagtggcatgatctcggctcattgcaacctccacctcttgggttcaagtgattctcctgcccccgcctcctgagtagctgggttacaggcatgcaccactatgcctggctaatttttttatttttagtagagacaggggtttcaccatgttggccagggtggtctttttttttttttttttttttgagacggagtctcgctctgtcgcccaggccggactgcggactgcagtggcgcaatctcgactcactgcaagctccgcttcccgggttcacgccattctcctgcctcagcctcccgagtagctgggactacaggcgcccgccaccgcgcccggctaattttttgtatttttagtagagacggggtttcaccttgttagccaggatggtctcaatctcctgacctcatgatccactcgcctcggcctcccaaagtgctgggattacaggcgtgagccaccacgcccggcctggccagggtggtcttgaactcccgacctcaggtgatccacccatctcggcctccaaagtgctgagattacaggtgtgagccaccacacccagccagtggtgtagttttcttataatgtctctgtattgagtatgagggtaattttggcctcaatggatgagttgggaatgtttccttctcttctgttttctggaagagtttcttaagtattggtgttaattcttatttcagtattgttagtattcacctttgaagccatcagggcttggggttgtgtgtgttttggggggaatgttttttaataacaacaagaaaaccctctttgttacatttgtatttagattttctgtttcttcttgactcagttttgatagtttgtgtctacttgggaatttgtccatttcatctaagttatccaatttgttggcatacatttgtacatagtatttcattattttttaatttttataaggttactagtgatgtcctttttccattcctgttcaaagtagtattgagtcttctctctgttttttgtcactctaggtaaacatttgccaattttgttgattttttcaaagaaccaaattttggtttgtcggttctctttttctaatctgtttcattcgtttctgctctaatttttattatttccctccttttgctatctttgggtttgtttttctttttcttgttccttgaggtataaagttaggttattggtttgagatcttttaaaatatgggtatttatagccataatgttcctgctaagctctgcattttctgcatcccataattttttgtttgttgtggtatttttttctttttctttttctttttttttaatttttctttttgagatggagtcctgttgcccacgctggaatgcaatggtgcgatctcggctcaatgcaatctccacctcctgggttcaagcaattctgctgcctcagcctcccaagtcgctgggattacaggcatgtgccaccatgcctggctaatttttttttttttttgaggtggagtctgatgcctcccaggctggagtgcagtggtgcgatcttggctcactgcaacctccgccccccaagttcaagcgattctcctgcctcagcctcccgagtggcatggtccaccacacctggctaatttttgtattttttttttttggtagagacagggtttcgccatgttggccaggctggtcttgaactccagaccacaggtgatccacccacctcagcctaccaaagtgctgggattacaggcgtgagccaccacccggcctgttgtatttttcttttcttttctttttttctttttttgagatggagtcttgctctgtcacccaggctggagtgcagtggcactatctcggctcactgcaagctccgcctcctggattcatgccattctcctgcctcagcctcccgagtatctgggattacaggcgcccaccaccacgcctggctaatttttttttgtatttttagtagagacggggcttcactgtgttcggcaggatggtctcaaactcctgaccttgtgatccacctgcctcggcctcccaaagtgctgggattacacttgagccaccacacccagccctgtgtttttattttcattcctcccaaagtacttgtaattgtcatgtgatttattttttctttgactctggatttttaggaatgttttgtttaaattccttaaatttgtgagtttcctaaatttctttctgttgttgatttctgttttaattcatttgtggacagagaacatacttgacattatttcaatcctttgaaatctactgaggcttgctttatttatttatttatttattttgagacagagtcttgctctgtcgcccaggctggagtgcagtggcgcgatctcagctcactgcaagctctgcctcctgggttcacgccattctcctgcctcagcctcctgagtagctgggactacaggcgcctgccaccatgcccgggtaattttttttttgtatttttagtagagatggggtttcactgtgttagccaggatggtcttgatctcctgacctcatgatctgcccgtctcggcctcccaaagtgctgggattacaggcatgagccaccgcgcccagccgaggcttattttatatcctagcaaatggtatgttctgaagaccgttccatgtgcacgtgacaatgtatatcctgctgttgttaggtggcaagctctatagatgtctgttaggactagttggttttcattgttgttcaagtctgctgttgttattgatggtgggaaattacaatcgttattattgctgaacagtctgtttcttcagttatgtcagttttgcttcatagaaaggcttttttttttctttttgtttgtttgtttgtgtttttgagacagagtctcgcactgtcgcccaggctggagtgcagtggtgtgatctcagctcactgcaagctctgcctcccaggttcatgccattctcctgcctaagcctcccgagtagctgggactacaggtgcccgtcaccacatccgcctgatttttttgtatttttagtagaaggggggtttcaccgtgttagccaggatagtcttgatctcctgacctcgtgatccgcccaccttggcctcccaaagtgctgggattacaggcgtgagccactgcgcccggcctgtttgtttgtttttgagacagggtctcactctgttgcccaggctagagtccaatggtgtgatcgtgactcactgacgctttgacctcctaggctcaagtgatcctctcactatggcctccctagtaactgggactacaggtggtgcatgccatcatgcctggctaattaaaataatatattttttgtagagttggggtcttactgtgttgcccaggctggttgcgaacgtctgggtttaagtgatctcctacctcactttccaaagtgctgggattacaggcatcagccaccatgcccagcctgtttcttttactacctgtcacccgcaggacttgcaccttcgagatcccctgtgtttacccagctggaggatgatgaacagtcgtgggtgcccagctgggtggatgtgactccagtcagcagagcagaagccaggagaggttttggtcttggtaagtggagtggaggggaataccttggtttcagcagtgggctcacagaatgctgagtacctgcatacaccgataccttggtgttgagggcagtgaccataccttatttccttccacctttcctgtcttatgtggacactgtgcagtctgccatctctaccatgattttcaggccccgcatgttcctgcctctctggcctgcgtctcctcattgcccttctctgtatctgtgcagagctgtctactgttggcgactcagtgcgtgtcttgaaatgtgcacatatccttaaacaggtatttgaacttcagccaatccttaattaatacttaaacaccagctactattttggaatcacattttgctgggactagacacatgcctcctcatagtgcttggctgtcaccagcagccaaggccctgctgaaaccctttgcagaggagtgacttggagaccccacctctcttccctgcaccatatcctatcttgtgccctcatctcagttgaggttttccttagtctgtagtctggtggagccatattcagttgtgccaggctttcccaacccagacctttcctagcaacctctcagcaattcttttttttttaagatggagttttgctcttattgcccaggctggagtgcagtggcgcaatctcagctcactgcaacctctgcctcctgggttcatgccattctcctgcctcagcctcttgagtagctgggactacaggcgcctgccaccatgcctggctaatttttttttttttttttgagtcggagttttgctcttactgcccaggctggagtgcagtggcgcgatctcagctcactgcagcctctgcctctggattcaagtgatcctcctgcctcagcctcccgagtagctgggattacaggcatgcatcaccacacccggctaattttgtatttttagaagagatggggtttcgtcgtgttggtcaggctggtctcgaactcctgacctcacgtgatctgcccgccttggcctcccaaagcactgggattacaggcgtgagccaccacgcctggccctttcagcagttctatggagtccttctgggtgtgtctgacatgcactggtgattaaggtacctcctccctctagttcaactcttagtaatgattcatctctgctttcagatggtttgtgtagagtggaggatgagagagcccatcctgagcatctaaagagctacagagtcatccagcaccaggacactcatagtgaggggaaaccaagaaggcacactgagcatggggcagctttcccacctggttccagttgtgggcaacagcaagaagtccatgtggcagagaagctgttcaaatgcagtgactgtgggaaggtgttcttaaaggcctttgccctccttgaccatctgataacgcattctgaagagagacccttcagatgcccaacaggcagaagtgctttcaagaagtcagctcatattaacccccgaaaaattcacactggagaaacagcccatgtgtgtaatgaatgtgggaaggccttcagttacccgtctaagctgaggaaacaccagaaggttcacacaggcataaaaccttttaagtgtagtgactgtggtaaaaccttcaaccgcaaagacgcacttgttctacaccagaggattcacactggagaaaggccttacgagtgcagcaaatgtggtaaaaccttcagtgttctgtctaccctcattcggcaccggaaagtgcacattggagaaaggccctatgagtgtacagaatgtgggaagttctttaaatacaataatagcttcattcttcaccagagagttcacactggagaaaggccttttgaatgcaagcaatgtgggaaaggctacgtgacccgttcaggcctctatcagcactggaaagtccacactggggaacggccctatgaatgtagcctgtgtgggaaaaccttcactaccagatcctaccgcaatcggcaccagcagttccacactgaagagaggtcttatgaatgtacagagtgtgggaaggccttcaaacatagttccaccctccttcagcacaagaaagtccatactccagaaaggcgtcaggaggacagggcacatgggaaggtcgttagctgctagcaccgtgttcatcaggaaaggtcttattccagaaaggaggttaaggagagtggccgtgagagtgccatccgaaagaagctaaaccttgcacatcccaacacccaccccagggagagttcccgtgtgtgcctggtgtgtgggacgctttcgggagccacattgcactctgacttgcctggggctgttggcagtgtcacatcactgagtttatccaccgccatccacctctatccaccccataaggtccctacagcaagtgggacagcagaccttgtgctccttgctctaaacagtagagaatcgttaatagtggagcccaaaacaggcctcattccctacccttgactggtttagctgtggacatgacccacctctggccggaggagctgagctggtatctgctgggggcttcctgggaaggtttaccattttcatggaaatggttgacattacacatggtatttgtcatgccctagcatggactgtctcatactgctctggactatgtggtaataaaggctttattgtttaagccgcttaa

SEQ ID NO: 2043 - DNA, 13401 bp, Homo sapiens; identical to SEQ ID NO: 2035

SEQ ID NO: 2044 - DNA, 13734 bp, Homo sapiens
cttctgtgaacacatctgagtttattctgccactgctacagggcccactgtcatttccagcccactgaggttgagggtatggccaggctgggattcacacaggcccaggatgaaagggacaccgagtgtgttggggtgggggtggctggctttgatccctaccccagtgggttggccaggtgatcagagcctccaggttccctcacacacagcctggtacatttctgccgtcaggggccggaaggactgggcccggttgtccagtacaaacagagggtcaaccacgatccccacattgaagccctcacgcaccaaccgggtcttcatcagtttgaacgtgctggtgacctccatggcgtcctgcagggcagtgaccatggtccaatcactgtgacatccacccgccccctggctatgatcttccacccacccaccaggccaccctgggctcacctggatgcggatgaaatggggggtagcgtaggcagggagccaagcgcgaacgtgctggtacaacttctccccgtcgaaagtctggccgggggctagctgcacagcagccatgcccaccttaccctcacaacctagagagcagtctggtcactctcggctgacccatctcgagggcccatagctgaccctccagcctcgcccagctctgctcactggctgtgagagccagcaagtctctaaacctctctgggccctagcacttccccacctgtaaaatcagaataacgacccctccacccacaaagctgttggaagtttaaaatgagaaccctccgcacctggcacgcacacgccatacacgttaacctgttgcaagaagtccacctgcgacaacacgccctccacctcgtgcgtggacacgttctcgcccttccatctgcaaggagggagccggcgcttgtgaccacgcccccgggaaggagaggccccgcctcttgcccccgccccgccccttttggggatcaggaggcccagtcagccccgccccctcgaaaatcgagaagccccgccttcgcgtgagaagtcctgactccaagttccgccctcttacgacaggaaagtcccgcctcttcagcctgactccctctaggatctgaaagcgtccgtggccccgcgccagccccgccccgagaaaccctgcctcggaccggaaggtgtccccgaggcggtcgcggaagtagaggaagccttcgcggtccatggccagtacgtccccggtgttgtagtaaacgtcgcccgattgccgcacgttgcgcaccagcttccgttccgacagctctcgggggccgcggtagcccacgaagggttgctggcttaccaccttggtcagcagcagccccggctcccctggggtaggagcaggaacaagaacccctggagcccaccagccaagccccctgctggaggttttcaacaacggtggactcttcatcacccagcaccctgccaaggacagacccaaagacacagacagggagatccagagatgagagagacattcagagaccttgagagactgcgacaagcgacacagaaaatgagagagaagtatagagaaggcggtatggggagcccatgagaaacaggaaaaggataacaagggatggaagacggacagacaaatggcagtgagaatagatatgaccaggaccttgcaaggccctgggagaagacactaacagaaggtacaggacaagggaccaatggctggaatgccgtcttccacagaaagctcaagagaacaaatcagatggacacccagagacccagtaaatcagagcaagagatcaaggcaggggagctggacagagccgagaagctgaggcggaggccccagatggtggtaaggcaggccactggctcagggtccagatgaaggctgcagacccctctagtgagcaccaacgtcaagcttttgagcagctcgttccagccaagcagaagactgagggtcgccacccctgccacccaggaaaggctcctcaacccccatacctagccctacagggatgcagaagccctgattgtccctcacaggctccgccgcctccatgtcgaactgcaccagctcaaagggggacagcatctggggtggagggtggagtgttgacataggtcctgtgggctcagcctcagggcagctgcacaccaggtacccgcacactcactcggaggaggcagctcatcttgcccagggccccgcagcgccccacatagttgactaagcccatgttgccttctgtggagccgtagacttcccagatccgaataggaccgaagcgctgctggaaggtctcccacacatcagcccgtagtccattgcccattgccaggcggactgtatgtgtccggtcctctggttgctacaggaatgtccccagaagggtgaggaggaggtgctcttggggcatgccttggaacctttacctagagggggtgttatcctgggtccttaccttgggagttacctggaaggtgatgggggacctctacctaagggatctacctgggttacttacatgagagtagttactggagtcttaaatagagggttacctgcaggggcgacctcagagctttgcctgggggacgttaccagaggtgactggaggcctcatctggggtctcacctaagagtagttacctagaactttaatttaatggaaatttaattttaattaattaatttttaatggaaattctcatgataggggtaggggctattatccctgttttccaaatgaggacactgaggctcaaggtagcacagctatcaaagaaaccattattggaagccttgtctgaaactcattatctggggttcttgcatgaggtgtattatctgagggacttgagttcagtacctgaatctttacctgagacctttacctgggatttcatacttgggtgttcaccatggagccctaatcttagagcctcacctggggaatgttacacaagtaccgcaggagctcgcccacatacaggatcactgtcacgccatgctgccgacagtcatcccagaagcaggaagtagagaacttgggggccagaacacaggtggctcctgggagatgacaggagagggggtttcaggtcatgcttccaaattgttgtaagaagctgcttttagcacctgtgctcacccacccccacaccctgaaatacaggacaatactgagttcatctttgtgtccttggcccagccaggactgctctcactagaagagcataggcaggcctgggttcaaatcctgtctccaggatgccgggaaagctccgtgcctgttataaagtgagcaatgctaaataagggctgtaaatattaaattttttatttttatttttgagacggagtctcgctctgttgcccaggctggagtgcagtggtgcaatctccgctcactgcaacctctccctcccgggttcaagcgattctcctgcctcagctttctgagttgctgggattacaagcacccgccaccacagctggctaatttttgtacttttttaagtacagacggggtttcaccatgttggccaggctggtcttgaactcctgacctttcaggtgatccacccgcctcggcctccaaagtgctgtgattacaggcatgagcctctgtgcccagccacatttttaatttttattttggcttgtcactgactcgaagctcaaatcactcttgattacgataaatgaatgcccagctaagcagatgggtgggcaggtggatggatatggtggatggatggaaagatgaatggatggacagttagagtagtgagtgagtagatgggtgggtggacagagtagtgagtgagtagatggatgggtgaacagttagagtagtgagtgagtagatggatgggtggacagttagagtagtgagtgagtagatggatgggtgacagagtagtgagtgagtagatggatgggtgaacagttagagtagtgagtgagaagatggatgggtgaacagttagagtagtgagtgagtggatggatgggtggacagttagagtagtgagtgagtagatggatgggtggacagagtagtgagtgagaagatggatgtgtggacagttagagtagtgagtgagaagatggatgggtgaacagagtagtgagtgagtagatggatgggtgaacagttacagtagtgagtgagaagatggatgggtgaacagttagagtagtgagtgagtggatggatgggtggacagttagagtagtgagtgagtagatggatgggtggacagagtagtgagtgagaagatggatgtgtggacagagtagtgagtgagaagatggatgggtgaacagttagagtagtgagtgagtagatggatgggtggacagttagagtagtgagtgagtagatggatgggtggacagttagagtagtgagtgagtagatggatgggtggacagttagagtagtgagtgagtagatggatggctggacagttagagtagtgagtgagtagatggatgggtggacagttagagtagtgagtgagtagatggatggctggacagtgacatgcagaggcaggggggtagaaagatggataggtggctgggtgaggatcgtcacgcctgtaatcccaggacttagggaggccgaggtgggcggatcacgaggtcaggagatcaagaccatcctggctaacacggtgaaacccgtctctactgaaaatacaaaaaattagctgggcgtggtagcgggcgcctgtagtcccagctactcgggaggctgaggcaggagaatggcgtgaacctgggaggcggagcttgcagtgagccgagatagcgccactgcactccagcctgggcgacagagtgagactctgtcttaaaaaaaaaaaaaaagaaaaagagaaagatggataggtgtaaggatggatagatgggtgggtggatgaatgaatgaatgagtgaggaagtaggtgagtaggtagatgggtgggttggtgaatgtttgtatggttgtattgacgtatggacacatggattaataagatatagggggctgggcgtggtggctcacacctgttatcccaacactttgggaggctgaggggggtggatcacctgaaagatcaggagtttgagaccagcctagccaacatggtgaaaccctatctctaccaaaaaatgcaaaaattagccaggcgtggtggcgcacacctgtagtcccagctactcgggaggctgaggtggaagaatcgcttgaacccaggagggggaggctgtagtgagccgagcttacaccactgcactccagcctgggtgacagagtgagaccctgtctcaaaagaaaaagaaaaaaactgaatctaacaacacctctagttaaagtttccaatttaacaagaaatgcagatgaaaggggaacagagacctacaagcaaatacaatggggagactgtttaattgttaaaaacaaacaaacaaacaaacaaacaaaaaaacagccaattggctgggcacagtagctcacacctgtaatctcagcactttgggaggccaacgtgttcagatcacttgaggccagaagttcaagaccagactggccaacagggcgaaaccctgtctttactaaaaatacaaaaaaattagctgggcatggtggtccacacctgtaatcacaactgctcaggaggatgaggcatgagaatcgtttgaacccaggaggcagaggttgtagtgagccaacatcacacaactgtactccagcctgggtgacaaagcaagactctgtctctaaaaacaaaaccaaaccaaaacagcccattggagaaatctgaacatagactggacatcatatgatattaaggggttacatcatatgatattaaggacatcatatgatattaatgttgttacgtgtaataatcactttggttacagtttcttcagtgcttatatgttagagatatgtactgcaatatttacaagcataaagatgcagtgtctaggatttgctctgatatattctggaaaaaaatagggaagtggctgggcacggtggctcacgcctgtaatcccagcactttgggaggccgaggcaggtggatcacctgaggtcaggagtttgagaccagcctggccaacatggcgaaaccctgtctctactaaaaatacaaaaattagccgcttgtggcggtgcgtgcctgtaatcccagctattcaggaggctgaggcagaaaactgattgaaccctggggggggggggggggcgggcggggcggagcttgcggtgacccaagatggtgccactgcactccagcctgggcgacagagcgagactctgtctcaaaaacaaacaaacaaacaaaaaagaaacagggaagtacatgtgaaattaaactggccctgggcgcggtggctcatgcctgtaatcccagcactttgggaggccgaggcgggcggatcacgaggtcaggagattgagaccatcctggtgaacaccgtgaaaccctgtctctactaaaaatacaaaaaaaatagccaggcgtggtggcggtcacttgtagtcccagctactccggagacttaggcaggagaatggcatgaacccaggaggcggagcttgccgtgagcagagattgcgccactgcactccagcctgggcgacagagcgagactccatctcaaagaaaaaaaaaaaaagaaattaaactggcagcatgttaacaattattgaagctgggtgaagatacctgagatgtcatcaaactattttcacttttttttttttttttttttgagacagagtctcgctttttgcacaggctggaatgcaatggctagatctcggctcactgcaacccctgcgccccgggttcaagcgattctcctgcctcagcctccctggtagctggaaatacaggcgcccaccaccatacccagctaattttgtattttcagtagagacagggtttcaccatgttggccaggctggtctcaaactcctgacttcaggtgttccgccggcctcagcctcccaaagtgctgggattacaggcgtgagccaccatgccccggtaatttttgtattttaggtagagacggattttgccatgttagccaggctgatcttgaactcctgacctcaggtgatccaccagactcatcctcccaaagtgctgggattacaggcgtaaaccactgggcacagcctaaacttttcataattaaaaaaacaatttggccgggcgcagtggctcacgcctgtaatcccagcactttgcgaggctgaggtgggcggatcacctgaggtcgggagtttgagacaagcctgaccaacatggagaaaccccatctctactaaaaacataaaaaaaaattagccggtcgtgagggcacatgcctgtaatcccagctacttgggatgctgaggcaggagaatcgcttgaacccaggaggcagaggttgcagtgagccgacatcgcgccattgcattccatcctgggcaacaatagtgaaaccccgactcaaaaaaaaaaaaaaaaacatttggccgggcacggtagttcacacctgtaatcccagcactttgggaggccgaggcgggcggatcacgaggtcaggagttcgagaccagcctggccaacatggttaaaccctgtctctactaaaaatacaaaagttagccaggcacggtggtgggagcctgtaataacagctactagggaggctgaggcaggagaatcgctcacaagtgctcaccaccatgcctggcttttttttttttttaacagatggactctcactatgttgcccaggctggtgttgaactcctgggctcaagtgatcctcctgccttggtaccccaaagtgcagggattataggcatgaggaaccacacctggccatgataaaagtttgaaaacaaacagacgccaggcgcggtggttcacgcctgtaatcccagcactttgggaggccgaggtaggtggatcacctgaggtcaggagttcgagaccagcctggccaacatggcaaaaccccgtctctactaagaatacaaacattagccaggtgtggaggcgcatgcctgtaatcccagctactcaggaggctcagcctcagcagagaattgcttgaacccgggaggcagaggttgtggtgatctgagatggtgccactgcactccagcctgggtgacagagcgagactgtgtctcaaaaacaaacaaaaaagaaacagagaagtatatgcgaaattaaactggcaacatgttaacaattattgatgctgggcgaagatacatgagatgtcatcaaactattttcactttttttttttttttgcaagggagtttcactctttttgcaacccccgcctcccaggttgaagcgattttcctgcctcagcctcccgagtagctggaaacacaggctcgcatcaccacgcccagctaattttgtattttcagtacagacagggttttaccatgttggccaggctggtctcaaactcctgatttcaggtgatccagtggcctcagcttcccaaagtgctgggattacaggcgtgagccaccatgactggctaatttttgtattttaagtagagacagatttcactatgttgaccaggcttgtcttgaactcctgacctcaggtgatccacccgcctcagcctcccaaagtgctgggattacaggcgtgaaccaccgggcacagctaaacttttcataattaaaaaaaaaagaaaaatttggccgggcgcggtggctcatgcctgtaatcccagcactttgggaggctgaggtgggtggatcatgaggtcaggtgttggagaccagcctggccaacatggtgagaccccacctatactaaaaattcaaaaattagccgggcatagtggtgggcacctgtaataacagctactcgggatgctgaggcagaagaatcgctcacaagtgctcaccactgttgcgggaagtcagggacccctaacagacggaccggctggagccacggcagaggaacataaattgtgaagataacatggacatttatcacttcccaaataatactcttataatttcttacgcctgtcttactttcatctcttaatcctgttatcttcataagctgaggatgtacgtcacctcaggaccctgtgataattgtgttaactgtacaaattgattgtaaaatgtgtgtttgaacaatgtgaaatcagcgcacattgaaaaagaacagaatgagagtgattttagggaacaagggaagacaaccctaaggtctgactgcctgcggggctgggcaaaaagagccatatttttcttcttgcagagagcctataagtggacgtgcaagtaggagagatattgctaaattattttcctagcaaggaatattaacattaagaccctgggaaaggaattcattcctggggggaggtctataaatggccgctctgggaatgtctgtcctatgcagttgagataaggactgagatgcaccctggtctcctgcagtaccctcaggcttactagggtggggaaaaaccccgccctggtaaatttgaggtcagaccagttctctgctcttgaaccctgttttctgttgtttaagatgtttatcaagacaatatgtgcaccactgaacatagacccttatcagttctgcttttgccctttgccttgtgatctttgttggaccctgatcagtagttccgttttttgccctttgaagcatgtgatctttgtacctattctcggttcttacacccccttcccttctgaaatccttaataaaacttgctggctttgagctcaggtgggcatcatggtcctaccgatatgtgatgtcacccccggaggcccagctgtcaaattcctctctttgtactctttctctttatttctcagctggccagcacttacggaaaatagaaagaacctacatcgaggccgggcacagtggctcacacctgtaatcccagcactttgggaggccgaggtgggaggatcatgaggtcaggagattgagaccatcctggctaaatgtgaaaccccatctctactaaaaatacaaaaaattagccgggcgcggtggcaggcgcctgtagtcccagctactggggaggctgaggcaggagaatggcatgaacccaggaggcagagcttgcagtgagctgagatcgcaccactgcactccagcctgggcgacagagcgagactccatctcaaaaaaaaaaaaaaaaagaacctacattgaaatattaggggcaggttcccccgataccaccatgcgtggctttttaaaatttttttttaacagatggcctcttactatgttgcccacgctggtgttgaactcctggactcaagtgatcctcctgccttggcacccaaagtgcagggattataggcatgagcaaccacacatggccatgataatagctggaaaacacaaaaaggccgggcgtggtgggtcacacctgtaatcccagcgctttgggaggcaaatgcccgcaaatgtgggcagatcacaaggtcaggagtttgagaccagcctgaccaacatggtgaaacctagtctctagtaaaaatacaaaaattagctgggcgtggtggtgcgtgcctgtaatcccagctactcaggaggctgaggcaggaaaatcgcttgaacctggaaggcggagcttgcagtgagccgagatcatgccaccgcactccagcctgggcgacagagcgagactctgtctcaaaaaaaaaaagagagagagagagaaaatagccaggtgcggtggctcacacctgtaatctcagcactttgggaggccaaggcaggtggatcacgaggtcaggagttcaagaccagcctggccaagatggtgaaatcccgtctctactaaaactacaaaaattagccgggcgtggtggtgggcgcctgtaatcccagttactcaggaggatgaggcaggagaattgcttgaacccaggaggcagaggttgcagtgagccaagatcatgcctctgcactccagcctgggtgacaaagcaagactctgtctcgaaaaaaaataaataaataaaaattaaaataaaaaaaaaagagagaaaacaaaaagaacaagctatggagaggtccccatctagactctgaatcaagagtccagagagacagccctgtggagtgcttgagagcactcctactccagctgcccttggggccatgtcacaaatctgggccagcatccccatcatctcctgagcaccacaccttccttggatgcctgtgaccatcactcgtatcaggtcttgtcacctcctgaccaaagcatggccatcagggactgtgtgggtgtccaagcttctgtccatgcggccctggtagtcattggtgggtgtcccttctcaaaagtgagaacacagggtgctgggtaacctatggtgtctttttgccttgacagccccacgccgacacttactcccgtggtcctgtagactggagggatcctcagaagtgggcttaccgagatctaagcagccgaggatcccaacgacaagtcccatcacgtggtacagaggcaggaccgtgtaaaccacatcatcagctgtggccccagataaggacagcatcttgctcatctgcagtacccgctcatgcgtgaggatggctggcttcgggaggccttgggatgaaggcatggcaagggcagggtggtgacatgacagcacagagaggggcctgaccagagggatagatctccaacagccaggcctacattggggtttgaggctctcagagaacagtcaagtatagggatttgtggttgggttcacaggctgaatttggactgaaagtaatatgtcaagatcaaaggtttcagtggctgtttactggacacaggaagaattctggcattgacctctcaaattacattgggggtcagagttcaggccaaatatcaaaatcaagtctgggagcagtggctcacgcctgtaatcccagcattttgagaggctgagttgggcaggtcccctgaggtcaggggttagagaccagcctggctaacttggggaaaccctgtctctaccaaaaatacaaaaattagctgggcatagtggtgtgtgcctgtaatcccagctactcaggaggctgaggcaagagaattgcttgaacccaggaggtggaggttgcagtgagccgagattgcaccactgcagtccagcctaggcgacagagcgagactctgcctcgaaaaaaaaaacagccaaacaaaaaacaaatgtcaaaatcagagggtaaagtggtttcagaggtcaacactgagtcacaagtcaagtgtggggtcaggtcagcctgagagttcagaggctggtgctagggctaatgggcaccctcaccagtggtccccgaggtatagatgaagagggcagggcttctccatgtgatcccagcacgcaggtcagcaggcactgggtgggagggcgctgcatccagggcagcccccagagcccccacccctggtgtaggggaggtatggctgaggtagaagcagcggatgttctcagcctgcagcttgggaaggatctcctccaggctctcccggaggtctgcagagatgggtcagaggagaaacagaggcaaggctcacctttgaggttgcgaggcgggatctgagacccacagatgcaggcagaggagcagctagtagagaaaagcatccatgttgtttggtaaagaatcccatcattagtatttttggtcaaattgtgggaaaattaaactctgatgacctgagaactactttctgctcataagtcttgattataattgcctgtgaaagtaggcaggtggggaccaagggcctctgccagtcccagcagaacccctgtcctatagtccctgcccttgcccccttccattctccactggctccaaggccctcacctgggtccaccaccagcacccgggccccagagctcagcacagagtgcgccaggggcatcccccggccatgcgggttgatccaggctgttgggcagcccagcttggccagccccagccacatacacagggctggaacggcctgggaagccagcacaaggagggcagtaggctccccggcacacaggctcgcagggtcacccagctcagccttcagggcccatgccgcctggcaggcccgggcatccagctcaccaaaggtgactgagccggccccaggccccgtccacaccaagagtgccctgccaggctgcgctcgtgctcgccgctcgaaggcatctacaaaggtgtcaggcggctgccggctcaagcatcccctgatcttcaggcccaggtggaggatcttggccaagaagatcacatcagccggcagccagcgtagtcctgggggcagccgtgctggcaggagggttagtgccagggccgcagctgccaggctcagcccatggggcacccaggggccgagccagggccgtgctaacatggccagcccaagtagcacgcaacatgtgggatcccccaggagccagcgcagggtcaaggccacagcgactggccacactggctgccccaggccccagagcaggagcagcagcagcagcagcaaggccaactgttgcctgacacccatggtaccagctcctccctaggagcagcagctgtggagtgttcaggctcacctctggcccctcaagagtagcccaatggctcctccccaggggtggtggccctggcactgct

SEQ ID NO: 2045 - DNA, 184002 bp, Homo sapiens
atatacattactcgatttttatgcttactttcttttacatttcaaccatataattaatttttccatgagacagggtaggacacataatcttcttggatacattactgtttattgtttcaagtggatggaatatataaatcccactgagtagtttagtgtggccttgtatcttttataaacaggttaaatggagactttacactgtaatctgtgtatttatctgtctaccataaattgtcttcgtgacaaatgcagaatttcttttattacttggctcaaattaactgttgatccttttcactgataatatacaagggtaaaaaagcaggaagcctttaaaattgaaaaaagaaataagatattttccactaaattactgaaaattgaaatttttatgttgactgttgatgactgaaaagccaatgttaagaatcaatatcatccaatataaaatagtacattgaattatttaataaacagaatattaagagcttgtatatgctgactgggaacagtggtggctttttaaattctcagaaagtttaaacattttataattagaagaaaccactggtgatgatgaagatggtccatctctgtagcagccattacagtgaaaatcttgacagaaccttttcactatcagaaagataattttactggtattagtggtaaaggtaaggagagaaaaaggagtgaggagataagtctgtattagttttaaaagtgagaaaaggtaataaaacaacatggaaaagccagaaatttcttcttctatatgtgccttgctacaaataaaccaaaaagaaagcaagatgggtattttaaaagccaatgtggggaaacatccaatgataatgcccattattttactttatacttaaattacaccagtagaaaagttatgcttattaatagtttaatgtatgaaggaaacatccagatttctgaatatgaaggtacatatctcacattaatttaagtctacataaagtagagcctctatactgacatattgaaatttactttctgcttagccttttctgttatgtaaacaattgtacatttatttgccattctaaaacttcaggatcaagtttacataattttgctaaatttccgtgtttgctcagaagcagtttacagtactaaaaccaaccagccaaagaacagcttcaacagaaagttatgtccaaaggggaagagggaaagaaaaaaagaaaaatgataagaaaaatgctaactaaggtaaaacggatgatgatggggaatgggcagtcacaaatgttcacagaaaataggtcagttagtaagatcttctgcaaaaagcctacacacttcagtcaagcacatcagtagaatgatttgggagcataattttttttttcggccacttgtgatttcctccaaatgaaaaggaatctgcaggctaacaagctgatcctcatcagccaagctggttcatatgcacactgttcatgtgaggtgcccagggtccagtccacacctatgaatatagagcatgcattttacaaaatatatatctagcatatattttattaaaataaaacttttaaaaaactaaggaggtactcttcaatttgcaatatactaggaactaatggaaaaaaatgataaaaaccttttttctattattttcctacctcttatccctcaaacagaatctgatttacaacctttaaaaaaaaaatcattacctgagcatttatagattcacggttgtggaagaaaaataaatcaaagatattaaacatacactaaactaaaatatacaaccatttatgtgaattctcagagttatttatagtacctttaataaataacctttagatggtcttttcacaccactagtaaactttaatgtataaaatcatatgacagtcactttgcaacttaaaatctttcatttattatctgctacccagtagaatatacaatacctttcataattttagccccaaacctgcctttggtaccactgcccacagccctctgctatattgcagctatattagatttcctcaactgcccatattcaccaaactctcttgctatcatgagttacctgaatcctatttgtctttgcatttcttaaacacaaaacaactgtttattcactgaatgatcagcctcaccgtttgagggccattattttccgtggagctggaaaccatctttatcagtgagttccaagaagggtctgcagcatgagggccattaaatatgggtcctccagcaccatcagggataggtgctactggaggaatcattgcattcccatacacagaaaaaggcatacccttaaaaaaggaaaacacacacattaacatccaagtcattgttcatttttcccaatataatcaatagccttaaaattgatatttgaaagttcacctcatcctgggaatgtgtaacttatctaagaaatctaaaaattattacccattatataacttattttaacattagattatacatatgcctactatattcaaaacattttctcagaaaatcctcccttaaataactagtacaaaatcaggactttaccccaactttaggaaagtccatgtagcctgcaggaacatgctgatggaatgtaccagaaggagttacaattcctgtactatctcgctccattgcttgatgttgtgaaaatactcctgggtcagacatcggtctgtggatcataggatttcccatcccagggttacaccagtctactttgtctgagggcaaacaaagaggcaaaacaaaaatagataatatttaaaatcaaaatcaaatattttgtttttctaatattttccacattgaaccgtaaattatttcaatataatgacctacttttatatatttacagcaatatttccatggtttgtaagtagtgacataatagcttaatgaaataatctaaaaacttggtgttataaaacaaaagaaaaaaacctaagtacaacctaaagggactgaaaggaaatattattatgtccttaatatgatgaaaggaagaaaagaacatgcttgcattagatattttctgaaagcagtaataaatacatgtaatgagaaaggtcacatggggacagagctcataaagaagtgattaaatattcacataacaaaaaaaataggaatacagatcttttagaaatgactacgaggctgggcgtggtggctcatgcctgtaatgccagcactttgggaggctgaggtgggtgagtcacttgaagtcaggagtttgataccagcctgatcaacatggtgaaaccctgtctctactaaaaatacaggcggggcacagtggctcacgcctgtaatcccagcactttgggagaccgaggcgggcggatcacaaggtcaggagatcgtgaccatcctggctaacacggtgaaaccccgtctctactaaaaatacaaaaattagccgggcgtggtggcgggcgcctgtagtctcagctacttgggaggatgaggcaggagaatggcatgaacccgggaggcggagcttgcagtgagcagagattgtgccgctgcagtccggcctgggttacagagcgagactccgtctcaaaaaaaaaaaattagctgggcatggtggcgcatgcctgtaatcccagctacttgggaggctgtggcaggagaatcgcttgaaccggggaggtggaggttgcagtgaaccaagatcaccccattgcactccagcctgagcaacaagtgaaactccatctcaaaaaaagaaaaaaaaaaaggaaatgactattaaagttaaatactgtttacattatagttaaatgcattaagttaatttctagagagcaggacagaatatcctaccttgattgccaccaatcccttcaaaggaccagatgccactatgtcctactgatgtagacaaattgctcccaataacagatggagctgacgttccagtttgcctgatacgtgcagaacgttcagtcccaatagggactggaactttcctgtcctgagacacattgctgggcttttctgaccctaacggtactgatgatggggcaggagatggtgcacgaactcccgaggatactgactgtgcagaagaatctagagaagagatattttgaaataaaatacaggtcatctatagaacatgtaattttataaaaccaaatcttaaaaccaggagatgttttaaatatatattctcagaaaaacaaagtgtaaaaataatacttaaaaatgatgcatattaaaatttggctaaagttccatgacttcaaggtagaatatgatgtcaatgctgcaaaatgttcaactacaaaggtaataaaccattaaattaaataatattcaaatgaattaacccttgacattaagtaaaatgtagcaagcaataagacatttaaattaaaaaacaaaccaacaacaacagaatggagatgggtaagaatcactgcctgtagtggcaatctccaaactgtattccctgggaatacttgctctttgtgttatgatgaaaaagagattcagctatctaataaatttggaaaacctagcctaggaaaaagaaatacgtttctttgttatttattcattttttatttattttatttatgtatttttggagacagagtcttgctccattgtccaggctagagtgcagaggctcgatcataactcactgcagcctcaaactcttgggctcaagcgatcctcccaccccaacctcctgaacagctgggactactgggatgagccatcatgtccagtttaaaaaaaaaaagtttcttcaaattagaactgaagtttatagaacattatatatactgataaaataccaataagaggatcattgcctaagtctgttttattttatcttgtgagtacttcacagaacatgcttttggtaatgagaatcttttttacttatgcaaacaaggtggatttcttgatttgagactattcattagtgattcaatctctatacattattgagaaaaaacaaaaataaccaaaattatattttatgtgaaaagcttaaatattggccgggcgcggtggcacacacctgtaatcacagcactttgggaggccaaggcgggcggatcatgggatcaggagttcgaggggccaatatggtgataccctgtctctactaaaaatacaaaaattagccgggcgtggtggcacgcgcctgtagtcccagctactcaggaggctgaggcagacgaatcacttgaacccgggaggcggaggatgcagtgagccgagatcgtgtcactgcactccagcctgggtgacagagcaagatgactccatcccccctccccctcccaaaaaagcttaaatattaaagcacatttaaactaaaatggtataaataataaaggagtctgaagcttaaaaatcaaaactgttacctgcagattcaacagaactgcagttgaattccaaataagcctattatataagataaaagagaaagacctatagcattcctgttgacaataaaagcactccagaaaaaaagctataacctaaaattcaaaaatgaacgaaaagaaaatgatatgaaggaacagcataattcagaattagtaaaacggaaacaatatgacaaaactcaggaaagtgttagaagtaaaagaatattttagctaaagaccaaataaaaccaaattctgcaattatacatgcagtagaaaacagacaaaaactacaaggaatacacagacatgtaaatgtaaacacaaagataaataacaaaagcttgttttttaaaaacctacatattgaaaggccacacctaaacctctaggaaaaatcaacccagaacaactaacatcaagacatagtcagggcaggcaggcaggaaggaaagaaggataaacaaatgaatcctgctttcccctaggttcatccctgggagcctaccttaacctctgtgttcactctggtttcccttttatttcctgtatccttctagaaccaaagtagagcaaaataacaacaaccttccacattgttttgttttttatgagacggtctcactatgatgcccacactgaagtacagtgactattcacaggcacaatcacagtgcactgcagcctcaaactcctggcctcaagccatcctcccacctcagcctcctacacattctattttaataaacagaattactaggcttgcccgctgagctgcgccatttaagaagtttactctctgcacagattctgccacccctctagtcatagtttttatcagatgaccctgttttctgctccctctctgcacaactattggattaaggataggcacccatccaagttttattttaggctagtcagtaatctgactgaaatggtctgacttgaacatatgagctgagccaatcacattcctcatcaaagaatggggaattaaagggttaactggtttaattaattatgaagttgaaccactgatgtgcatatacaaggtaagattatgaagaagtttaggtgtaaagagagcagaatgcaagaaactgacaagaaacagaccatgagtgagagaccacaaatcctctaagagagagagagagagagaatagctatccctaagtcctggacggtttggaaaatggttctgcatagccttatataaacatcattttccatgagagtccctggatgggcctatattccttttcatgaaaagaacctaactaaaataattttcacatctctaattattataattacttcaattagaaaaaaagcaaaatttaattcagagccatgttatttaaaaacatcagcttatatattagagaaacaggtttcagaggatggggcagatctaggttttgtggggccttaaacttacaaaattttgggaaccttttttagaagaatgaaaaattacaaataaaaaaatcatgtacagcacttggaagtaccccataaaatgaagtggcctaaggatttaagtttcactgataccacggtaacttcaccacagtttagaaatgataacagagtcctgagttaaaattgaaagagcaatgtgatttacaaattcaaaaagtggggccactgggtgtggtggctcacacctgcaatcccaacactttgggaggcccaggtgggcagatcacttgaggccaggagtttgagatcaggctgggcaacgtggtaaaacctcatctctacaaaaaaaaatttaacaaattagccaagcatggtggtgcacacctgtagtcccagctacttgagaagctgaggcaggaagattgcttgagcccagaaggtggaggttacagtgagccaagattgtgccactacattccagcctgggcaacagagagatacattatctttttatttaaaaaaaaaaaaaaaaaaaggggggccaagcgtggtggctcacatctgtaatctcagcatctctgcattttgggaggctaaagtgggaggatctctggagatcaggagttcaagtccagtctgggcaacatggtaagacctcatcttacaaaaaataaatacataaaaataaaataaaaacattagctgggtgctatggcaagtgcctgtagtcccagctacttgggaggctgaggcaagaggactgcttgagcctaggagtttgattgaggctgcagtaagctatggtcacacactgctgcattccagcctgggtgacagagacagaactcgtgagaagaaaaggagaggagagaggagagaacaaaaagtgcttctacagtaaaattacatgaaaagaaaggagaagaacaaaaagtgctcctacagtaaaattacactgcacatttctcacagtttagttcagtgtttattaaacataccctgaatttaatcaggaagaaatagtaggaaataaaaataaaaggcattctagcaaacaactggcttgtagtcttcataaaatgaatctttctttgaaagttaaagaaagactcagagaacagttctagattatttgagactaaagagatatgggaattaagtgtaacttgcagtcctaattagaatcttggatgagagaaaataataaagttattgagataactgatgaaatgtaaatatgcaccatatattagataataatataaaatgtaaagtttgctgaatttaaacactgcatcatagttgttgaagggaacattcttatatttaggaaactaagttatttaggggcaaaagggcttgacgtctacaactaactgtaaaatagttcaggaataaaataattttacacacacacagaggaatatatgatgaggaaaggaagtaatgcagtttaattggtgaatctgggaaaaatatacaagggatccttgtggtattcttgaaagtttaaaattattaattacaaaatctgagagacataatcaaatgcaatatgtgagccttgagtggtagttcctggttcaagaaagaaacatctataaaaaacgttttggaataattgaagatatctgaatatggactgattaattcttactgaattcatgttaacctattaggtatttgacaatggtatcatggttgcataagaaaatatccttattcttaagtgatgcatgtttttaggtctgaagtgtcatatctgcaccttatttacaaatggttcagcaaaacagtagagagagaaaataaatataacaaaataattgggaaatttaggcgaaggaaatatggatattccttgaactattctttaacttttctatgggtctgaaattttttgtaacaaaatagttactggaatgtggcaacaataaaagcaattgtaatgccctcaatgatactctgtatttacaatatagcactatattcaaaagcatgtattaaaaaacctaacctgggtggtgtggtggtacacgcctgtaattccagcactttgggagctgtgcaaggataattaatattctatatgactgccactatttgacaaacacaagaaaaactatgaatatataaattcattgcaggctacaatttacctcatgctttaactggcaatgtactctgacatgtatctctaaaataattataactctttactctttcattaagttaattaggttaactgttatttattccagtattgctagttagaagaaatttgatagttaaaaaaaaaaacaaaacaaaaaaaaaaaaaccgaagtcttactataacttccttaagggataagcaatttcacatctttacctggaaaacaaacatatccaaccttactacagaattctcttagttgagttgaattctctattgctgactgatcttcattagtttgaaaatctaggcctggtggctcacacctgtaatcccagcagtttgggaagccgaggtgggcagatcatgagatcaggagtttgagaccagcctggccaatgtagtgaaactgtctctactaaaaatacaaaaattagccaggtgtggtagcacatgcctgtagtcccatttattcaggaggctgaggtgggagaatcgcttgagccattgcactacagcctgggtgacagagtgagactccatttcaaataaaaaaaagaaagaaagaaaatctaatcactgcttcaaaagtctgcctgtagttaaaaaacacatgtgataatgtgaaatctgttgtgttgttaatgcagatgagatttttttttttttttgagatgaagtcttgctctgttgcccaggctggagtgcagtggtgtgatctcggctcactgcaacctccgcctcctgggttcaagcaattctcctgcctcagcctcccaagtagctgggatcacaggtgcacaccacaacgcctggctaatttttgtatttttagtagaggcagggttttgccatgttggccgagctggtcttgaactcctgacctcaggtgatccacccgccttggcctaccaaagtgctaggattacaggtgtatgccactgtgcccagcctagatgagatttaaaggtggactaaaaggatgtaattttcactcaagggtagaaatctttctccttggtacctgtattctcaaaactaaaagtaaacataaattaataacaggtacaaggattaatttttttcccccaaaaaatgatccctcaggacaggtgtggtggctcacacctgtaatcccagctctttggaaggcaggaagactgcttcagcccaggagtttgacgaaaccagcgagggcaacacagtgagagcctgtctctaataaaaataaaaaataataaaaatccctcttagaaaaacttcaatattttaggtttgatagaacctaggttgattctaatcatttaaatacctagaaatttttttgaaattccagacttctaagagtacaaattacctttttatggtattaaaattatgatgaggtttgaaacctgctgtttttaagaaaacatatgcagattcttatggaattacggtgtataaaactcaccatttgatgctgatgaacacggagtcaacaaactaagcggggaaaaatgttgtctgttaaagttagcagctgcgggtgctcctccaaggggtgccccaggtccgtacatctgacctcctgaaatgtttgaagcaaagtttcccaaatgtgttgaagaaggtgttacagaaccatatggcgagtccatattgacaatacctataatgtagaaggtcatcataatttataatagttactcctgcaagaaatagagataccttaaaattctaaaaggccctaaatatattcaaaactattttagataattaaaaaaatcccggctgggagtggtggcccacatctgtaatcccagcactttgggaggccaaggtgggaggactgcttatggccaggcattcaagactggtctgggcaacacatcgagaccccacctcaaaaaaaaaaaaaaaaagttcctggctgggtgtggtggttcatgcctataatcccaggcatgaatctcactttggggggccaaagtgagaggactgcttgaacccagagttcaaggccaggatagactgcctctacaaaaaattaaaaaaaaaaaaaaattagccaagtttggtggtgcgtgtttgtagttccagttacttgggaggctgaggtgggaggattgcttgagcccaggaggttaaggctgcaatgagctgtgatggcaccactgcatgccagcctgagtgacagagtgagaccctgtctcacacacacaaaaaactaaactatgtagataattataaaagaaacaattatcacattatactcttaaattcaaattataatttactgggaacaaatttaattcttgattttagtactttcagcactagtgggcattaatgttttagttaaaaaggatcattagttttcctttacatgggctttctgtcaaagtggacttttgttgcctttattgatcataaaattaatgcaaacttatttaaaaaatccaaaaccaaaaaccatatataaaacagaaagtgaaacttccagatgttcctatttcaaaaacgaatgtatgtgtatttgtgagagagaaaaagaagaggaagaataaacgtttacctttagggatttttagataacatttttttttaaatgtttatttttagggataaagataaaacatttactcttcctcttctttttctctcttacaggtacacatttgtttttgaaatatgttcattaaaaaagtattacaaatgtttacacactaaactattacacaagtaacctatctgattttagtctaacgggttaaaaatacagaaaaaaaagaaagaaaataattgtcaacgatttttttttttaatttaggagacagctttctctgttgctcagggtggaatgcagtggcatgtgatcatagctcacggtagccacaaactcttgggctcaagcaaccctcttgcctcagcctcctgagtatctggggctacaggtgttcaccattacacctagctatatttttgttttaccttttattagcttttatagaacacatgtcaatattggattttatgcttgaacctgggaggcggaggttgcagtgagcctagattgtgccactgcactccagcctgggcgtccgagtgagactccatctcaaaaaaaaaaaaaaaaaaaaaaatatatatatatatatatatatatatatatatatctgtaggattttaaataggtttaaggaccaaagagttgtataaaactacagggcaaaaaagggctgtagatacaattctacaatgaagagatctgataattacatactaaccacacggccatgctttccacagccaatactggaacaatttatcattttttctttttttttaaggagacaggagattgctctgttgctcatagctcaccccagcctccatctactgggctcaagtgatcctcctgcctcagcctcccaagtaggtgggattacaggtacatgccaccacacccagcttttttatttatttttgtagaggcaaggtctcacaatgttgcccaggcaggtcttaaatttctggcctcaaatgagcctcttgtctcagtctcccaaagtgttgggattacaagtgtgagccaccacatccagccaatctgtcattgataaaatgcagtgtgaggttcaaaacatcacctatatgatgctccttcctgaaatatttgatctgaatctaatcatggattgacataatcactgaattaaacttgcccacagagtcaatgtcaagaattacagaggaaggcagtagaatactttagacagagggagaccaaagacacataacaaccaaaagtaatgtgtgaatcttgattgagtcttggatcaaatggcaaggaaaagagacacacatagtcagaaagaatatatttgggaaaatggcattttatgttgggtgttattatcaaattcatcctcattttattgggtgcagtaatagtggcatagctgtgaaggcaaacattgtgaagatccatatcaaagtatttaggggtaaagtatcatgtttgaaagttatcttctcatgatttgacaaaagatggggaagaaaagaaaatagagataggatagaaagggggaaaaggaggaaagaaggatgaagaaggggagagacaggtaagacaagacaagagagggggaagaaaaggaagcagcaaaagagaggaaaaaaaaggagggaagaaggaaaaggggagagaggaagggaggggagtgagggagagagtttgaaaagatgttaacaagcagagaatatattaataaatgtggaaataccaagtatttactatgctgcttattctgtccttagatctttatgtgacttaaataacttttcaaaatacaaactataaaaacagatctgagtctaaaatacaaataatcaaattatttacataagaaaagttaaacaaaggaagaaaaatatggaacacaaaatgaattaggaagaagtagagagaagtgaaaattaggatctgagagaggtttaggagaaaataaaaggacatacttcctatgtaataaaaggagtatctttaactcaaaatgacctgaattaggtaattgacttgtaagttaaacttcaatgctaattttggctctcatcaactatacactccctaaaaacctcacctttcttacagaggtctttcttctataccttttcaaaaaataggaatttatttttttgttctctaaagcttaattttagcctttctgaatcccacacctagattatcacatttttggaaaggtaaagtattaaattccaactactataaaaatcaaacttaaagcatttcctacgcactggcacataatgatctaaaatctaattatattgattctattgttttaatataaaataaattatttttcatagtacacataaatatttcagttgacttttagcaaagaatatttactgaccaccttcattaaattttatttacatgttacagaaataggtaaaaataacattgagttcccattaaacttggaaatttttgtcccggaatgtcatatttccaataacacagataacgagttggcaaccaagagccaaataccaaatattttaggctttgcaggtcacatggtctctgtcccagctactcaattctgtcattgtagcataaaagtagccttatacaatatgcaaatgaatgggcattgctgtgtttcagtaaagctttctctacaaacactgaaattaaaatttcatattttgtgttgcatgtttattctttttaaatttttttttttttttttgagacagggtctccacccaggctggaatgcagaggtgtgatctcagctcactgtaacatctgcctctagggctcaagtcatccttccacctcagccccccaagtagctgggactacaggtatgcaccaccatgcccagctaatttttatatttttgtagagatggggtctccccttaagcccaggctggtctggaactcctgggcttaagcaatcgacccacctcagcctcccaaagtgctgggattacgggcacaagccaccgtgccaagcctattcttaaaaaaaaaaatttttttttaaacatttaagaaatgtaaaaacaggcagcaggccaaatttggcccatagaccatagtgtgtccatctcttacgtggactatctttaattacttgaaatgcttatattaaaacccaacagctttaaatggaaactggcatcctggattagatcctacaatagaaaaaggatattacttgaaaaacttgtgaaatctgcctaaaatctgtagtctagttagtagtactacaccaatattaatttttttagtttcgaaatgtatcatggttatgtaagatggtcacatgaagggaagctgaggaattatagaattcttctataaatctaaaaatattttaaagtaaaaagttttttttaaaaaagcaatagcttacaatcaggagatctttgtatcttctacatatatcagtgttgcccagtagaattttggataatagaaatgttctagatctttgctgtccaatatggtagctaccagccacaagtgttttttaagcacttaaatatgggtagcctaagaagctaatttttttatttttaaaattttcattaatttaaatttaaaaagtacacatggttattggctaccatatcagactgtgtagctctatttttaaaattattttagaaataaaaaagataatgcgaaatgaaacccaattttttaaatctgttattttgtatttgtaataaatgtaaacttttggtgacagtaccttattaaattaaaacatgaaagacttctgagagagaaaaacacgcctaggccaggaactgtggctcacgcctgtaatcctagcactttgggaggccaaggtgggtgaatcacctgaggttgagagttcgagaccagcttggtcaacatggtgaaaccccatctctactaaaaatacaaaaatcagccaggcatggtggtgcacgtctgtaatcccagctactcgggaggctgaggcaggagaatcacttgaatctgggaggcagaggttgcggtgagctgagatcatgccactgcactccagcctgggtgacagagcgagactctgtctcaaaaagcaaacaaacaaaaaaaccccgcctgatcagaagacttatttatggaaaattaaataaaaatctatggtagcttttaaaaagatttttaaaaataacaccatactaaacacaaacaacagcatctgagttaactaaatccaacaatctttgtctatatcgtccagagaataaaaatattagaaaatgaccaagaattttcacatcacttgtgcaaatgaacagctgcagaatctcagaaaatataaactcacctgagggacttggagcaggtctctgtaatggtggtctaaaacctggagctttggaagtatcagactgatgtaaaggatctgaatttggcaaatatgaggattttcctgatagcatagattctggtgttgactgagatgaaacaacagatcctccccagaaggcatgagcagaagtagggctgttttcaaacaatgtgctaaagggcccaaatggtaagggggcactgaaattgggagcaataggcttatttgctggatgtactgaattctgacaagcactttgtgtacttaaggtcgaaggtagctggacagaagagggaacactgtgaggtcttttaatgtgattgacactgaggactgcaacagatgaattttgcactgaagctgaattcttgtgaggggcagttgtgccatgagggggtggtctaatagcaggggtttccattttaggagtaggctgggggcatcccattggtgtctgaggcatagggtaagtcactggggcagtagaaggcaccgccactggagcagaacttgttgctaaaggaggaacagtcattctaacttccgggggaggaacctgagactgctgaagaggtggtcttggttcctgagaaacagatcccggaggttgttgctgattagaatgagctgatgaactcccagaagaactgctgctgtttggaggtctagtgtttgttgtttctactactggtggactacctgcttcctgttcggaggaagatgccactttatttggagatgctgatccacaatccaaagggctgtttctagaaacccctcctggctgggctggtggtgatggggaagatggggatgatactggatagtgttctttggcagtaggcataggatatgtggcatttgtgggtgcagtgttgttgttgcttgccgtggttgtgactgttgttgtggtggcattggatgtcttcacaactgtgacaaaaagctgccttcggacagaaggtgaacttggactgccatttgtagatgtaccaggcaccgttgaagctgatgaactggttgtagttgttgggcttgaagttaaagaacctgctgaattcacctgagaaccactgctattctgattgctatggcgaggcaccatgtgaggcttaggcgagttagtagctctggcagggctcaaaggcctgacaggaaacggaccccaagtggattgagctggtggaaaagtacctccaaagtgggtcatgggcaaccttggtggacggatctgctggaaagtctgagcagcaagcaaagcatgtgcaaactgtggaggaggatatgctaatggaagagaaactggaaaaccaggcctcacattattcactgggttcttaatggttttgtgagtggatgcagaagaaattgcaggcacagtgagtgctgtggcagtttgagatgttgatgacagagctacagttgtcattttaattcccattaaggaagtgttagcagcagtggtggtaggtgctgatgaccctattttggaatttgctgaggagcttttcaaacgattctttggaataagttcatcaatttctttgtctggatccttgatcaaagcattaatcaattgagttgcttgtcttgttgattcagtgccacccctataaattgagaaaaaaaaattaggtagaattttccctacttttgagtatgtaaagtgtttttaatatgtatttatgtacacaaacacacacacagttttgtgtgtatatacatacacacatacaaacaaaggacagataacaaaagctgggcagcaattttcttaccattcctgaggtattctacaaacaaagcaataaactgtcctgaattactacttttatttttcagaagaatagtaaatgacttatttttcaaaaatacatttcactattgtttccttagactaagaaaccattttcctactgtaaaatacactacagttagaaaaaccactgcacataaaagcctatgtaatccacaatgttattgaaacatttaatcctaaaaatattgaaacagttaatcaacactaaaaataatagaagtaaacaaggaaaataatacaactgagtaagaaaacagtattttattttaaatcttggtatctgggatgactccgtctactaaaaattcattagtagtttgtctattaataggataattattgtaactcctctgggaagatgtcttaaaatgatgcaggaatcctgatagtgccaaaaatagccatataaaaccttagtgctggatcttcaggaaaatatttgatatttatggaaactcaagggagcaattaccaataaagggtatctggttccctcttttctagataagataggctgtgactacccaaatacccaggggaaaaccagtcagaaggagaggacgatgaataaaatagagatggctacttgctttcttatttttgaggtatgatgtaactattagctctcctatataatgcaaaggggcatctgcctcatacaaacttatatctgccatgtaaaaaatataaaactctttttcaaaggaacatgaatttactttaaagtaattaaatatagcttcctacattcttatgatttcttagaacatcacttttattttaagaatattcaggcatagacatattcgacgagttattcaagataagttatatcttcacttcagattcaaatctgaactcaaattcttttttttttttttttttttgagggagtttcactcttgttgcccaggctggagtccaatggctcgatctcggctcaccgcaacctctgcctcccaggttcaagcaattctcctgcctcagcctcccgagtagctgagattacaagcatgcaccactatgcccggctaattttgtatttttagtagagacggggtttccccatgttgaggctggtctcgaactcctgacctcaggtgatccgcccgcctcagcctcccaaagtgctgggattacaggcgtgagccaccgtgcccagcccaagaactcaaattctaaagacacaatctcagaataacaaatctcaaaggttatttgagaaagacaaaaacccactgcttaaaatgttagaaatgcgctccctaaaagtctcagaacaaatttttaagaatgtcatataaacagtttatgtacagaaattatttatttaaacctttgctacacatgcatacaaattcctataaaagtctctgaaacacttcacaaaagtgtattacctaggaaaaaagaaaactataaaatttatcttctcaaacactaataaaattcccattttaaaaagtatactatgtaacacaaagttccactgaaaactcatatggctgtatttcattaagctatagtgcaataaaataaaggaagaaaatgtaagagacaaagttttgccttatagtgattatccggtctccagtcttgtctttctgtttatcaatatctatgtgtgcaccagtaaactcccgaatagcattgatattacagcctcctcttccaatcactctggatatcacagttgatggaacagatactttctttgacctgtttaaaagttgtatatataaattaagattagtcattaacaatagttattgtaatttttaaaagaggaaagagtattactaaaatgtctttctataaatacagaatattgttgaataagcctcttctatttactcttactctagatgaacagagaaaaggcaatcaggagcaacagacagataagctttattatagcttctcatctcactatcaaagattgtttgctttgttgattatcattcttcacttgtatcggtaaagcacatactatgtagacacgtgctgtgctaatgcaaatactaacggtaaataagacagacatgggtttctgcccacatatattgactatctacacgctaattatgaaaacaccaccatgtcatgagtgttgcaatagtatgtgtgtacacacacacaaatgtattatatatacatatatgtatatatagacatatatatgtatatacgtataatatatacatgtatatatgtgtatatatatatattatatgtgtgtgtgtatatatactggttgggcatctaatctagcctcaagagtcaagaaagacttcttgtgggccccttttggtgctttactcatatgcttctttttattctctaatatacataactcaaagagtgatgttaaaaattcatgactgggagtggtggctcatgcctgtaatcccagcactttgggaggccaaggcaggcagatcactttatgtcaggagttcgagaccagcctggccaacatagtgaaatcctgtctctactgaaaaaaatacaaaaattagccaggcatggtggtgtgcacctgtaatcccagctactcaggaggctgaggcaggagaatcacttgaatccgggagatggaggttgctgtggactgagattgcaccactgcactccagcctgggtgacagagtgaaactccttctcaggaaaaaagaaaaaatattcattacttccctgtattcttatagtagcattaaaatgaccatccacaaatatgaaaactttctaaaaatctttaataatgtccggaaaaagaaaatcctactagaatttaaaaagcaaaatctgaggccgggcacggtggctcacgcctgtaatcccagcactttgggaagccaaggtgggtggtccacctgaggtcaggagttcaagaccagcctggccaacatggtgaaatctcatctctactaaaaatacaaaaaattacccgggcatggtggcatgcacctgtaatcccagctactcgggaggcagaggcaggagaatcacttcaacctgggaggcagaggttgcagcaagccgagatcacgccattgcattctagcctgggcaacaagagtaaaactccatctcaaaaaaaaaaaaaaaaaagcaatatccatctaatacttgcaaaattacattttaattttaaacattcagatatagattatagatttcctttattattattttttttttgacagagtctcgttctgtacccaggctggaatgcagtggtgtgatcatagctcactgcagcctcaaactcctgggcataagcaatcctcccacctttcccaagtagctgagattacaagcacaaaccacatgcccagctaattttttaattttgtttttagcagagatggggtcttgctatgttgcccaggctggtcttgaactcatagtctcaagtgatcctcttgtcttggcctcccaaaatgctgggattatagacatgagccacaggtgtcaggcccgaattcctgataagctgattaaacaatatttctaaaagaaatacagtataaagttctcaataaagagaagcagtcaagtatagttcaataaacaagcaaattatttattgagaatggttaagtattaaaaattgtcatattttctaaaaggaagggcatgatccctgttctctatatatacaactaagttacctaacaactctttttaacctaaagagcatgataatcagccagtgatcatcatttccaaactgtataacacagtattaaatgcatatacaaaaaccaaattatcttattagtgtatagagaatattctgatgatgtgatttcaattaatccaatagagtgtgtatgtgaaggagtgaaagaaagaatgtgtgtatagtgtgtgaaaatagagacagaaataaacataggtatgacggggacaagatttggtctaaaatacggaggaaataagccaaaaacctgtatactgcacttagggattaacagtagttactaagtttggttcactatagcttttgtttcagataaccaaaagtttaaatttttacgaaatttccggaaagttctttaaaataagttatcaaagagtgacaatggatcacattctttctggatttcaggtgtcttacctccttttacgtttctgagatattgtatttttactcttggatacatattatttttaaaatcccatgcaaaacaaaatatttttatcctgaaacccttaaaataaagttatcttatgatttaaagacaacagttactatgattagatcaacagtttaacatcaatacctactaattcatcaaatgtttacaagtagcttttataatacttctttgtattatataaggctttgagataacgaagctgagaaagacacaatctaaaatagttctcaaagcaaactccaatacttttgaggggccaaattaacacgtaatttttttcatctaaaatatggcacaggctctctctgttggtcaaatttagccttgaaccatcagtttgtttgcaacctttagaagagtaggaggaatttaattataaggtagataacacttgactgtgatatatagcacataaaaagaatgacaaaaacaattactcaccttcttacaacttctttccatccttcttccctcttttgcccacgcttaggacttgctactgttaacttcccatttggagaagaaaggggagatggaccagattttgtacaagtagatagagaattactggtcccttcactgatagtttctgacaatctttaacaaagagagggaaagtacattaaatatggaacagatgtagaatttttaaatgataaaggtagtctactacccaatttttaaaaatttatttttaaataacaaatgacgaccttatttttcacttctcctcatatttagcatataatatagagagcctttttttttttttctttttgagacaggtcttgctctgttacccaggctggagcgcaacagtgcaatcacagctcactgcagccttgagctctcgggttcaggtgatccttctgcctcagcctcctgagtagctgggaccacaggtgcatgccatcacattggctaattaaaaaaaaaaattatttgtagagacagggtctccctatgttgtccaggctggtgttgaactcctgggcccaaacaatcctcccactttggcctcccaaagagctattattataagcatgagccattgcacccagcctgaagagccaactttaagaagatactatctagggtacacatttagcagagtttaatcacagtaataatcccttggaaaccacaatccatatttttcatgtgctaagtttaacaaccaaaaaaaaaagaaattacatagtaaaaataatttgatgtctcattatataaaatctaaacaaaagcttattcttcaattcaattgaaacagtaccttctttagcacaaagaaaaatcctattttgcaagttgcaaatttactttctttaccaacaaattcagtaataaggtatttcatgatgacactataaatattgaaaataaaaattggaactaactttattgaagccttgccagaaacagattttctctcttcctttggaaatgtaacaagaactgatggctgctttttgctgctcacagtggtagtgaccacagctggtgaatgattgtcactcttacgactgctgttgctgttactactttcatcgctgcagctggaaatcctcatgttatcactgtccccactctcgctggtactgctgctcttggactctccattcaccttctctggctgactgtatgaaattggtagtggatcatcaaatataatttgaacgttttctggagtaattttatttttcctgtttttcctctttgaactggttgtagttatggtattatttcttttaccatgagaacctgccaaagttgtccaggttgcagatatacctatggtagtagtggttgtggcacttggaggttctgtcaagacttcaggctcatctgtaaaagtagcaatactgaattagcaagttctaagtgttcccagaatgtatttagctataagcacttgaagaaaagaaaaacccaggagagatactctactactattagccatgtaagttattctcacattcatcggtaatgagctggataggactgatatactctgtgtacccacgttctgttcaaagaatagcaggtagttataaaaaatattttggggggcatttctggtgctggcgtggctccaggaaggccattccagccatcaatcttccacctgctccttagagaagggaagatgagtgagtcgagcttgaagtccagccagcccttggcctccaagcaggaaatggacagcactgagaagcggggccggggcaggccccgcaagcagcctctggtgagttccgggacagcactggtagggagtcagaaggagcccagtgaagtgccaacacctaagagaccttggggccaaccaaagggaagcaaaaacaagggagctgccaagacccggaaaaccaccacaactccaggaaggaaaccaaggggcagacccaaaaaactggagaaggaggaagaggagggcatctggcaggagtcctcagaggaggagcagtgaccgtgtgtgctgcctgtgcctcactgaaggagcagcttccttctgggactggacagcttttgctccgctcccaccgcccccgcccctttcccaggctcaccatcaccactgcctccggctgccacccccatccttccacctgcaccctcaccaccacactacacagcacaccagccactgcaggggccccatgggctgagtgggaagcagttttcccctggcctcagttcccagctccccgcaaccacccacacatacacacgtaccctcctggacaatgctaacatcccacttagccacaccctgcacatgctgcatccccactcccttagtagtagcaacactgctctctggtgatgggggcaccctctctgctcctccactgttccctctggcttcccatagtgtggtctgggaggattcccctggccttaaaaggggcccaagccccatctcatcctggcatgccctactccactgccctagcagcaggtgtggccaatggagggggtgctggcgccaggattcccccagccaaactgtgtttgtcactatgtggggttcacacttttcatcctttcccacctcccctagtccctgcactaggttggacagtcccctttggctacaggaaggcaggaggggtgtgagcctcttacttcctcttcactgtggccccagccccgttgccctccacctgggatctgagtacacattgcggtgatggagatgcagtcatttattgtccaggtgaggcccacaagccctgtggctacctgagatgggctggggccgctcccccatacttactttgcttctgccactcagccatttccccctcctcagaaggggcaccaataacaaggagctcaccctgcctgctcccaaccctcctgctcctccctgccccccaaggttctggttccatttttcctctgttcacaaactacctctggacagtggtggtgttttttgttcagtgttccattcttcgacatccgttattgctgccgctaccagcaccaaatgttcatcctcattgcctcctgttctggccacgatcccctcccctaagatactctttgtggggaagaggggctggcacatggcaggctgggtgaccgaccaccccagtcccaaggaaggtggggccctgcccctaggatgctgcagcagagtgagcaagggggcctgaatcgaccataaagggtgtagggaccaccccctccccctgttctgttggggaggggtagccatgatttgttccagcctggggctctccctctggtttcctatttgcagttacttgaataaaaaaaaaaaacatatatatatatatccttttctcggagaaaaaaaaattggggggacagtttggaaaatataagtatgtactgtatattacgtattattatgtaattattaaatttcttaatgtcgttgcagttatgtaaaataatgtcctctttctgggagatacataatcaagtatctgggggtgatttcacatgatatgtatagcttacctcaaacaactcaaaaaaagagaagacacaacccatgtgtgccaaaatgttttaaaaatgtaggtgacatagaggtatttaccatattaatccttaaaattttctgtagtttgaaaattttcaaaataaaatgctggagaagggaaattaaaaacaaaacaaaacaaaacacacacacacatacacacattgcatgcacatatttttggtggtttcatggcaatggttccttcccacaatacagtcagtcctctttatccatagatttaaccaacactagattgaaagtattcaaaaaacaaaacaaaaaacaaatacgaatttaaaaaatacagtataacaactatttacatagcatttgcgttaggtattagaggtaatgtagagatgatttaaagtatatgggagaatgtgcataatttttatgcaaatattacaccatgttatataaagacttgagtatctgaattttggtatccgtgagggtcctggaaaccatcccctgtggatataaagggacaggattactatacttccatcccaaataaccttttgattataacctagttaaaaatgattccttcatttgaagaaatcgatgatctggattgtagatgatattatgaaattaccatttataatacctaaaatggtattatgatgatgtaagcaaatgtcattcttgggatgtgggcttaattatttataggtggctggcgcagtggctcatgcctgtaatcccagtactttgggtggctgaggcaggggggatcacttgagatcaggagttagaggctagcctggccaacatggcaaaaccccatctctactaaaaatacaaaaattagggggacatggtggcacgtccctgtagtcccagctacttgggaggctaaggtgggagaatagcttgaacccgggaaacggaggttgcagtgaaccgagagcataatactgcactccagtctgggcaacagaccaagactcggtctcaaaaaaaaaaaaaaaaaggatttataggcgcaatgtcaggatgtctgcaattctgcaatttacttttagatggctcagaaaaaaatatgtacaagtacttaaagagaaaaataaagcaaatatggtaaaattttaacaattttgtcaatctaggtggaatgtattcaggtattcattttatcatctgtcaacttgtctgtagttttgaaacttttcataataaagttagggaggaattcagtcaacaaaaaaaaagcatatatcttttcttttctcttttttttgatagaaggtcttgctctgtcacccaggctggagtgcagtggtgccagatcatggctcatgacagtctcaacctcccaggctgaagtgatcctcccaccttacctccccatccccccaatccccagtagctagctgggactacaggagtatgctactgtgtccagataattaaaaaaaatttttttcctttttttgtatagacagtctcactttgttgcccaggctggtcttgaactcttagactcaagtgactcgctcaccttgacctgccataaaatgctgggattacgggcgtgagccactgtgcctggcctatgttaaggggttaataacttgaaagcatattttcaagagtgactgataatcaagtaaatataattttaactagaatataaaacaaatgggatggttgttaagagaaaataccttcaactttaagcttttctttttcttgagcagcttggagttcaaagttctctttatttttggcttcaatttcttctagtttccttctttgttcttcctttttcttccttctcttctcttttcttttttctcttttcgcagccaaagccagcctccgactttcttcccttaactgttaaagatcaataaagcagaaatataacgttgaaatttaccctggagaagaagttgtcacataatcatttaatcataaggaaaccatgatatcataaaattcaaagtcatctagttcaattcattgttttatcaagatcatattcaaaccactctaaagagacaatatttttacaatatcaagatcaaattaacaatataagactaattttaaaatgggtaaataataaacagatacatagcttttaatcattaaggacatgtaagttgaaccgacaaaataccattttttgatcattaatttggcgaaatttaaaaaggtatcagatatcagcacaagtttgagaaactgaattctctcctgtactgctgcgggcatgaatatttacattttagaaaaagtaatttgaaagcttcctaacaaaaattacaaactgcttatcccaacaacttattatataaaatgtctatctctagtgaaaaaacaagggttcagcaattttctttgcaaattgattataatggcaatacatggaaacaaggtaagtctgtcaatgggaaggaataaattaacagtatatattcacagaatactagataggcaccgtaagtattataaatatgtacttgggaaaatgctcccagtttacatttgttaggagaaaaaaaggcacactgaagactaataatcacttttatgagagaagagaaccctctttgtgcatcgatttgtataaatacagaaaaaaaaaccataaaagttataaataaaagggtaacagagactacctctggagggtggaacaggaggagggatagcagaatgatggtgactttcaattttactttatataactatacagtgtttctatttgttaaaatgagtacattattactttcatagtcaaaaaactaactgtaggtttaaaagtccaaaaatatatcttaataaactattttaactgttaaattttctttcttggctcataaaggtatgaaaatcatcttcaaactctgtctgcatgtcatctaaaagatgttttttaaaaactattctccacccataatctagcattctgaattattttatgtgtattttaaatatgtgtcaaaacaatgtcagttaaggcatggagcctacaacatgtaaaaccagtcctcataaattcataagccaaacaatatttagttttcattcaaaaaagtctgacttcatcttttaagtgctgtgcttttgctagatactctctgtcctgcctttcaaattaaccctctccggttttttttttttttaagccaaatttagcagctgggggttgtataccaactttagtgacactaacgttaataagttctgataacccatgacactcaaaccagctctctgctaggttcttgaaaagtttggcccaccaccaggtttttacaccctgcggtaatgcaacatacttaccttaggctaggtgagagataagtcttgttcctgaaaagggcaacagtgaaggaaaacctgtaggtagaatacccatactttctccagcaaatcgattttaggaaagaatgcatctaaaagctaaagatacagaaactgcctgcatcgtaaccctggaaatttctgctggactcccagaaagctccagtctgaagatcagtagaggagcttttacccctgctgaagtattaggaacaaaacagtaactggtgacctttactccctggatcaccacaagggaggagtaatatctgattggtgagtttgaaagaagaaactgagcatgtgtgactcagctcatttgagccttgcttatgtgttttctccacgtggaccccagtgaaggagggagaagtgtgcttgttctgtctagctttgattttgtggaacaggtaagtaagtataagagggagaggaggagtgaaagcaaaggtgaaacgtgcaccagaaaaacgtattatcaaagcagctatggctacaagtgtgtattaagtctctctacttcaggattaggaataacaaaatcaatattttatctgtatcgtatctgtatagacagaaaaatcctgggaaaggaatgctttgggggagaatcaaaacagcaaatgaagttttagaattttggctcatccatgatgggttgttcattttgctggaattttgtacttacctggtagcaggagctaattatgactgctatttaagcgggaggtgggggggatttgggggtggagaattttttttaaaagaataagagttttaattcagaaagcaggatttcatttaagcccatatgtcctagatgttgatgggggtggtaggtttgggtaggtcatagggtgtggctgggtcttagatatgtaaatttctcagggctggcagagtcagtcaggggtagccctttggcaagagtaatatgagtttggattatcgaacttcagagtttaaccctaagaggtaagtatttgctcgtttctaaattttgaagttttaaagccggcgttttgataatctgatatattttactaaccctctgaattcactgagagtaggtagggcactaattcagaggtcctagggaaaccttctggggggagataccaagttatggctacaaaatgacccaactttacatggcacggagctctaaaagtaagcagaattagcaagtgtggatcaacagatacaggatttaagaggcatcataagtttgcaggcggtagctgaaactaacaaatgaggtaaccagaggaaaaaggtgtaactgtgtgtgtgtgtatacatacacacatacacctactattttactatatataataaaatatatagatattatacatatataaagagagtttatgtatatgtgtgtgtgacagaatatctaaggggtaaaggaagaacaaatgaggcttctgaaaggcataatcagaggaagacaaacaggagaaagcaactccaatgggaaaaggaaggccagatcaacactggtaaacctcacaaaagtggtgggcatcaataagaactgaaaagaggtaaatggatttggcgtgctttgtgaactgaaaagaaacaaaaaataaaatttaaaaaaaagaaggatttgtcagttaagatgccattggttacctccaccacagttagtttattggagaaggaggtcacatggttcagacctaagatttaatttaaaatagttaataagacatagagattattataagcattaaaagaaaggcaaaatactaaatttgagaaaaagttccattaggatagagctaccctgattgtacctctgccttgactgaagctgtaggtagtgggtaggagttagtaaaacagtagaaattgaagataaaggcatagggagaggtgctaataactgatagaaaatcccagacagcatatggaaagagtaactaaaccatgaagattcaaatacgtccagaggcataagaaaataaaactaaaaattcagtctcactttctatattttctctcactttctctcataagcctaaatctcattttacttcttggagaactgctgtcatgtttgttagtgtgtgtgggggaggttagaggctctgagaaaaagggtcaagttagacaggagaatggcgtgaacctgggagacggagcttgcagtgagccgagatcgcgccactgcactccagcctgggcaacagagcaagactccgtctcaaaaaaaataaataaataaaaataacttcactgtggaatgggaaagggcactaacccaactgatgatttctaattgagggctcaggaaacaaagtgacacttgggagttaggctttataagataagaatttaaggacttggggaaagccagtccagactaaacaaatactgcagatttagatatatgaaagtgaatgggatatgtgagaagtagcaaaccatagtgaaagatgagcctggagaaataagagagaagacctgaatgtttagaatttcccatgcaatcaacgaagaggcactgagggtttctgaggagaaagtaaggcatcccacctgtgtattaaaaaaatacgcgggctgggcacggtggctcacgcctgtaatcccagcactttgggaggccaaggtgggcagatcacgatgtcaagagatcaagaccattctggccaatatggtgaaaccccatctctactaaaaatacaaaaattagctgggtgtggtggtgcgcacctgtagtcccagctactcggcaggctgaggcaggagaatcgcttgaacccaggaggcggaggttgcagtgagccgagattgcgccatggccctccagcctggcaatggagtgagactccgtctttaaaaaaaaaaaaaaaaaaaaaaaagcgaaactgtaaaagttacaccggagcagaaaaggaatactgaagacaaaagataagagagagacacagatatgtatacaggtagacttttaagaagccaaatgcaaaattttgggtgagaagtgatcactcagagaggaagtggatggaacagaaggcagacacagagactgccaaagctaaataaaaggtgatggtagtgatgatgataataatcatgatgacagtgctgatacagctaatatatagagggtctaatatgtgccagatactggtctaagttaactcaccaagttaattcatttactggatgtaaagaatgggaggcaaaaataattgagaacctaaaagtagcatcaagatttcatttctcaataaagagtagtaatatcaacagcagaaagagatcaagaagtttcaaaggaaggtaggggaaagatccaacaaaaattttctggtaacttgctatgtgctatgcacggttctagtttcatcagtaaaccggataaaacatccctgtcttcaagtttacatttagttggttaggggagggtggatacagataaatagaatgcatacattatagtttgttaaaaggtgataagtgcaatgtaaaaaaggggaaaagagcagcgagatgaaaaatgtgtgtatggagacaaatggagggttttgatttttaaatagggtaatcagtgtacccctcatgagatgaagttaagtgaacacctgaaggacataaaatatttcagccaaagagaaaagccagtacaaaagctctaagttagaactggacccagtatattcaagtaagctagcgtggctaagaacagtagcaaatgagtttcggggaacagtatcaggaggcttgatcacctaaggccttgcagagcattttaaagactgtcttttactgagagggaaagtcattgtcgggctctgaacagaagtgtgatatgatttgatttagataattgaagaggatcagggtgctacataaactacaagcaatgatggaatcagggagaccagttaaatgactaatgcaggtatgagattaaattaattgtttgaaccatggtgagaagtgattaagattatatatctatattttgagagaaggtctcacactgttgcctaagctggagtacagtagcacaatcacagctcaccgcagtgacctccccaggctcaggtgatcctcccacctccacctcctgagtagctaattttcaggcaaaggtaacgggatttttcaacgcgatggagtatagagagaaattaaggatgatttcaaggtttctggcctgagcaataagagttgtgggtttggggtgggcaaggatcaggagttcatatttggacacatcaagtgtgagatgcctaataaggtattcaaatggacatgttgaatagctagctgaatacacgagactgaagtttagcaaagaagtctgggctagagatacaaatttggaatcaactggtgtacatttaaagttagggggcaggataagaccaccagtggataaagaagaccatgtaacaagtcaaaaggcttttcgctaaaaggtaggggagaagaggaggaaccagcaagaggacacaggaacatccagacaggtaggaggaaaaaaagagcctgtagtggcatgaaagccaagtgaagagagtatatcaaatgttattagttcagtaagataaaagatggagaggagaagtaaccattggatttagctatatgaaagttactggaaaccacaaaagcataattttagtgagttgtgggagttgagagccagcctgtcaggaacagattcaggataatggaagaaaaaatggaggtgactgaaagcggcggttcagggatctttaccgcaaagggaggcagagaaatgggtctgtagctaaaaggttgaggcaagagggttgaagtcaaaaggttttctgtgtttaagattggagaaataagtgtgtatgctgatgagaatgattcaagagagggaaaaaaataggagaaagaaaaggaattgctacggacagtgctgttgagaaggagaaaccatataggatctggtacacaatgaagggactggttaccaaaaatttatctaggctgggcatgatggctcacgcctgttattcccagcactttgggaggccaaggcgggcagattgcctgaggtcaggagttcgagaccagcctggctaacatggtgaaacccagtctctaccaaaaatacaaaaattagtagggcatggtggcccatacctgtaatcccagctacttgggagggtgaagcagaaggatcacttcaacctgtgaggtggaggtcacagtgagctgagatcgcaccactgctctgcagcatgggtgacagagtgaggcgctgtctcaaaaaaaaaaaaaaactttatctagtcactggtaggaagtatatgggtgtagatattggtgggtggatagatagggtaggcaaagtctttggaagttttcttttgatgcttccattttctcattaaaggtaaagaagaggaggtgcaggtattggtgggcagatagatggtgtaggtaaagtctttgcaagttttcttctgatagttcaattttctcaggatgcaaggtcacctactgaaggtgaaagagaggtggtgctggagttcctaggataagggagaaagtaagaaacagtggtctaaatgaatggaagactaaattaaactaaggaaatgcagcattttaactactggtcagcattaaagggctagggaaatctagtaaagctactgtcagcataaaagggttcgttgtcacacatttcaagtaaaattagtcataaagattgttttttctcgacacgtttagttactgaggttcatgtgagaataagaagaaaggagtaagaaacaatgaaagggtagtatgacataaatggttcttaccatttattggtcggtggtgttggcaggattattaaaagtagaattctagagggagtaaagttgaaaagatagaaagcaataatcagagaatgaaatgtgtgaaaccgagaatgggataggttgtgtttgaaaaatatactattacctagctccctaaaagtttaccaaaaaaaaaaaaaaaaaaaaaaaaggtagaggaaaaaaactaaaatgaagtgaagggggtaaaaaaaggtagaggaaaaaaactaaaatgaagtgaagggggtgaaataattatatcaaaaatgtaagtttaaaatatctgctagggattctaacagccaagaacgtaacttagttgttaatgttctgagagcaagcaattaactgttaagaagattccataacttgaccagatggaactacttcagagcagggactcttccacttagtaaatgctcaataaataaatgtttacttaataagtattaaaaaatctgctggccttaacataatggccactgatctctttttcttttgtagagactgggtctcactacattggccaggccggatttgaattcctgggctcagcctcccgagtagctgggactacaagcatgtaccaccatgcccagttttctgcagcagtttttataaaccaaattttccaaattagaaagactgaccaaagaagcacttttatacgaggaataacttacgtatggagaatctcaacttggaccagtcaagaccaactccagcgatgaagccagaatgtaatatatctcaaaaggctaaagaagtccattttcccagatgtaaattataattaaaaaatagtgagccaaactctaatatcccaatgtgataatctttcaaataaaaatatgggctgtagttcaggaaaaaagtggcttctctataattaaaaattttacatatgttccacgttcactcaaaactatacataaaagtatataatgcatgtgcaggaatcaatttagatagaattgattaatgattaagaattcttcattagcttttggttttaatattatggaaaaatatacaacgatatttaaaagaagcttctcttgacttctcttaaaactaaggctcttgaaagtataaacattaaggttaaataacgctggcaagaatacaaggaaatgacattggtgtattgctaatggtactaggaaagtattctgcaagtatctactaaattaaaaatacagtagtgcccccttatccatgatgagtaagtacattccaagatccctggtagatgcctgaaaccttggatagtactggaccctgtatatatatgttttttcaaagaaacccatgataaaatttaatttataaattaggcacaatgaaagataagcaacaatagcaataaaatagaacaattataacaatatgccagtaacactactcttgcactttggggccattattaagtaaaattagggtttcttgaacacaagcactgtgatacctcaacagtcaatctgataactgagggctactaagtggatacaccagacaaaaggaggattcatgtcccaggtgggacagaaaaggacggcgcaaaatttcatcacactactcagaacggcatgcaacatgaaacttatgaattgtttatttctggaattttccatttaatattttcagaccatagggaaagcaaaaccacaaataaagggactactatatgttgacccacatgaaggaacttatttcataaaaataaaaggagcaaaatatttaaaaaatatgtataagggtgtttattacaatattatttgtcgtgacaaaaaactggaaacaaacttattatggactattctgcagttatttaaaatcactatcaaatgacaatatccatcagttactaagagaggggaaagcaagtattagagtaatatgtttgcatgattctgttttttaaaaaaagtacaccatcacaatcagtgtgaacatttattcattcaacaaatatttattgagtgcctactatatgccagacactattttatgttctagtaatagagacaaacaagataattaagtattttgaatgaatacaatatttagaatgttgaaaagtgaaaaataaagcagagaagagcagaaaagtgcttgtgaagaggaaactaaaacatgaggacatctaagggacattcatggaagatgctgctgacagcacaaacaaaaagaggatggtcagtatggatagagcaaggtgactaagagaaagagtaataaaaaacaaggccagagaggtttaagaagtggtgtgggtaggcagatcattacaggatcttaaaaggccttataggtaattgcagaggtaaagattttaaaacaaccattatcacatttctaacttcagttatcttaaaatgatggcagctgttcttgtctttgtttcacagtttaaactgagcacactgttataataaaaaaacaaaaatttaaagaatcaaatatatattctatcacacaaactggctcaattatactgccttgtatttagcaggcattaaataaatgttaggtagtgaatataaaaacaggtcaagtaatagttatagtggtcattatatctcttaatgcactcatattcttttaacatttttaaatggccaaaacagctacttttaatttgctcagaatataaaccacaaatttttaaaaatgaagagcttccaaaataaaatacattttttcagaaaatagtattttcaaatttaaattagaataaagtacttcaaatgattcatattaatgtaggacaaaatgtagaacttaataaagaaagcaagtatagtaaaaaagaatgtagctaacaagtcaaaaaacgcatatgcataattatcactgcatctcctttataaatttaaatagtagatgttaaattttatagcattttgacctttttaaaaaaattttatttattttttgagacggagtctcactctgttgcccaggctggagtgcagtggcgtgatcttggctcactgcaacctccgcctcccaggttcaagtgattctcctgcctcagcctccagagtaaatgggattacaggcatgcaccaccacgtccggctaattttcgtatttttggtagagacggtgttttgccatgttggccaggctggtctcaagctcctgacctcaggtgatgtgcccgcctcggcctcccaaagtgctgggaatacaggcgtgagctactgcgcccagccactgacctttttataaaagatgagatatggcagttccataatattcaatgccaaaccaattattttcctatgattactattcagttaagttctagagtacagaattataggggaaaatgtggcagaaaagggaagtgaagaagctataagactgtccaaactatatgctgttttggtgtattttactccccatgggaatagatgggaatgatgttgtagtctgcctgaaagagaaaagtacaagagaagtcacccatttaaaaagtgtactcatttgacattccaagatttgtatttcactagttggttatgccttggtagtgcatttggtacttgtgataaacctgttggcaataaattacaaggtctaaaacaataaattataagatcaaaaaacaacagatgtggttgaggattaagagatcattagctgagataagactaaaatccagaactagaagctaagttttctgacttccagatcaatgtaattcctataacaaaattttgttagttacaaagaagctttcaatgatgttcaatgtactcataattctctccacgatttgagccaaatgtagaaagaaatcatgtacgtaatttaaagcaaacaaaacaaaacaaaaagacggattacaaatcaaaagaagagaaaacaagatggaaaaaagtgggtagttttcatgtgtaaagattattgttaccttttccaagtctaactcctctaacaaaatgctggcgtttttgtttgcttcagcagcctgtctatctttggcttgtactattgactccatacaaagatgacacttcttcagcatctcctataatgaaaaattaagatttttccaggctcacagaacaattctcacttagagaaattcctaaaaacacgaagatctttagtaaggtactcaaacctaagcaataaagatccatgaaagggggaaaaaaggtgtgcaaataaaaacgtaattgacatggtatatttaggaatatatacaaatgaagaatcaaagagtagcttttgctattcttcaaaataatatccatttagcaggcacttcagaaactaaagtcatttatcctctaatttaaatataagaaattgtacagcaaacagaactacaataatttatgttggctggttaacaggctaaaggaaataatgtcaacaaagaaaacagatgtgaaaatttttcaagaaatgtcctcaaatatttaagctttgttgctccaattttgtgtacaataatcatttacaaaggaatcagatacatgtacttacataattttctcagtgatttcattctcaagtcacactttaggacagtaaaacactacttccttatttttataaaatttttatttatttaattttagagataggggcttgccatgttgcccaggcttaaatgcagtggctattaacaggcataatcatagtatactgtatcctttaactcctaggctcaagcaatcctctcacctcagcctcccaagtacatgagactaatgcgtacctgagactacagctgtgtgccactgaaccagtcttattcttagtattattaaaaataatttatttttaatctccccctctgcccctaaaaacctgtgatatataggaatgttaattgtcatggacaagtctagagctaggaaagacagtgacctagctagtttaaattaaaacttatagggaaaagctgttcactatcatgtaatagcaactgtgtaaacgtcataagaagacatttttaagatttgttgtcctctttggttttcagaggcatgtgttaggatcttattcaagtgttagtgtaaactccaaatcaaaatgtatgtctccaggagaaggtctcaattaggatctctaataggattcagttttatcttccataaaatttcctgcaaaatttgcatttcctgcaaaattcctagccaattcattctaaaacttagttaaaactaaaagttagttaccctaacttttacatcacgctcaagacttcttgctcatgattaaaagtagtatgttcattttactaggaaataaaaatctattggactcattactttctcaatataggtatcagtctggataaacacacatatacagaggacagccctaatgaataataacatgttgctttgaattacttagtgttcacataaaaattaaattagctcaagaatttttttgttgttattttattttttgagacaagagtcttgctttgatgcccaggctggagtacaatggcacactcttggctcactgcaacctccaccttccgggttcaagcgattttcgtgcctcagccttccaagtagctgggattataggcacatgccaacatgccaggctaatttttgtatttttgtagagatggggtctccccatgttgcccaagctggtcttgaactcctgggctcatgcaatccacctgcctcggcctcccaaactgctgggattacaagggtgagccactgcacctggcctcaagtattatttttaaagataaggtaatcctatagcagaggatgttttattgattcattaggtaagtaaataatctgcaagaatctcttaaatcgcatacttcattcccaaatactagataaatgaaaatggctacatattacactttactactcaaactaggaattcttagaatggaagatatattaaccgaatagagtcccttgctcatatagtgaacaacatattaccttatcagtgatggttgctatgtatctcatacattcagaatctgatggaaactgattgacttctttgactaagtagcgcaccaccttcacatgaccctaaaaaatagatatcaatgtcagattgaaaacagactctaacagttcagtaaatctatgcctgaactaactttaacagttaagattagggccacaaagtaaagactaaattgcatatttacactataaatgaaaaagagacaggctttggttccagtgagttaaatccacattgatcattctcatcctaccctccaaaaaaagtacataataatatgagctaaaattctaaacaactctgaataaaaaaaacaataatcccaaaatcaatacaaagagtaggggatatgtctgaagggtggtggggggtggggattcttatttttttctttgctaactccctaaatatgagagtctagtttcaattctaaggattaaaagggcaaaaataataattttgttttttcattccttcagataaaaaacaaatgtataatactgtcttaggtagtgtgaaagaatatatactttcatgaagaataagctatgattattcactgcaacacaagttagtatctaagttcaaaatctttagacttgccctttcctacttcttaaacgccattcccactttgtctagcccatactgttgctttctgacacaacatctgaagttagccagtcgggataaacagctgttaatctttagtatattttttctattgcctctatctcttccttttagactgcatgtttctaaacttttctctaaatgaatagctcaaatgccacttgcatcattccctaaggatctctctaatacttctacagtgtttaaactatttacatgggacaactcaaacagttacctaactttgggtatggatcttacctttccatattgtaccctatataacatagtatatgttatatatacatatatagacaatatgtatatacatatatagacaatgtatatagacatatatacacaacatatactatgttgcaccctatataatatagtactctagcccacagttgcacatgttaggtactcaagaaataatggaacaaatacataagagtataaaagataagcactgctcaactgaagtcaataagtctatctggaaagatatatgcatgttagatactagagtaataactaataaaaataacaactctaatagttagagtaataacatataaaaatatgtatttctccaaatgaatgataaacactgtcaaacttgtacgacctctagagattagagatctcgatgtgaactcaaataggatgaagagtttggtaggagagacttcaactataactaaagaatgagtaactttggaaaaatgaagaaagacatgggcattctatgagatgagaacaaaggtgatgtgagagataggaacaaggaaaagaccaagcaagaagataattctccacattaaggattctaatgggagataagatctacaagcactaaattgtggtggctgtgaataccaaactaagattggatttcaaatgatttcagaaactggggagacacagaaaggttcttgaagaggttctctaatatagtagagtggttagaaagattaacttgataatgatatgctagcttgcttggagaagaggcagctagccagtgagaaggaataagttggattgctgagaaacaaaaatatagagagtcaaaaatacagagtcactggtagtccagattatctagggaagaggtagaataaagaacagcggtcagagataataagagaaaaaggaagaaatagcttattgtgatttatttattaaaaattttcaacattttggcatctacagggaattttatctacatatctccaaatgacaaaactcaaaattataatccctgtaacagtaatctgatattcccaataacaaactaaagctggatttaagagatcaatggattatcaaacaaaccattaaatcaaattacttacacacagctctgtgctatgtacagaaagagaaagtttgttttactttcacggaatttgtatttttacctttaaatgtaatatacttgaaacttagtagtttaaaatgctggtagtggcattttcattatttaattcattttttttcctagtaaagtcaataattgaaatgaaaacaaattttttttgagacggggtcgtactcttgtcacccgggctggagtgcggtggtgcaatctcagctcactgcaacctttgcctctcaggctcaagccatcctcctatctcagcctcctgagtagctgggactattagcacatgtcaccacgctcggctaatttttataatttttgtagaggcagggcttcgctacatctgcctgccttggcctcccaaagtgctgagattacaggcatgagccaccatgcgtggcacaacccccgcccccagcaaaataaccagtttaagtgatatttttctctgtagtggtaatacaagaaaacactcactaagagtaactaactggaggtacttacttaagtatcttaactggatttacactttgtgaagattaagactgcaactagattttgaacacattacttagaacagctttttaaaagtttacttagctctgatgtccaataaggttaaaattaatggcttttctgaaaaacctgtatatatctacatttaatgttgccataagagtaattatttgcatattattgctttcatcacagctgcaaaagcacaaaatgagtctttagtgatcactaagccatgtacttcctagtgtaagtaaaaaaacatccaggtaaatgaggatgaaagacttatacctttctaaatgctgccataagaggagttatcttgcggttatctgctgcatccacatctgcacctgcttgcaccagtaactgaaccacatcgaggtgtccaccatttgctgctagccacaatggagtgttccccttcttgttacgtacatcaatatgagctcccctaaaaaccaatgacacagatagcattgtcttttttttttttttttttttttttgatacagggtcttgctctgtcacacaggctggagtgcagtggtgagatcatggctcactgcagcctccacctccaggggtcatatgattctcctacctcagcctccagagtagctgggactacagtcccatgccaccacgctcagctaatttttaaatttcttgtggagatggagtcttcctatgttacccaggctggtctcgaactcctgggctcaagtaatcctcctgcctcaacctctcaaagtgctggaattataggcattgtcaccacacctagcctagcattgtcttaaatagaatgaaatgacacagtaacaaaaatcaactatcaacatgtgaaaatattctgtaaagataaaaattgttttcaatattcaaagatgtaaatatgtcttgctctcagaattatactacacaaacaatatcctatgaggcaactgtaaccgtttcagattatttgtattcatatacaatttgaccatccctaatctgaaatccagtatctgaagtctgaaatgctccaaagagcatttcctttgagtgtcataacagggctcaaaaagttccatactttggagcttttccaattagggatactcaatctgtttttgtagttatgttaaagataacatgcaggtttagcattcattcagtgggcatgatgtagatgggaagaaccatggttagtaagagttaacagcagttactgccaaatactactgcttagaataccatgcaaaggtctttgagagtgcacgaaaacaagttaaacagacaagcatctttggaaaactagcaggcaacttctacgtgactgaaagtagaaagtaccttggatcctgtctgtttatcttaaatagtcccataaccacacctaaaagccttaattactgtgaagaacaagaaaatggacaatgaagccttagatcactgccagacttttaagacttgtgtgtgggggatgtaagtatgtctgataacagatggatgttcaaatagcttgttattgtagacgttaaaagtaatatagacaagaatgaaagaaaaacatttttaggttacacagaaacaaatcagacaatgtagcatagctctggagggttggaaaacaatgggtaggtttgggggaaaaagcacttgtttataaaagaagaaataatcacatttgattttttaaatagtttaattgcctagagagaatgataaccactagtaacacttgtgttcatatatgaagggtatggtaacaacatacctgccaataagaagctcacagaatttgtaatgccctttatctgctgctatggttaaagctgtatctcttgaggagggaactggaggggcattaacatcagcacctttatccaaaagaactcggcccacctccgcatatccaccagaggcagcttccattagtggtgtgagaccagtctaagtttagtgtaaaattaaaagtaatgacacgtaagagactggaaagatctaaaattgtaaagaataacaacttgaagaaggaatatgatacagctgttaccaagattcacaactaaatttaatcactgacccttattagctcctttgagttagtctgatctattaaaagaaaataattctacctaatctcaacggtattgcaaaaaaaaaaaaaagaaagaaagaaaaaaaaatctgtttaagatgcaagcacttggcatataactggtactcaataaatgttccattcccttccttttcaaaatagtctctctttttcagctgataatcctactgtcattgttgcctataaaaatttatcactcaggtattttcaagagttaatgtttgactgagttatacagaatgatttctaattaaatatatacataggagataaatgttactagaaagaactaaaattataatcaacatgttgctactatatatcttaaatatcaaagcaataaattcatgtgtaaatctcagactttttcttaccttagctctgtgttcaacatttgcttttctatcaagcagaagactaaccacttcagttcttccttggaagcaggctaaagtaagggcagtgttccgattggtttctatctgagcatttatgtcagagcccatgtctaacaggagcttaacagcagctgtatgcccattcatagctgctaacatcagaggagagatgcccaatttgctaccagttctaggggtgcaggtatggggaaaacaaatggaaaaatatatattttaaatgacagaaaaattggagatgatatataattctaatctaagattattttgaaggattgtttaaaatatccatttttctcaaccttagtaagtctctgagatactaccaagactccattagaaatgttttattagaatattttttgtatttcactcaacataatgacttaggctggaaggtgattaataagttattaggataaactttcaatcttaaagcatgtattagcttgcttaataaaagcttctaagatgtttacatttagtatcataagaaacagtactcaatatttttcaaactctatatcaagttttaattacttaaataaagttcatctcaaaaatctctaacactttgaatgccaaatttgtaataaagggatttactaaatttggcactaaaaaataggtgttctacaaatatctataacagtcttactaaataaggggcttacagaaagggaatacaacttgcctagagttaatctcagctcctgcatttagtaatattttgatgatgttcacatagccaccagaagcagccagacttagaggtgtgtaatcagaaacattcctgtgctctttatttgcccctcgagctaacaatagctccaccacctgaaaataaaatagaaaaaaatatgttttcttatggagagacaaattaccaaagtgtgtatttttaaatttctttttctggtatactgtacaataaaagaaggggaaagttcttccttcatgctctgcataaaatcagcctctaatgatagcaggaggtcttagaagccaacaaagagataccttctcaagtaaaacccatgtagaaatccactaaaatgctacaatgtgttcatgaaaggtctggactgaaaattttgtgacatgctttggaaattaatatttgttatttcaccacaaagcggtaaaatagagtaatatgggacaagattttttcgtattatacatgtgaatgtatttaacatatttttaaaccttttaatcagtaagtattttaaaagcatggtataaaaggtcctatattttcacaagattatgaaaattttctaagataacattaaaaaaccttatatacattcactacctagattttaggtcccacctactggcagaatttctgggtgtatggttttgtaagaaattgccaggctattcttaaagtggttgtactatgtacactcccttcaataatgcatgagttctagtagcatgagtcttggcaacatctgttattgccagtcgtcaattttagccattctagtggatgtgtagttgtatcccactggatcttaattgcatttcctgaaacctaaaaatatttagcatttatttaagtactgatgggccattcacagatcattgtccactatgccatttaatgcctaaacaatcctttgacacaatattcattctcattttataaataagatatagagaagtcaagactggctcaagatcatagctcttacccctgctcttactattaataatatatcctaaaatactaactggcaaataataaatgttaatgaatagtggtttatcttgcatctcagcaaagctatgtccaattttagatatcacattctttccatcactttttgctttcagagcgagtgacaaggttataaaaacaagaaaaaatatagcgttaggctattttataaacagtatagtagaaaactctaatcaaatttctcaagttttctcaatgccattatatttctcaattctttcagagaactcttctgctcccaaaacatccaatatacaacaaaaatgtatgatttttatagtaaaatgactttccaacattttattaatcacttcaaaatacttacctcttctattgacaccaaattaaagtaacaaagtgtttataggcaaaattgttaccctaacatacttcaacaattgttataacctaatctgttatattttaacaaaaatacataattcataaaaattacagtgccctattggctttaatactacttttaaataaagaaaatcaactaatatcttcttgactcaatattgaaaaaatctgttcttatataaagcaagtattttttcaagctaaataatgattgaaaggcaatatgattgaaaggcaaaattttgctttccgggatttatggggatttttactttttctggaatagtagaaataatttatcaaattaagtggttcatttttcactatcttaatatttggcttataatacttttaacctatctattgcccctactatgaattatagaagaaaaaagtgacacaagtagaagaaacaaaacagtagggacaggccaggctccttgtctcttgtgtggagtattctagtaataagtgtatctaactatccattcatataatatctattccaaatataagggaacaaaaattatggaaaaaaatgcctatattatcactgttaatagatttcagttctttttaatttacaaaatgaaggatgaccaagccctacccttactgcacttacataattttattagatttcccattcttttgtataggaattattatatctattaaaattgtttatttattagtttattttaaaaatctagtgggtttaactaactagagctcaatataaccttatgtgctatgactggggggaagtggggggaaaagctagtttaagatgctcaaatgggaggtaacagttccccagttcactcgtcagaatacctttacatataatattttaagaaggatactgacataaagggtgaaacagtcacgatgatgaagggattggaaaaggtattcttaggctaacaaccgaaacaagacttgtttcacacaaagaataggtgacttcaggaaaaaaaaaatctgaagatagaaaaggttaaacctctttctatttgtttaaagaacaaaactaagaactgtggggaaacaaaaaaggcatacttcaggcctgataaataggaaaaccttataaaagaataagagaaaaaagattttaaagctaagacactgatctgaatgacctaaggtgctttccaaatctaagattcaataattccttgatagagaagggaatctatggagacaacacatctggtttatatcccctgtacaaaggactgaatttgaaaaaaaaaaaaaggttatctagctgattataaaatgccacaagatacataagtgagtgtaaagctacattttcttgagcctagctaatctctatcagttgttctagtttccttaaaaaaacaaaaggtcatataatcttaccatcttatctgagaacctttcctccagagttgagaaagggtggggaaaaatcaaagcaagacaagagttctcaaaacacataaaaattgaatattcttaattccctactaatcttacagacagcaacagagactgtgattaagtaccttctatgccatgtactatagggcaggcaaagatgagtgaatataggccctgtacattaggaacttactgatttgacttggaatagtctttctcctaccgtaaatgcatggcattcctacttttagatgagcaggattctaaacaatgtgtgatttttctggcaagatagcttatgctaacaatgatactcatctttttgttaatagataatagtttcagttattgtgagaaatctaaacgtcaaagcattgttctgatagaaaaaataatataagtgaaagtacacatttgctaaacagagaaaggaaaacaattacactaaggggaaacattacctcctgtcttcccccagaacaagccaaggagagtggtgtgtccttggttctttcagactgggcttcaatgtctgcaccattgtccagcaatatttccacaacaccaacatgaccagctgtggcagccaagatgagtggagtaaaacctggagaaaaataatgatcttctcactacatgctaaggcaaaagaacaaaatatctgaccttcaaaataggactaaaaaataatgttcctaaataaattttttgaccagtattccaaaaaataaaacaaaagtaggccctacctttcttgtctcggtgctctatactagctcctctctctagcagtgtttgtaccagttcctcgtggccaccagcacaggcaagtgttagtgccgtgtcatgattactctcagtctataagaaattattttttggttagtttattaaataacttaagatgttaatatcaaatacataatatgcaaacatatcaaatacacacaaatacatatgtaccactctacaatatcaagcatttgaaaagcaaggtttatggacgggcgtggtggctcacgcctgtaatcccagcactttgagaggccgaggtgggcagatcacgaggtcaagagattgagaccatcctggccaacatggtgaaaccccatcttgactgaaaatataaaaattagccgggtgtggtggtgcgtgcctgtagtcccagcttcttcggaggctgaggcagaagaatcgcttgaacctgggaggcagaggttacagtgaaccaagatcacgccactgcactccagcctgggtgacaaagcgagactccgtctcaaaaaaaaaaaaaaaaagaaaagaaaagaaaagcaaggtttacttgtttccatattagcagccaacttgcgagttttttaaaaaggctacaaacatcaagaaaaataaagtatgactttcaatcacgtgattgaaagaaatactgtggattaacttttgctttcagccattaatggagaaacatagatcagatttattttcctatttcaaataactaaaaaagaaaaaaaacctctttgaaacgatggtgtttagacaggcagtgcagaagagtgatctctgaagacagaaatgattagcccaacttactgcctggagagtttccaggctatagtgcaaggagcaagtatccaaacaacctggcagtctccccaacttgagaagacagaatttggagagatcaaggtggctagaattcatggagcagattattgaagaggagagtactgcagaaagggtactctggagatgtgcagaggattcccctcaaatcttcagctgagttttgatcagtccatgtgcatgaggaaattatcccaggccaggaaaggaccaccagagagagtcaggctgaataatacccagggctcacacggagccaggaatagtttggttcccaccagccagagtagaaagacctcaaaacacacaggatgtcaagtagaatcctcagtagtagggccaaattagcagttgtggacccacctaacaaactgagaagtaggccttgaaatttaaaaaaaaaaaattgtttccaagtaacttagctgtatttgagaacaaagccccaaaatacttaaaggaaccaaatatccaaaatatactgtgtattttgaaaaacaaagactattataatgagacatgacactatctacatatggtttgcttctgccttctgctaatgataatgaccaacatattagatttaccagtgttcatactctgttatagtttcaatgctaacctagcaaactatctaatttctcatacttttattatttattttattttttatttttgagatggagtctcgctgtcacccaggctggagtgcagtggcgcgatcttggctgtctgcaatctctgcctcctgggttcacgcaacgctccctgcctcagcttcctgagtagctgggtttacaggcgtctgccaccacgcccagctagataccttttagtactctacaagcaacatgtgactattagcatttgaaatatggttagtgtaacagaggaactgaattttaaattgtatttaactttaatttaaatgtaataactgatattcaatttggttactggaaaatttaggatgtctcaaacaatttgagtaaatgaatctacttttcgactgcacatttaattaaatctagatacaaattgagtatttccaatgaaatccaaattcagatatactttaagtagggtgacaaatctgggactgagggggtttctgggatgagggacttctggtgctaaaacaggaaagtcccaggaaaaccaaaatgatttgatcactccagctgtaagtctaacatgcccaagttttgaagacttttagtatgaaataaaaatgtaaattatctcagcaattgtggtgtattgattgcatgacatgttaaaacaatatttggatatattaaattaaattaaatatattttaaaattcatcccatttgtttcttttcacattttttaatgcgactactagagaatttaaaattacaatctcatcatatttttcaactgaacagtgttgctctaagcatttccctcactttcacatatgtatctctattatagtacttatcaccaatctgccttatatgtttatcacccacagagactataaattcctgggaggtaaggaacatgtcttatccatgtttgtattttctacctgtagtgataaattacttaggaaataataaatgatagttaagtaaaatgaatggcaatagctgcaaaaggtcatagattcaaaaactgttactaataaacataataagcaagggactatatatgtagcattgattacatttacacattgtatttgtagaatgtacataataattataaaaaggaaaagcatattctcccagaatgtaaataactctacagaccaaattccattataagaaatgaaaaacaaaagacaaaaggcaaaatcagtaagagttaagaaaaaagaaaaagcctactagtcagtgatgaagagggagacggcaaaagctgctctgcagaagaggctggcagagagcagagctactgactgcagagatcagggatggccacaagggagagatgcaccaactacaacaatggagaaggacatgaaacttaaatgagtgacagctctgactgtgttatactatttgatcttcatttcaggtttataggaagaaattatatctgatttcagagaaaaggagataaaggctctgataaataactttccgatggccacataagctaacaactggtagatatgtgctttaaaaaacccaagaagatcttgataacaaaatcctgctctccccactatatcacagaggggccctaaggcaaagcagattgtgctgaatataatgttaagtgtatgtgtcttatgtccactctacgttggtgcatatgcaatcagcagaagaatcaattttatgatgaagtttataaggtttctaaaattcttccagggtttaaagagtaatttaggaaagcttaaatagaaaatgaagagatgtacataaaatttgcaaaagataagcacggaaaattttagtggatcagtaaaatgttttttccaatattataaaacataaattcaactgacatttattaagcaccttttatattcaaagcactctactaagtgctcgagggttgacaaagataatacaggactcaaagaagcttactgattactacacagggcaaattcaggttcaaactaggagacaagcataataatatattatgagatttcaagaaacaaacatttaaagctaagaaaacagctttaaattccttgtggaaatgaagttaaaagtgggcaactccattgtatttctgcattaagagaaactaaaccaactaacatgacagaaatatcactctatttctgaatacatcaataaacaaatgaactgaaatagaaatttgggttaatattaataatgacaaagtaaagaaaaaaacaggtgtttcaaatactgctaatcatggaaataattataatacagctgactattttgtagaaggcaaagtaccaattaaaggaagaatccttagattcaaattatattgcacaaagttacattagtcaagaagttatattccttgtcacagatctaagagaaagtcccgaacctgaaaaaggagatagatgtccagagctttaagagctcattcaggtttctattctaaagaaaatttcagttagcccatgatgccataatatatacaccattctataccattaatagaggttgttatgatgaattctggcttataaaaaatgataaaaaatatatttaatgcaaaaatattctgtaagttatcaacatgactattcaattttataatggtggtacagaatgaaaaacaagaaatagtaacacagatggcaatactgaaggaaagacaacttttaatgagctgaaattcaggtgaaaaagcactgaactgtgtgaagtgtctttaaaaaaggaaatacgctgggtacaatggctcatgcctgtaatcccaacactttgggaggctgaggcaggaggatcacttgaggccagaagtttgagaacagctgggcaacatggcaagaccccatctctgcaaaaaattagccagaagtggtgtgcaatgcctgtactcatagctactcatgagtttggggcaggaggatcatttgagcccaggagttcatggctgcagcaagctgtgatggtgccactgcactccaacctggctgacaagagtgagaccctgtctcaacaacaacaacaacaacaacaaaaaagtacatctattaattactttttttttttttttttttgagagagagagtcttgctctgtcgccaaggctagagtgcagtggctcactcagctcactgcaagctccgtctcccaggtttgcgccattctcctgcctcagcctcccgagtagctgggactacaggtgcctgccaccacgcctggctaatttttttttgtatttttagtagagacaaggtttcacggtgttagccaggatggtctcgaactcctgacctcatgatcctcccaccttggcctcccaaagtgctgggattacaggtgtgagccactgcactctgcctattaattactcttaacataattaaattaccttgaaaactactaggacttaaagagctgaactttttttacacttccacaaccttcaaaatccttaatatctcattctctaacccactcaggttacatgtaagcttaaaaagtgggatagcacttcaaggtattcaataaatgagaataatcagtaaaataaataacctattaaaagcagttcatatgaacaagtagaatgcatgtattttaaagcagaatgctttaatggtagcatattatatatgtatcactgttaactaatttttgctggcctctctaatttctcatgttaaatcactgtgattaaactgttctttatattgcaaaaccaataagaatagagaaaaatattcatataatacttataccattaaaggtaaaatataattttacatacttaacaatttcagtcttgatacgtcacaagtgaaatttgatgtctacccttctttaaaataatgaatatatgttaattattaaaaagtgaaagaaagcaaaattctataaagatctattttttttttttcagttttgagatgtactagaataaggtactccaagttcaagaaaagacttcagcggcctcagaataaaaacaacaagcagtttaggaatatagggaggacatgtgacaaaaaagaggctggaacaagtttttatagcccaagaacaaaacaactggttctttctcattggtagtggctcctagaatcgatcatattttacacaataaaatacaaaaaatatttaattaacttgtggtattcagttctaaccttcaagtcagaattattgttccacataaagcctgtggttttaaaaaatctctacataattcctcatttctgtatgtacagaacccacaaataagtttggttataccaaacttaagcaaaataaactcaacttaaactcaagcaaaataaacacaaaggtcagagcaatgctatcaaaaggtgtaataaaaatagtcccaaataattccttcaaactattatttattggtttcctaaaacagattttgatagcagcaaagtatgtggtattcatcttaaaagttttgaaaatacctagacaaatttgattcagtaaaactggagagttggaaagtctgtggcacacccttggcaagtgagttctagttgtgtagcagagagttgaagccccttatgaagaatgcaaactcttcagcatttgtcaaggatcagaaataaaacatatgattcctgctaatccttgttaaaaatattagctcctgtctaaaatgttcaactaaagcagttaaaggtctgaccattttccagaatcattagcattttaaaaggagttatactttgaggctttaaaagattaacatttcctttgttcttccttatattttgatgttaagtatgcaaagatgaaagacaaatgatctcttaccatctaggcagtggacacgtttctgtgatcccacttaccaggctaatacaacataattcaaattcaaggttaacacacttaagttaaaaataaaaaaacaatgtaacatagtgcagtggttaataaaagaaaagagtctagagccagagtgtctgagttcaaaagtaggctccaccactaattagctgttgggcaaggtagttaatatctttatgtcttatattcctcaaatggaaaatgtaataataatagtacctacttcatgggactgttacaaagattaagttaaagaagttaatatctgcaaggcattaagcctgtatgttagggtttgttacataaacagatgaaagatctaagtattaaagaatgtttaatctttcagaatagcaatcttggtattaatttcttcattatattatttgtcacagcacagtattatcacacataatcaaagtacccactatgtaagagcccacaaaatttttattttcttatcaaaacaaaaactttgagcttttgtttgattgagtataaaaggatcttcatttttaatcacttaaattacctgcttgatataaaaactagttgttttttttttttttgagacagagtttcactctgtcgcccaggctggagtgcagtggtatgatcttggctcactggccaacactctgccttctgggttcaagtgcttctcctgcctcagcctcccaaataggtgggattacaggtgtgtgtcaccatgcccggctaatttttgtatttttagtagagacagggtttcatcatgttggccaggctggtctcgaactcctaacctcaggtgatccatccacctcggcctcccagagcgctggcattacaggcgtgagccaccacacctggtcaaaactagtaaattttaaaaacaaacatcaaaaattaaaggagaaaaatggtgaacaattatttttgaacagtatttttttccaaggtaggaactttttaatctctaactaaacacatatggtaaaactccacagagagtagtttaactcaggtctggctaacccaacaaatgacaaatcttgatgtgagatcagataaaaaaagtagatttttaaggagtcatagtcaaatttttctataaaagcatgtctactatgtttaaaatgtaagtttaaaaataattttaattaaaaaattacatgtaacttctcagaactaagttataacatggtgatagttggtgagtggtacagcccagaaaaatcatttcaccatcactacagtaatttcatattcagtaaaatcaatgactggacaaacttttctgtgcctgtttaaaaacatttttataaagaagtctttttacattttggtgaagtacttatttttgctaatggatcaattcttgggcccacaaaaatcagaaaactacctcttgctaaacataatagtctcagctgtgtgcggtggcacacgcctgtaatcccagcactttgggtggctaatgcaggcagatcacctgaggtcaacgagtttgaaaccagcctggccaacatggtgaaaccccatctctactaaaaatacaaaaaaattggccaggcgtgatggtgggcgcctgtaatcccagctactcaggaggctgaggcaggagaatcgcttgaacctgggaggcggaggctacagttagccaagattgccactgcactccagcctgggtgacagagcgagactccgtctcaaaataaaaaaaaaataaaaagcctcaaagcaaaaaagactggggaaaaataatgcaaattcaatgccaagttcaaaccaattctacaatgctatcaatattaaatgtaaacaactatggctcatcaaatgaatgtctcgtgttttttttttttttttttgagacagagtttcgctcttgttgcccaggctggagtgcagtggcatgatctcggctcactgcaacctccatctcccggattaaagtgattctcctgcctcagcctcccgagtagctgggattacaggcatgcgccacaatgcccagctaattttttttgtatttttagtagagatggggtttcaccatgttggccaggctggtctcaaactcctgacctcaggtgatccgcccgcctcagcctcccaaagtgctgggattacaggcgtgagccaccacgcccggccatctcgtatttttttttaaaaggctatgtagatggtagttaagagtgtctttgggggatggtggcacacctgtaattccagctactcaggaggctgagacaggagtttgagaccagcttgggcagcatggcaagaacccattacaaaagaaaaaaagaatggtgtctttgaagtcatgctgaatgattcccagccctgccgcttcttagcctaaatgaagtgactaaacaaaatgcttaacctctctcttagctacaatgtcttcttcagggagatggatattaagagtagctacatcatgtatgtggtctgaggattagatgagacaattccttaaaatagtccctggcaattttaagtactcaacaacaacaaaagtcagtacataaaaaacaacagacatttggccaacaagtaagagcagaaataaaattcctttttcatagtgttactgaggatcattttaataaaaaggaaactttatttttaataggttaagagtacatgcccttaatggtccatccaacacaaacacacatacactcactcctctctctttctccccacgttacccctgctaaaattcaggctttattataaagaaataatcatatataaaattaaaagttttataatgtacacaccccaggtaccatcaaaatacaaaaactaagtaaactgcaaacatttcttagtcctgatggccatgtactcttgaccttattcagcagtcttctaaactagacctcttaacttttcttcaggataaaacacgcactattctctccaatctcaccttgccctgagatttcatggtcaactactttttaataaaaaattatacttaatagctctcaaactttctaaagcttaacttaaacagtgtcctccccccactccatgttatttcttcaaaaagtgcctggaatcccgtacagctaaattttacaaatacagacacagactcaccacatatttcaatcagtaagatgagaattttcaaagatgatatatgatatcaatcatgtgtatgacatacaaaaatataattttatgttagaaccttttttcttttacatgcaatccattatatatttcaaaccatatcttctattaatttattattagaagaagttatgcactaatcttaaataaattatttttcttttatatcctcttgtgaactaaagttaaaaaaaaggttacctgatgaccttggaaaccagaccatcacataattatcactaataatctatatttagcattttattttttaaatgtgaactttaattaatttaaaactggctcaagactttgcctagagacaaagcagtctttcatggtttaaatctctgaaagttaatgtttttaattatggcataattccaatgaaaaaaccatctctcttaagtttgggacttacctgtgcatcaatatcaatggcagggtagataggaagcatggctgaaggagagatgataggacttggagttggagtctgaggttgggaaatggatgcagcaatactgtgggtaggagtgtttgacattgcagatgctcttccactgactgctgttgaacaaaataactgcacttaataaggatgaaacattgttaagtaatactaagacatattcactcaaaaatatttaaagacttcttaaaacaatatgtctacaggaagactactatagcactaataactaattttcctggttattattcactgatgacagtgtaaaattgtaatgtatactgagtaactcattttctaaataataatccaactgaaaaacaaattcccctgttataagcagtcgtaaaaccttaattcaaaataaccctgaaaacaaaaatgtttatgtattaaatataaatgcaaatggaaacttgtccattatatcctaattagaaaggggatcaaaggtaaaatagtcaagatcagaagggggaatatgtggtttttacttgccaatttcacaccttatattctagaactagtaaaattaatatcactgtcggggagggagaaatctcactatgcaatcatttaaaacaccgccatactgttttactaactgcagactgggatatagtaatattctgcattgtagccctctggaatgacaggatattcaaatataaaaatttatcctcacacagaagtgtagttgctcatgtgaagaattattctgagggagctaaaatgctcaccaatgaatccagcaatcacactgacttaaggacaaaattaaaagattagggtagaaataaatgtatgcacacaaacattcttcaaatatggattactattattctaagtatgatgttgctgtgatattattttcaccaaaatatgcaacttaagaaaaggctattctgatcagtacttgaggtgggaggactccaaatatgctggcataggatatactgtagattcagctgagggtactttattctctcattgccttatttctggagttgataggtgaacatcatctcccccaaccccattaaaaatgctatagtattaaagtatgggcatttatctttgactggtcaacagtactgtggatgtgtattaccaaagtagttatcaactacatcagacagaaaacaatcatgattcacaactggatctgaaaccaggcaaaagagattatgatcctgtcaagaataaaactgaaattgatcttattataacaattataaacataattatgaattaagaaatctattttacatgaaatccttagttcaggcacaaacatacactatacattatagcaacacacattctataattatacatttttaagtccacttaaaagccaaaggaaaaacgaaggagaaaacaaaacaaaacaaaacaaaacactgtttgaatccttagggatccagaccaatagaaaagggcatatactaatatattaaattgataatctagcgatctggatattgttactccatattgatagttttgtatgttacgaaaagatcaagataatttaaatgtacatattgttgatatacatttcaaaatcatataaaatctagagctctttaaattgattccatatctcctttgattggattttcacaataaaactgctaaatacaaaaagtagcttaaacaggatgaacaccagtctgtccgaatcactaaattttatttcataatactaaacaggttaaaaaaaatctaagttttattgttaaatgactaaattataatttacatttcaactggaatattttcttttaaagaacctaccaaaattacagagttttttttttttttttttttaagtcaaattggttgttcttatcacctcatctaaaaggagacaggaaaaatcaattatctcatcatttccttcggggtacctataaaattggtttactaaaattaggtgactgtcaatcacacatccattctctacaactaaaagaaacaaatgtaaaatatgtaggtacctgaaggaactctggtaaaaatctttacatgtggggcttcattttagtgttagatttagagagggagaaccacacatcagaaaagttttaatgtcagcatagaaaaaagggaacttgaaatgatagcaaaggcaaggtgttgagacaggttaaacagggagctgattctggtttggcaagtgtgaagaacaggaaagacagacgattttggtcagcaaattttatggtagaagtctaataaatgaagcctaagaaataaagagcagggactgtgctagagggaggaaaagaagacgatgagactaatgaggctgtaatatactttaaacccctaagaaagaagtggaaatcatcattaagcaactgaaaggatacatcctaccacagaaatttaagattgaggctgcaaaagtcagtgcatgagtatatgtgcatgtgtgtgaatgtgcacatgcctgttgtcagggatgagttgcaggtaagtagccaaatgttttcaatcctactcttcctccttctggctatgtttctctccccatagaaatgagcataataaaaaagtaaaatatttttgtattatgacaagcatctgtcatatttcctaaaaagttatatgcacttaaaatttttttatacagaacactgagaatacacagaattgtttttgtttcatgtatgaatcaaaagaaaagatactttacaaacttctgataattctgatcagcatacaaaactgtacaactagcaaatcattgttgacaactatgcatgcccaagcacatcaggtaaactctgatattatataaaaaaaatttttttaaacaaccattactgtgtaatacctattcttcattaaagtggatacgtaatatttaactctatacatcctttagtagtttcacatgatagagcactattatgatctgaattcatatggacatagtatcaaatttagggttaatggttactgtgctccaactttcacaggatatttaataattttaaaagtttactctcaattattataatcagctagtcatgattagtagtgactttcaaatctatagaaaaattttgcactcatcaataagagtcgtacaattcttactagtaattattactagcatttttccaatgtggttatttaacccttaagactagcagaaattttcattccacatgttataactactgaggtgctattaaaggcggactagcaaactttacagatatttttaagtataaaatctatctcagctggattcttagtgtctgaacgttacctaaatatctaaacactatacagtttagtttcctattatccatttaaaagatgaaacttaaaaaaaaataagctcatcatatttaatgctactgaaacagtttttaaattagaaaaagtcaatcatcctctaagtacagatgaatgaataaaaaaggggaagagatcagatggaagtcaccaaaattccactgtttattcctttcatttttctgttttccttccttttcaaattttctttttttaatgaagcaaattatccttctcagtacagcattcttatggttcacaaccctataaaacctcatcccattactttgttacaaaacacaaaaaataagtaccaaaaactagaagcataaaaacagtcttctaaagtgtatcttcttgtcaatgaaactagttataatcgaataaaatttatctggctacacatctaaaaatatatcatttatgatactttcaggggggccacaccttctcatgatacagttagaaagagactacacattaacattcacaggggacaaaatcacttacatacagtataattaaaccctatttggttttgaactttattaattttgtaaaagtgtttttttttttaaatatccatcaggtttgaagtctgatccattaggatataaagtatttctgttcataaataagcttcctgatgtgtcctactagttttgcacttcaacttctatcaatttcccagtttattggtgtgaatacagaagcaaaatgccaaaattcaatctcagtattctgaacttaaaggaaaaaaatgaaaacaaaaacaaaaatcaaacatcaaccccactactgaaaaacctagattctcaagctaccaagctaagccagaaagcttcagtcatttgtactgaatgagctaatctttaatttgacctgtatccatctgagaacttctgagattgaactaatacttctaaagctagacatgagtcagtccaaaaatagttctcaagttgggtaacggcaaaaaatttgggtacattcttactcgccttaagcaaatcatatttgatacctgctcataacaatataaacccacctgccatgatgtcatccagcgtgtcattgagggtctgagcagggctggctaccattaacccttgttgtgtttctgtcagaattccttgccccagccctgccaactgtgcttggcccagtactggctgtccaactatcactccttgcagttctgtaagatttgcgatggaccctggaggcaagggacctgccgccagaggcaaagcttgaggcatcgccagaggctggattggcgcaaaacccatctgagcagcagtctgctggggttcatctttaagtaaaacaggatccacttgctgtaaccgtgcatagtctccctcagaaagctgctctccaactccaacaggagttagtaatcccaggtgttggcaagactgttgctgctgttgctgaagttgaattctttgagctttaacctctagatactgcttttttagctgctgctgagttttcagttgtaactctcgttctactttctgtagttcctccaaaatcttttgtttcttctgaatttgttcctcccttgttttgttgagctcctcgatcttctccttggtaagttggtcagcatgagccagttccaaggactgcagctgtgcattcttttctatggcttcttttatcctctgttccagttctgttaactttccctgagcctcttctacaatgctctctggagactgattggtgatgtaaccctgtacatcctggctgtttgctggcaaatggctgctggacttttgtttagaagcagctgtgtgaaaaagaaaccccctcagaagtgcacatgaatggcatcctcattacagagttactgttgggaggtttagtgccaacagttatgcactaagtaatcatatccataacaggtgaaaatgcactgttaaaaaattaaaaacaaatccaccttctttttcacaaatataaaatgtatgtattttatgtgcaaaatctttgtaaattaatttcagaatcttaaaaatagcacatggcttaaattagacaatagaggaatgcaggtttgtgatatctaagtgtgcaattaaagtaacatctaaggctatgtgtagatattttatatggtcataaagatgttaaaactcatcataagaacagaacaataatgctaaattattagggtgaagaggaaacagacctctaagtcaggttttttcacatttcatagtctgtgccttttaaacacacacacatacacacaaaaagtacccaaaccactaagaagtaacaagaaattaaaatctgagtaaaatatatgtctttgttggggcctaccatcttcaagactaatagaggcaagatataaattcacatattcacacagctatctggccagtagagaattgggattcagtttccctggaagaaaagatgctggactatgccatccactgtatcttctgacagccaggtgaacagacagatctggctataggtatagcaatcaattgtttgctataccaactgaaaaaggtgccaaggctctaggttgatagtagtgactgaaaagagctggtgaaaatacttagcattcttgttcataaaagagtatacgtagccaaaaaccaaaaaataaaaactgcactgtttcttcaggtaaaacttttaaaaagaaaaactgattcaaaccggtaggtataaaatgtttggggacattacttaagaacacacatggtgtaacatacacaagtcaaatatggacctcagaattctagagaaataaacaagcatatctcaagtaactgaattattggttgagaaaaggtatcccagatcagatataaaatctatattaagccagtcattctaaaataaatttctaatatttgatacatcttgttaatttatgcctttataactgcagagatttaggtaagtaatttataaaaatattgctcaactatacccagcttaacattttacatgaataaaaattactattaaaggaaatcatggataatcagaactgcatcaaagatgagcatctgaatttctcatgctaaaacttctaattgtagcacaaattagtgctattaactatttttttctcccaataacatgcttttatcatgggttaaaaatttagtaatgccaacttagtaaacttctttgtttgtagaaatgtctattttttggtaatcttatttttacctggacaccaagtaagaaacagtctttagaagtataactgacctttattcctgatgggaagagtggtggcaacattggcaggtggtttgtcaggctcctgaggtggaacaaccatgggcagtgcttgaactggtacacgaggagcctaagacaaaggacactaagtgactattagtgtcctacacaatccattaagtaatatgctctaaataaagaataaattagagattttttgacaatatttttaatatgtcatcttagacaatgacatatttacttaaaatatgttggcaccaaattgtttaccacgacattttttagtaggctttgaattcaagttgtgacctttaaaagctaaagcataatcatatcatctaggatctgaatattgtaccagatgttcattaactgtatcaagtacatatttacaaacagaactacatattagaacaaaaaaaaaccctaatttaaacagaaactgtaagtgaaagaattaggataaagaagacataccataaaatgctttaatttttaaaatcttaccctatttaaatcgtgggatgggggagttaactgagtgacatctggtggaggggctgaaagcaagttattaggataatccaagagatagcaaacaacacttgtatggccaccttttgctgcttctatcaacatagttgagccatcctaaaagagtgaatatggaaggggaaaaaaagtgaagaaaaataagttagtttacagaatcacttaggaagataaagccaacaggtcccagacgcattaaaatcataggtttggtaaagaacgcttcaagtgaaaaaggagaaaatttacacttagaatgccattatgaatggaacttgtacatgatatgttgtaacaatgaccaagagagaaatactaattcacaattctgcacaaacatttgagttacatactttcaaacggtgagtaggatctgccccatgagccaaaagtagttccaccactgccagatgaccccctgcacaagccagggacagtacagtatggtcattattagctgtggttctattcacattcgctcctaaaacagaaaaggcatggaaaatcatattagtagaatggtttttcttaaaattatggtaaatttaaaaatcatgaagagtagagaaaatagtattatgaggctccacatacccattaccgagctttaatgattataaacacaaggccaatctcatttcacaaatatcctacattaattctcctctcccatcttggattattctaaagtaaataaatcccagacaaacacgatataatttgaaaaggtttgagtatgcaccagtaaaagataccaaagtacccattactcctaatgtaataactgtattaaaagtaaaatatgaagttttatttgtattttaagttcttcagtagaaaagatgactgaataaaaataaactatactgccctctatgggctttatgtagagaataaacactaaatagaaagaatagtaccattttttttcccattagtaaattcctgacaaggaaaatagataattcacccctattcccaaataggaatgtatccctaatttattcgtttgttgttttcgtagaaatggggtcttgccatgcatgttacctaggctagtctcaaactcctaggctcaagtgatcctcccaccttggcctgccaaaatgctgaaattacaggcatgagccattgcacctgacctctatccctaatttggattactgtgctaggtaatgtgagaaatggaaataaaacagcagaaagaaactgaaatcaaactcattaaaattaaccaatgagaggggacagcgattatgtacataatgctatatattcataacagtattctaaagcatatcaccagtgcatgggaaaatgttgaaagtaatttcgccagtaagttatttcaaattttctttacctataaacaattataaacttgagatttcgttactattattataatgtgaagaaaatggtatattattgccttttaaaattgtatatggcctacatcttttttttgttttgagacaggttctcactctgtcaccctggctggagtgcagtggcacaatcatagctcactataatcttgaactcctgagcccaagtgcttctcctacctcagcctcccaactagctggcactacaggtgcaagccaccatgcccagctaattttttaattttttgtagagacagaatctcactgtgttgtccaggctagtcttgaactacaagactgaaaggaccctcctgactcgaggtcccaaagagctgagattacaagggtgagccaccacacctggcttcctctttcttttatcaatgcagaatcaaaaataaaatctgtaatctcttatacttaagaatatgatgaactctgaattgaaaactgtctcaactagaactttcctagtaagcacgttaagaaacaatttaaagaaagtaataatatactcccttttattttatttggtcattaaggtctttggtattcaaactaaaatttctgatcatgaatgaaaatcctcatgcaatttgctatatttgtcacatttctattgtgaacattttttgtactatatttataaccagctccctgtattttataaaaaaggaaacatagaagcagggaaatagtagaaatgttacttgccacaaacttttttagtggcagaaacatcataaaattccaggtttcaagaaagtgctatagtacatgaacacagcagagtttgttacctaaatcctcagtttttacacagagaaatttccctttcctttatacgtttcacaacaagtgtgctacttggtatgacaattatttctagtttgaagctggtctgtgcatggcaggatgtttatcaactatccactcaatcattaaatgtcagtagcatccctcctcatatgataccctcttgccttcaaaagacctttacccttaaatctctaaatgaaggcaggggtagatacctttcaaaaaaagacaactgttttatacaaacctacctttactaattaagaactgaacagtacaaacatgaccagctcttgcagctttcattaaaggagttcttccaccttcagattcatgttcctgtttaaaaaaaaaaaaaaagacttgacatttaattgccagtgaacaagtattctttttcatggaaatcaaaaggaaaataattggactgatttctgaatctaaatatttaaatataatgctttgaagcaaattaagaaatatacttttaaatttaaaaaaaatctcaaatcataaacatgttctatggaaataattttagtatatgtgctgccaaagtgagcactggaaataattttaaatttgaagttatagtcacgtgatcatgatgccctcatctaaacgcatctgagtaatttgtccttctctctacacaatgaattgcggtacttgaatatgcatgtatggtactctagcatggccttctccgaacaatcaatataatgagcattatcctcatccactccaagttattttcctcttatgagtgtatcccatctctatgaattttagtaagtacatcattaccatctctttacagacttcctattatctctagtttcccttatacaaaaatgataacaaacttttctaaaaccatcaactctaagatgttacaagagctttctgggtcccaaaaggatggagactctactgcatacttatgattactaagtaatcaagaacactactggtgaaattttcaatcttaaaaaaataaagatttgagaaaaagtatcttttgtatggcattttttatttctttttttaaaaagccttcacatctgatgaacaatttctgatttttctcttaagccatatcctaggtttttctaattgccatcaactaaccaagtactaaagatttcactgctgtatgtttcagagccattgtggcaaacactaggaatacagttcttacactgaagaagctctaagtctaacaagctcgaagcacttattatatacgttctattctagttagttgtgtgcttatgtctcccttgttagacttagtgctaacactaagtggccccagcaataatctaattcaacattctcttctcataaatgacaaaagaaagattaaattataaattattaagtttataaaattaattactgaaggggggcttgttgctgcctgcacatgaatttgtcataaactgtgaaggaaagagcacagttgcttattaatcttagaatctcggggccataaatatatgggtgcttacattttaactaaaatgggcctttggatgtcttattccttttaccccgcaggctagactggaagaccacctattctacccacacacagttgcttcatgctttcttacccctcaggcttcactcataacattttttccaattgaaatatctctttagccacaacactgccatatctatctttctaaactttagccatccccaaaataatacatcagatgactgctttaccttctgatcttctttactctgcattttcactacaacatctcttataataacctcagtatttgtcacctattattttttctgaaattataaagtacttgagggaaaagtttattatttatgttttaaactcttttattatttaataatgttctgaatattgtaggcataatttatttcctaagcaatactgaaattcctctaagccacatttgcctttttatatcaaatcagaaaagcttctaaaaatagttaatatctaagggaaaaccagtctgcattaatatctgtaacacaaaaatttcctttttctatggaaaatgagggataatgcagtgaataaccctattaaggatggacactaaacagtgtggaaaaaaatgtgactaagtgagagaaagaatggcaaaaaaataaaaataaaaaaaacaataaaactgaaggtaaagaaataccttttgtctagactctccataatttaaaattaatttcttattgttaaatattaagatttaaaaagtaacatagcttaccagatctgcgcctgcctgaagtaagacatctgctacatcagtatgaccattttcacaggcatatgttagtgctgtatcccctgttgctgttgttgcatgaacgttagctcctgtagtagtcaacaaataatacatagacttaataaaggagccataagacatatatgacgaaaataaaaacttcttctagataagtcatacctcctcaagttaaacaaattcaaacttcactcatttccagaaacagagaatattgtaggcattaaaaaaattacaaacaaaactggttgaaattaaagctgcagatacttcaaacagcagtaaggtaaactgttcagaatacatacaaaggtatatcacacgtttttttaaactcacacattcagtgtatcatagcatcataaaaatatttgcattatgacatttttacttaaacaaatcatgtaaaaaacttctcccaaatgcaaaaatgcctacctgcagctaataagtatttaactaactccaaatgaccctcttgagcagcttccattaaaggggtagaacaccctagttctatatcggctcctgccttaattagaaagtctgccacttccagaaagcctccacagcaagccagagtcaaggcagtttcttgagtttcttctgtctgtgcattgatatttgctcctaaaataaagattctaattatttaaagaaagtcattaacttattccagagatatgaaaaacatgattgtttcttaataaactgaatctttaaaatgaacatttatattactataataaataagaaagtgcctctctcctaactcctaaggcagttaaaactaaaaataaataaaactattaaaatcacacccagatttgatgtaccacagctggagtaatatttactcagccagaaggtacaagtcgggtgataaaagaactcaaaaaaataagctacatcctctcattatagtgattcaaaaatgataaagatactggtgataatgatgatgatgatgataataaaaatcttaacattcaataagctctatttcccaggcaatatcaaagcattttacaacttatttaggtattattattattattattagttccattttacagctaaggaaactgaggttatttaacttatacaaggtcacaacattattgtcatcaatactaccaccatcactatagctagcacttaacaggcactacatgacaagcactgttctattagctttatacacacgtattaactatcacaacaaccctacacgagaaaactgaggcacagaaggttagaaacttgcctaaagttacaaaattggcaagcagtggagttatgattcaacctaagaagtctgctccaaaacctacgctttaaaaatcatagtcaacattacttctaaataaaaacaaaagttttttttaaaagtgtcattcctcttaaatttgtccagacaaaaactttactactgaaagaaaaataaaatcacactacaaatacagagatgggagattacttctaaactgaagatatcttaacatattgaagtaattgtttcacttttcccaaaaaagaagtttatgtactgagccccttggcagcttctaatatgtgcgcattcttgcactctcagcaagttagtctttactgcgtggtttcccatactgttttttaaaacattagatctattaaatacttattagtaggtattccgcccccaaaggaatacattctcttgatctattacctttagaaatgttggctcttatattcccctatttaactcacaagccttgccaacaccagttctgtttttcgttcacatatagcacatgatgtctctgaaagctctatatgaaagaagtttctttgattttgttttaacacagtatgggagccattttcacagtaaatactttatcactggtttgtgtaatagctcattgcaactctactagaaaggtgaaatactaaaatccaattttataaaattatactcttaggttttacacatttatactttagtgtcttgatagatacggttaccttgaccaagaagtaatgccaccatttcttcatgtccttctcgagctgcttccatcaatggtgtataaccttcatcattgacctcttccaggctagctcctctttcaataagtaaagccgcaagttccacatgcccaccacatgcagccaaagttaatggtgactcaaatgaatcagcaggcatgttcacttgggcaccgctgtcaagaagtaacctagctacttcaacatggccatcctaatgataatacaatttaaaaaattaaatcagcaccattaaaaaaatcttgaaaaatttgaagacttctcaattactatacaatgaagtttatctatctccactcaaaaaggaatagagctacatttaacagttgagtaaatcagtatttattatgcactgcctatattctgttaacatagaagagggaaatagagattgaaaatataaaataagtagaaacatgataccttcaatcaagaagcttattaaccattagaaaaaaaaacagtaagtatgtgaaataagagactatagtgagacatcaacactatatggtacaaacttaaatgttaaaaggataaagtttagagaggaaaagaagaattttcataagaatctttaaggataagcaaacttttgattagttagaaaaaaatggaaccctttttggagaagtgggggaaggatacatgctgtgttaggggaacacaaatgcgtacatggtactttctatattgttcatcgtccaagtaccagtgaaattaagaaaagggccaggtgtggtggctcacgcctgtaatctcaggactttgggtggctgaggagagaggattgcttgagcccaggagtttgagccaggcctgggcaaaatggtgagatcccatttctacaaaaaatacaaaaattagccaggcgtggtggtgtgcacttcgtcccagctactcaagaggctgaggagggaggatcatttgagctcaggaagttgaggctatagtgagctatgatcatgcgactgcactccagcctgggaacagagtgagaccctgtctcaaaaatgaattaaaaaagaaaagaaaattctatattctgtcttctggtcactttttcccactgctttcctaattactggcaacttcaaggccctcttttcccttctttttgtccttcagtaatttttttccatctatatgttatctcccagacatattctttcaaacatgccatgcctatttttgcctctatgcttgtcacattacacaattttaatggcttactacttttttttctatttcaatttgtagagaagactctaatgtcttattagtttgattactttgctatttcttcagtgctgaatcttcttcctcgatagcgaactcccacatttcctttaaatcctagtttaaaaactcagtattatagcaagtctttcaaatgtctggcccctactaatatctttcacttataatatttacttccagtgcatgttggctagacctacagattattccattttaatttcttaatctacacacaggccatttcctcagtagggggtggcaagaatgtttaaatttccttatcatggggaacttttaaaactgttactgttaatactattaatgtgttttatgcccattatctcatttaatcctcacaactccagagaaagatattttcctcattttacagatgaagaactcaaaagcttagaaaaacttttatttgttaaaaaaaaataatttgctaaagcaaacactaagatggcaataaggaaaacaacagataactcaagtcttaaatggctacctcatattttaaaaaatagtaaataaaatttaacatcctttcaataattactctctgaagggaagatgagacaagaaacttcagattctttgggggccctttctaccgctggcctgttctcctcataaatttttctatgatattttggcccatttctgtgtcataaataaacaaagatacaaaggtttaagagtactgttatgagccattcccgaatacaaactctaaaatgcagctcttcaaaagacaatctagggctcagaaaagacctcgagagaggggaaattatgtaacataaattaggccctacttttaaatttttgtttagtcaatttattggtttgaggtatgttatgcttattaataatgtacatactctgaattatatttccttttttctttttttaacatttttttaaatagagagggggtcttggtatgttggccaggctggtcttgaactgctggcatccattttaatttgttaatccaatcctcccaccttggtctcccaaaatgccgagattacagtcataagccaccatgcctggccatattttcctatttcatatcctcaaccaatctttacaagagtgactttggtatagttatatgagactaagaaaatgcaggtagcattgtaaagcttcagaaagtaactttaatagaagttaatgttgtacaactgattcaataaggttctgacaaacagaatcatagcacccattggaaaggcattcattgtatactactctgtctctccctggttaatatataaacatatttgacatatttcaccaatcttaccatgcaagcctccatcagagcagtgtgcatttcatctgttttatgctcttgatccgcgcctgcttccaaaagaaatcgcaccatctctaagtgtcctaaaccaaaagtgtacaagattacttgaaaatattttattattccaaaatattttttaaaattataatattttgaaaagttatatttaacttacagcattaaatttataagcataataaagtcaactagaagccaccctcaattgtagaacacaaattatacaagtgatcttgctgttctaccccttaccctactgccctataaactgctgcttctagagtccctgctagaggtgaacaaagatgccattaaaatccaacacccaaaatgttccctctacaaccttttaagagcccaggcatgttatatagttatgttatatatgctacggaataaatcagttttcatgaactagtagcctgagataatgatcagtcaagttatttctgtgagaaaatgtatttaaagttccaatacctaactcagaaacactttaggaaaaacctgcttataaactgggaactgtatgtataaaaatattcttcaaaccacaccatttaatttatatttatatatttaattataatataaacatgtacacacattaatgcagtttcaaataaaccatatgcttcagttcatttaaagatacaagtggttaaaaagcagacgacaaattataatttaaaaaagacttcagatcctatgcaaaaaacaatagaaaaattatttaattttttccagctttatttggaatgagctacaatcaattcttattcaactgggaggcgggagaaggacagatagtggagtcacaggtaaacaattaaacaaaatttacttccataagtaagtgtagtatctgccgcgtcttatatttgtcaactacctaccatcccttttcctctctgtcattctcccctccccaaaatccacattagtgctcagtctcagcctgacttgtctctcttccctaactcctccttgtcagtctatatcctacaaaacctcaccagaaggagaggaagggaagggggtccatggatacctggaagtagcagagatgttctccaccagctcagtttgctatccagcttctaattaaagcctgcaagccccaacctcagatcccccttttggatagcagggtggggctacaagcaaaggcgagagggcagagtagttacaagcagccccatctcaaagctctctagccagcagggactcagtagtgaaatgcagccagtactgggttcaaaagtatttgtgagaaggggagagagccacccaatcaacccactccaaggcttacctcctctcctcccagtgaagatcagcctctgcctaattataaacaggattggggaagggaactaagggacctcagctgtgctccctatctgaaaatctattaacatcagataatcaaaagcactttataaataaaccatatttttcaaatttaagttaaattttagtcaattaatccaaatatataaggattattttcatgtttataaatgaaattattccaaaaggcatcatacaaccttggctactcttatatagaacaaaacaacaccagggccagaactagggtgaggaaatcaaagtgctgggtgcaaaatttaaggagccactcacatgtaagcttgtgcaagtgaaaggttagtcactgagaatgagtgcctccttaaattttttactaggttttgcaaaagctttttcttgatgcctaggggtcaagaatttatgacgtaaataatatgggacaactatatagacagatgacataaaacacagaaatgagtggctaaacacaaaattgtatgactttttttaataaaaaacttccttaataaaaaattttcttaatttactttcttaaaaagtaaaacaccttactttacagccatttatctgtcatacatgtggagtctaaaaaatgttcagctctgtggctgtgttttaacaatctagaatatagaacattaattatctacagacaaaatatctttctaggcaattgtccggtctgccaaaggagggcattttctgtactatcaatattttcaggttcattgacatcatttaaaataccatgtaccccttcataccaagcaaaatcttcccaacatgcaaagctattatacagttcatattaaaagaactgtttctgataaaacaattagatcaattaatactcatttttcagtgacaatatttatagttaaatctatattttaaaaatttaaatagtaaacaaactgcaacactgcaaacacttatttaacctttaattacatactatatactatcattgttttattttttaacttagaaacaagattacataaaataattataatttcacatatttaaaaactttgttttaagaaaggtttatactgtacctttgtaacaagctaaggtaagggcactctctttaaattcattagaatgcgtattaatgccagccccattttctagcagcaatctggctacttccacatgtccagcacttccagcttccataagaggggtatgaccattttcattatggtcctcaatactagcaccggattccaagagcacctttacaacatctacatagcctccagcacaagcatatgtaagtgctgtattgcctattttaattaggaaaaataaaaagacattaacataaaataccaaaataaattaaagtgctaatttacattaagaaaatggaaacagaagactacaaccataataaatattaaattacatatacatatatgtaaatatatatctatatataaaattcctttcctactgcattttatctttctgaaatcaactccctattctccttttccatttaaaaccaaagtcaaatacatgtggaaaatcatatacacttatccagactggggagttgtaaaagaactgggcaactctgccccagagctaagttttaccttaagatgagaaaaaagttgttttaatgtttatcagagaaatgcttcacaagcttttttttaattttaatgtttctaacctaaaattactcatcatatacatactttatactataccttttaatcatatatgttttcattacaacttcaaataccagttaactgatcaaattcaaatttctaaatttgaatttgaattcaataatttctaaaacattcttttctgctgataaaaatttcccatgttacaagaaaaatcaaccttctgggtaaaataagaatttctaaaaatcccttcaaatcagaacatgaccttaaaaaacatttaataacgggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcatagtggcaggcgcctgtagtcccagctacttgggaggctgaggcaggagaatggcgtgaacccgggaggcggagcttgcagtgagccgagatcccgccactgcactccagcctgggtgacagagcgagactccgtctcaaaaaaaaaaaaaaaaaatttaataaatttgaaaaatctgaatgaaggaaatgcacaaaatatttccatgaaattttagaatttttacacaaatctatctaggcccaaatttgaaaaaaatatatattttagactaaagttatgctcttcttcaggacacaatgttttcacaatatttttttctgtgggccacaatttagtaacagtaggaaacaatgaactatccttttgttccacaattgtttggtctccctatcttcccattcctctcctaaaaaactggaaacatggatttgagcactacggcccacacctctcaatttccaagagagtggtccatctaactgggtcagtgttttacttttatcttaaagaatcttaaaaggccaattgccctcataaacaaaacaggaagaatatcatttgaaatatattctatatacttcaaaactcatacacagatgtgtgagaatatgtagcacttctaataagagaactgaaaaattagcactaaacatcactttcatgcaaaatcattattaccaaatgatgttactatgtagtaaaactgaaaaagaaataggcatgacctgttgaagactgtgcattaacatctgctttatgagctagcagcaacttcacaattttgacatgtcctccattagcagcagccattaaaggtgtaatgtcacctttgattcccctatcttccacatttgcatgcattgccaacaaaaccttatgagagaaaaatagtttaaaaagatattaggaaataatcgtcaaaaaattttgaacacgtatttatataacgtctacctagtcatagtaaaagagctataagcacacaaaatttatctaacaaaactatttgttgaaataatcctaatggttggaaggatttattttattatttccttagtaagcaagccagtttttaaaaaaacaacaaataagctttattttgataatacgaacctgtgcaagctcatagtatccagcagaacaagctaaacaaaggaggctctccccttcctctgtgtgttcatttacacttcgcccttcaatgagtaactttcgcacagcatttacatctccttctgaacaggcttctgccaaactgcggctattacggaaagaatatcacaataccagaatataagaatattaaaaaattgcacagcataaatattgtttttgattgttttgttttttgttgtttagaaacggagtcttgctctgtcacccaggagggggtacagtgatgcaatcagctcactgcagccttaaactcctggcctcaagcaatcctcctgcttcagactctcaaagcactaggattacagatgtgaacaaccacacccagccagagtattggatttttatgtcaaatcttgacagttaatatggtttggctctgtgtccccacccaaatctcatgttaaattgtaatcaccggtgttggggaagggacctggtgggagatgattagatcatgggggtggatttctcccttgctgttctcatgataatgagtgagttctcatgatatctgtttgtttaaaagtgtgtagcactacccactttgctctctctctctctcctactgcgccatggtaagacatgcttgcttcccctctctctctcctgctgtgccatggtaagacatgcttgcttcccctttgccttccaccatgattgtaagttttctgagacctcctcgctatgcttcctgtacagcctgtggaactgtgagtcaattaaacctcttttcttcataaattatccagtctcaggtagttctttatagcagagtgagaacagactaatgctaacattagtgctcaacaaggatgattatttcaatatgattcataacaaaaaggcaaaaatgattgaattcattgagttttttacaatctacatattaatggcactgaattaaaattatcaatattccaaaatgttttcagttatgcaactgaaggataaagtctaatttactggtaagtggagaaagaacataaaattttaaaacataaaagtttatagaaatcacatacaaataacaggtcataattatacttcttttgttcggtcagtagaaaattttttataaaatttaattaaaaagtataaaatgtgcaaaacttccactaattataaagatctatgtgagtccttccatcaagtaaagggaaatcagacggaaaagatgggagaatgtaatattaataaatgaataactgatgagccttttttggttttggttttgaaagtatttacttatacaatcaaatttggggggaagtttcaaatccaggcaaagaaaaagctaaactcaagcaaaatgagagtggaaaaagtggagtaacaaaaaattaaactgagagaaaagtgtatgccccataaacttcccaaaacaattccaattgtagacatttctaaagattctcactttcgtataaaataatcctaaaactaaatccagggctattaatattctttttatttcaaatataactcaattattttattatcctcttaaaatatggccctttcatttcagatactaaaggcacctacagataatcacttttctatagccctgttattaccatcagccagatttaagaccaacatctttgtctcagatatggcaaagcctcctaaccagtctccttgccttcacactacttgctctccttcaggctcttttcaacaaggcaaccagagagatctttttaaaagaaaagtagaacacgtccgccgggcacagtggctcacgcctgtaatcccagcactttgggaggccgaggcgggcggatcatgaggtcaggagatcgagaccatcctggctaacacggtgaaaccctgtctctactaaaaatacaaaaaaaaattagccgggcatggcagcgtggcctatagtcccagctacttgggaggctgaggcaggagaatcacttgaacccaggaggtggaggttgcagtgagccaggatcacaccactgcactccagtctgtgtgacagagtgagactccatcttgaaggaaagaaaggaaggaaagaaggagagaaagaaagaaggagaaagaaagaaaggaagaaaaagaaagaaagaaagaaagaaagaaagaaagaaagagagagaaagaaagaaagaaaagtagaacatgtcattcctctactcagaaccctccactggcctataatctcactcacagtaaaagctgaaatccttacaagatctgcctagtggcaggataccatattcctcttcccttttacttctctggctttatctcctaccctctcacccttattccttccactttggccacattggtcttcttgctgttcatcaaatatgctaaataagctccaacctccaaatatttgcatttgctgttcctgtgccaagacagctcctctctcagacatggctcactcccttccctatttcaggtctttcctagaaagccaccattttaagtgaggacttctctgaccacgctattaaaaaatgtaatatgacctctgctatggtttgcatatttgtcctctccaaaactcatgtgaaatttaaccccaaatgtggcaatactgataggtaaggcctttaagaggtgactgagtcatgggggctttgtcttcatgaatcggttaatccattcatgaattaatggattaatgggtaaatgaactattacttatcatggagtgagactgggtaggctttataaaaggaagagaaacctgaactagcacacttagcctacttgccatgtgatggcctgtgctgcctcagggctctgcacagagtccctgccagcaagaaggctctcaccagatgcagccccttgaccatggacttctcagcctccataattgtaagaaataaattccttttcttgcccagtttcaggaatcctgttacacgcaacagaaaatgaaccaagatgacctccaacccaaacactgtcttagcacttccctttcaatttttcccatagttatattattatgtgcaatactatatattttatttacatgttaattgtattgtccccttaccaaagtgaaagtctcgaccagtactaaataaatttgtcttttaaacatctcttctgatttcccatttcacaggacactgacagtccctagactcaatgctatcatttttaagcatgtttagaacaaatccttcccataagacatttcctgtataagagcataccttttctctctttcaaagtagtctctctctgtctctttcacttctttatgcatataccctaatttacattatcatttgaatttttcattcaatttccatgtgtgtataccagcttgaaaacaaccttacaggatctactctagcaacagctgaacttaagaacttgtgggcgaagggcatattaagcctggcacatggcactgtccttaactaatataaaaatgtggcacatagtactcactgcacttaagtccaccatctttctcaaactttgttgaataaatataattctcacaaatatgttctattttttttgctgttaaattccagtattttcaatgcaaaatcatttgtgactttatttttctattctatttcctgcttgaactggttttagtatacccttcaaggtgttttaattctttctcttgccaatcttagtaggcaccacattaaaaaatatttggagattaccaatgatattgtaggctagtaaaactgaacatttactatggaatagaaaccgaggttaactaaagaagggagtcagtcaacctatgagaagaatggtaaagcaagttaatacaaacacaaaaatctagatgaatgaacactaataaagagccaagagaaacagcaaattcatgaccttgttaatactatctaacctctcttttatgctcttaaaaatgttgtatgaaaacaccattagacaacaaagaattcttaaatgctataatttactctctaaacccaaatagaatattcagatgttctcaattgttttaaggcaattgctaaaataaataaaatggcttcattttattagaggaggcaaaaagaagccaccaacggttgaaaatggtaacatgtattaatgattcttttctagttgcttccttgaagtatctatccatttttcttatcactttttttttttttttttttttttttgagatggagtttcgctcttgttgcccaggctaaagtgcaatggcgcaatctcggctcactgcaacctctgcctcccaggttcaagcgattctcccgcctcagcctcccgagtagcggggattgcaggcgtgcgccaccacacccggctaatttttgtgttcttagtagagacagggtttctccatgttgctcaggctggtcttgaactcctgacctcaggtgatccgcccgcctcggcctccaaagtgctgagattacaggcgtgagctaccatgcctggcttccatttttcaatatacatccataattgtgtttatatatgagatggtgtgatttttattggataacatcatcagaacagcttaaaatgccatgtcacaaaacatttactgagtccttactaactgtaaagtgctatctatatacaaggaattataggatataaaaaaataaagtccctggactcacattcaagttataggaactagatctataacttcttttaagacttcagaaagcaaataaataaataaaaagccttactctttaaaatggtcagaactacgcaaatgaactgtaaaatggcctaattgtaaaacatttacttctttgtcaccaatacatttttaaaaaaaatctaaataagcaaaaagtcttttataacatattgactaggccatcagccttgcagtcggaaagacactggtgctctgccacttattatctatttgatcttgattaagttactcatctctctttaacttttcatctgtaaaatgggagtaaaaacaaaatctataccttataaagtttttgtgaatctaaataagacatcacatgttaagtggttagcacagtgccagccaggcacaaaataaatgctcagtaaatgttagctatttgttattatttttaagaaaatgatttcatactgatggcagcaaaaatgtacttacttgtccgactgccctgcatttgctgtgctttcagctctcatacgggtaagtgcagcagcagcttcatccaacgcacaactaacagacgatgtcaacctccgaagtacttcaggatctgcaaaggctttaccatcagccgtggacaattttcctattcctattatattattttcacaccaatatggacacacccaaaaggagaaacaaagcaaaattcaagttacttaaagctatactgtgtatgttaacaaataacctccaaatggtagagtagacatatatattggctgcccagcatcttttgagaaatcactcttctccagttttctaataatcttattcattccatgtggttcataggtacttgatcctgtgaccctctggtgccagaaacgggtctttggcctatgatgggacaattagactctgtcatatctctgaaagaacgtatattcaaaggttgctaaattggtaagatgtgagtcataagctatttagccacttttgtcaccacatacagaaaaagactgcccaaaataaagtcaacatagaggagaacagagacacagaaagagaaggggacagagtcctgataaaattatttttaactcattgacgccagtagtgccagaagctagcaccatctctatgatttgggaaatgtctacattttattttttttaatttatatatatttcttttcgagacagggtcttattctgtcacccaagctggagtacggtggcatgatcatagctcactgcagtcatgaactcttgggctcaagtgatccgcccaactcagcctcccagtagctggaattataggctcacaccaccacactaggctgatttttctctctctctttttttttttttttagacagggtcttgctctgttacccaggctgggtgcatgccacgattacagtttactgcagcctcagcgtcctgggttcaaaatcttcctgcctcaggctcccaagtagctgggactacaggtgtgcactaccatgcttggctaattattttactttttggaggaatcagggtcccactacattgcccaggctggtctcgaactcctgggcataaggaatcctccggcctcagcatgccaaagtactgggattataggtgtgagccaccgcagcaggacacccagctaatttttaaactttcttgtagaggtagagtctcatttatgttgtgtagggtagtttagatctcctagtctcaagtgatcctcccacttcagcctcccaaagtgctcccaattacaggtgtaaactacttcatcgggccaatgtctatttttgcttaagaatgtttactgggctatcatctgtgaacaaaatatggcctaaaaaggcattctagactatatataaaagataagctataaatgagttatgtctacaacttatcacatatacttaaaatcatctgaaagtactaatctgaaaaccattcagaactgcaaaattaaaaaaaaaattcaaaagcagagatggttagtaaccatctatatgaaacctaactgttgctctttcagatatccctataaagcatgcagcattcttacccctaacctttattattttaattcagtggtgcttaatccaagctgcccatcagcatcacttgtggtgcttttttgttttgtttttgtttttgtttttgttttaagataggatctcacctggttgcccaagctgaagtacagtggcatgatcatggttcactgcagcctcgacctcccgggctcaagtgatcccccactttggcctcttaagcacctgcgaccacaggcgcatgtcaccatgcctggctaattgcttttttttttttttttgttagagacagggtctcactatgttgcccaagctggtcttgaactcctagtttaagtgatccacatgccttggcctcccaaagggctaggtttacacgtgtgatccagccccctgtagtggttttcaaatatatagatgctgaggttttctacatctggggatccaattcagtaagtagaaagcagggcctggcacctacatattttaaaggctctaaggcaattctgataaacagctaggattaaaaacctttacctctaatgttatgatggatattacagaaccctgctatccaacatgtggtccactgaatagaagcactgctatcgcttgggagcttgtcagaaatgcagaatctcaggccctacgatgtactgatccaaaacctgcattttaaaaaagatccccatatgattccaatgcacattaaagaaaggctattataggttttacaacaaactagttaactaagaaacaaaaaggaccactcacttggtaataaatatatctgcacagataagtatgtaacagtgaaaggtgttcaataatatcacataagtttcatgtttaaagttttgaaagtgtatacttttacagtgcactttataataaaataggcagcctagattaagcaccgagttagaataaaaaggttaggggtaagcatgctttatagcgatatctgcaaaagcaacaattaggtttcatacaggtggttattaaccatctctgcctttaaaatattttttttctgttgccgtcctgaatgatttttagattagtacttttagatatatttttatgcttttctttaataaaaaaactaacatagcaaatgttatatctcacaaaaccaaaaataaatctgccaagaagcctttatgattatagccataaaaaaatgttcagagtagtcaaatttcatatctgctacagttaagatgtataaagaataaaaactgtcttggtctgataagactgatacctactgtataatttatgtcactaatattaaaagtcatactatattctgaatctactacaatatttaatagatcatctttcggttaaatatatgaaggcactattgagatcaacatcacagaagaatttccacatgaaaaaaattagctccaatttttcagccatctgagatcactatataacaaatatttgtcagtgatagcaacagcaactaggcaagaggacagatctggctcagtaaaaactaaccactgttttaaaaaaatctcactttaaatctttatgaacttcttgtatcttcataagtaaagataactattttaataaatgtaactaggaagaaaccaaagacatagatggtaacctttcaaattaattagcagtaatcaaaaattaatttattctagctaccctgaattatggtgattcttttttttctggtcttatccagctattgaatattaaagtgaagatcgaaaaacagaaaagagctgggtgtggtggcttacgcctgtaatcctactacttggcgggtggatttcctgagctcaggagttggagatcagcctgggcaacatggtgaaaccccgtctctactaaaaatacacaaaattagctggacatggtggcatgcgcctatagtcccagctacttgggaggctgaggcaggagaatcacttgaacccgggaggtgaaggttgcagtgagccaagattgtgccactgcactccaggctgggcgacaaaatgagactctctccaaaggaaaaaaaaaaaaagaacaaaatgaccagattattatttccaaatgctctcatttaatcaattgaacaacaaaaccatagaaattcagatagagggcacattaaaatattatttatattattattttataataaaattattaatattactaacactattaaacttattaaatattatctgattttaagataattgaatgcgtaattatgttcctctcagaacttactcagagggctaaaatgcaagagaaattccatctatggtaaaactaggaaaaatctgtatataagctgaatatataagctaaaatgtataaagacaaagtaaaccagagaactaactaacttatagaacagaataaactgaaacaccactatcaaaagagaaacagaccattagcccaacaggagtcaggtatgagatgtaccagatacaggggtgaggctttggttagaaaaaagggagaccagctgaacacttgtgaggagtaatcagacacaagttttcattgccaaactaaacagccaggtgattattctctaaagaaaccaaactagaaaggccctggactaggagacatcaggtatacaggaggatgacatgaagtactacataaaagcattaagtgaaagtttacatgataagtagtgaaatcctcagccccattcccactgtcagctcccactgtcagaattatggtagctgggttaattattcagaagacaaacactggcaggtgtgtgtctaataaaatgatcctaaggttacccgtccctgatgtacacatcctacaaccttgggactgtgaatttgacagattttactcccaaaattaagttacgttatatagcattgttgacctaaagacagcgaggttatcctggtgggcctgacccaatcaaatgagcttgtgaaaggcagagatttctttggctggttggagataaggaagtcagagattaaaagcacaagaaggattctacttgccactgctgacttaaagatggagggtgccacatgtcaaagaatgtgggcaaccttatggagatgacagcccataaaaaaaatcaggatcttggttctacaattgcaaggaactaaattctgctaccaataacaataaatttggaagtaaatgttcacccacagcctacagataaggaacataggatagctgatatcagccttgagaccataagcaagagaatccagccacactgtccccagatgtctggctcacagaaatttaagagataataagtgggcgttgtttcacaccactatatttatagtaaattgttatgctgcaatagaaaactaatccatgctgtacagtgaaatgaaccaacaaaacatgcatccagactttccaatttagctttttatggcattgctatagactaaaaacagaacccaaggatcaccagacatctgaagaaaatcttaaatatgaaaagccaaccaaagtattgaaaatgagactgaaattttataatgccaaaattataaagctttggggaaggagaatagggacaagtggtacagagacagggtaagtcataaataagtttggcaacaccagaagtttagtaactttaaaggtctgagagtggttttttaaactggaactctatacctagctaaactatcaagtatgaggatagtaagaaaggcattttcagacagtctaaaaaattttacctctcaagcatcctttctcaagaaatatattggatacctaaaccttgttcaatctcaacatcacaaaaagagaagcaaccagacagtgcctatgtgatacataaggaaacacacagcattatgaatgactattcttgtcaaaatcagaataaatctgaatctgatcaagtatctggatctaaaataggaaatacaacacacagaagcacaactggcaaaatccataaagtgagagaaatgactatttcttcaacaaataaatagaaaaaaaaaaaagaggaactgttatgattaaacttaaaacaattttttttaatttttaatttcatgggtacatagtatgtgtatatatttaagaaaaataattaacattaaaactatgtaaacctggtttggatcctgatttaaaccaactgtaaaaagacagaaaataattgaagaaatctcaacattgacaggatactggcaatattaaggaattacttttttttcctttaaatctgaaatagtattatggctatatttctttttaaacactcttaatttacagatacatactaaaatatttatatatatgaaatggtatggtgcttagatttgctttaaattaacataggtggcaatgtcagcaaggtggtaataggcagatatgaaaaaagactgcctgtacactgaaggctgctgaagctggatgatggataaacatacacaggtttcattacgctattctcttagatttgtatgtgagaatttccatttaaaaagggaaggaaataaaggagtgagggagaggaaaagtgaaagagaggtggagaaagaaagaaagggaagtagggggaaggctagcttgttagctaccataaagaaaatataaaaaatagaaataattacacaacttagaaaaatgaagcaactatttgcatcgtatgaaaaggtatcttatctccaaaaatcagcttttatgtaaaatctacttccgtgtaacatctttgaatcttcttgtgcctcttggggccacagaaaacaaatctatatgacagtctcttaagcatttgaagaacactttattcaacctgagtcttcttgtcttcaggagaaacattccctgctcctctgaggtatatttttaaataatttcataatctgcatttctctctcataaacttctagagcaatgtcaaattgccggaaaatgctaaattaggtctctactcttctgtacaaatagttttctttactccaagacaggaccgtgcacatgccctgattatgtttccaagtctatttggttaagatccttttaataatccattctagaattttaccttggatggaaatcaagtttaaccatgaatccttcaaatatttaaataccggttgggcacagtggctcaagtctgtaatcccagcactttgggaggctgaggtgggtggatcacgaggtcaggagatcgacaccatcctggctaacgcagcgaaaccccgtctgtactaaaaatacaaaaaattagccaggcatggtggcagacgcctgtagtcccagctacagcaggaggctgaagcaggagaatgccatgaacccgggaggcggagcttgcagtgagccaagatcccaccactgtactccagcctgggggagagtgagactccgtctcaaaaaaaaattaaaaaaaaaaaatttactgtattacaagatgtttactgaaagcattattgaacagtattaggtcagttttatgctataataaagtagcagtttacatgcattgcatgtataataggtagtgcactggggttcttaaaccatgaacaattagtgttcatagtgtatttatgtctactttacaaaacctaagaaaacatcatgtctttaaaatgattatagagatttcattatcactgccttatatttaagatatgatatatagtgctaaatatttgattgtgtgtgtgtatatatatatacactcctcaattaaaacattgttcctatggggataatataatgatccacttcacaaaaataccacgatgattcacatgaggtttcagcctacagtctctaacaaacaagtggggaaaattatatattgtcaattctcattattcagttattcacagtagttatgttaagtcgctagaaacacggaattagcaaatactacactcaaccactgctcctgggagaaatatagcgttagccagcccctggccacagcattgtcattaatgcacataaccctgttttacgtgtgtttctgtttaaatgtacgttttttgtgtgtgtccttccaacttttattttaggtacagcgggtatacatgcaagttggttatgtgggtaaactgcatgttgtgggggttcagggtacagattatttcatcaccgaggtaatgagcatagtatctgataagtaacttttcaatcctcaccttcctcccattctcaagtaggccctggtgcctattgttcccttcttagtgtccatgtgtactcaatgttcagctcccacttataagtaataacgtggcatttgtttttttgttcctgcgttaattcacttaggataatgggctccagctgcatccatgttgctgcaaaggacatgattttattcttttttatggctgcatggtattccatgatgtaaaatataacttatttaatatatgttgttgattcattaacattgaactcacagccaacagcagtaaaactcatgcctgaacctaaaacatgtttttcccaaaaggcacatcacagcattctcacacttaggaacactagacagcactatgcttgggcgccattttaaacagtgagtgggagggactgtacatcatggtttgagtgccagctaagacacagtacaatagaatatcagacagatttctaaggtttttgacctcagtccctggctcccagatggcatctctagaccaactcagggcctaggggaactagccaccctgaagggaaaaaaaaaagtctggctggcttcaccactgagatagatggagtaagatggctgaaaagggggctctagtgatctccccacccctccccaagtttggcaactatctacacaaagtgagcatcttcataagaacccaaaatcaggtgagcacacacagtgcctggttttgacttcgcattgctgaaataggcattaaagagggtagaaaagacagttttgaattgccaatgacacccctccctaatcccctagcagctccccacatggtgcaaagaactgtgcaactgtaagacggagagcatagcaactgtgagcctttgcattgaactcagtgctgcccggtcacagcggagagcagaaacaggctgaactcagctgatgcctgctcgtggagggagcttttggaccaggcatagccgcaaggaaattgtccatcccagcagtccaaatttgacttccagcaagccctgtcaacacgggctgcagtgttctggggccctaagtgaagctgaggggcagtctaagtcacaggactgcaattcctaggcaagtcctagtgccaagatggacttggagtcactggactggggatggggagcaggcaacttcctgagccaccacttgggtggctaagggagtgcttgagtcacccctctcccaacttcaggcagcacagcttaaggctccaaaagagaccccttccttctgcttgagagaaaagagcagagacaacttggtcttgcatcttggatacaagcttagccacagtaggatagggcaccagtcagattcgtgaggccccccattccagaccctagctcctggacaatctttctacacacaccctgtgccagaagggaacctgctcccttgaagaaaagaacccacccctggaaggatccatcacctactgactaaagagcccttgggccctgaagaaccagcagcgacacccaagtagtatgccacctgccttggttgagattctgagatgtgctggcttcatgtgagaaccagcacattcccagctatggtggcaacagtgacagcacagttggggtcggggggcggggggctgttaagtagaaagtggactctcggggtctcctattccaaggcttggcacttagatgacatttctggagctgtcctgggagagagggggcccactgttctgaagggtgagtctcaggcctggcagctttcatcacaagctgactgaagagcccttgggctttaactgcacattggcggtagcctggcagtactccctgtgggcctctggtggtgacggccatgggctgagactccttacctgtggaaagaggaagagtgggaaggactgtatatcgtggtttgagtgccagcaaagatacagtacaatagaccctcattagatagatttctaaggtttttgacctcagttcctggctcccagatggcatctatgaatcagctcagggcctaggggaacctgccatcctgaaggggaaaaaaacaagtctggctggctttgccacctgctgactatagagccctagggccttcagcaaacataggtggtagccaggtagcagtcacaacgggcattgagtgagacccagtgctctgctggcttcaagtctcacctagtacagtcccagtggtggtgaccacaggggtacttgtgtcaccccaaccccagctccacatggctcagaggggggagagagagagagagagagagagagagagagagagagagagagactgagactccatttgtttgggagaaagaaaagagaagaagagtctctacttggtaatccagataattcttctagatcttaaataaaaccaccaaggtggtacctctatgaatccataaaaaatcatagcgatactgggattggggtgcaccccaatgcagacatggcttagatcacaatacccaagtcccttcgactacttagaaagccttccaaagaaggacaggtacaaacaagtgcagactgtgaagactataataaatacctaattcttcaatgcccagacaccaacaaacatctgcaaggatcacgaccatcagaaaacatgacctcaccaaatgaactatataaggcaccagggaccaattctggagaaacacagatatgtgacctttcagaaagaaaaatcaaaacagtattgaggacactcaaagaaattaaagataacacagagaaggaattcagaattctatcagataaatttaacgaagagactgaaataactgaaaagaatcaagcagcaatattggagctgaaaaatgcaacagacacagtgaagaatgcatcagagtctcttaatagcagaattgatcaagcggaagaaagaattagtgagcttgcagacaggctatttgaaaatacacagttgaaggagacaaagaaaagaataaaaaagaatgaagcatgcctacaagatccagaaaacagcctcaaaatggcaaatctaaaagttattggccttaaagaggaggtaaagaaagtgataggggtagaaagtttataaggtaaaggtatagtaacagagaacttcccaaacctagagaaagataccaatatttaagtacaagaaggttacagaacaccaagcagatttaacccaaagaagactaccccaaggcacttaataatcaaacttccaaaggtcaaggaggtaaggatcctaaaagcagcaagacaaaaagacacaaataaaatacaatggggctccaatacatctagcagcagacttttcagtggaaaccttacagcccaggagagagtggcatgacataaagtactgaaggcaaaaaaattttatcctataatagtacatctggcaaatatatcccttaaacatgaaggagaaagagggactttcccagacaaaagctgagagatttcatcatcgccacttctgtcctacaagaaacactaaagagatttctttaatcagaaagaaaagaatgttaatgagcaaaaagaaatcatctgaaggtaccaaactgactgataatattaactacagagaatattataacactgtacctgtggtgtgttaacgcttaccttaagtagaagcactgaaagattaacaaatcaaaaataataactacaacaacttttcaagacatatgcagcacagtaagatataaacagaaatgacaaaaagttaaaaagtagcagacaaacttaaggtgtcgagtcattggttttcttttaccttgttaaatttgtttatggaagtggtgttaagctgttatcagcttaaaataatgggttataagatagtatttgcaagcctcatggtaacctcaaatcaaaaaacatacaatagatacaaaaaataaaaagcaagaaattaaaacatatcaccagagaaaatcactttcactgaaaggcaggaaggaaagaaggaagttaacaatacaaaacaacttgaaaacaaataaccaaatgacaggagtaagtcttcacttatcagtaacaacactgaatgtaaatggacttaaaggactacaaccaaaacacatgcagaggctgaatggataaaaaacaagacccaatgacctgctgcctacaagaaacacactttacctataaagatgcacacagagtgaaaataaagggattgaaaaagatattccaggccactggaaaccaaaaaagcgcaagagtagctatacttacattgcacaaaatagatttcaacacaaaaatatgagacaagatcattatataattataaaggggtcaattaagcaacaggatataacaattttaaatacatatgcacctaacactggagcacaaagctatataaatactagagctaaaggtaaagatagaaccccaatataaaaatagctgtagactttaacattccactttcagcattggacagatcttccacagagaaaatcaacaaagaaacattggacttagaaagaaagatggcagagaggagaggagacagggctaatgtgcagctcccacttggatgggcagaatagcatgtggagactcacaccacaaactccggctctaagaaccactgcaggaacattaccaggaaaaccaaaataattcacagattctctgaaagaagtgacacatcgctgcaaattctgcaagacagtcaaataactgtgagttcccaaagtacaagagcaggaaaacctgtctccaaacacacatgtccactggggaatctgaaaatccagatcacaggagaaggatttaacctcacctataacaaaaatgaatacagggagccacatgaaatataaaggtagaagcagcagtgggaagagccttgtaagcacacccagtctccagctcgagcccagggaagccatccctgactgcatctgatagggccctcagggaaggcagctagcagaattagggaggggtcacagggtgaaaaaagcttccaactgaatttcataataatttcaactgggcataaactttcttcagcagaacccacagggtaaatgggaatcctccctaaatcattctatgaagccagtatcaccctaataccaaaaccaagaaaggagaggaggggaggggaggggaagggagaaggaaggcgagggaagggaggggagaaggaaggaaggaaggaaggaaggaaggaaggaaggaaggaaggaagaaaactacagatccctgatgaacatagatgcaaaaatcctcaacaaaatactagctaacagaatccaacagcatagcaaaaagataatataccttgatcaaatgggtttcacaccaggaatgcagagatggtttaacacatgcaagtcaataaatgtgatacatcacataaaaggaattaaaaacaaaaattgcatgatcatctcaatgatgcagaaaaaacatttgatgaaatccagccatccctttatcattaaaacctttagcaaaactggcagagaagggacatatctcaaggtaataaaagccatctatgacaaaccaacagccaacattacactaaatgggaaaatgttgaaagcatccccccaagaactggaacaagatctggatgcccactttcactatttctattcaacacagtactgcaagtcctagccagagcaatcagacaagagaaacagacaaccaaactgataaggaagaagtcaaattatccttgcttgcagataatataatcttatatttggaaaaacctaaagacttcagcaaaaaaactattaaaactgataaattcagcaaagttgcaggaaacaaatcaacatacaaaactcagtaccatgtctatatgccaagaactaacaatctgaaaaacaaatcaagaaactaatgccatttacaatagctacaaataaaataaaatacctaggaaggaacttaatcaaagaagtgaaagatctctacaagggaaactataaaacactgttgcaaaaaattgaagacgacacaagaaaaatgggaaaatattccatgttcatgggttggaagaatcaatactgttaaaatgtacatactaccccaagcaacttacagagtcaatgcaattcctatcaaaatactaatgacattatttacagaagtagaaaaagcaatctatattggtctgttttcacattgctataaataaccgagacagggtaatttatcaagaaaagaggtttaattgacctacagttccacatggctgcgaggcctaaggaaacttacaatcatggcagaaggtgaagaggaatcaaggaccttcttcacatggcagcaggagagagaagtgtgaggagcggaaggggaagagccccttataaaaccatcagatcttgtgagaacccattcactattacaagaacagcatgggggaaactgtccccatgatccaatcacctcccactgggctcctcccttgacacatggggataatggggattacaattcaaggtaagattttggtggggacacagagccaaaccatatcacaatcctaaaatttacaaggaacctcaaaagatccagaatagccaaagatatcctgagcaaaaagaacaagactagaaagaatcacattacctgatttcaaattatactacagagttatagtaaccaaaatggcatgattgtcacataaaagtacacatatagaccactagaatacaatagaaaacccaggaataaatccatacatctacagccaactcatttttgacaaagttgccaagaacatccagtggggaaagaacagtctcttcaataaatggtgctgggaaagctggatatccatatgcagaagaatgaaactagaccccgatctctcaccatatacaaaaatagaatcaaaatggattcaagacttaaacataagacctctactatgaaactactaaaaggaaacattggggaaactctccaggacattagaatgggcaaagatttcttgagtaataccataaaagcatgggctcctaaagcaaataaggacaaatgggatcacatcaagttaaaaagcttctgcacaggaaaaaaaaaaaaatcaacaaactgaagtgacaaccacagaatgggagaaaatatttgcaaactacccagctgacaatgaattgataaccagaatatataaggagctcaaacaataggaaaaaaaatctaataatctgatccaaaaatgggtcaaagatttgaacagcatttctcaaaagaagacatataaatggcaaatacacatatgaaaaggtatcaacatcactgatcatcagaaaaacgcaaatcaaaactataatgagacatcatttcacaccagttaaaatgacttatccaaaagacaggcaatgacaaatgctggagaggatgtggagataagggaatcctcatatactattggtgagaatgtaaattaatacaaccatatggagaacagtttggaagtccctcccaaaagtaaaaatagagctaccacatgacccagcaatcccactcctaggtgtacacccaaaagaaaggaaatcagtatattgaagaggtatctgcattcccatgttaattagagcactattcacaatagccaagatagagtagaaggatgaataccagaggctggggagggtagttggggcagtggggatggttaatgagtatcaaaaaaaaaaagttagaaaaaatgaataagacctagtatgtgctagcacaacagagtggctatggtcaaaaataatttaattgtacacttaaaaataactaaaaaagtataactgggttgtttgtaacacaagggataaatgctttaggtgatggatagcccatttaccctgatgtgattattatgcattgcatgcctgtatcaaaatatctcatgtatcccataaatacttacacctactatgtacccacaaaaattaaaaattaaaaaattaacaccaacaaaaatcacaaaaatgtgtaaaacctggcattaaataggccacaaaaggacacttatttatagcaggagagctgaaacaagaatgtagagcatcactttgttcgacttctactgggagcatgcatgtagggtgattcaaatgttccaccactttatacatgcctatgaaagaccgctagtactgattttgaagttaaaatgcatttttgcaggtaggcaaattcacaaatacataattcacgaataatcaaactcaactgaaaaatctctctttgtaaggtcaactgtagcacatggactttactctggtaatgaaaattacaatatgctttagtaaaacgctccatgtaattcagcagaaagtaatcaattaacctttattaatagtatcattctaaatacccaatatcattcatttttaacaagagcttttattagattgatgtgcaactttacataacaaggtagacttattactatgtagagtacatacctgcagcttctagtaaagcttccagtctagcctgtgtttctggatctactgtcctgaggtctgcaccatcagcagtacctgataagagcaacttggaagctgtttccagcattggattttccaaatcatcctgatccaaaatgaaagactccacctataaaacaaatgcaaaaagagggaggaagggagaaatgaacagcgaaaggaaaagaggggagagaaataaaaagaaagcaggggagggaaaaaatatgttaacataattaacaatggtaaacacagtgcaaccctaaaaagttcaacatgacatctaagcctgttgattaacaaaagaagaaatttttttgtggaagaattcaaaactttatttctcatatgcagcctaattttctttactaatattcttttctactttaatttggttattaggtatatgtagggttgagtgtgatgcttaggttgtgaaaactttaactgtgaatagaagacctaactaaatcagcagtttttaaatgttttgctttcaggactcaatgaagtactgaactcccaaggactttatataaaccctgtatttcttgatatttaccatactggaaattaagtaacaaatatcactatcaaaaaatcacattcattaatatcaccactgatttcatccaaaaagtctttaagtactggaaagctgtcaagcctaggcaaacaagttccaaaattctaatttttgcttcaaagcttaactttatcattggcaacaagtattgttgttttccttaaagtgacagactcacttcaaacatttttagaggagcatttgccaaatatccaagtttgataactatagtttttcgtttgtactttaccataaaaatgacatttcatgggggaaaaaaggctaattcacctcacatctaaaaaaattgcagttatttttcctccagacaaacactatactttttatatgcagcaaaagtgctttatgtgtacttcccattttgttacacacactaatattgaaagaacatgcattcaaaaggggagttttcataaaatgaataattttatcgcttcatcaagaatattcttaaactagcatttaattttttttttttaacttcaagcacgtggtagtgaagaatacaatcatatcagtacagtttgtttccatggccttcgggtccataagttttacccaccactgtttttgcaccatcatcgtaaatgtcaacatagtaaaaaagtcaagtaacatctcaatattatgataaaaatagttttgacctcatggacaccttgaaatggtctctgggccctgaggggtctatttactgtgttaagaaacactgatataagtctagccgattcaagtaaatttaaagaattagaaaataacaaactcctaagacaggggtaaagttttgttttgatattccctatcacagtgctacttacaaataggtactaaaacatattcttttctgcttagtgataaaaattggtaattattatataaaatatcactaaaatgatcagtttatttcacaaatctaaggtactactaacactgcaataaccaaaatagatgtaaaaataactaataagctagaatacaatcacgctcatgcctagtatccagaaggtcaacaataaaaaagacaacttaaggaataaatccttaaccatcataacctcagaaacgatactgttccatcttgaaaagtcaactatcaagtaaccaggaatactgctataattaatcaaaacatttaatactaaattttaaatctgggaagaaataatatgtttctctacaaagttccattaaactaaagcagtttaacgtggaataacatttgagatttcaaatattttatacacaaacacaacattctaaaaatattctgtaaatattttttaaatttcataaaattttgttctacattaactttaattaatctataactccttatggcaaggagataaaaaatacaaaaacaattttttaaaattatatatattttaaattatatatatatgtgtgtgcatatatgtgtgtgtgtatatatatctgtgtatatatgtatatatgtgtgtgtgtgtgtgtgtgtgtatatatatatatatatatatatatatatatttttttttttttttttaaagagacatggatagtctcactgtgttgcccaagctggcctcaaactcctgggatcaagtaatcctcctgccttggcctcccaagtagctgggattacaggcacacaccacgcctggctgattttttatttttgtagcaacaggatgtggaattcctgggctcaagtgatcctcccactttggcctcccaaaggacgggattataggcatgcactaccaggcctggctaattttaagttatctttaaaggtagtagtaaaagtatgagaaaggaagaattttaaaggctgactaaagtattatactttaggaagcaaatttttgggcacagcaaagagtgattcaaaattatagcagtaaaaaaatttgttttattgtcaaaggtccagaagatgagtctttctaaagaaaaagctgtttcctaatgaaattttctaatatctgaaatttattaaaatatttacaattatttcaatttaataagaaaagataaaagcaaataaacaaatgtatgaaattgaacaggtaaaatgaatagatgaaataccataatacaatattttaaatgaacattttagaaagtagaagacatcaaaaagcagtatatagttaactgattaatcaaaggtagagatcagaggtgctaaagatgttcaaaggagacactgcatgcataaagaataatataaaaggattttgaccaaaaaaattaatttgtataaaagaagagaaagaaggaacatggactggcaagtaaaaaatttctatgtgatagaacacagggttttacacagggttttactgtaggtttgaaaagataggttagaagttagatcacagaagatatcaaatttcaatcagaagcgactgtcttacacaaagtcccctatgccacagatatcctaactagcctggtgaaaacttactaggaaaattgcatttccatctcttgatgagatataataaacacagaaacatttactttctactgactttaagcttctccacaaaagttcttatgttattcttaggcccactattctcactatatgcaaaacttggtaacttaaaaaactgtaaattcaaatgactatgaaattcttatagacagctttagaaaagagaggggctatcaaaatgacagaaaagaacaggaatgaatatttattatttcctccctatccctcatttatgattaatgaaggagctactttcaaggacactgctaaaatatgaaggcctaagtaccagaattgctttagctgttacctatgtgacctaaccaagtctctctctcagccatctataactttagacccccaattctgcttaattttttcatagatttatcacacatgaatattatacatacagtctttctaagctctgtaaaaacaaacactttttttggtttagtcatgtacacccagcaattagaaatgtgtctaactcactgtcaggattcaagcaactattgaataagtcagaatctgtaaagaaggtgaaatttaccagatgattttggtattcttccctttcagattctaaaaggctctagtgtatttggagaacaaaggggtaatcacaataaatacatctaaaggtatattttatagatcttagaggagatacagaatcttacattaggtagtaggtggtgcaaaatgctatcttcattgatttattacacacacatttattgcaaacattctatgtgtaaaaaatactgtttaatactatgggagataaagaaatgcatgataccagccttgctatgtaggaccctacttctttaatgagtgtgtgtaaaaatgaaccataatacaggatagaaagtgcataaggtaatgagaaagaaaaagaggtataaaagttcagcgaggaaaaagagaacttcctcctttaattccagttcctctttttccaactagaaagagctcgcgttacattacaaaacaagtgaagagagactggcataaagagatgcaatcttataaacatacaaaaataagtattcctttattaaattatgggcatacacctctctgccataccacatccccagctgagacagttcagattaaaaactaaaatgaattttccctctgaaacctatcgcatttttattatattattctacagaaaaaaaatcattttgaatcacaaccaacttctggaacataacaaacattaaaaatggtccaaataagaaattaaaataagtatttgagctgggcacggtggctcacgcctgtaaccccagcactttgggaggccgaggcgggtgcattgcctggggttgggagttcgagaccagcctggccaacatggtgaaaccctgtctctactaaaaatacaaaaattagccaggcatggtggtgcactcctataatcccagctacttggaaggctgaggcaggagaatcacttaaacccgggaggtgaaggttgcagtgagccgagatcgagccactgcactccagcctgggcgacagagcaagactccgtccccaccaaaaaaaaaaaaaaaaaaaaaaaaaaaaaaaaaaaaaaaaatttaaaagaaagtattcgaaaatattttatttgaatgaaatatataaataacttccatgaagagagaagacaaaggaaagaaatgtccttactaaatgtattctctaaggggggaaaaaagttatcaaagttacaactggccttttttaaaagttgtatttaaagtggtttgaatgtgttgttttgaccagctggatattttatgaaatgatgtttaggcataaagaaccatcaaaatgcaagaggcgtagaaatcaccaggttcaattcagtgtttacacatgaaaaaaccagacacaaggacctttatttaaataggagatttctaaatacctagcaccaagagaccagttatccaattaactagctcaatatactttccaccagcaaatacaatgctggaataataaggggttgaactttcacactgctctgggaaaggtgactttaaattttacatttagggatcaggctgttaactacctgaacccattgtttaattactaaaagtgggacaaacaaacctaacatgcccccgatttatgcaacataaaatacacagcacctcctataaagaattcttgtccccccaataaacaataatctactagaacttttagacgtgtaaataacttccagtacatgaaaattagtaaagcaaatacaggaataagataaatcaatgtttctcaatgtaaaagcactattaacattttggaccagataattctttgttgtttggggctgtcttgtgtaatttaggatgtttaacagcaaccctggcctatactcactaaatgccagttagcaacactccttcaggttgtaacaaccaaaaatgtctccagacattgctaaatgttcccttagaagagaaaattaaaaacaacaacaacaaaaatcatgaaggagaaagaggttgagaatcactgggttaaatataagccaaaaaggaaagtctaaaatgtggaacattttgcagcaaaactgaccatttccttcaagtaagtagaatgggagcaaaaaatcttttttgaatagagtaagaactgttctgaattacagagactcgagagatataaccagcaaaataataggtcttacttaaatcctattcaaacaggacaactgtaaaaacagtatttttgagacaagaaatctgaatgtgaactgggtattagataatataaaggaattactttggttatgtaagaaaatatccttgtttttcagacatgcatactgaagtatgaaggaatagtgtcggaaatttgtcatcaaatacttaaagaaaacaaagcttcatggcaaattcttgaaaatgttgcatctgagaaatagatatatagagggtttttttgttttgttttgttttttttgagacagggtctcactctgtcacgcaggctggagtgcagtggcagaatctcggttcactgcagcctctggcctcctgggttcaagcgattctcccacctcagcctccttctcttccttcagcctccggagtagctggaaatacaggcgcatgataccaggcccacctagatttttgtgtattttggtagagatgagttttcaccaaaacacaagttttgtgtattttggtagaggtgagtttcggcctctcaaaagtgctgggattacaggcgtgagccacttttacccggtctatagagtttttttttatacgagtctctgtacttttgttcatgctaagtccttttaattttgaaagactaaaggtgatgacatttcactgtagaagttgcttttatttaaacagaaaaactattatttaacagtaatattacttagatttctaagataattagaattctttttcactttctccccaaattaagtctgacttaatacaaatatttaataatgaaaaccaaggtcttttaacaatggtcagagctgaatgaatttgtttgtcattaacggtaattcaaatccttctacactcaaaacacaaagtcacatggaaatttggtaatgcggggtcatttggaccaactgtcatcgttagcattacatttcaaactactcctcaagttagaaatattactgccatactagagaagaatggttcgttctgtagtttaataaactcgtatttattccaaaggataagaaaattagtatattttggccgggtgcggtggctcacgcctaatcccagcattttgggaggccaaggcgggcagatcacctgaggtcaggagttcgagaccagcctggccaacatggtgaaagcctattgctatttaaaatacaaaaattagccaggtgttgtggcaggtgcctgtaatcctagctactcaggaggctgagacaggagaatcacttgaatctgggaggcagaggttgctgtgagccaagatagcgccattgcacccagcctgagggacaagagctagacttcctctcaaaaaaaaaaaaaaaaaaaaaaaaagaaaagaaaactagtatattttaattaactgataccatacatacaaactccaacttaacaaataactacaaattacatactaagtgcaaagcagtaggctactcattggattatacaaacacaaaaataattttgttataatcaataccttccataaatacacaataaagaaaggcaactctatgtgcaaataactatcaaacaagtttgaaagaagtactaaacagatactaatacagtgattgtgcagagaaatgagaaaacaattatgaatgagagtgctaaaagcaatgatgcttcaggaagatggcgcctttcaatactgtgctgcgttcagaatttatattaagttactgaaggatttaagcattaaggcaaataactggtaaaataaagataattagagaccatgttaaagatcattttagacagctgtgacaccagagacaaaacaaccaattacgaacttaagtaaaacaaatgcattatgtgaggtgaagatggaaaaaagggccagtctctaagcataaacatactttataaaagtaaaatgctggcaaccgcaaaatttagacttctttacattcaacactaaccccatcccccatctgatgttttccgaagaaaaaataataataaataaaaaatatttaaaaaataaataaaaaatatttattattgtttttgttgttctggaaaataccctatttatcaatgaatctcaaaagctggtaataaataaaaatatttattattgtttttgttgttctggaaaatactctatttatcactgaatctcaaaagctggtaatctgaattttaaaccagtaatctacatttcagaaaaggtgttctaaattttgactatattataaaagcattttaaaacaaataatccccacacttattccaggaaaagaagttatcttcagtcaaaaatttaccatacttaaaattttaagatctcttaataaatccagtcaatgcagaaaaatccctccaaaaagattttatattttttctaaatttttcttttagtaagtgtcaatgattgatttttaggaccaatttagacatttcagtaacataaaatgggtttacagacataaatccataactaacaccactttggctacaaaaaataaaagttcattagaaatgacttacggctatcattatgggatgaattatataactcatacatataaaacatattcactgatattcaaagcacaggctatgtgaacataattgaaggcaacaacagtcttaattttggttttatcaatatgaaatacattttacatatgaatacatattttaaaaactgaatattaaaaagtgaatagaaaaattaagaaacttgagtttatgatcattttatgacagtgactgaataaattcttaatttattaagaaattataataatttctggctctcaagtaagcctggaaaaatatggctatctgctcttatagttctttgaatactgataagcagatttacacataaaataagaaataagaagtattcataattgtaaagtcatcacaatttagtctcttctgaacatgacccagaaataattccttttgtctgtattttttatagtcttaaataagggtaaactttgataaaataccacaattcttaatggggtaaattattccaaaattaatacaattcaaatattttttctatacatacaaagacaaaatcttcagtaatgtcacagaacactaatccaagtataagactgaaatttgaaaagttgaaagaaaataaaaacccacttaaagaaataaaatctttcttgtaaaaagaatggtcaatgattcattatggtattctgagattatagtaaataaaactaaagtgaacctcattaaagataatttacctttcaaaaagtctatttacagaataaaccactgatctattcttatattttttcattcatacttgtctatcaatttgacaaatattaagcagctactataatctaggaatcagtgatataacagttaacacagctttgttctatagcactttcgtaaaacgtgacttcttatgcttcaaactgctatttgcctgcaacaattgagtatgacattactaacaattcaatataaaatttttaacataaactttacaaagtggacaaattatgaatatttcaaataagacaaagttctatggaattctcaaatctagagtttctaagtggtttttctgtaacagaattaaagttatatggtttgtcaaaaattctcccaaaattacttatcaatagtaggatgcaattcaattatgaatttagcctgctccaggaattatcatttatcaattattgtaaaagcagctgcagaatataaatattcttataagatggctttacaacacacacagatacacacacacacatatatacacaccacaaaacctgtagtcataagcctggtgacatttcaaacttctaaggatataaagtctagaaaacttccaggatggtagcagtggggacctgttaggggtcagactgacatcagacttcctaaatacagcaccagatgctagaagatatctgtgcaattaaaagttctgatgaacagtttgaaagtaaaattccaaactgtataatgaaatttttttaggtatgtaaacactatgaaatttaaaagccacaaacattttctgaatttagagaaaatattacttcaagaagaaaaacccatccaagaaaggggcagccttggaattgcaagactaagcagctagaaaagaaaccagtataatacaacgtatttttaatatctcaggtaattcttaatatatgattcactaaagttataaaagtggaagtgagacaggaaaatggggtctgttggcagggaacataaggccgagtcacatttcggctgtaacaggaaatatcctctctgttagagtatatgccataaatgactttgtaactttacttcatctcctccatttacataggacatactgaagtaaccaatggaatcctctagaggggacttaaactctcaaaaattctgtaaggaggcctttgagcaccaatgcttgggcctgctcccacactgttgagtgtacttccattttcaataaatcccgtcattccttccttgctttgtttgtgtgttttgtccaattctttgttccagatgccaagaacctggacatcctccactgttaacagaagtatataacataaatatatcacaaagatttctgattattttgaaaatatgaaagccaggattcaaatgaaataatgccaaaagcctatgttctagggcagtgctccccaacctttttgacaccagagaccagtttcatggaagaccatttttccaggggcaggataaagaggatttagaaatagaagtaattaactgtaatacttatatttcatagtgaactagaacttagtatatcacaaacagagaaaagtctttaaaaacaaaaacctgatcatatcttaagcaaaacagaaaatctcaacacatttcaaaatgaagaaattatacaagggcacattcttggtccataaagttgaaagaaactaaaacttagctataagatgacgacactactttaaaatttaaaaagaaaaggaaaaaaaaagcctactattaactctcagaatacagagtaaatgaaaaataaaattataagcatattatttcatatgggatttagccatagcgatctttaaagaaaaatttaggccaggtatggtggctcacacctgtaatcccagcattttgggaggccaaggtaggcggatcatgaggtcaggggttcgagaccagcctggccaatatggtgactcctcatctctactaaaaatataaaaattagccgggcatggtggtatgcgcctgtagtccccgctactcaggaggctgaggcagaagaattgcttgaacccgggaggcagaggctgcagtgagccgagattgtgccactgcactccagcctgggcgacagagtgagactccgtctaaaaaaaacaaaaaagaaaagaaaaatttagagcttgaaatgtattaaattcattagaacctgagatttaaaataaataaatgaaaagcttcaaaatagaatacaaatcaaaatgcatcaacataatttataatgaaaaaacaaaaatgagaaaattgagaagaggtaaaagtttcattaataaaaccaaacacagtttcttgggtaaagtctagaaagaggatataagcctttggcgagaatgattatgaaaaatgagagacagagaaaaatataaggagttattaaagtcagaaagttgagcacatctatgaatcaataaatctaaaagtcttaaacaaaatggatggttttctagaaagaaagataatcaaaattaactcaagaaatggtagacaacctaagtagaatatgtccactgaagcaacgtcaatgacagataaatctaacccttcaaaacggcacctaaacccaaatgaatttagaggcaacttctatcaaaattacatagcattattataacatttaaggaatagagcactacttttttatttacaaggcccagaaaacagatggaaaaactctctagttcattatagatagccaattaacaaacctaaacgagataacaacaacaacaacaaaaacccaatagcaaattaaatttagtagtagtataaaagacaactacaagaaaggggataatagagaacactaagaaatataatcctttcttttttctgtttctctgtcacaaatctcacacacacacaaataaaattaatcatacatatacggtgatattcctctgcctggaatgttttttttttttttttttttgaaacggagtcccactctgttggagtgcagtggcgccatcttggttcactgcaacctccatttcctgggttcaagctattttcccacctcagcctcctgagcagctgggactacaggcggtcaccaccatgcctggctaccattccgccccctcagccacccaaagtgctggcattacaggcgtgagccatcgcactcagctgtctggaatgcttttcccaaccctttcgttcttcaggtcttagcttatgttttacttactcagatgatactatcaacggagtttctctccttatctttctaccacaccatcctctttatttcctccataatactaccacagcctgaaattatcttgttcttggatacttgcttattatttcttctccataaaaaaaaatgaacctttcagacttagtgctaacaccagtgtgtgacatagttcctgacacaatgcaataaccaaacaggtatctgctgaataaatattaaaaatagaacacattatgactaacattaatgcaatcaccacattgaggtattacaggtaaaaaagaatatgtatcatctcaacaaaagtacgtgattaaagacaatatccattttcattaaaatacttattaagccaaaaagaaaacttttattctttataaagtattctggggctgggcgcggtggcttacacctgtaatcctagcatgttgggaggctgaggctggcagatcacctgaggtcaggagttcgagaccagcctggctaacatggcgaaatcttgtctctactaagagtacaaaaatcagacaggtgtggtggcatgtgcctgtaatcccagctacttgggaggctgaggcaggagaatcacttgaacccgggaggcagaggctgcagtgagctgagattgcgccactgcaccccagcctgggtgatgggatgagattccgtctcaataaataaataaataaatattctactagaaatctaagatatatattattgtagaagtttaaaacttagaagcatcccatttaaatcggggacaagatacccaaatcaaaactagtaatgaactattctggaaacctaaccaatgtagtaagaccagaaaaacaaaacaaatgtcctccaaaaaaaaaaacaaaacaaaaaaaaaacaaaaaaaacctgtaagggtgtaaacacatacagaaaaaggaaaaggaaatgacaaaatgctatcatttgcagaaaatacagccatccttctagaaacttcaagagaagcaactgaaaactaagtaaatggtaagatcaacataaaaatcaatagccttcctacataccagcaataacccatgagaaaataaaatgtaaaatggaagaaaaaaatgtaattcacaacaacaaaaacaaaaaaaatccaggaatacacctaacaagaaaagtgtaagacctacaggaaaaaaactgtaaaactttactaaaggacaaaacaaaaacaaaaacaaaaaaaacacctgaagaaatggagaggcataccatgttcctggatgggaagattcaatagtgtaaagatgtcaattttccccaaattaatctgtaaattcaatgcacttccaatcaaaatcccaaagggatttttaatggaacttgacatgttgattctaaagtttatctggaagagaaaatacacaagaattgccaaaaaaatttgttgaaaaagacaatggggagggatgccctaccagatgtcaaatataatataaaatgacaataaccaaaacagtggagtattgaatccagaacatatatatatgggacttataaagtgtgataaaggtaagatttcaagtcagtaggaaaaagacatactgctcaacaaactattttgggagaacagctatgaagctggaaaaaataggcccctaccaaaaaatatatatgtgtgtgtgtgtgtgtgtgtgtgtgtgtgtgtgtgtgtgtgtgtatctccagatgtaaaggaaaatctactagaaacataaataaaactaagtagtagaagaaaatataagagattatgttgttgctataattttgtagacaagaaagcttttctggaaagacacaaaacctagaaactaggaaacaaaagactaataaatgtggacagtatgagaataaaaattcaaagatgccataaaataaaaaaactgacaggctaggagaaaatattacaaatataatgtacatattaaaaagaggattataaagaaatttttaaattttagtaagaaaaagacaaacaccacaatgggcaaaatattacagagtaggcaattcataggataaatacgaatgcccagtttcactgggaatcaggcaatataaattaaaataaaatatttttcatccattgacagataatatctaatgttttcaaggataatttttcagaatctaaaatcaacatttaaaaatacaattttctttctagaaatttagtataaaaatacttgcacatgtaagcaaccaactacgtatatggaagttctttttattttaacaggaaagactataaataacccatatatccatcaatactatggttaaataaattatatatggaataatagctaccttaagaataaagcagatttacacataaaggcctaaaccacaactatctgtgctgctcattttgtcccatcacctctcatctcttttgcctacattatttatcttcatgaacttattaatagtgacatttccccccaatttattgtcttcctctcacttgaatataagttcacttggacaaagaacctattttgttccttgctctatcccctgtatctagaatagtgccttaaacattaactacttaaaaaatatttaccaaatggatacattaatattgatgcagaatgatcttcacattgttaggtggaaaaaagcagcctgaagcaaaaaaaacaaaaacaaaaacaaaaacatggtatgtacctatttaagttgacttaaaaagcaaaataaagcatatacacatgtgcaagaatgtacacaaaaaatttcaagatgggtaaacccaagttattaacagtggtaatcaaagaatgaaatcaaagagagaattgtacctttttacttactccatacccttctatattgcttaccttaaaaaaaaaatgcagttttctaccgtgatttttagcaaacaattaatgagaaaaaacaacttctttagactttcaaacaaaaatataaagaatcacccaaccatttacatatttctagaataaattctgaaagagctatcataacaatttgtattgtcttgagatatataggattaacttgctggtacatgtaactcatctgaaagtatgcatatgcaacctcattctttttaaatgaaagaaaaagttttggcaacaaaataaaatattgtaagaattagttaaagcaactgctcgttttctcaagataagtaaaatcaggaacatattatgttctcttcttttaattctttttcttttaattctttttccttccttttgaaaatcaggtttattgaagtatactttagagtaaaattcacccttttttcgtggtacaaatctacgaattttgaaaaatatataatctacaattaagatacacagtattttaacactcaaaaatttgtcctgtccatttgtaggcaatcatgtaccactaccttttgcctctaacaatcatgacttttctgttactttcattttttcctttccagaatgaatggaatcacaggtttctgaatgtagcttctttctcaaacacataatgcttgtgagattcataaatgttgtagcatgcatcagttcatttctttttaatggtgaacagtacttcatcatatggatgtatcacaatttgtttggttattcaccagctaatgaacatttaaatacactactttatgcaggcatggtttcacttctcttaaatacgtacataagaggaggacaggtcatatgagaagtgtatgtttaaatttataaaatactgccagacttttacgtgacaccactatacattcctacctgcaatatatgaaagttccagttgctacatattctcactagcttttggtatcttctggcttttcccccctttgtagttttactctgcttttccctaatggctaattaatggtgttgaacacctttatcttgtgtttatttgccatcagcaaatcttcaataaagtatctgttaaaaccttttcctggctgggtccctgaggctcacatctgcaattggagcactttgggaggtcaaggtgggctgattgcttgagcctaggagttctgcaacagccctggtcaacgtggcaaaatcccatctccacaaaaaatacaaaaactagccaggcgtggtggtgcacacctgtggtcccaagtactcggggctggggcaggaggatcctttgagcccaggaggttgaggctgcagtgacccatgattgcgacactgcactctagcctgggtgacagagtgaaaccttgtctcaaaaacaacaacaaaaaaatcatctttttattgggttttctcaatattgatttgtgagaattcttaatatataccaaacaagtcctttatcaaacacatggcttgcaaatattttctgcaagccagtagtttgtctttttattttctttttagtatcttctgaagaacaaaagtttttaatttcaatgaaatccaaattatcgggggttattttatgtttgtggttttttgccatatataaaatacttctatctaacccaaagtcacagattttctatgttctcttctagaagttgcattgtttacattgaggcatatgattaatgtcaggataatttttgcacatagtgccaaggaataggttgaagttccaaaacataggttgacagtcaaacgtttcagcatcatttgttgagaagactacattttctctattgaattgccttggcatctctgtcaagtattatgtatcttccctagactattctgatccattaatatatgtgccacactgttttgattagctttataataaatctttaaattctccaacttagttcttgcttttcaaaaccgttttggttattatagggccttttctatatagatactaaaaagcttgtaaattaaaaaaaggagaggatctggtgggattttgattgggattgcattgatactcttgttttcgggggaatttacatttaacagtattgacttttaaaaatacatggaaatatatatactatacattgtagtatatatcatatactgtaatacagctgaaacatctggctatcaacctattgcttgggactttaacctactccttccaccataggcaaaaattaacctgaaataaatcataagcctagatactacatattttttcatgtatttaggtcattttttatttctctcattaactgttttttttagttttcagcacaaaaactacatacatactttattagatatatgcctaagtgtttcatgttttttggtgcaattagaattggtgcgtttttaaaatttcattttccaaatgttcatttctaatatataggaatggaaaacgttgctaaactcactgattaattattgtaactctcttatattcctagtttgctaagaattttttgttatcagtggatgatgaattttgtcaagttccttttctgtatctactgtgattataattttttttcttgagtgtgctgatagtgaattacattgatggatcagtaaacgttaaacaatttaaaccaactttatattcctaggatacacaccatttggtgatgagctatcttgtttacatattgttggactgtttgctaatattctattaggattttttatctatgttcatgatatatattggttttaattttcttttcttataatatctttgcttggtcttggtatcagggtaatgctggtctcataatgtgagtggaaatgtaatccctcatcatatattttctgtaaaagtttgtgaagaattagtattatttttacctttaacatatcatgtaatatgtgcacgaagtcatgtagacttaagagttttctttgctgaagattttttttttctttgagacagagtctcactctgtcaccaggctggcgtgcagtggtacaatctcggctcactgcaacctctgcctcccgggttcaagctattctcctgcttcagcctcccgagtagctgagactacaggcgcataccaccacacccagctaatttttgcatttttagtagacagggggtttcaccatgttggccaggatggtctcaatcccctgacctcgtgatctgcccaccttggcctcccaaagtgctgggattacaggcatgagccaccgtgcccagcctgctgaagaatttttcatgtgaaatacaatttctctaacagatattagtccctgttagccttttagtgtatatgggtgggatgggaggcaacattacattttttcactgccagtgttaataatttgtatgttctctccctctgttagtatgattagagctttagcagatttaatgattctttcgaagaaccatgtttcttttttttttttttttttttgagatggagtctcactctgtagcccaggctagagtgcagtggcaatctcagctcactacagcctctgcctcccagagtgattcttctgcctcagtctcccgagtagctgggattactggtgcctgccaccatgcccagcttatttttgtatttttagtagagatggttttgccatgatggttaggctggtctcaaactcctgacctcacgtgacctgcccacctcggcctcccgaagtgttgggattacaggcatgagccactgcacctggccttagtttctgttgcttttaatttcattgattttcttatcttattctttcttccattctgcctgctttggttcaatttgctcttctagtttcttaagttggaaattattatatcgctgatttgaaaactttcttcttttctgacctaagctttaatcgtgtaccacaaattctgatatatttcatttaattcaaatatgtaccatatatacacgtatgtgtatgtttatatacatatatacgtttatatttacacacacacacaaacatatacttatgtctgattttaagtgagcaaggatctagtgttctaatgttacttctgtttaccattgtttgtcaagctaagagtattcttttctgttggatctcatccaaatagtgaaagttatccattcagcaactattttattgagcacctacagtgttattggatgctgagttacataagtaactcataagtaaatagataataatgtttgctatcttagcttattgtaaaaactagcttttgatttaagtgaaatgggagccaatggacagttttgaacaaaagaattataaaatctgatttacattttaaagggaattggaatacttaagaaatctgattttattatttgagctttattaagttttagggaatatatacacatgtatgtgtatgtgtatgtgtgtgtatatgtatatgtatataattaagacaaaatcccataatttatttggttaatgatagtctgctagtcattcagaacccaggacacattctgattaggacctctgagccaccaactccctaccaatcactctaaaatgagcagctctgaaacagctgttagatcttgtgggtgcactccccagctacaagaggggctcttgtagtagaaggtgaaaaaggagttactatgcaaacaccactgaagtcttatattcctacagccatatagagaatactgtctgcattatgaaaatcaaggcttatgtgatgtttacagcaatacagataactgtgctatcatgcaataaatgcaatgtgataaacctcccaatctgtaaaacaccacattaaaataatatagtttagggagaaaacagagctggggacattctactcaatacttacgcaactctgtagtcagaactctgagagaaagaaacagcaattgtaatacaaatactagcacacttaagacatattaaattccaagtcttcacttttaaaagaagagaatcctgtaaaaagcactttcaaggccaggtgccatggctcatgtctgtaatccctgcactttgggaagctgaggtggaaggataaacttgaggccagaagtttgagactagcttgagcaacatagcaagacccatctctattaaaaaaattttttttttaatcagccgggcatacgagcatgctcctatagtcccagctactcaggggactgtgcccaggagtttgaggctgcaatgagctgtgatcaaccactgcactcgaggttgggcaacagagcaagagcctatctcaaaaaaacaaaaacgaaaacgtactttcaagagagaacattgagctaaactgaagaaattcaggtaaatgaacattgtattaaatatatgtttttggcttgtattcaactatgttagtatactttatattcagttgatttcatttggtgctacaaaacttataaatattcaggaaaactatgtataaatgattgtaacttcagatttaaaccaccatcattcctctaactttagagtctccatacatacaatctaaaaactttttaaaaaaattatgccaggaaaataggtatatactagaattgtcccaaacaaattaaaacatgtggctactccatctacctgctaattgtctgcaagtattcacattatagaagcattaaatacagaatagttttactaaaatatcactgactttgacccattacctagtgataaaataatcatcatttaattggcaatataaatatttaagactatataatgagacttttaaattatccaaacaaatttagtttctcaacgaaaatgaaaaatttggtatactgcaaagtatacttaacaaatttgtatacccaatggctctgtgtttcacttgataaagaattaggttatataaggataggtctacttgacactcaaaaatctccaagaaatttgggtaacttgtctatatggtatgctggcaaaatgaatgaaatatgtatatgcaaaatttcatccaaaacccataattttgtaaaaggagaaagaaaaattaaatgttattagtcatgactcaacattactatttcaagaattcttagtataaacagtctagtatgagagcaaaaagaaaaaaattaaaagataacttactcttactatactacagctttgcccaaagtcacaaaggagattaaatcaaaattataaatattcctttcactggacatctggcccccaccacagatcccaacaaaatcaaagctatcctttcccttaatgatactcaaagacattctcccatgaattgtatgataaattagatgagcccaaacaaaataaactacaaatgtcaggaattgtgaaggttaaatattctgggtaaggaaggtgacgtaaaacttgtaacacataaaaagatattcaagagtttgaagagtatagcatcaaaaacttaaactactctttgggaacaaattcaagagaaaacttctatagtatgctaaaattctaaattttcccactcttcccaatacatttcattctagtcatgggctcaaattatacctcaagattatgaagacaagacatcagcaatcatgttactgttataaaagtcatctccatgagtgccctgagcctttcttcatggctaatcagaactgctaccctaacaggctgcgaaaacatacagtttggctgtgtgtgtgtgtgtgtgtgtgtgtgtgtgtgtgtgttgggaggagggaaggggaaaacaaggaaagtaaaagaacaaaaaaggagggaaaaaaagccagccagaaagacaaagagaaaggcgagatgccaagcacctttcattcatcaacctcccagcaagaatttagctgagaaaaacattgtctcaatttcccattactttatatagagtacccctattaatttcatcttctctcaattgccttcaaaacatcaactgtagaggcatacctcagaaatttaacaattacagttccttctacctggaattcatgaagatcttcaaatggctagctgcttctcaacattcaggtctttgcttaaatgtgtcactcctaagtccttatgaatacctcctcccctcagtcacggtctgccccattatcctggctttattatttagtagtactaatgactatataaaactgtagtatttattttcttatccaagtattgtagttgtcagtctttccaacgacaacgaaagctcaatatgagtaataacttcatctgtctttttgttgtagtttgaaccaagaacagtgcaggacacctagagggcagtcaataaacatttgttaaatgaatattacattagtatatgtcctttctgaaactagaaagacattaaatgctaaaagtgctcttattctaacagagattttcttatattttttatccagctcaaatttcatgtgaattctgttttacagatacaagcaaaaaaggaaacacagaagagcttttgtctctataaacactgattatggaacaaaatggatttagattacaaaataaaattatacaggaggaaacattttgtctaaatttcttaaatattgaaaaagtctaccatgacagaccataaatctccccatctgaaattttttataaagtaccaggcaattcaaatgtctgcttccattcagtatttagtaaataaatctttactctcttggagagttttcaggcacattgctttaaatcctctttgtctcagaacagtggttctctactttagctgcacactagaattatcaataaataaataaaaattgtcatcggggtacatacttacagtccaaggtacttggaaggttaaggcaggaggatcatttaagcccaaaagtgtaagacgagcctgagtaacatagtaagatcctgtctctttaaaacaacaacaacaaaactaagcctgggccacgttctcagatactatgatttaatagttttggggagtggcctgggcatagggattttttatagctccccaggtgatactaataccaggtgaaggttaaaccactgcttaaaagattaaaattaataactccattatgaaagtagtttattatataaagattataataacctatcttgactgaaaggcatttagtcattctaaatgccattagtttttgttgatattcaaaaactgccaatttataagtcacataaaaaatcagaattcttctttcccatcctttctgtcagttattaaacaaatgcttatcaaaaaacctgtaatttctcaatactgtgctaggcactgaagaaccagatccctgtactcttgtaatcagtcatttccctccacctttcagatgcctccacctcaatcaccactatgttcactctctcctttccaacaaaggctgaacttagatacccagaataaaaaaggtatagctttatgaattaatcacctgcttaaacagtatgggcggggggggggggagattcttaatctcatcacaatactgcatgtattacaatataaattttaaaataaattctagcaagactaaataaaatgccatatagagtaatattacctgaattacaggagaacaaaagacataaaaagtcacaaagaataagaaaagacacatttatttaaaatgtatgcaaaaaatatcccaaaccaaaaaatgtaaataacagtcagaaaaaaaatgtttatcacacttgacaaagattcacatcaatatacaaaaattctctagaaaaataaagtcacatctcattagcaaaatggctaaagggtatctataaactttttttactatagggaaattggaaataacccagttatgcaacaacacaaatgcacagtaagttatattcccaagctagaatattatacaatcaccaaaataatgattttcagaaaaattaataaaatagaaaaaaaaactacaggaaaatgtaaacagtgcgtgaggaaaaaaagcaagaaacaaatatttttaaataatacagtcccaatatattaaaaatgtgtatatatctgtatttgcacagagaatgaactgaaaggaaatgtatcaaaatataacaccattaatttttctaacacaggcttataattctctttgaacctttttatgttttccaagttttctatgagattttgtaattaagttttccatgtcattcctaaagagctaataatatagtaattgccattaggaataacctgaaacagtttattttaaattgctttaaaatgtattcacttttctaaacataagctgcttggagcaattttcaggctttctcactaaaaatgtttaggtttccttaagacatactgtgaaacataaacatattagatgctgctatacaaacatggacactatctggcagtcatctgtggcaaaagcatctacaatggcactgcactgacactatttctattgagtacatattacacaaaatgaaatgacttcacaactaaacagaaagggctacaaagactaagatgtggcactttattagccatgaaagatttttcactgcaaatttgccacagcacagtaggtctactttagcataattctctccaccaatcagtagttcaaatacagtacgatgtggcttataggcacaacagagcaattgggacttggaaagacttcccacctcttttcagacaatgaacaggcataaaagagtatgacccactgaaaagaaacgatgaagtcagtcctactccttcccatctttctgtcaaacctagcagtatttaccaaacccaaggcaggaacaggattaaaaaaaaaaaaaaaaaaaaaaaaaaaaaggcacagaactgaagtcttacttagttcaggagaaaaagatcagagtttagagaaattaatgcagctaaaacgtgggggcagaaaactagggagaattgggaaaagaactattgaggagctgtaaactaaacaattatagaaactccaaaagattggtggagaaatatcaaaatctaaccagccagaggagagagatttcattgaacacataggtatttagcagaaaatccagaaaggctacacataccagtagggctattctaactttagagtacagactactagaaagatgatctaacaatgcttcaaaacaagccttaaaaggataaagctgattttcaagtaaccttacagccaaatataaatactctttaaaagaggacaatacaatccagacattcaacaatataatatcacaacatccagcatctaataaaaatcagtagacttgcaaaggagcaagaaaaggtgtctcataattaggagggaaaaaggtaaacagaaacagatgtagaattagcaaacaataactttaagacagtccttttgcaagtgctcaatgatttaaagaaaatgtgaaacaatgagagaaatgaagtctataaaactgaaagatcaaatagaatttctagagctgaaaaatacaatatttgaaataaaaattcactggatgatctgtcacagttaatttagacattgcacaaaaaaagatcagtgaacatcaagatagcagtagaatttataatagcaaatataaatagcaaaactataggcttatttcctctggttggttagatcttgatgtttctcaaccaaccctgtgggagtttctatgtttgtttagtttacagctccccaacacttcttttcccagttttccctttcccagttttctgcccctactttttagtagaaaatgcctcagtttctccaaaccctcatctttgtgtcttgaactaaattataataacaaatggcaaaactaaacaataaagagaaaaacagctgaaaaaagatgtacagaggcaatgttatttttaggacaatatcaaaatatctaaaaacgtgtaactggaattccagaaagagagaaggagggtagaaaaaacatttaaagaaataatgtgggctgggcgcgatggctcacacctgtaatcccagcactttgggaggcccaggcgggcggatcacgaggtcaggagatcgagaccatcctggctaacatggtgaaaccccgtctctactaaaaatacgaaaaaattagccgggcttggtggctgatgcctgtagtcccagctactcgggaggctgaggcagggagaatggtgtgaacccaggaggcggagcttgcagtgagtcgagatcacgccactgcactccagcctgggcgacagagcgagactccgtctcaaaaaaaaaaaaaaaaaaaaagaaaaagaaataatgtctgaaaattctcaaaattggatagaaaaatataaccttacaaatccaatacgttccacagtcttcaagaaaaacacgaagaaaagtgcaccaaggcacatcacaatgaaactactaaaaatcaacaacaatgaaaaaactcttaaaaacagccatgggggggaaaaaaccatcatgtgcacagaaaggaagataagaatgactgctgacttcttattcaaaagaaggaaaaccagaaatcacatgaaaaagacctttaaagtgctaaaagataaacaatcttgtacgggcgcggtggctcacgcctgtaataccagcactttgggaggcacaggcgggcgatcacgaggtcaggtcactgagaccatcctggtaacacagtgaaaacccgtctctactaaaaatacaaaaacaaaattagccaggcgtggtggcgggctcctgtagtcccagctactcaagaggctgaggcgggagaatggcgtgaacccgagaggcggagcttgcagtgagccgagatcacgtcattgcagtccagcctgggcgacaaagtgagactccgtcaaaaaaaaaaaaaaaaaaaaagaaaagaaaagaaaagaaaaacaatctttctttcaacaaagttttcaatatgcagtaaaaatatgcttcaaaaataagggaaaatagatattctcaaacaaaatctgaaggaatttgttgccagcagacaagcactataaaaaatttttttaaagtaaattcttcaagtggatagaaaatgatacctaataaaactggatccacccaaagtaataaagagcactagaaatggcataaaatggatatcttctttttcctcatttaagaaaatatctttaaataataagaatctattctggcgattcacaacataggtagaaataagatacatgacaatattcagaccagagacataagagaaggaatgaaatatactgtcgtaaggttcttaatattttcgggaagtggtattatatgtgacaacaattattagctaacacatatatattacaagcactagaacaatcacaaataaaataataaaaacaggtaatacaccaataaaagggacaaaaaggaatactaaaaatactcacaaaatactttttttgtgagtaaaaatactcacaaaagaatggccaaaccaatcttcagcaaaaagtacaaagctgaatgcatcacactacctgatttcaaaatatactacaaagcagcccaggcagggtggctcatgcttgtaatcccagcactttgggaggtcaaggtgggaggatagcttgaagctaggagttaaagaccagcatgggcaagaaagcaagacaccacctctacaataaaaaaatttaaagaattaaaatttagccaagtgtggtggcacacagcctatagttgcagctactcagaaggctgaggtgagaggatcgcttgtgcccaggctacagtgagccatggtcatgccactgcactccagcctgggtgacagagtaagaccatttctaaaaaaaattttttagcaaaataaaaaatttaaaaaacaaagcagtaataaccaaaactgcatgacactagcaaaaaaacacagaccaatggaacagaataaagaacccagaaatcaatctacccattttatggtcaattgatttttgacaaagatgccaagaacacaatgtgaaaagaacagtaatttcaataagtagtgctgggagaactagatactgacatgcaaaaaaatgcaattacatcctatctcacaacaaatacaaaactcaactcacaatggattaaagacttaaacataagcactgaaactgcaaaactactagaagaaaatacaggggaaaagctccatgacactggttgggcaatgaatttttggatatgactccaaaagctcaaataacaaaagtaaaaatagatgaatgggattacatcaagctaacaagcttttatacagccaaggaaacaatcaacagagtgaggagataaatctatgaaatgggagaaaatatttttaaacatatatctgattaggggttaatgccaaaaacacataaaaatcttagtggcaagaaaacaacctgatttttttaaaaaaatgggctaaggacctgaatagacatttctccaaagaaaacatacacatggccaatggatgtggaaaaaatgctcaacatcactaataattagagaaatgcaaattaaaaccacagtgagacactaccattcaggggtttgaacagctatgaagaaaaagacaaaagatagcaaggattggtaaggatgtggagaaaaggaaacacctgtacactattagtaggaaggtaaattaatatagccattatggaaaacagtacagaggttcctcaaaaaattgaaaacagaactaccatatgatccagcaatcccacttctggacacatattcaaagaaaatgaaatcagtcatactgaaggaatatctgcactcccacccatgttcacggcaccattgttcacaaccaccaagatacggaataaaccggagtatccatcaatggatgaatggataagaaaaatgtggcctatatacacaatagaacagaaagaaagagagagagagaaagaaagtgagagagagagagagagagagagagagagataaagagaaagggaggcaggcagggagggagggaaagatagaaagaaatcttgtctcttgcaacaacatggaggaacctggagaacactgtgctcaatgaaacaagccaggcacagaaatgcaagcactgcatgatgtcacttatatgtagaatctaaaaaagctgaattcatagaagcagtgagtaaaatggtggttaccagggattgacagggaaggtgaggggtcaggagggtggaccagaaagatgttggtcaaaggacagaaattttcagttaagaagaagaagaagttcaagagatctatttacagcatggtaactagagttaataacaatgtactgtacacttgaaatttgctaagagaatagatttttttttcccccaagacagagtttcactcttacccccaggctggagtgaaggggcgtgatctcggctgactgcaacctccaccccacggggttcaagtgattctccagcctcagcctcccgaatagctgggattacaggagcctgccaccaagcctggctaatttttgtatttttagtggagacagggtttcgccatgttggccaggcttattttgaactcctgacctcaggcgatccacccacctcagcctcccaaagtgctaggattacaggcatgagccaccgtgcccagccaagagagtagatttttaagtgatctcaccacaaataaacataagtatatgaggtaatacatatgttaattagctcaatgtagccatttcacaatgtatacatatttcaaatatcatgttgtacaccaaaaatatatataatatttgtcaatttaaataaaagtaaagtcagattaaagatatatgaaaaacaaataaaaaactcaacctaataaaaggcatgaacaaagggaaaaaagaagccataacaaatgggagaagtgggaaacaattagcaagatggtggaatgaaatataaaatattgctaattatactaagtgaaaatggattaaatatactaattaaagggcagatattgacagtttgtataaaaaggcaagagctatcgacatgctgtctacaagaaacatactttaaatataaagacagagataggttaaaagaatggagaaagatataccatgcaaacattaatcatagaaatgctggtagagctattatcaatttcacatactgtacacttcagcaaaacaacaaatattaacaaagccaaagagaaatattttgaaacaataaaaggattaattcagcaagaagacatagtaactctaaatgtgtatgtacctcatgaggaagctccaaaatacatgaagcaaaaactgacaaatcggaaaggaagaatgggactctctacaattatattttggagatttcaacattcctctctcagatttggcaaaacaagtagacagaaaaatcagtaagggtattaaaaaaacttgaggccgggcacagtggctcacgcctgtaatcccagcactttgggaggccgaggcaggtggatcacgaggtcaggagatcgagaccatcctggctaacacggtgaaaccccgtttccactaaaaatacaaaaaaattctccaggcgtggtggtgggcgcctgtagtcccagctactccggaggctgaggcaggagaatggcgtgagcccgggaggcggagcttgcagtgagcagagatcgggccactgcactccagcctgggcgacacagcgagactccgtctcaaaaaaaaaaaaaaaaaaaaaaaacttgaacattattaacttattggtcatttatggaacattcaacacaacaacttcagagaacatattcttttctaatgcccataaaaaactcattcaacaaaataaaccatattctggggcataaaacaagcttcaatacatttttaaaaactaaaattaagagtacagtacattctctgaccacacataattaaatgggaagcctataatatgccaacatatttagaaatgaaataaccaacttttaaataacccacatagcctttccccaaaagggttccttatatgaaccatggatggccaaaaataatttgagtgactactttctcagttctcctaaaaatgttatataaatagtaccataatacagcacaagcacaggagagaatagagtgactaacagccttaggcattagagatcaatcctccaaggaaaccccagttaagacaggcagaatgagtcaaagaaatccaggggaaattagaaaacatttagaactaaatgctaataaaaataaaagatatcaacatttgtagtatacagctaatgcagtgcatagagggaaacttatagtgtttaatattagtagtagaaaagaagaaagattacaaataataacctaagcttccacataaaactagaaagagggacaaactgaattcaaaaaagggaaaaaataagagcagaaatcaattaaacaaaaaatgaacaaaataggctgggcgcggtggctcatgcctgcaatcccagcacttccgggggtgggcagatcacctaaggtcaggagttcgaaaccagcatggtcaacatggcgaaactcccctctactaaaaaatacaaaaattagctgggcatggtggtgcgtgcctataatcccagctactcaggaggctgaggcaggagaattatttgaacccagaaggtggaggttgtagtgagccaagatcgtgccactgcactccagtctgggtgacagaacgagactctgggtcaaaaacaaaaaacaaaacaaaacaaagaaaaacaaaatagaaaataatcagtgacacaaaatgaaaatcaactgaaaatttattgaaaagagaaaatgtgaattgccagtgaaagaggaaacactatcacaaatcctgtcattatctaaacagtataggactattacgaacaactctgtcaattaattcaacaccacagactgaaattgacaaagtccttgcaaatcacaatttatcaaatctgacagaaaaaaaatctaaacagccctatatctactaaagaaattcaatgtttaattgaaaacattcccaaaaacaaaaccctaggtgcagatagcttcactggtcaatgcaatcgacccaaactttcggaaaacagaaaagaaggatatactcccaattttttttacgaggcttgcatttcccttacgcaaaaaagatcaaatatattacaagaaaaataaagagcactatgccttaaaatccttaacaagatattagtaagtcaaatgctgccatatacaaaaggagtcacacattgtgaccaagtggagtttatcccaagaatacaaagttggtttaaaatgcaaaagtcaattaatataattcatacaataacagaacagtggaaaatcacaggatcacctaaaaagatgcagattaaagcacctgacaaaattcaataccctttgatgataaaaatccttagcaaactaggaataaaagggaacatcctcaaccagataaaggaatcaagaaaaaaactacaggtaacagaatacttaatggtgaaagactgaatacttatctccctaaaatcagaaacaaggcaaagaagcccatagtcaccagttctatttaacattttatggaggccctacttaaggcaataaggtagaatattgaaaataagagaattaaaaggcataaccatgggagatgaaggtagaaactgactttatttgtacatatgatccaagtagatagaaaatcctaagatctaccaaaaaaacaaacaaataaaaaaaaccctagtagaactaagtgaatttaagcccacaaatatccactgtattcctacatatgaacaacaaacaattgcaaaataaaaagaattagcagttacaataatatcaaaaacctaaaacacctaggaacaaatttcatgaaatatttataagacctgaacagtgaaaactatacaacagtgctgagagaaattaaagaaaatataaataaatgagtgtgtgtgtatatgtgtcatgctcactgtgtgggccaatgttatatgaactacacaaaacacagttctaagtctgatatggccaagaagccacaagtttggaacctttgccctagatgttctaaattttattgttgaaacaaacaagaccatcagaaaacctagtacttacactacattattgttttcaaccaaattgcattttattagcaaatctttagtttatactctgtataaacaatgtgaagggtatattttagaaatgctgaaaaagttatctactacctggagtatctccattatgagggcccaaaagaaattttttctcagatctcaatttcagaaaatatgagtcctccaaatcatctagtatacctatgaagctatggactatgcaaatctcaaaattcatcaagtttccaaatttggctctggttgctagttaactgaatctaagtttaataactgtatattacatacatttttctgtataatccattttcctttggtcttaatttactaattctacctttgtatttttatttttttagagtatatactctaaactacttcaaatcattttgggggatgaaatatcttttacctaaatacatagatgacttttttttaacttaaagagtcagggtcgctaaaaattaaccatatagtcaagcacataatacagaccataaaatattttaaatgtatatggtctcacattacttttacagagcagaaaatagtaggagctaaagaatgtgaaaagaagactagggtgggaaaaccctagagaagaggtaggatctaggtggagctctgaataatgaagataaagagggtagcaggtagacaacatgggtaataacagggtattaggatacaatgtaaaggcaaacggttgagattaagtgttgtaaagataaagttgagtggatagaatgaagtcatataatgtatagttcaaagccaaactgagctttagtttgattcttaaatgtaaaataacacagtaaaacaggttacaaaggctttgacatatataggagatacacactatcatctcaaactttttgtttagtagttattggagccactaccttaagaaatctaattgtcggccaggtgtggtggctcatgcctgtaatctcagcactttgggaggccgaggcaggtggatcacctgaggtcaggagttcgagactagtctggccaacatggtgaaaccccatctctactaaaaatacaaaaattagctgggcgtggtggcaggtgcctgtaatcccagctacgtgggaggctgaggcaggagaatcacttgaacccgggaggcagaggtcgcagtgagctgagatggtgccattgtactccaacctaggcaacaagagcaaaactctgtctcaaaaaaaaaaaaaaaaaaaaatctaattgtaagctttcataagcagaaggggtcttaagagaaactatatggtacaactaaattttagagattaaaaaacacaggaataaagaaaaatgtatagtatttcaaatgatgtacaaagcttattatccttaaaatcccaacctactgatcacctggattgatctgagttaatatgaattacttttagttcttctttatacaatatatacacctaaccaaagccaaggagagtctaaacacactcccaaggtgtgggttgggcagagggaaagagggtggcgattctttcactgtacaagaataactcaaaatgaaaaaccagcatttactatgttctaagtacaatgttgagtcactgaagataccaacaacaaagctattcacagaaaatcagactataacactaaaagctcaagacaatgaaaaaggaaacccattaaatgtctagaaatacttaaaatcactgtcaacataattcagcatttccatttacctaacactttataaaagatatattcttccataattcataaaacatttacgaaacgatccacctgccaagattattttttaaatgatatatgtagggcttaatcttaacattctggttgtctaatgaaagttttcagaagagagcatatttctatctagagctatctcccttgactttatttcatggagaaaactaaaaaataatagaacagagaaactgagaaagatattaaaaaaaaaaagtacttgtgcagatgtgatacaaaatcttaaaaacgaaaactttctgatatgtgtgaacatttaaacccaccacatgtttttggaaaatcttaactagttatttctttgtgaaatataagaatttaggccagcacagtggctcacgcctgtaataccggcactttgggaggccaaggcacggggatcacctaagatcaggagttcgagaccagcctggccaacattgtgaaaccccgtctctactaaaaaaatacaaaaaaaaaaaaaattagcgcagagtggtggtgtgtgcctgtaattccagctactcgggaggcggagacaggagaaatgcttgaacctgggaggtggaggttgcagtgagccaagatcacaccactgcactccagcttgggagacaaagcaagactccgtttcaggggaaaaaaaaaaaaaaaagaaatataagaatttagaagctgagtggatagaatcaagtcaaataatatataattcaaagccaaattgaggtttagtttctcaaacttaagcatgtcacacaaatatatgttggtcttatgatgacagtgcataaattacaaatgctgaacatatgacaaggactaggcaagtggcaacaggacagattcaaggttagaaccaggtaaggataaacactagttagatgaataaggtcaagaagtgagaaggtctgtgtgaaatcaaagagttaggctggcagcaatattcaaacactgagttcaggataaatatctggacaacctgcagcaagaaaaagaaatcatgattaagtaggcagtattaccaaaactgagagaaagaggttaaatgacaaaagctcaggacagcaaagaatccagacagcacagaacaccaaaaacacttttaacactgaacctaacactgtatttctcacctcaagcagttcctcaaaattttatggtggtgggaagatatggaatttgagaatgagaaagacagagatgtacagatgttactgacctttctctttcccagtgaaaacattatttgttccaaagctaatatcaaaaataaattgttgcaaaaatatggtatatataaacattgatatttatataaacaaaagaaggtgagaagtaaatcttaaatgactcaattttacctctatatgaagaaatttgaaaaaccttagtttttaaatagaggaagatctacattatctgaattttatttttcattttcatagactatataaaataagagaaagaacttctcttgaccagatgaaaaccaaagtgatacctgtgaaagaagggaaggataggaaagacactttatagccttcaaaaaaaatactcaaatttgacaaatatttcatatatctgtttcacttaccacttaatattactccacaagcaaaatatttttctacttatttctattaatagcttctctttgcattcactacttccttcaggaatcctcaaactcctgacttcctgaaattctgaatgactaatcttggactgataattttaaagcaatattcaaattcccacacagatttccacacaaggtttttctccggctctttaaaattgctatattgtagttaaaggatagagtgacctacagggtgtgtcaaagagactggagaagttggtactatgtgattaattaataaattttataaaatagtaaagaatacatttgaatcaagcagacttgtctaaatcttacttttactcccttaatgagtgtaaacttgtaaactgggcaatatactgtaaaacagcagttgtgcaagtgtggtccatgggatctatgagaatctccaagactcttaaagagtctgtgaggtcaaaattatttttaaacaactaagatggttatttgcctgttgcactgtgttgacacttgcactgatgacacaaaagcaatggtgggtaaacctgctagtttcttaacatcgatcaaggccatgataccaatctgtactagttagtagttatcatattcttctctgcatgcactcacaattttgtattaaaaaaaaaagagagaaaaagaaaaacccagtttccttcatgaagcagtagaaaatatcattcttaaacattttcaatcttaggccaggtgcagtcgctcacgcctgtaatgctagcgctttaggagcctgagactcctaaaacaggactgcttgaagccaggagttcaagaccaacctggccaacagagtgagatttcgtctctattaaaaaaaaaaaaaaaaaaaaagcaagaaagaaaagaaaaagaaattttttcagtcttgaatatattactttaatattctgtgtgataaaacagaaagcacttctattacatacccaaagtacggtagctgtctcaagaaaaacacttgtgcaaactgcaaatggtagccaactttttttcatagaataccatcttttcttaagacatactataattattcactaatttggcagacattttctcaagaacgaatgatatgagcctgtcatttcaagaaaaacaattcaaatgatttgtcatcaataataaaattcaaacttccaagcaaaattagaattttggagatcttatatctgacacgtgacagcttcccagtttttgacttttctgagaacactgatgctgttagaaaatgtgatttttttttttttgagatggagtcttgctctgtcgccaggcttgagttcagtggtgctatctcggctcactgcaacctccgcctcgcgggttcaagtgattctcctgcctcagcctgccgagtagctgggactacaggcgcatgccactacacccagctaatttttgtatttttagtagagacagggtttcaccatgttggccaggatggttttgatctcttgaccttgtgatccacccatctcagcctcccaaagtgctgggattataggtgtgggccactgcgcctggctgaaaatgtgatttttaaaaatattgcagaataaaagaaaccagtattttactatgaccaatattataaaaatcatacatggttttgataaattcaaagtgcacaataagccagtgagttttaatctaacaaagttcagaaagttcaccggtaattgtttcagattccacactgcaactaacctttaagaaactaccacttgtggagtttaggaatggttttaaagaagattatccacaattatctgaaagggctatgaaaatagtttttgtttttttatcctcctaacaatgtgacactaaatttctttagagacttcgaccaaataatgtatcacaatagactgaatatgacagcagatatgatgggcatggtggctggcacctgtagtctcagctactcaggaggctgaggcagaatgactgctcagcccaggagttcaaggctaaagtgcattatgactgtacctgtgaacagccactgcactccagcctgggcaacgtaatgagacctcaactctaaaataaaagttaaattaaattaataaagaagatatgagagtctagttatcttccattaagtcagatgttaaagatatttataaaaatgtaaaacaatgccactctcacaaattttttcttttggaaaataattatttttttataaaagcatgttaacatgcaatggtttatcatttttttaaatgaataaatatgtaaatgtttttaaatttttctttcaactttaattttaattttctttaaactataatttctaatatagtaaatagtgatagatataactctcagaaacaaaaaacttttgagttctcaataatttttaacagtgaaaaagagacctaagaccaaaagaatttaaaactattgctctaataatccctgacgctcaaattttcctgtcaaatggcgggggtgacagcataaggatagaagatgagggttaaaaaagggttaacagttaagggttaactatgtaactaaatgctgtgctaaatgtttatgcagattacttcatttattccttataagctgcttatgaagtgggtacctacctcctcacagaatcattcagaggattaaataaaacaatgcttatgtagtacctggcacactccctctctatatataatttaaatactcaataaagggtagctaatgtgccaattactgttgccaccataaaactatgtgctatcctacttacaacacatatccaactagttagagttctgattccatccaagactaaattattaatggccagtattaatccaaccacacatgaaagttatcacctcataggcatttaacaattataaacaccttgtgaaaagccattggtttggcaaatttggaagatatatactaaaccaaaccaatggttaacaagactgtgctgctcaccaactttgtagtgatcaagtgacttcatatcagaatgagctgttatcaagtgtcaaaacaaaggcctctcacaattcagaaccagtaaagggccaatgttgttgcctctataaatggataatatatgatgtagaccttttctaattaatgctccataacatgcactaattaccagactacgatggatcagtgggaaactagtggttcattggacaaccgtgcctttactttcatataagagtaatacattgattcacatacttctagttatactacctttccacaagctatttggagcctccatattccactaaaatatcattcttctttacagggattaactaacataagtgtatcttatactacttccccattaattctcccaaaattggcatatgaaagcaatgttataacatcaaccccacccttacatgaaaaattggacttccaaataagagtatcctcactgcaaaatatacaggttgatcatccctaatctgaaaattcaaaatctgaaatgctccaaaatccaaaactttttttttttaatttttacttttttgtagacatagggtctcactatgttgcttaggctggtcttgaactcctgggctcaagcgatcctcttgcttcagcctcccgaattgctgtgattacaggcacgagccactcactgcacctagccaaagatcagtaattttttgagcactgacataatgccacaagtgaaaacttctgcatttgacctcgtgtgacagatcaatcaaaactttgttttcatgcacgaaactactaaaaaaaattgcataaaactacattcggactatgtgtataaggtatatataaaacataagtaaatctcatgtgggtcccatccccaagttatctttacatatacgcaaatattccaaaacctgaaaaaatccaaactccaaacacttctggtcccaaacattttagataagaaatattccacctaaagcagaacatgagtgtatgagtatgtgtgtgtatgtttgtgtgtgtgtggagtatatgtaagtataaatgtgaatatatgtattgtaggtatgtgtatacacacgcgtatgctggtttataggtaaaaatgagaaccagtggatgttcttgtcagcaccacattcataaatacatataacaaaaagatttgcataaaagtgacaacataaaggtgtccagataaagaaaaatatctgcttactgaaaaattcagaatgcataagggatatccgctttttaagtccactgctgaaaacatgagtttcaaactattcagatggaatcaatgaagtaaaatactagtattaaaatatgtatctatgcatcctaaattcaagactgtttaagataccaatggcagaggccggctgcagtggctcaagccattactgagcactttgggaggccgaggcaggcagatcacctgagatcaggagttagtgaccagcctggccaacatggagaaaccccatctctactaaaaacacaaaaaattgccaggcatggtggcgcatgcctgtaatcccagctactccagaggctgagacaagagaatcgcttcaacccctgagggggaggttgcagtgagccaaggtcatgccactgcactctagcctgggtgacagagtgagactctgtctcaaaaaaaaaaaaaaaaaaaaagataccaatggcagacatttcttcttcatcttcttctacttctgcacttccacctctgtgagacaaaattagctggactaacctcattgaatttcaagtgcctcacactgaaggtactcaataaatgcagtggctcacgcctgtaatcccacactttgagaggctgaggcatgcggatcacgaggtcaagagattgagaccatcctggccaacatagtgaaaccccgtctctactaacaatacaaaaattagctgggtgtggtggcatgcacctgtaatcccagctactcgggaggctgaggcaggagaatcacttgaacccaggaggcagaggttgcagtgagctgagataagagtcactgcactccagcctggcaacacagcaagattccgtctcaaacaaacaaaccaaacccatatctgtccaacatttctcaacttgattccaaaacttcttgatgaatggaaaatattacttttatcaactcttaatgatttacatatttatctaaacttttcagtcactagaccaatttaggttctaagagttactacaacttttcctagtgaaaaatgtcaccatggttactttagaaatctatgaaagacttactggtatagtatagaaatgatgtgcattacatataacaatgtgccttacagaataaaaagaaatataacacgtatctgtcaaaaaaagtctaccacatggagatttgatatcattaccaaaaataatttttatggtaaatagcaagtggatttcccttgtttgacctagaattcactatttaccattagtccacaatcttggcaatcaaaaggaaatgatgccttccttgagactctttcaattttatttaaaaaacaaaaacagctaagataaatacagagcaagaaaagcttccataataaacctacttactttgcttaaatctgaaccttaattcagttccaacctaaagggttcagtcaaatcctcaacccactgtccatagacagaaccatagagagttggcacttttattttatataccacaacctataacatcaagtacagatgaagctggacatcctggctttagatgacaaaagaataagaacgggtatgagagttattattacacttaacaatataaacatttttattttcataaaatttcctactttcttaaagcaaaaatatatcaaatactatacccagaacaatctgaacttaatcaaaattaaaggatggaaatatctgtgaagatttcttattactaagactcctaaaactggctcaattataaataataacactaaatatacagtaaccaagtttctgaaatgatctctcagttgtttcatgttttcatataaaaaagccaacatataaaccacaggtttatatacacagcccttggccatgtaaatttgggatataaaattggaagacatttttcctcttattgatcattctaagtagtacaatctattgttacacataattttacaggaaggtcatcaaaattctaaaattataatcatgtctcaggaaaacataaacagaacaagaaaagaggtatttatatgagctgtcagccctttttctgccatctgtatatggctactttcctgagtattagttccttttacagaaggtaggcagaaggaacggaaatactttgatgcctttggtttggagaagaaaattactgcctggattatttgaataaatgaaatagccaagacactctatttaatcccttaccttggactgttgaaaagcaatgatgtaagttgaaatccaccttttctaattttattatacattttagagagtattttacttaagattttaaaggtctaaatagtcaacttaaatatatgtgggcatatataatcagtaatcacagtttaaaaggtaagccatagtattatgagaaatcatttgtgttatgttcactaatgatattgacttttgttaactaatattcaataagagtacctttaagaagtttatgattcaaaagatcaagttacaaagacaggaaaaaaagagtctaatatttattcaatgcaaataagcataatctacataaaattccgtatgttcaataaataaaatcacaaaggtgaaaattacggtaatgaacttcaagtagctcaatattaagtacaataataaaactgtcactgtggtatacagatgaacttcattatccattactggacatttattcaaggagttatccctgtggggggtagagggctagggaatatatttttctggaaagctcattatgtaataaatatctgtttacttgcaatatgaggtgctttagaaaatggtacatttatctgcaaagttagcaaatttattctttgcactctgtatttttagcactgtgtcattatgagtacttataactttggataaggctcttttattactacttagaaaatgttaccaagattgacaaatatttaagtcaaatgatattttaaataaagagaaaaagctacttatttagtatgataggatgcaacaggtacatagaaactaaattaagataaattgagaattaggaaaactaaaattgcagaggttgttttaataactagcaacattgaataaataaggtaacatgaaatcttaacatggtattaaacaattgagataataaaaagccagttgttcaggtagcattaaaaaaacctatgcataaagcacaaaacagtgctcaagtaggatttcctcagaacataaataagacttctaaaatctgttatatgctgaagttttaaatggctaagaaaaattgtcaaatagatttatcaaaatctccaaagcacacttctttaaaatccaaaccaaaaaattttaaaagcaaattaaaatgtaacactagaactctgtaatctaattaggcttatttaaactgaaccactaaaaagtcatgtggccacttgtaattactaaactcctttgatgaaagtttatactactatttctaagtagataattttaccacacatttttaaggaaactcactaatagaaacaaagtaaaaaataaaagagaaaagaataaaaattaaccacaattcaacttagacctaacagcttttaggaaaggggaaaagagcacattggcaggtgtctgcaaggaggtaggtaataaatggaatcagttttcattctgcagaacaaccatgagacttgctgcaatgtcagctccaagcacacactgagggactccagaaaatactcattgatcatgcagcactttataatgcgcataggcttttttctcctgctaaccccgcctagcttccctttgcagcttcttctcccaagccctctccccacagtaaaataatcttcctgaagatgtgaaatagttaataaattatctcaacagtctaagtattaggaataccactcaccaccataaagcctctttatctgaattacccaggttttatctaatgaggaaaaaaaagaaaaaccctacacaatcccacagataagaatatgagatttaaatacctatacctataaatacaaatttctaatagtatactacattcaatgccaaaagcaattatagtttcactttgacatgtatttccttggactgatttatactcaaataggatcttataaaatttttacaaccagaaaagagaaaatataatttaaaatgttcatgattcaaattatagtaattttgtattgatgtctctctagcatcagtgccctaaatttcagggttttaatatttttaatttaataatttgttttataataatcaaagtcacatgaaaaatctaggaccagagtataccagctaaattaagcaatcagattgatataaacatgcttagtttaaagctaaaataaccgtttttaatagttaactgcagcaaagctttaggcttagatatgtaaatgaattctaagacatatgatactaaaccttactcaaagctgctttgcagaccccaccttctaatgagttaatctaaaggtcaccaccagcacaaggctttttattaagcctgagtctcccctttttccctaacaaacatatatctacaatttatgaaacatgaagtttaaacaaaataattatagacgtctatagtaatcatgtgaaccagtctgaaacattctcacacggaataggtctgaccgtgtcttgcttttatgctctgcttctctttgctctctcctctaatctattcatctgtaaaataattccggcagataagatttctttgttcagatttcaactttcatttcacttacaaacctagccctacctcaagaatgtcttctagaacatatgcttccatttcagccgctgtctccaccatgttttatcaaactgccatgtttcttactgcactatgattagatcattgccagcaggaacactcctctgtgtcagcaagggaacaggaaatggaatgttctattacatgcctaaagcagcttagctgttcactagccaggcatctaccaaaagagcagggggtgactcactgtgtattttttaaagatacagaagctctattccaaagcaaacttctgtcaagtaattttaacagacaaaataaagtctcttattttaccacttcaatttttaaaatcctaaaatttcaaaaaagaaataacatattttttaaaaagctatttaacacgtctggcttcctggttgaacaaaagaggttgaagtgggttacgcagcaatttatccttagtaaagccttgtagtgagattaatggttgtattaaagacgcaaagaaggaggcatgataatgccaagttagaaatttgctacatcaggcaaatgtattatataacatacatattacagttgacttcagggtttcaaaaataattatcctaatgtagattttttaatagtaaattggtttttataaactaatctgcttgtaaatacttatgagaaccaggttaacattcaactaatttacagttactgaagcaagctataatatttgatatatgcattttctagtagtgcctttaacttcatttactaaccaaagaaatggcctttttctcttacaataaatactctaagagactaaaatatcctagataaatgaaatttagagacaccaaatctggatcatcaaacagcaaataaagtgagtgagtgacagtggagccaatatatattatattcattcctgtaattgatcttccatttagtaaaacttgttagattgtcaaatttcttccttatacaactttgaatatgaaaaaatgcactgaaaaaggaacaatgggccgagcgcagtggctcacacctgtaatcccagcacttggggaggctgaggcgagcagatcatttgaggccaggagttcgatcaagaccagcctggccaacatggtgaaaccccgtctctactaaaaatacaaaaattagctgggcgtggtagtgcatgcctgtaatcccagctactcaggtggctgcatgagaatcacgtgaacccgggaggtggatgttgccattgtgccactggcaccctagcctgggcaacagagcgagactgtctccaaaaacaaaaaggaacaatgttttatgctctaaactgagaaaagtgatgtgatgatgtgcatgacattgctggtactatctcctcaaagtgatgtcatgttttagtggtgattttggagtactcttgggcctcaatttattaatcatgaaatgggataatattcattcaacttgaaatatcagaaactgctctaggtgcagtcaactagacagattatggtttcttaacagtttatatgaagattaaatgatataaagtacctactacacggtttctggtatttaagaaatacccatactgtgtcaagcaatatatgatttctttttttaaaaaaataaacatattatttatcctcataacaacccagctatgtcatatttttaaactacattttgcttactatatgccattttaaatgctttttatatattaactcatttaattttcacagtaatcctaaaacatattattattatccccattttacgtatgtggaaatgggacaaaaagaggttaagcaacttgcccaattatttcaagctaagctaattaagttgaagagttgagatctgaattcaggcagtttgcaccagactggagtccatatccagaatcatcaactatacttcttccctgtgataatctcattttacgaataagggaaccaagtatcagacagggcacacagttatatgcagagtcaaatccagatgcaaatccagaactgattgcaaagggtatgtggaattaatggcaaacaaatgacactatgttttacctcataccatacctagtgtttacatttaggtatgggtatgcctggcatttaaaggctgctcaaagtaatttacattgttgagacctggcttaaacagaaactacaaactggcttttgttatttcctgcctcccaggtcaattctttctatgcttcaaataaactgctccatctttagacttaaaacaagtcgtcaacaaagtttcccttcctcaaattttcctctaatgctatcaagcaatgataggtttgagttcaaggaacgtatgctggaacactctccttttccataaaccaagaataggccttccaaatcctttatctgacaagaaatgggggcccctaagactaaagttaataaaacctttcactctccccttctcttccattctaggattatggggtgcttctgttttctgacatttactgttgtttttaacaatacatatgtgattatggctttctcacagaattatggctatcatttattatctgtctcccttaaagactagaaaaaagcaggcaacactgttgaaagcaggcaatactttggccaggcgcggtggctcatgcctgtcctgtaatcccagcactctgggaggcccaggcgggcagatcacctgaggtcaggagttcgagaagagtctgactaacatggtgaaaccctgtctctactaaaaatacaaaaacaataagttggctgtagtggtgggcgcctgtaatcccagctacttgggaggctgaggcaggagaatcgcttgaacccgggaggtggaggttgcagtgagtcgagatcacgccactgcactccagcttgggcaacagggcaagactctgtctcaaaaaaaaaaaaaaaaaaaaaaaagaaagaaaagaaaaaagaaattaggcaacactttattcaccaatgcatacctagagccagcactctggcatagagcaggctcttaagcttttttttttttttttttttgaggcggagtctcgctctgttgcccaggttggagtgcactggcacaatctcggctcacagcaacctccgtctcccaggttcaagcaattctcctgcctcagcttcccgagtagctgggactacaggcgcgtgccaccacgcccatctaacttttagtatttttagtagaaacggggtttcaccgtgttagccaggatggtctccatctcctgacctagtgatctgcctgcctcagccacccaaagtgctgggataacaggcgtgagccaccgcgcccgccagcattttttgattaaatgaacaaattcacagataagagaattgtctgatatccactacagtatcctaataccttttaaattattgctactaatagtaataatttcttttcttctgtttttttttttttttttttttttgagacggagtctcgcactgtcgcctggggtggagtgcagtggtgcaaccccggctcactgcaacctccgcctctggattcaagcaattctcctgcctcagccaccagagcggctgggattacaggcgcctgccaccatgcccagctaatttctcgtatttttagtagagacggggtttcaccatgttgaccaggctggtcttgaattcctgacctcgtaattcacccgcctcagactcccaaagtgctgggattacaggcgtgagccaccgcacctggcccaatagtagtaatttctttattctttctttttcttttttgaggtggagtctcgctctgtcgcccaggctggaatgcagtggcgcaatctcggctaacttgcaacctccacctcctgggctcaagtgattctcctgcctcagcctccccagtagctgggactacaggcacgtgccacaatttctaacaaaagcatttgttcttttactctatctttaggtcactggatcactgaaataagatattagaagtattgaatataaacagaatctaaatttcagattttctgcagttatttgttacatagcaaaataatgtatcccctttaattctgttttccagtccttttcatcaatatgattacctatgtcactgcaggataccatgggcaaaaggatataaagagaaatttatacatatttgtctaaaacctgtcatcctaaaaacaagccaccttccagttcaacctaattttatttttgagacggagtcttgctttgcactccaggttggagtgcagtggcgcagtttcagctcactgcaacctctgcctcccgggttcaagtgattctcctgcctcagcctcccgagtagctgggattacaggcgcccaccaccacgcctggctcatttttgcatttttagtagagacggggtttcatcatgttggccagggtgctctcgaactcctgacctcaagtgaccgcctgccttggcctcccaaagtgctgggattacaggtgtgagccaccgcacccagcctcaacctaattttataggcaagaaaattgtcttcccatttatctaaaatggatttcaatggcacaagacttttcattattttgccaacagaagtattaaagtgtaaatagcaattaacatattaagctatgcaaacaaatgtaaacatataaaaataatttaaaataataaaagaaaatattgactgaaaatgttcaaatatccaaaatgaagagtgaaacctctcataaaaagaaggtaaaggacaaaaaagctcagtaaatacctagattgaatgaaagaatcttccaaaattgacaattttatttaggaccagcattggtttccttgaagaaggaaaaagaaaatcaaaacaaaaaaatatgtagaaatgtgctgacaagcaagcaactctgttttgcatgacttaacactttgttgtttgttcccttcatgtaaaactttaatagaaaactccttgtaaaggagtttcattcctatcaattttttaacttagggaatggtgaggcttcaaaatctatatattcaaacaaaacaaggactgacaactggtggtaggaaaaatttaatgattttgcccactcacataaactactagaaaaaaaactaaaacaattctacctcttaaaattattaaatttaatcattactttatagtatctctctttttctcttttctactgtgtaaattatagtaaagcataagtatgaaacccaagtgtgaaagagcctaaaccaagtataagtgaaagatattaaaacagaatttaagttaaaaggctaatacgatttggtaagatttctgaaagtccatacattattaaaacaacacattctcatgattttaccttttatttctcctaaactactcatgctataaaatgactgaggaatctagatatatgtctaatgtagcacaaaataaagaataaaaagtaatattctttttattaccactatagtttattttcttctttattaactatgatttttatgtaaaagtaatacatgtacatggaaagcattcacggtttaagagaaaagcaaacctacctcttaccaagccatcctaagagacacaaccagttattgtatccttccagaaataacctacatatttcaagcacatcttagggtaacattattttttatacagatggatactattatgcatactttctgtatcccaattttaatatttaatactccataattgtttcagattagtacataaatatttatctttgatttttgacagctgctcaaattttcattgcagaactgcataatgtatttaaccagtccagcaggcatttatcttgtttctaacgttcatacccaaaggattataaatcatgctgctataaaggcacatgcacacgtatgtttactgcagcactattcacaacagcaaagacttggaaccaacccaaatgtccaacaatgatagactggattaagaaaatgtggcacgtatacaccatggaatactatgcagccataaaaaaggatgagttcatgtcctttgtagggacacggatgaagctggaaaccatcattctcagcaaactatcgcaagaacaaaaaaccgaacactgcatgttctcactcataggtgggaattgaacaatgagaacacttggacacaggaaggggaacatcacacaccagggcctgttgtggggtagggggagggaggagggaaagcattaggagatatacctaatgtaaatgacgagttaatgggtgcagcacaccaacatggcacatgtatacatatgtaacaaacctgcacgttgtgcacatgtaccctagaacttaaagtataataaaataaaataaaagtttagatgttacccaattaactgccttctaaaaaagttgaactaatttatactgacagtgagtgagactgcctgcttccctacaaatataaagtgttactgacacaagtctactaaaaatccagatctgaaatcaatattagttttaaatcatgtatccagatttattcttagttcatcatttctacttttcaagaatcacaaatcaaagttacacctcctctcatctaacttcaaaaaaaatttaaaaaatccttatcaaaaaaaacacataaattctccaacaaattaagaacttcaattgattatttaaaaaaaaaaaacccaaccacaatgcagagtctatatatatatatacagctgatatacaggtggagaagagagaagaatggggagtccaatgatctaccctttaaaaaaaaatctccttctgataaaatacaaattccccccaatatttaatgggttttttaacctggtagtaagttgtgaaaagatgcttctgccagaatttagtattttaaagacccagaattgtttgggaaatatttgggtatattctcactaaataaaatactgctggatacatttatttctttgccttctacatttatgttcaaattactctttttaaagcatgaaattctaaagtaatccatcatattaaaaaaatctaatgtacaagaatacagggccacacataaacaatttttatgaacataaaaagcactaaacagtttctatctcagtttcttggcatagattccaggtctaattttgatgattacatttaaaaataagaatgattaagccttcaccagaactgccaaaataagacagttgaacatgcttcgagaaatgtagaagaatatctaaaggatatatgtaagaaaggactaagttaaagatacataaaattgtaacattataaataaaataatgcaacatagtatccagtagtatattctaaatataaggaatggtagggagggtatgtactactttgtaatattcaaataattaaagattttttttttgcttaaacatttttctcaaggctcatactataaaaagccccagtacaattgttttgtaagatcatcattagcattttgatcattcatttaaacaaacatttactgagtacttactaggtggcagggtttatactatatacactggagacagaatggcaaataaaattagtccacctccaagaggctataatctagaacacaatcctgattcttgacaatgtttaatactaaaaacttcaatgatttttttctctaattggtccccttcccattcttctctaatccaactaataaatgaaatctgaaattcaacctagaaaagtacagaagagaattatattagatacaaaacgcttcatccagatgtgtcctatgtacagaatgaaatacaagcatagtcttgtcccaacgtaagtaatgtactaaacaaagtaagaaacaaagcaatgctgcctcttttcacatccccagtaatagttgtgtctgttggacactcgcatttgttgtctctacccatggtgggtcacaccatgaattcattctttttccagcatttcacaataggttctatgtacacaaaactgataaaatatttattgtttacaatcaaccctcccatttgtctgaattgtacattttcaaatgaaaataaaaacaagtgcatacataacagaaattacttatttcaatgtttttgattttaaataggttaaatctattgatgatacagcactttcaacctcgtcagcaacacatttgtcctccacttgaaagcaaatatctaccaacagaaagaaatacacaccacacacacacagacacaaaatggaggtctaggggacctggggataaaaatttaaattacaagaaaaagcttaaatctaaagacaattttcttgagtcaccggtttctaccactctgggggaatgaagaaacagttccaagtaactcaagatagcatcaagggcatggaaaataatcaggaagtaaaaactacccaagtaaccatggaatctcattgctatcactggctctcctctggttccttaatggtctggggtccctgacaagctccaatcagtctggtctcaagatatctgttaccactctgcgctctgctatttccagcctaatctattcataacaaaccttgaatggtttgcctgcaagcaattatttaaagatgtaacttttgcaagcaattatttaaagtaccaaaagactgcctgtgatatcatgaaatatacatttggtctctggtcttagaccagtttcctggcatacactcctataatccttagaatcttcaaagtggttatgtggcttcctatatgctaagatttgactgaagactgacaggccctaggtagcttcagaataagggttggttttagcagaaagaccaggggaagattaaatggttgggattttcagccccaactcccatactccaaaaaggggagaataaaagtgaaatcgatccccaacggctgatagtttaatcaatcatgcctatgtaataaagtctccataaacgcctataaggacagggcgtgaagggctttcagagaacagaacacagtggaagttactggagggtggcacgcccagagagggcagaatttccatgccccttgtcccataccttaccctatgcatctcttcagctgtatcctttgtaatatcttttacaataaaatgtattaaacataagtgtttccctgagttctgtgagctgctcagtaaattaatcaaactcaagaaggggatcatgagaaccctgatttataggccatgggacacacaatgggtcctcagcaaagatgagagggctaagtatataagatcagccacgtctttagaaggaagggggagaaaaaggcaatttctatttccaccttccttcttctagctcttccaggagacataccttgcctccagtagttgtagctctccttgatcacatgacttccaccttaaggacaaactagtttctatacttggtccttagtccatcggataaaatgtcatcttatttagaggcactggaaggaagtaggcctcagaattttccaattttttgtacttccgaatttttcacaataaacatttgttttttaaaaagagtttcctgtcaaatttcatggaaagggatcagaaattaacactcaaaatcgagcatgtaagccagtcaagaaagaattaggcatcttacattaaaagagtcacatttgtattctacacaactttctaatttcctagaattaatccctgtgtcttctatttgtacctcagacaatttccgaaaatcacttggcccgagaacatatttacttcataaagagcagtattaaacaactaggtagaggccaccacatgtctgcaataccccccctttttattttttgagacagagcctcactctcttgcccaggctacagttcagtgatatgatctcaactccctgaaacctccacctcccaggttcaagcaattctcctgcctcggcctcccaagtagctgggattacaggcgcagctaccacgcccagctaatttttgtatttttagtagagacaggatttcaccatgttggccaggctggtctcgaactcctaacctcaagtgatccacccgccttggcctcccaaagtgctgggattataagcatgagcctctgtgcccagccttgcaatctttttaacattataaatgtgatgcatccacttagggtttttaagaaattcaaaggctacaaaggcacaagacgaaccataagtcttgttaccctcctgcatcaaaatggcaaaatacatgttacatcattaatagacttctagcacagttaccagtttaactttaatgccattttgctttcatatcttgattcaccaaattttatatgcttgttatctactgactgtccaccgaaaaaacgagcactgaccccttcgtttgttgccctccatctcctaaatttatagatattatttttatattataaaggtttataaagcattctactccataactataattaagcccattttatacattttctaggttgattctaaaacagaaaatcaataaagtgtacttacaatgtgattatataaatactagtcactaaaggaaatttaattttatgttgtttagacattactacttgaagaaatgttcatgtattccagactaatagaacttgaatttccttctagctttcttcagttctttttgaaggcccaagattgccacagcagctatttcttcccactcaccctcccatccccccactaccaccatatcctctaccttgggattatttttttctctgtgctactgtatctcaaatatgttcatacaaagtgcatcgttttttcccagtatagaaaatgcaattgtcctcacatgataaaatagaggggctgggtagagaaaacataggtcaaaatctattgtctctcaaacagtgaagtcactgttccactgccttcaagcattcaacacagctgctaagaacttagttatttgattttccgtattttttccctctctctggcaataattttgggatcttcttgtccttaagagttctaaaattgtggatctttttccattcattttggttactagatgggctctttcaatctgaaaattcattacgtttctacagctcaggaaattttcttcaattatttctttcattattctatccttcccatggttcctaaatctcttgctctgagaactcatacttatggatgtgaaaaactgtgatatattttccatgcttctttaattttccctcaagtttttccagattattttctcttttgatttacatatgcagacagttcctcctcttaattccaaaatcaacaattgagtcttgattcatgctgaaattttatctcttcaattaaaatttttataattttcaaaaccttttctagttctatgcccccttttaaatgcaactatgattaaacattacgtattcttaaattttaaataaaatactaattacactttgaagtattcttctgaattatagctgaggttggttgttcttttattcattttaatcttctttcatcctcttgattgtcctcaattgtctgattatccctgtctgtttatatttgcaaatgaaagattactttagagtatatagagtgtaagagctttccctgaggttatttgggtttgttttcctaagtggcttctcctttaaatggaagaacagtacaatttaagcaggtagggcacgcgtatacgcaggtaccccaaaaaggtacctggataggaagtcaagttggctgggaacagacaaaactgtttttctcctggggtagcacagtgcctccacttctctctcaggttctaacacctaagtagatgcccatactaaactgctgacctactttcttaagagaatgattctgaaacttcaggcctaagagtgggcatcatagttgtttaggctggagaaagggtaggagggaagcccaactgacctagcactgtggaaaagaagtcttaagaaaattcttaagtattacccaactgcccactactactgattggtgtttgttgactccaagtttggagccattccaaggtttccctgggaaaacctgagcttacctctgttatcttgggttccagtttcctctgggattttgctgtcaatccgattccatgaactttctatcttcttcaaaatttcttggtcctctgatggtacctgtagtggactgtgaactgtaattttactgttcaacatgttttctccctgaccccttttgctaacaacatcatccctcttttttatggggaatgtattcatgtgctttgggtagaggtgagccttcccagtcaccacaggagtggccactatacctaggtctggctagaatatcccattcccatctcctttgagtgacagtcatctttggctgaaaataaagctgatacagaaggaaacgcagaccaaaaatgttgagacagtaacagggttgcagccatactactaacactattcaagtttagatccatctatgcacctaagttgtagtttcttacctctctccccacatacacccaagtacacattaaagttatagagctaatgaggtccttttgttcctcttaagggtagtttgactaatataataacatctgttcccgcttttcagaattatgacttaattcaatctttaaacaatatcagtgggacactgaaaagaaattaaaggaatgtactaaatccaccattttttaaaaatttcagtcaataactaaaataagcccggataaatagagttatacttttaaaatttgttaaacatacaataaggaaatagctataaactttatttagtacatcttatctttccaccctcagagggaaaaaaggcagatataaaaaccaattatctctttactagttttcttctaagtcaggattccaatagtttcagaaagaaaaagaaggaagaagggaaggttcgtaatgatttaaaattttttctttttttttttggttttaatagagacagggtctcactatgtttcccaggctggtttcgaactcctgagctcatgcaatcctcttgcctcagcctcccaaagtactgggattacaggcatgagccaccacgcccaaccataatttaaaattttctagcaaattattattttttaaagctctcttatatgacagaaacctttcaaagaaaaattctgtagctactgttgtgattactggggacagagtagggaaaaaggatggtcaataactcctcaatggataaaaaacaaaatccagtactcctttttcagacagggtttcactccatcacctagactggagtgcagtggttccatcattgccactgtaaccttaaattcctgggcttaagcaatcctactgcctcagcctcccaagtagctaggactaccagtacgtgccaccacacccacctaatttttaaatttttgtagagatggttactgctatgttgaccaggagagtctcaaactcccagcctcaagcaatcctcctggcctcccaaagggctgtcattacagatgtgagtcactgcaaccagcctgaaatccagtcctcttgagctaaggttcatattgtatggttcacacctcaaatacctatgcctcaaaaactctatatcccagaaacaactggcaaaatgttgtatgatgtatttaagtaaatgttggaggagaataggtctacatttttcattataatctaactaaagtccatgacctaaaaaaggtaaagaaaattgatcctgactgggaaaaaaaaaatgacaacttcattccaaaatagtatataagaattaaatccagtaaaatgtcaaaataagtaataaattacctccaacacagaaggtagtatagtgtgctaaataatgtagattacctccattctttagaaaaactctgttaaaaataaatcattagccctaaggtagatgaagacaacaaggttaagtagtaactgtccccaaatcacacagtgttaaagcaggattcaaaagcaagtggctcaacttgatttcaaactctttccatatcatgcttttttcctggagaaatagtgtaagaaaagaaatacaaaggcattgggttatttcagaattaaatgtaatttttgtcaagcacagaaactgtgaagtattcatatgcctgtggtttaatgaaactggaatctggcccttcttcctacttgctctctgatcaaagttttcagaaaaacttctgcttatggtagtgaggtcaggaagaccttcgtatttgattaagatatatgaatcttaacattctaggttgcctaagccaatgaatgggtaccctggccaagcaaagctgttcttctgggatccctgggatacaaaacaaaactgctcatgcatagaagacaaaaagctgtaataccaagcctgtgttttttatgtgttagcataaaagacaaaaggatctggtgattaagctaaagtaggttaagaactccctcatatgaaaagacatctcacatactaaggcatattcacaacttaaatcatattacagtccttcgatctggccaagagaagccaggtactgaagtttaggtggcagccagaaagctggactgagtggtagagaggatcttggactgtgaggtggggatctggatgcagagtaagaaaaggaagaaaaggtacaagtgaaaggagtccacaaagtgagttagagatacattctaaaggtcctgagatttagaaaacagcatgatcaaatctttgccttcatacttttcattttatctagaaccctagtattatctgctaagcctatagcagagacgccataggcatatggtttgctttcatattcccagaaaaggacttaagagtcagaaaaggatgtgcatttcccataacccttatctctccctctttattaacagtatgataaagtactacaaatttttaagttctcaaggaatttaagaacatattctacataaattctaaaaacttaacaaattcagaatacaaccattattttgtgaactgttcattacagaatcccaaccccttaacctatctactatcagctccacctaaaacaattaaccaaaatgtacaattagaactgaaaatatttactagcaatctataaattcaataagataaccaaatttaatagaattagaaatttaaaataagggattctcctaaattaaaaaaaaaaaaaaccaaccatctcagtagtcagaattttcataagactctctatttttattcatacttcagttttaacaattaatttatgaaaatccttataggtcacaaatattttcacaaacattaggtcacctaacctccctcaaaagaaagtattaccaggccccttttatgagagactgagatatttaatttttacatgtcacacttacctaacagcatgaattaagaggtataggagggtctaaaacagcattcttcccacttcacattttgagcacttactgtaagaggtaatctacaaggtatgtattttgatttgatgtttcagaaatattgaagagtgacattcccatttattccacctatgaaatccatcccaagattaatccatgaatgttcccaagacaggagttagggaaacaagatgaaataaaacagagcagtattaactagctacattcaggtaaagtgttttggagtaaggaggtcttccataaccctccttactccatcatttctctctggttatcctacttggggataggtcactatacataaatttgagtaagacggtattcatacagatctgtaaagaggacttagaagcaagatgaaatggctagtgaactctacaatgcatacaaaacatatttcttgagcaattactagggaggccataaaaggatggtaagaaggcagtacaatatgagagttaagaaagcagactttcatgtgagactacccatgtttatattccatttccatcacttactgtgaccttgaacaagttacttattctttaccttgattttttcaactacaaagtgtagatactatgtacctcttagaactgggaagattaaatgatatacagcagtgtaatacacataaaccaattagaattgtggctggcacacagtaagcactcactaaactattactggggttaaaattattcaatgttctaggtgttataaacaccttcaggaaagaggtgatatatgatctggcccttttatggataaagtagtcaacagagagggatatccagaaagaacagagatgaacagggcttgaaagctgatgtttgacctatcagatcctataccactacaaaatcactagtttttaaaatacagtgctgacacacaataaaatgtcagttacagaaatagattcccatacctttggtctagcagttttacctctggaatatatcttaccacaatacagaaacaatatcaaaaagtccacttcagtattgtttgtaacagcagaactttggatacaaccaaaatttccataaactggaaagcaattaagtcctgatacctgacaagggaatactcacagccatttaaaggactaagataactatatgtgtattaacgtgaaaatctatgatggaatattaatttaaaaagaaagtttcaaacaatatttttataatgatctcatttatgcaaaacaaaattacatagatatatctgtatatgtgtgaaaatgcacagaaaaaggcataggattacatacacttacaatttacacctagggatataaaaaatcttcaactcttactctgtatcttcctctactgtttaaattttcagttcacagttactatatgatttaataaaagtggaaaaagatactgcaattttaagattcctccaatataaaaaaatcaaatggataaataaaaagaaaacattactcacagtttaacatttggtgaaaactttagacaagtttggtttaaaggatattaccccctcaatagaattaaatttatctacattgtatcttaaaaggatattaccccctcaatagaattaaatttatctacattgtatcttatacaagctcttcttttttgacattttctgaacagcaactatgtaagttttaaattactcctagttcatttgaaatagataaaataaacagtgaaacagttcttcaaagaacattggaaagatagtgcaagagaactacacaacagtcatagtttataggtcctgcaataataatgtatagagattttcaagttcaaagacaacctaagggcatcatcaaatcagtaagaacactatatagatgctggcattgcttatattttcttcataaaagtacttctgtactagaatctgtaagggagggaaagagaaaagaaaaaaaaatgtcaagcctgtttagaggtttaagcaataaaagaagaaaaattgcttcaaaagatcactgacttggctgggcacatgggctcatgcctggaatactagcactttgagaggccaaggcaggaggatcacctgagcccaggagttctagaataacttgggcaacacagcaagactatctctacaaaaaaaaaaaaaaaaattagctaggcatggtggcatgcacctgtagtcccagatacttgggaggctgaggtgggaggaacacttgagcccaggatttcgaggcggcagtgagctatgatcatgccactgccctccagcctatgcaacagagcaagaccctgtgcctaaaaaaattagaatttaaaaaaacacataactgacttgattaagtggaaaacatctaaaattcctttaaccataaaaccccacacagatgttagctacttaacaaacacaggaaactgcttagtacaagtagccaattttagtattcaggccttcagcttatataaattcagtacttattcttttttttttttttttttttggagatgagtcttgctctgacacccaggttggcgtgcagtggcacaatctcggctcactgcaacctccgcctcccgggttcaagcaattctcctgcctcagcctcccgagtagctgggactacaggagcatgccaccacacccagctaattttttttgtattttaatagagacggggtttcaccatgttccccaggctggtcttgaactcctgagctcaggcaacccgcccacctcggcttcccaaagtgctaggattacagatgtgagccaccgtgcccggcccaaattcagtacttataaagatgtatatactgagcagatatttggtttattgttgtattgtggaaatacataaaataaaggcattattcaaataatgaggacagactatgaaacagataagtcaactgattaactatttggaaatacaagattaagttcctattcccctcaatgaacccatataaatttgaaataaatgaataaaatgtaaaagttaagaggcacactagccaagagatggaagcaacccaaacggtccattaactaatgaatggataaataaaatgtgatctatacatacaatggaatatttaaaaggaaatccagtcacatgctacaacataaatgaacctcgagaatagtatattaactaactagtaagttattatttttaaaaagaggtatgtactaaattacttaaagccactttttaaaaaattactaaactataaaaagatcaaataaaccacttactctaacttctttctaacatttcagtggccaataaggttaaaaacacaacatataagactaaaaggaaaaaggatgcacataaactgaatctgtaaaatgagtatctttacaaaactgatgtaaggaaaaaatatttacagtttcttcaaataaatttgaaaaactaacatgaataatcttcatagaaaatataaattaaaatattaatgaaactaaaccaacagtgcattaaaataattcatcataccaagtattcaaaacacaattaaaattaggaaatcttttattacaattcaccatatggacatactgaaggggcagaaaaagaactgaccatttcaaaagatgccaaaaatgcatttgataaaatttagtacattatttctaataaaacttaagtaatttaagaaaaagtgatgtaccctaaattgataaaagatatctgcattatacttagtagtaaaacaacagcacttccattaaaaataagagaaagacaagtataacctctgttaccactgacattcaacattttgggggtggttcaaaactcacgcaataagagaacaaaaacaaacacaagggacaaatactggaaatgagagaaaaaataatttactggaatcaatatgacatttgagtcagaaaattcaacagaataaactgaatacaagaattcagtttagtggccatatacaagattaaaatatgccaatcaatagcttcctatattccaacaataactaattaagaaagtataatggaataaaatataccatacatgatagcaggaagaactataaaataatctgaaataaattccacaagaaatgtgtaaaatctatacaaaaactaaaattttattaaagacagatgaagggcctgaaaatacataagtatgccatgtttccgaatgggaatattcagtattatacatatatttctctccaaaattaacacaaatttcaatgtataatctgagaatatttcatggtcacgtacaaaagatgattctaaagcatgtctgacatgttaaatgaacaatatccaaaactcttgagaaagaagctcaatgagtgagaactgccttctaagataccaaaccatgctaacatattaggctgaatcatatgaaaccagatattcaatgacttgtggcttataaaaataatttcgccaaggttcaactgtgaaattcactcaaagtctcccaccccacttccacccacaaacttctttccacgtagtaagaaacagacataagagtttactaaatatttaatactaataaagcttggtgaaaaaccaacagggctctttcctatgtttcactacagtgcaacttactcagttaaggcaaaaaactaaaagggaggtaaaagaagaagtggtgtaaggggagaaagttccctctaacaatactggacgaagaaggatatctaagctgaaaactaaaggatgagaaaaaacaaagaaccaggggaacaccacactaggaagaaagtaaaaagaccctagctagaaagtctgcatgtttcaaaacaaggagggtcagtgctactagacgacagtcaaggaactagaagggctggaacaacaaggagcagccatacaaagttctgtggggcaagttaggagtttggattttattctaaaagcaatgagaaatcaaataacaatgacatttcagaaagattagcctaatgctacgtgaagaatgaatgaagaatggggattcaggagaaaaagccaggagatcaaattaggaggctactatgaagttcaagtaagaaaatagccagggttaaggcgatggtagtggagaaggagagaaggagaaaaattcaagacatattttggaggtagaatggacctctcctagtctacctcctacatagggtggagaaacatgacctagtcctaaacaaagcatctttttccttagtgatagtggctggttcaagaatggacacatgaccaaagcttggcccacaagattatttcaggaaccaggaatgactttcattcttgttttggtagtcataaggacaatataatcatagaattgtatcaatataaaacattaattaccctccaatatccacagtccccttcttttagcaaaagactacttctccacaagttttacctgggtacatggccactcagcaagagctgagtcttagatatggctgcgtaagaaatttctggtcaatgggatataatggaaaatgacgttggcaacttgttggtcaattcctcaaaaggaagttacctatgctgacctttctgtttcttatttctccagtattagtttactagcgctaccataacaaaataccatagactgggtagtttaaacaacagatatttattttctcacagttctggagactgtaagtccaagatctgggtgtctgcagatttgtttctcctgaggcctctctccttggcttacagatgaccaccttcttgctgtatccccacatggccttttctctgtgggcatgtatctccggtgtcctgtgttcaaatgtcctctttttataagtacatcagtcagatggattaaggcccactcatatgacctgattgaaccttaattacatttttaaaggacttatctccaagtacaatcacattctgaaatacttggggttagggcttcaaaatattaatattaatgttggggacacacagttcagcccataacaggctgaaacatggacatgatgctagtgagccacagtagatcttgtagatgaacactccaaagcagagctgtccaataaaactttctgtgatggaaatattctacatatgcactctccaatatggtagccactagctacatgtaatatttaaattaaaaattaaaaaaaatttaactcaaatccttagatgcgctagccacatttcaagagctcagcagcaacctgtggctagtggctacagtattggacagcactgattaagggatggtgtatcaagtgcaagacagcagatacttagatgtgtgaataacctgaaggtctacctctggagtagcacataaaagaataacaaacttctatcttgcctgatgtgttctggagtctctttgttcaaatgatccatcctataccttaactaatacagttaattggaaatgacacgctgctctaacaaactcctaaaatctctggtaaggcttagagaacaggtagcaaggaaacatctcaggctggagatctaatgatctgtgctatacagttgcagaacatttagtaaaactcttgcctgcaataattggaagggcacatcatatgcctactaagtttgtagttctaagaaaagcagttagaaaaactcgaaatatggtgtgttggctatttaaagatcaacaagaaagatcaattcacctataaagcagtttgcaagcagagacagacatgaaaacagtgctactaaaaagaagctttctcagtggcaaactccgacctacaagagtccagtaatttggggcctcccaggatggaaaaggcagctgcttctgtgctctaaataccaggaaataactttgtgagttcaagggttctctgtcaggtagtagcaaagatcaagttaagagtgttgcttttccacctgtaatggtttcttcttagaaagaagacaggacagcagacattttgtagcacaaataccttctctcaattattcagtcaaatgctaatctaggtactgctgtgaggggattttgcagatgtaattgaagttcctaatcaactgactttaagccagggtgatcatcctcagtgagcctgacctagtcaggtgagctcttaaaagagatcaggttcttccgagcaaatgagactccaaacagcagctgagtctacaattgttctctcttcgctgtatcttcccttcctgactgcctatggagaacagcttcagcctaagcccatggattccaccttgcccacaatcttctcccactaactgcctgccgtacagatttcacacttgcttagccagccctcacaatcatgtaagccaaattccttgtaataaatctcttaatacataacaatcatatataaatctacttgctctgcttctctggttaaacccttactgatacatcatccaagactattatttcagatcctctcgaggtagccaggaaacctaagggagagaggagctagcctagcacagagaccagtaaataagagaatcagctggtttccaaaacttaggactaagagatattttgctatagttattgttacatagtcccgatctaagaaaaacagaaaagaaatctattatgtttttgaaagagttttaccaacaaactacattactggcctaaaaatcttacacttgaactttaagtaaccctaccggccctgcatctataccaacaggtagggggctacaaaagttgtacacttcctagggatgtcacaccctccaatgcctactacttcaaatgtggctaaggaagataacaaacaagaaagaatcatctaaagaactaagcaaaggaaacagacagcagtgaaaagagcattcctctcatagaggaaaatcagtataaccaagaaaattactcagtagccagagcaaagttgtcacaactcctcccccgaaggatttcattattaatatgtaccaatgactgctgtgtacttcctattcttcccttctctagaagagttttcattatgattatcctattcctactcactactacacaatgggttgggtgaaaagagggagagatagttgtttattgctttatagatcactagaattctctgaattaggaggaaaagcattttgtatatatctttcacttggagctgtatgtagtaactggatgggactttgaattgattctcttgaggaaagaaacaattaggtgttggaagaaaggtttgcacaaatggtaggtggccagaagggtgagcccaattctcaaaaaaaacaaaggtttaggttggagctgtaaacctgatagtcactggtatatagatatgtaacgacacaatagttaaaatcatctaaatgagaccagacacaaaacagaaaagggtccaatgaggtaaataatcaaagtatgtttgctgtgcggggtaaaaggaagcaagatgaccaacaaaaaacagtgaggtacaaacaggagaaggtggtattacatgaggaagagaggattacattttaagaagcaagaatcagtcaactgctataaaaaggagtaaataagaaacagacacaagaattaaatactatatccaaaaagagatccatgtatctttgaaaaacaaagtacaaagaaaaatttctaagaattgttaaatactggagtgaggaagttctccagaagtcataaaagaataatacattttactaaacaataaatttttccatgttgtgaaaacaatgtcaagggagaatactgtaacacataacactatgaaaaattaatactataaatactatcaacaaatcaataagaaaacaacaagacaatcctaatagaaaaataggtaaaggataaaccaggaaattttcaagacatccaaatgaaaaacaaagattaaaaaacttatactcaatgttgacagtaatcagaaaaatgaaaacaaaacaccattttttgtttaacagatttttaaaactaagtaaattaaccacatctaggaacattctcatacactgctgatgcaagcaaaacttgagagtatttatcaaatttaacatgtgcatactctagcccaacaattccatttccaggaatccatcccaaagaaatagtttcatactcaaaaataactgtacaaggatgttcacttcactaatagcaatgtagtgaaaacaatctaaatgtctaccaaaataaaagatcaaataaattatgaacatttatattatggaacattcataagtaaatgagaataatgtggcaaatattaacatactctaacacacacacacacgcactcagtctcaagaaagaaacaaacatttgatatacaccaactgttagcagcatttactctaagaatggaataaaaagccctatatactagaagacatttttgtaagtataaataccgtcattagtttttatttttaaatatataaaaatcataatctgaagactcatctcttcaattgatatatttgaagaaagctcatcaataaaaatttcagcaagcaaaatttctaagtggtacctctgctctttgtgataatttcactacaacataacaaggaaaaagaatgaaaagacgtatttcaggtaatgattaattctgaagacagaataataggtgatttttctattctttagatctttttgagtttgtcaagttttctgcaaatatgtgtttctacaaataggtataaattaatgaataacatttaattatatgtaacgctatatttaaaatcttaagaattttcatcctacactgtcttgtaattcaatcttcatattttaacatatctccacctgcatcaatcacaagtatattaatatagatactctcctttcttactataaaaccttcaaggtaaaattagaatggatgactctttagtataatctagttgtcaaggacactctagaaaaatcgtacatacagacctcatcttaagaacaaacaaaatatcaaaaatcactgagtattccaggagacactcataaaagatataaagtctaccctactagtattcaaaaaccaaaacaaaatgatccctatgatcataaggcacacagttacaccaaaaatgaacatagatgccccaaaaaagtataggatttatacggggctaaaatcatcttcacagttttaaattattactagttttatctcaacaaaatttaaattttatgaatctagaaataatgtccccatttcttcaaaacccttataatacctaggtaattttgctagatgttaataatgcttcttaaataaatttagttcagagagtatactaatagtgataaaactattagctaataatcatagctaataagattagataatagctaataatcacgtggaaaactgaattctatcattgtgctaagtttcaatgtatgtaagttttactaactacaatatgtacaaattaacttattcatatttaacatatacagctataattttaaatataattttttttcatattcactgggaaggaaatagttcagattagacaatgaaaacagccacacataggagataataaatgtttgtcaggtaaaagaattaactcctgtaggagttaattctagtatgtgctatactagaggctttgaaacaagactgttttcattattaatgccattaaaaaaataaacatggcacagagaaagaaagagacaacaatggggtcaaaggcatttctaacactaactgtaacacaaacaggtgggcttccttttcttgtcaatcttcacatttaggttgacaggaaaagagggaaaggaaaatagatctctatggtaacatatatttattctaaattccaaactaatggaaccaacctttccatagatacttccaaaataggtttcaatcaaatgtttttaagctaattaagagatgatccataaagaaacccagaccaagaaataactttagagcaggttcttatttcttcactttcgtatttttcttttctattcctttcttttgtgggggaagatggggataaaaaaagtgaaaggttaaattaggcaagctaatagtatttttgggaaaaggaaagggggaggcaaaattccctgcaagagaggcacagccataaagcagttccataaatgtgccatttctacaatgtactttcaaataatctcaagaaataaaaaatgaatttattttctaaactgaaatagcactatctggtacacattatgattttctctaccttataagtcagtttgagtatgaagtaataagcaataagaatatacttaagtaaaatcggccgggtgctgtggctcacgcctataatcccagcactttggaaggccgaggggggcggatccaaggtcaggagttcgagaccagcctgactaacatggtgaaacttcgtctctactaaaaatacaaaaattagccgggcgtggtggcgccggcgcctgtagccccagctacctgggaggctgaggcagaagaatcacttgaatctggaatgcggaggttgcagtgagacggcatggcgccactgcactccagcctgggagacagagcgagacttcgtctcaaaaaaaataaaataaaataaaaataaattaaaaagaaagaatatagttaagtaaaatctacagtcctcctcaatcatggattccatctctagccctaccatcatttttaaactatccctctctagacctcgttttagtcatcattttcatggtacagcagccaaaaatatacataatctattttgtgcagatgtagcatagcattatttaaaatgagaattatgattctggttatcgccaacgccttaacttcaccctacattatactaagcttttaccaaaaaagcatgctgtatttcagatcatttactcaaaacacattttttttacccttgacgcataaaaacctatttaatatttttcaatttattcccaataatcttgtttcccattcttatcagcataattcactatgatcagcaagctttgagaaatttcaccatatatcaaaattgtttataaaggctgcgcacagtagctcacatctgcaagcccagcactttgggggccaaggcgggcggatcacttggagccgggagtttgcgaccagccgggcaaacatggtgaaaccctaactctaataaaaatacaaaacaattagccaggcgcagtggctcacgctgcaactccagatactcaggaaggtgagatgagaattgcttgaacccgggaggtggaggttgcagtgagccgagagcacgccactgcactccagcatagatgaccttgtctcaaaaaaaaaaaaaaaaaaaaaaaaaacagaaaaaaagagttgtttttaaagacactaataatggctccaataggaattcctcaagtactgtaacggtttttgttgttgttgttgttgttgttgttgttgttgcttgagacagagtctcactctgtcgcccagactggagtgcaagggcgcgatctctgctcactgcaacctctgcctcccaggttaaagcaattctcctgcctcagcctcccaagtagctgggacttactggcgggagccactacgcccgactaatttttctatttttagcactctgatgtttcaaatgtaaaatctttacatttccttctccccactctcttttatctctagtctcactcagaagtaaacttaaaaactaaccccaggctggatgcagtagctcacgcctataatcccacagcattttgggagcctgcggcaggaggatcacttgaagccaggagttcaagaccagcctgggcaacaaagtgagacgccatctctacacacacacaaaaagttgactcctttaaaagatcatgtaatgtttatgagtttcacaggacagaaggcagtctaagttatgctttcaataattagagctatattatttgaagtttcatagcatgcttggggaaaataacagttaacatttcccttttcaataactgaaaccccaaattataaatcattataaaaatgatacctatattgtcccacaactctacatcccttcaggaatgaataataataatttctaaagacaaaaaaatgttaagaagtgaagcactgttaagtcagaaagggtattttgcttctgggtaagaagtggatggacataactgtaccagataggtaagattcaagggactagaagggtattcgtatttacccaccaccttcaattccctaatgacttacttttttttttttttgaaaagatgaaagctgaaaaaagttaggtttggtgtaggttacaccatggatgttggtgcctcctactggtcctaacaaaaatataagtggtaccagcaggcactacttcgcataccaatgtgaagtaaaaattccctttcatctgtggtcaagtatggaaaaattatgaaggtcctcattaaatccacattttttaacccattaaattatccttataaaaattcagataaactactgtcataaatgcaactgcactgcctcaaggacctaaaaactgttttcctaatcaactagatggcataatcaggtaacagcagaaacagatagtctagtgaatttccgagagtcaaaatatgctactttgatgcttattaaacactgaaaactttcacaatactaactccagttaagttggtgaggttaaaaatgactaaactaaaaataatggttcaattaaaacatcccacagggatctactgtaaataatagctgcaaccaagttctgttacctcaagacttgaagtcccaaagatttcccacagtaggtggctaataaagaaatatttatgagttattcttactacagagatgggacttcatgagaacctagcagagatacaaagacttacataagacacatggtactgtatagcaggagatatacagatgagtaagacaaggcttttgctttcagatatgacagtccacagcacacaatgtaaactgcttcattaattaaagggcaaaacatgaagatataagagaaaagagagtaggcataaggctggtttaccagaaagatgtgatcaatcttggacccactatttcacaaataagccttctttgttaccacatcatctgcttagttagaagcagtttccaaactcttaataatccaaataaatgaccaaattccccactaaatctgtagtgagaatgtttcaaagtaacaaggtaggagggagagggtgggggtcacagaactctttgaggatctaatgaaaatcctgcacatatggggctagagcagaaaggaagaaaaataaagccttataagcaccttcaacaaaatcttttgtttaatatcagaggattcacagcctagccagaccccaagttaacaatctctatttaaaagaaacattttttttttcaaattaataaggagagattaccttgaaaagtaaatattttgaaaggcaaggaataagtggtaaatcgcctctagaaagggtggtttttcagtatgaagttttcatcttgttaacaacttaattctaggtggtgggaatatggattatttttctatacttttctgtatttcttgctttctttttctttagtgagtttttcagaagaactggaaagaaaacttggggtgaccaacttgtcttcaatggccgtccaactgcaaaaaagcgtctccccttatacaagccgaatgtgccaatatctgaaatatggtactcaacaccatacagcataacagagcatgtgaatgagtgagagaataaatgaatgaatgaggaggcgtagaatctaacagtcccaggttcaatcccattctgacatttattagctatgtgaccctgatgaggttgcctaaaatccttctatgccagtatgtttacctgtaaaatgaatgctccctgccaacatttgtatactttgaaactcacacattattcaagatgtacatttaaccacttaagctcactctcacacctccccaaacttataatatttattcattggtgtatttttaaatcaaggtgacttacaagttttgttcaccattgctcacgcagtacagcacaatacctagcacatagtaggaactccaaacatttattgaataatgaaagaaatatagcagcacctacttcatagggttatggcaagaataaaatgagaatacgagaaaattgtattaactcatttaactctcataacaatgttataaggtagaatctactatcattaccatttataccatttacatgaggaaattgcagtagagatttaaaaactcggccaaggtcacaatgctagtaaatgatggatcaaggatttaaatccaagctccaaaatccatacttttaacctttacctagacttcacaaacagtaggtactgaataagtattcatttttatttactctttaaaaattttaggaggcttaaggtacttaccaggcattcatcaattcctattagtttaactggctctccccttaatacttagagaagatcatcatcactacgaaaaggaattaagaaattggaaaatgttgaaatctgaacttcagctattcagaagccctggatccaagaagggaagaatttccattccttctcttctttccctaaatgaatgctgaatcctccctaagtactagttattcactaaaaatgttttgtttttttctagtactgtgcttaagcaggagagaagacaagataaattataattaagacagactactgcttcaaagatcttaaaatctagtttacaaatactgctacatcaattaagagatgaaacaagcaagcttctctgggctaatctaggattctaagcattacaaaaaaggaatttagatagcacttttccaataaaaaacaaacaagaatatttccaaatgaagctgaacacagcctaattctgaaatattttttctttctccctcattttcaactctctttttctgtctgtaaacagatcctccctggccttgcaaatcctttcaatactaagtcagtactaatttatttaccggctccctttgtctaaaatttcttcactaggtttatctcttgatttagtcacaggttacttacaaaaacagatgaaattctgatcaactcctactgtatttatactttaagcatcttcaacaaaaatgtttctccccctttgaattctgccttagaaaatactaagattgcagtgcgcagtgtggctcagacctgtaatctcagcactctgggaggctgaggccagtggatcacctgaggtcaggagttcaagactaccctggccaacatggtgaaaccctgtctctaataaaaatacaaaaattagccaggcctggtggcggatgcctgtaattccagctactcgggaagctgaggcaggaaaatcatttgaacccgggaggtggaagttgcagtgagccgagatcagactgttgcactccagcctgggcaacaagagcgaaactccgtctccaaaaaaaaaaaaagaaagaaaaaatactaagatcattcagtcatattcaaaaatgcattcaatagaatgcaatgttatttctaaaataaagtatcaactcttgaaattataagatttttttcttgtaatagtcaaaagcaatttaattaattttgtccactaatttgaaagagcatcatggcttttatgttagaaaatatatttgtattttccatattggtcagtcactcactgaaaaccaagaaaattatgcattttcaattttaaatgtaagattttgtgtcaaatagatggggagagggaggcaagtagctcttggtcttatttgtttccaggtatacccgaagttatgcaaattatctaagacgtgattaccctattctgaaatactttaaagtaaaatcctattctcaataacctactccaatgtctagaaattatattcttattgttcaacaattaaatgaagctcttatttgaattgattctcgtttccttccatttttcctcttttggcagatacagagattattcagatagcatttctttatagcaaagctatgtatttttgttaaattaaagttatcctttcaggttaaataccacaaaaccataacctttcacattcctttttaatcttttgatgatttttactggaaggataattttaaagatcattttatctacttttttttattgtgtagcctataacagaatgaattagagaaaagacaacactgtgattttagccacaagacttcctagctccagaaagttaggcttctgctgacatgtcagtaaaatggtaattaagagaaaaacattacacaactcacccatttagcttacagttttatttgtctttactttgatcaaaagatgaagatggggcagagacaatctgtactcctttttgtctgctcatccctcatctgtatagattttttaaatgggtacacttttttttttttgagacagagtctcgttcttgttgcccaggctggactgcaatggtgcaatctcagctcactgcaacctccacctcccgggttcaagcaattctcctgcctcagcctcccaagtagctgagattacaggcatctgccaccacactcggctaatttttttgtatttttagtagagatggggtttcaccatgttggccaggctggtctcaaactcctgacctcaggtgatccgcccgcctcggtctcccaaagtgctgggattacaggcgtgagctaccacgcccggccaatgggcacactttcttacacgtatttctcctgactcatcttcataaatgacaaacccattgtttaacaccatgtaaaagacaggataaggtatgttaaaaacatagaaatactaccatagttggtgaaagtcaacataaccattcctatattacaaaaggaaaacaaacctgacccacaaaataaacatacctacaaacttacagccattcttcatgatttaaggaattactaaaagttctgcttattaggccgcattccaatggacaaaactacctaggtatgttaagtttgcagcagaatatcccagtaagtactgcattcaactatcataaccttgctctaaaccagagcttaatagtttcacgagaatttaaaattttaagtaatggtattttgcctatagctgcatgattgtgttaccttgctattcagtaactatttttctgaatgatatcaggagggtgataaaaggaaataaattattattaaaaagtgtacaggtctgagacattagaaaactttgatttgtacttttgctactacccaccacaaccactttcctctaaaccttgttttcctcctttttaaaataaagggctgaattacctgtaaaatgtttctcacctttgagaagaatcatacaattgaatgattctaagtaccataacaaattttattagggataaggaccccattacatctttctcttccttgtttcaaatgccgccagagcaacacactatcctaaacatccaagtaggccaatataagtctatcaatacaaacctattctcagaatccaacaggctaaaagggaataaaaacaaggactggcatatttttgtcatacatacttcagcacttaatatctctacctatacaacttcatccagtctgagataaaagagaatctggtcttctacaaatagacatgtgtcaaatcctttaaaaggtacttctctatttcaacagagaccaggattcaataattccaattttcggaaaaccagacttgcatcaaaataagttccatgtttgtggaagagaataaatagtaagtggtacttttagatgaatcacttggtctcctcttagaactaagtttaaaatcagcctttaaagctgttttccctctgctgataaagatttccctctccaaataaagatttttctagattctatttcaggaaggagacaagagagtggtaaaacagctaataactagtaaagctaactctcagttggttgtcagtatggtatgttttactgagcctttgggttgtaagggcttctgtgaggaataaggtcctgcaacgccgcctgtctgtggacccaggaaaaattataaagttattatgaaaccagatcactaggacaaaccgagaggccttcctattccaactcaccacaaccaggcctggctccaaagcctaccctttggctgtcccatattacgggacaacaggtcctagcttaattctaactcactaaggaaacattcgaaggcatgtatgtatgtacgtgtaaggatcaaatatatttttcatccacttacaaatgtatatggtcatttgtaattatttaaagttactgataaatttatacaaatacagcatcagttcatcgaaaatccctgggagatcgaggaaatgaagttacttcagcagccaggatagttacgaaaaaccctgcagaacagtatggaaaagtacagcttctcacgtgtccctcacatacacaaacacttagctctgagtccattacaaccttacgtcccccctcaaactgctcccctccacctcacaactgggagaagttgatcaacctcctagttggtccccaagagactcatttacccattattttactcctcccgctttgatcccgatcccgcctcagactaaggtggccctactggccccaggcagaccacccccccaccccccggcgtgcaaacagggaatctaaccaattccctccatccttaaccaagtgagccatcccatgataacaggctgttcaccaactctgtgaactccgtggtcctcccacccccacgtgtcagctaccctcccccacattcccacacctcacgatttaggccgagggaagaaagggggcagtcgaaagcctggcccctaagagatcaacccactggaatctgtcccactccaaatcccctcccaccttcggcccctatcccttacagtcccttcctccctccttcctttgaaaccaggcccttgcctcagaaacctcctcttcctcgtcgtcgtcgtcctcttcttcctcgctgttgttactgctggtgccgccgccgccacctccgcctccaccgccgcctccaccgccgccgctgttgtcgctgtcgctgctgctttcgctgctgctggggggtcggcaagtccggttacgcttggccttgtggtgctgctgctgcggcggcttcttcttcaggagcaggtcgcagactcgcaccatcccacgaggagacgaggccgagcgagctctgctgctgccgccaacgccgccgccgacctccgccgccgcgggggggcccgccacagccgccaccgccggggggctcccttctccttctgcagccgtcgccgccgccaccggaaccgtcgccttctccatccccagggaaagagggagggcgcggacgggggaggggcgtggggctacgctctaccgcgacttcggccgcactggggccgacacagcaatcggtgccgcctccgccgccaccgcctc

SEQ ID NO: 2046 - DNA, 184002 bp, Homo sapiens; identical to SEQ ID NO: 2045

SEQ ID NO: 2047 - DNA, 15058 bp, Homo sapiens
aattatgcacatgaaagaagattcatttatttgaaaaggaagtatctggagataggaaaaaccaaagatgttttttcctactttcttttttgtacagacaaggtctcactatgttgcccaggctgatctggaactcctggccacaaggatctgccctatcctgaaactttctaggggcccccagccaccagtcatcacatgagcatacaaaagacacttaactctgcagattccgctggatgtcagggattggggataaagaccaaatacatatttcacaatatcatagcacgttattttttgcgtctcagcaaaagtgacaaacacaatgggaaaaggagactgatttccctcatgccattatgagaaaaatatctgagtgtactcactcagtaacacacacggcaaaggccattatgagaaaaatatctgagtgtacacagtaacacacacggcaaaggcaaagttattccagaggtaatatgtaactggcaaaattttcctcaaattctttcctctttttactatgacctaagctgcacacacatttctgcctctgcatccttgattgtacacgctgcaaatatagtcaatttgcattatttgtggtacttatgttccataaagtccacaaacactgaagtagtgaataccaaatcactgctcctagaaaacatacagggttaggtttctgcaagctttgtttttgtcaacagaacaatgcaacatattgttgattcagtaacactgaactctctgccaacagcattataacttgtgcatgaatgaagcttatctaatatacttattttctcctaagccttcctgagcttaggaacatcagaaagcactccagcagggcatttggaggccattttaaacagtaaaatcaccaacaaaaagaacagaaattaggaagagatgggactaagtagactcaaaaaggatacatgtttacggtatgagagctgaaactagaaggcagagtaccatttgtttcacttctgttgggaggtgactcacatttttgcctacaaatggctcaaaagcacttgtgcaagtactggttctggggttatggatagatttgagcaaggaggcaaatttacaaatataaaatccacaaataatgaggatatttcaattccttcaatgtggttggaaagcacaattgccccaataggacagtcagaaaccaggactaggaacttgtatgaaaaaagaacctagtcttaattgccaccatctatgtctaaaataaattctcagggaagcagaattcttacctctgtatgctgtacattttttctattaaaaaatgtcataacttcattaagcaggtgaactaaaatttaagagacatcaatcaaagaaatgactaatgaatttcactttagtttttattttattgtaaaacattgagatggaatgatagggtttcccagaatcaggtccatattttaactaaatgaaaattatgatttatagccttctcaaatacctgccatacttgatatctcaaccagagctaattttacctctttacaaattaaataagcaagtaactggatccacaatttataatacctgtcaattttttctgtattaaacctctatcatagtttaagcctattagggtacttaatccttacaaataaacaggtttaaaatcacctcaataggcaactgcccttctggttttcttctttgactaaacaatctgaatgcttaagattttccactttgggtgctagcagtacacagtgttacactctgtattccagacttcttaaattatagaaaaaggaatgtacactttttgtattctttctgagcagggccgggaggcaacatcatctaccatgttagggacttgtatgcatggactactttactgcatatatttcaagttgcccccgctttttttttcaaccacgcattaactcaagatcaatgtatgttccattagaataagatttattaactaggaattgccagaaaatcttcctggtaacaaggaagtccccgtattgtgagtcttaagatttttctgaagagaaaaccatacatatatagccttttttcagatgctcaaagaggtctaaaatcctctccacctccaaaataataagaaacatctcagctgggcacagtggctcacgcctgtaatcccagcactttgggaggccaaggtgggcagatcacttgaggccaggagttcaagaccagcctagccaacatggtgaaatcccatctctactaaaaatacaaaacttagctgggcatggtggtgcacccctgtagtcccagctacccagtaggctgaggtaggagaattgcttgaacacgggaggcagaggttgcagtgagccgagatcgtgccactgcactccagcctaggtgacagagagagactctgtctcattaaaaaaattaaaaaaaaaaaatgctgggtgaggtggctcatgcctgtaatcccagcactatgggaggccaaggagggtggattagttgaggtcagcagttccagaccagcctgtccaacatggtgaaaccccatctctactaaaaatacaaaaattagctgggcgtggtggtgtgcacctgcaatcccagatacttggaggctgaggcaggaaaatcactggaatccgggagatggaggttgcagtgagctgagattgcgccactgcactccagcctgggtgacacagtgagactccatctcaaaaaaaaaaaacatgaatcatctcactgatcctcttattttacaaaacagtaatatgcagtattgtttagtttaacttgccatcattcagtagctaaccctattctccaaagttctggtagctctaacaaactgtaactttataaacagagacaggcactttggttctattctaatactttcacaaacatactgcatttataacatttaaaagattttaattactgtcaaatatatctggattacatcttttttttttctttgatagcgtttcactcttgttgtccaggctggagtgcaatggggtgatctcagctcactgaaacctctgtattccaggttcaagcgattctcctgcctcagcctcccaagtagctgggattacaggcacctgccactaagcccagctaatttttttgttattttagtacagacagggtttcaccatgttggccaggctggtctcaaactccagacctcaggtgatccacccacctcgacctcccaaagtgctgggattacaggcatgagccactgtgcctggtctggattacatcttaacctacaatatttcatgaagttaatgattttaaataaaaggaaatcaagtaacatctgaatttctaagtctaaatacatttagatgatagtgactcctgcaactgtttcaaaattattggaaaatatgtcattttcttgaaatgaacttggtattaaaggcagcaaatatgtctttataaggagtttctgaatctgacttggtcgatggtattcggcaaagttggcgaaatccaggagaacgcagcagcaaattctgtgaaaggcccacgaagctggagcataaccagtagagaacaattgactataaagagaagacataaatgttagcatctgtaattctacaaggacatcacagtccagacaataaaaaataaaatgacaatctttgtaaatacaagtatgccaagactaagcaagacttgcagcagctactagattcctgggatagatttaatagacagggaaaaaaggttacagacagaccaaaaagcaaaaataaaggaaaaagagaagtatttagggtagaaagtaaaaagagagaagctcctaggcagaggctcaagagagatcttatctcccttcttcgacaatggaacataactttttccccaccaaaagtcctgtccaactgcttacatactgaaggtagaatgctggaagtgtggcacttatgatggcaaacttagcctccctacacctaattttccccatacagtcatctatcttccaaatgtttcccaacagccagtttctcagtgtagtaaggaatgcattttctttgccttcttctgagacaaacagcctcagcattatctccaaatttcttttgtattaccatcttgagcagtggtccccaacatttttgacactaggggccaatttttccatggacaggaggaagattttgggatgaaactgttccattcctcgtatcatgaggaatgagatcctcataaggagtgtacaccctagatccctcacctgtgcagttcacaatagggttcgtgctatgagaatctaatgctgctaatctgacaggaggtggagctcaggtggtaaggctcacttgcccaccactcacctcctgctgtcagccggctcctaatcggctatggaccagtactggtctgtggccccgggtgaccatttatttaggtcaatacgaagttctacaacctcctgaaatactcctatacttacacctgttccaaacttttctttagcatcagaaggtaatcaggccccagaaacaaaatcatgcagttgttaagtctaggtcctggaggcaaactgcctgaatttgaatcctacttgccatctatttgactttgagtaagttattttccttctgttccagtttcctcatctgtaaagtggggacagtaactgcatctacctcagaggattgctgtgaggaataaatgagataattcatgtagagtggtatgcaagtatgtggtccacattcagcacttacatttgttatttgttccaaagtcagtctttaggggcagaaagcagcacatcctcaaaggtagattagcacagtagttaagaggaggagccaaactgcttagatgtgtgttaagactctatcacttatagctaagtgaccttggatgagttacttaacttctctgtgcctcagtttcctcatcaccaaagtgaagattataatagtacctttatcgtcgcgctgttgggacaattacatggggtaaaatatgtaaaccatttaaaacagtgcttagcacaaagtcagtgttaaataaatattggctatcatcattatctgatttatccaccaaaagaaaaagaacctgcggccaactacagcagtctataagttgccagctaagtatcaatctcccctcttccttagtaacaaaatcttaatttttatttgagtaggctgtcatctaaaaaaaaaaaagactatatttccttgcctcttctgcagtgaggggtggtcataaaactaagatgttaacacaactgtttggtggaacatctggcaagtctccttaaaaggggctgactgcacttgaggcacccttttctattcctgcatgataacaagctctaacagccatgaccgtagtgtagccttgaaatcacaggctgtggataacaaagcagaaagagagcagcagtctgggtctctcatcttcatggacttgtctcatcatccctaagctgcttaatcagatttcctataattgacaggataaattttgggtatttaaggcattgtgttttagatctcttgttactcattttgaactcaatccctcattaaaacttaactgctcgtattttattttatctgaggcgttcttcagtatatagctggtatgattgctctgtggaaatgtagtgaatctgtgccgttctacttttacagggtattttacaacactactactttatgtaaaaagttctctaataggcactcatttcattaattctcacaggcattatgatatctattttagagatgaacaaacttattctgcataggattaatgacagtattatgttcagtaacagcctaaaaaatagattttgatagcaaaaacatactgttttagattcctataaaaaatattgtgggccaggcatggtggctcacacctgtaatcccagcactttgggaggccgaggcgggtggatcacctgggtcaggagttcaagaccagcctggccaacatgacgaaaccccacctctactaaaaatacaaaaattagccaagtgtggtggcgtgtgcctgtaatcccaggtactagggaggctgagggaggagaaccacttgaacccaggaggaggaggttgcagtgagctgagattgcgccactgcactccagcctgggcgacagagcaagactccatctcaaaaaaaaaaaaaaaaaatactgtgaggtagttttatatatgctacaccctaactattaataacaactgaattcgactttatgtgttagctctgagtaaacatggagatatacctaacacagcttttgcctccttagaaacttctaaagtatttgtgggaaacatgcaaaagactgaactaactgcaaacataaccatttctttttctatttctataaagattaattaggtatatacagggacaagtttacctatttcatagagttgttatgagattaaataataccatacacaaacccaaatggtcttagcattttgttttgtttctttttaagtgctaaattctttgctccagtctacataggcagaactaattcaatataccaagtagtcaaatggaagaaataccatattcatggtattatgcaaaacacgttgcaaaatttaaaaaaaggcaagaaatagagacagattagttaccacagaaacactgatttggtaagggatcaagtagtcagaggaagttcagcagaagaagcaggatcccagccaggtgcggtggctcacgcctgtaatcccagcactttcggaggccgaggcgggaggatcacaaggtcaggagatcgagaccatcctggttaatatggtgaaaccccgtctctaccaaaaatacaaaaaattagccaggcgtggtggcaggcgcctgtagtcccagctactcaggacgctgaggccggagaatggcgtgaacccaggaggcggagcttgcagtgagccgagatcgcgccactgcactccagcctgggtgacagagcgagactccgtctcaaaaaaaaaaaaaaaaaaaaaaagaagaggcaggatcccagccagtctaagctaaagtcagagaggatttagcacatgctacacacaatattggtgcttactcactgagggtaccgttgcagcaattggtatcatcaacaccgacattgcacggacaaagtacgtaatatacgtctgaaaacgagacattccaattttttgtagagcacaaatctgaaggggtagaacatatacatgcataatgattattaaaacgcatattaaatcagacaagctttaaaatataaactgatttttcactggcctccatctacactttaataaaagttatatatatacacacaaaacactgattaatttatatggctgatcatctttttattttttgagacctgtcttgctatcaaactgagaccagtttaagggctggtctcaaactcctgggctcaagtgatcctcccgcctcctcctcccaagtagctgggataataggcatgcaccaaccactgcactcagcttgatcatccatcttttaaaaatcttaactggcctaggtggaaggatcactctagtccagaagtttgaggctacagtgagctataatcatgccactgcactccagcctgggcaatacagcaagatcctgtctcttaaaaaaaacgacaacaaaaaaaaaacactaattatgtcaaattcttaaacggaggttttttgacactttgtaccaaaaaacaagggcaatgatttatatggtagctattgtcacaggattcttcaagctccacttaacaatgatttatatggtagctactgtcacaggattcttcaagctccacttaagaattctgcgtaaggctgggggcctgtaatcccagaactgggaggcccaggcaggccgattgtttgagctcaggagtttgagaccagcctaggcaattaggcaacatagcgaaaccatctctacagaaaatacaaaaattagctgggcgtggtggcatgtctgcagtcccagctattcaggagggaggctgaggtgggaggatcgcttaagcctggaaggcacaggttgcagtgagctgagatcacgccactgcactccagcctgggtgacagagtaagaccgtctccaaaaaaaagaaaagaaggaaaaaaaaaaaaagacttctccataattatgactctagagccaaactacgtagttttacatttttatgcctcactttctctgcattaaaaaaggataatatttagctcacagggttattccaagaagtaaatgagttgatttatgtaaattgcttataacaatgcctatggccaggcacagtggctcacacctgtaattccagcactttgggaggctgaggcgggcggatcatttgaggtcaggagttccagaccagcctggccaacatggtaaaacccagtctctactaaaaatacaaaaaattagctgggtgtgttggcgggcgcctgtaatcccagctactcgagaggctgagacaagagaatcacctgaacctgggaggtggaggttgcagtgagtggagatcacaccactgcactccagcctaggaaacagagtgagactctgtctcaagaaaaaaacaaacaaacaaacaaacaaaaaacacaatgccttgcacatagtgtatgttgagtaagaataagcttttaataagcttttatttttcttttagaggtgaggtctttctctctgtcgcccaggctagagtacagtggtgggatcacaactcactgcagcctccatctcttgggctcaaacaatcctcctgactcagcttccaagtagctggaactagaggcgcacgccaccatgccccgctatgaaaacacctttattagtctttagatgacatagaggaaaagactaggggattgacattgattcactgtaaccttgtgcttatcacttccttctttctaccaaatattcactgaacaccaaccacaggggactgtgctagtgctcttagggaaacatatttggactacaggtagagtctttcctcaagaaactttcacttaagaccttatattctatcatctccattttcctcatctgaaagaataaggggtatattagatttcacaaacaggcatcagaggtcatgaggtctgggagatctctactgaggtaaatcatttttaagatttcttccagtccagtctgttctactcagagtctgagaacaatttatgaaattatatgcacgctttccctaaactgctgagtaaagcagcctgtgataagggttaagacatgactgagagggctgggcacagtggctcatgcctgtaatcccagcactttggaaggccaaggcgggtggatcacctgaggtcaggagttcgagaccagcctggcaaacatggtgaaaccctgtctctactaaaaatacaaaaattagccgggtgtggtggtgtgcgcctataatcccagctactcaggaggcagaggttgcagtgagccaagactgcgccattacactccggcctgggcaacaagagcaaaactccatctcaaaaaaaaaagaaaaaaaaagacatgactgagaggtcacattttctatgtgtatgtttttcccatttcatcttataaagacattcaatgacttttctaaggtcataaagcaagaaaatagcagtcagggcctgacttgtgttctccgcctacaaattcacatattaaacacacacacggaacatcactctattttaagaatacaaccagattgactgggcatctttattactgtttttgccaaaagcaagtcacaaaattctatgtatcagaatcatataattttgaagctgaaagagacttggaagtatactagtgcttttactttaatttcgagagttctgaggcccagagaggttaagggacaggcctaagccaatgcctgacgtggaaccaggaaccaagggatctcacttctaactcagagctatcttcaccaactcaaacaaaaacagatttgaagtcaaaacagcagcaacaaaaatccccataaatggcaaacaaatttcatttaaaactactgacctccactattaacaaattgatgacgccaacagagataggcagaatccaagtggagtcgggtgcagtgaggtcaggaaaccacagaattccaccagtagctaactgttcctgaacagaaaaacctgctaaaacagttttataaataaaacaatagaagtcctaaaaatagcagagaaaaatatataagacataaataagtagtctgacaattccaataaggtgtccctcacaggaaagatctgcactggatttattccagtttttcacgcacaatatatatattttttctcaatacaaaatgttcacaacacaaccaatctgtttacacttaagactttaaattctatacccttataaggaagatagtaaacatatcgtaattatgaaaagtatgcttttttttttttttttttttttttagtacaaagacaatgttagagaacttctttgggagaagacatacaataattaccttctgaatgtgctgcccccgtgcttaaattccggagagcaaaagacatgaagatccacattggaagctgaatccaaaccaacacagtggctttgaaagggtggcagttatctcgcacatatagctctgaaattagcctcctcatattctttagataagtgagcctagattgaggttagggggaaaaaaggggaaagagaaaatgtcatctaagaatcgtgctttatttccatagcacaaatagcgcctgctgtagttattagctaaaggatttgtataagggtttcagctgtcacaggcatgttaaggagttgcctaaacaacaggcaaataaagccttttatcaaaacttctacagtatggtacacaagttacataacaatctgaaattgtcagactacaggctttgtctctggtggtctttggctgattaggctttaaaggtaaatttcactactgacatggtataactacaattaatattggaaatatggaagctaaaagcaaactttaatcaaatctctccactcccgccaaacttaaccacttcatccctgaatataccttttggagctatgtggttttatactgtgtatgctcttggcctgtcaaaatagtctccatttttcaatcaactatctcacaaagatatttttaatctgtttctctgttaaccatattagttactactgttttttcctgaaattttactttttagaatacagtcttccttcaggtccaagagaataggagttaaaaaacaaaaactaaagtattcttagtttaggggacagtgttctattttattcatctttaaatctcctgtatcatatattttgtacagaggaggcattcaatagtttttctgaatttagtcaaattatagtgtataataagacagtacacaaagacattctaggtcctccataatttcacatttgcctattcttccaattttatctcgttactcctctagacacctgcatattctggtctgaatgactttagttcatccaacaaatcagacttccgcataggcatgcctttggaagtactgtattatatcatctgtgtggaaagcccactttcctggctgtccatctgacacaccgtcttttacccttcaagactcaatactattgaaaatgcaggaagctggccaacactgtggcttgcacttgtaattccagctacttgggaggccaaagtgggaggattgcttgaggccaggagtttgagatcagcctgcacaacacagggagattctgtcttgttcaaaaaaacaaaaaagaaaagaaaagaaaagaaaatgccagaagccctcagatgtttcctcctagaaagaaacatctgtaaggctgtatctgcacaaccatcctgccagtactgcttaagcaaggtgccacaagtcttatctaggctgcgttgataacccaggcaagcagctattaatctggttcttttggcctatggctgaagctttcgacttctttgataagtaaaatttcaaacctataggtcaacttttaatttttaccaaataaagacattaagctatcaccacgattttttaaaatgtcagatctttttaacactaaatataggacacaatctcgtattaaagatagttgggaaatgtacaactatataaaaatatatggttaataatatacacataacacagattgataccacaaaggcctttttccattgctgtaaaaaggagaataatttttcgcagtctagtaaggattagagtttgggaaactgattgaggagttgattgaagcaagagggcttgtaagttcccagtgaatgaatgcagacatccttgggcgcaatcaagcacccttagattgggactttccaagaacccaggcagacaactgcacagaataaccacaaaggatagacagcatcttagctatcaaagtgtttctactgtggcacttgttttctacctcctctttcctgtaggctattacctgctgtatcttttccaaaaggtcaagattgtaaataacctgtgtcatttgttgaccaatatcacaaaagaatggcaaagtgccttcatcctgtgaaccctgccctgaccttccttgatgatctagctccttgtacatcatctttatataacagttagttcactgacatcattatttgattacaggtctgtctttttcaataggctggaatccctaaagaataggaacatactcttcttatctttatctatttatttctttgctttcagtccagcatatgaaactatcatgccatattaataacttatgaaaatataaaagagtaggctgggcacggtggctcacgcctgtaatcccagcactttgggaggccgaggagggtggatcacctgaggtcaggattccagaccagcctgaccaacatggagaaaccccatctctactaaaaatacaaaattagccaggcatggtggtgcctacctgttaatcccagctacctgggaggctgagggaggagaatcgcttgaacctgggaggcagaggttgtgatgagccgagatcacaccattgcactccagactgggcaccaagagcaaaactccgtctcaaaaaaaaaaaaaaaaaaaaaaaatatatatatatatatatataaaaaaagaaatactttactgccaaaactacagaatactcaaacttataattaacatcacaatttatgtatgtgtgtgtgtgtgtgtgtgtgtgtgtgtgtgtgtatgtgtgcgtatggtcttacgtggatataattagcttacctggcatctcttttggaccaccccaactgatttgcacgaactgcaacttcttggttaagatgcctggcaatagtttttatttctggctgcaaattttccacctagctaaaaaataggttttgttatgagcacataaaggatctttattcataatgactcataatctttcacattattccctcgagtcatttaaaaatgtagtttactgatcatatcaagaaatcttaattctaagcacaagatgttaatttgcttaaaatgtcctcagtcacaaccaaattcacaatgcatacttatccatgtgatcctgtgcaagtaacttaacctctaaaatcatgttccctcacatataaaatatataacagcacctacttcacagggttacaaatattagataagaactgcaccctgggctttactgttccatctctacatttcctagtaacgtaagcggagaaaacagcagtttgttaagaacctttaatacactgtgatagccacaaatcaaaagtaaaaatagcatttattcctgccctgtgctcattcttcctgtaaaatggctcactgccttaatgttgctgctgattccgttcctgttttgtttccggttttttttccccatgctcacaacctgaaaacaagaaagccactatttttgaaatatcccatttgaataatcaagcactttaacccgtattatctgacttgctctgataacgctgtgaagtaggcaaggaaggtactgctagcctgattcctcagaaaaaaggattcagcattaaaaggtcaagtaactgcgaccaaccagacacagtcttagtcgggtctggagaggaaacaagttcgcaaactgttagtctagtagtttcttcctaataagaaagaccagctggaatactttgggacgaaagacactgcagacatactggctattaaaacttttaagacataaattttgtaggtttcgccaacacaatttcttctgcgactgatttctttgtctccgttccccgagagcaagtatagtaaccacttgtgcttggagcacaaatccagtaagacaaaagaaatgacaggtacacgtgtcacaaagtatcttatttaacacacctaatgctagttcaattttttttaacgctaaaatggtcacaatgaaatggtcacgatgattaaacactaagcactgcagaaggcaacatcgtgcgatcgaaaaccctgagtgaatgtcggccttcctccgccgcaggggttgcagcgcagggtacgcgcacggctcggcgcccctcaccttggccaggatgtagtgctggtaggctgccaaaggcagcgtgacagcaccccgtaaggccacggtggagagcagaatgctgccccaccagggcaggcccgtggcggcgtgcacgccgagcagtacttcctccgcaacccgcaccggcgaagacgcggccagggcctcgtaccagccgttcgcatgtactgcagagactggtgccactgcccacactgggagagtggggcgcttggcgccgctcgtaggaaccggcgcaagcggcaggtccctagcccaaagctgcagggcagggagcggccgcagccaccgaccgccgagccggcacagcatttctgcaccacggcggagcccagatcccgggcctcacaatccagcggacatacaccggccagccaaggctgatacgcgcacgcgccagcaacagcgggcataaagc

SEQ ID NO: 2048 - DNA, 143202 bp, Homo sapiens
caaagagatatctgcactcctacatttattgcagctctattcacaacagctaagatatagaattgatataagtatccaacaatggataaatagctagaagaaaaggtttgaatgtttccaacacaaataaatgataaatgtttgaggtgatgaatatcccaattaccctgatttgattgctacacattgtatgcacatatcaaaatatcacatgcaccccataaaaatgtacaactatcatgtatcaataaaatacccatagaatatacaaaaaagaaactaacagaaaacaatttaaaatattttaaatgacaaaacaattaaatgacaattaacaataatgttagcctataaagctattttctaaaacaatttggtaaggagagtagcattgttttatagttctacaaatctctttaatgtttagcttgatagaaggcagctgaattaccatacctgcttctgcattcaacttgctgcaatacatgttgtaaaacctggcttcacacaggtagatatttggaaaaagaggggtatttaatagctttttcagatgatagtgtgcttttatattataccaaacattgatgaagtagttgaaggatactggttcttagtcaattctcataaaaattatctcttaaaactatgacattattggagcacaataccaaaaactaatcaggtctctgtaccatggttcttacaaatttaagatgagccttctagaggccggagtcatattcccttactttcctgcccaaagcatccattcctgtttcttcctccaaggcttcaggctacagggcagaagacagaagatctcctggcctccatgaaactttgcttatttagagattcagggttggtaaaaggtagttggtttttcttttcactcctaggctaaaccctgcataggtgttttaaaatagggttcataattgagttctcaggtgagactgattttcttctcaatgaaaagatttttttttttcctattagattcatctgtatatggttgtttctcaaaactcagagggtaataaaggaggaggcaagatagagggtttttattgaaagtaggttatgcaaacttggcttgaaaggtacttatcattttaaaaattatgcctaatgatgcatcaaatacaaaaacatataatacatcaatagtcaaccctttccccataaaggcaaagttactgagaaatgtttatttttcctctggtaatggctaatccaggtaataatatgaaagcaaatggaaaattcacattgcttctttcattgcttctgtcccttaaacctgttaatctttcagaaccacattactgaggtgctggcctgtgcatggaaacccaatgatatccaggtcttacaggtccagggcccagtggacagacaggccctggtcctccacgctggccaccatgtcttcgatggcattccagtccagcttgctgaggatgctgccagtgctctcagacacgctgtccacaccgcccaccccaaaaggatgctctggctcttcctcttcagttggagacaagtcctattaaattgaaaagacaattgtggtcctagcccctaaaaacaaacaaaaaaacaaaaacaaaaaaacctggaacgtgaactaagctttccaaaaattctagagttgctcatccatcaaaaggctgaaggaaatgtgccaggaaatagggctgtgattgcccagcacatccagatggacaagagctgaacatcatctcacacaacgagatgctggcaccagatgtgaagacagggcagaacggatgttgatacttgtagtacgattttatgttcttacattttggtcattttttagttaaaaaatacagtcacagagaagtctgaaagacaaatgctgaagtactaagccaaaagggaagatgctttgcatcacgatttcaaactgacctaacaacttttcagtatttccacatcccacaaaaaacaaactaaaaaacaaacaaacaaacaaacaaaaaacctgaagaacatagagcaatcactagacaaacaaaatctagaacaatgcttacttgtagaagggaattgtgactctcatgaagaatcttatggatttctgaaggtatcgtccagggactcaccacagtctcctctctttcatactctacacacacctgcttggtttgaggtgcaagcccagcacttccatgtttttttgtatgctgcagactatgacacggagcattagagccttttaagggataagaacaaagcacacattgggattgattcattcattcattcattcatttgttaattgtgacttttatcatcaaagccaaggtagtcacattttaaataatatttgaatcacaaggtctggaaatggttcactttagagttcgaacaattcctgtcctgtcactgtacgagatggaaactgaattccagcctttggatttgaaaactattagtaattaatctttaagacaagaaaatctagggaggagaggccacagatataacagaacggtggagaggtattgacaccaaagttgggtgaactctgagacctgggccttccctgtcttttacagaaagtcttgtgaaaacttcttagaagcaatgttttgggcatcttcacccaggcttaatgcttacaatctgcctttaggcaaaggcatcacagtgagtgtggtgacaatacattatgaccctctttcttcttactgcatatatcagtatttgttgaaaagaaattttcattccagctaatgcccagaggcagcttagtaaacccacaaaccaataaggtttctctgcacaaagccctagaggagcctacctcacctaacacaatgttccaaagccaatatcacagcatgttctacccttcgaggtgatttcatgaagaaacacccaagacatgggacaagatgggaagtaaatatagatcccaaacaagcagtcatgtggctccctgaagaggggagaagaggtatgacaatgctgaagtttgggccctctttgtcttttgtaactctaccaaccttatgtacttgaagctgaagatatctccaagaaataaagcccccaaaataatcacagcacacactttggcatttagtataggctaataagcacttttacattcagtcccttgaacttaccagacattcatgcctggtctttagattttctaacacacctctgctctccctagctaacttcatttagttccatggctttaaatatcacctacatgctgacagctctctaaaacctgtacctccagtctcataaagctaattgccccttcttaaaatccttgcttggatgtgcaataaacatctgaactttaacatgtccaaaaccacactgttaatttttacccctaaactgccctatcccaggaaatgctcaggttaaaatccagtatatcttttttgttttttgagacggaatctcactctgtccccaggctggaatgcagtggtgcaatttcggttcgctgcaacctctgcctcccggattcaagcgagtctcctgcctcagcctcccaagtagctgggattacaggcatgcgccaccatgcccagctaattttggtatttttagtagagatggggtttcaccatattggccaggctggtttggaactcctggcctcaagcgatcggcctgcctcagcctcacaaagtgctgggattacaggagtgagccactgtgcccagcctcatccttctttcttatacatgccacatccaatccatcagcaagtcctaattttgtctatcttcaaaatacatcccaaatcaaatagtttcctcccatctccattgttaaaaccctagcccaagcaatctatccttgtatgccgtcttctgttctttctttccacatgttctaaaacataaattatattatctctctgcttaattccctaaaatggagtctcactggatctcaagtaaaatccaaactccttgccttagcctacagtatctagcccatctctcccaccatatctctcgtcacctttccacactgatcttttctgtcataccaactttgtttctgtaccaggactctgaactttctgttctgccttatctttatacaacaatcttaccagaactttgaacttctgcctgaaactgttttgccttatctttacctaacaatctccttttcatcattcaagatcttcactccaacatcaccttctctttttctaaatttttattcatttaatttttaatttgcttcatactaagagctggagtaagagtttcaccttctcaaagagacctttaaccacccttgctagagtagttccacctagccagcctcattctcccttatttatgtgctgctttctgtgttgttcatgagtaacagtgcctggtatgtagtaggaactcaatgggcagttgctgagtgaatactcttcctgacagtcctatggagaaaccattattatccccattttgcaaatgaggaaagtgaggcttagagaggttatgtaattggcccaagatgatggagatgatccaccccagaacctgggctaatgtattaacttttttttttttttttttttttgagatggagtctcactctgtcgcccaggctggagtgcagtggcactatcttggctcactacaacctctgcctcccgggttcacgccattcttctgcctcagcctcccgagtagctgggactacgggcacccgccaccacacccggctaattttttgtatttttagtagagatggggtttcaccgtgttagccaggatggtctcaatctcctgacctcgtgatccgcctgcctcagcctcccaaagtgctgggattacaggcgtgagccaccacgcccggccaatgtattaactttctattctttttttgttttgagacagagtctcgctctgtcactcaggctggagtgcagtggcatgatctcggctcactgcaagctccacctcccgggttcacaccattctcctgcctcagcctcccgagtagctgggactacaggcgcccaccaccatgcctagctaattttttttttgtatttttagtagagacggggtttcacggtgttagccaggatggtcttgatctcctgacctcatgatccgcccgcctcggcctcccaaagtgctgggattgtacaggcgtgagccaccgtgcccggcctaactttctatagggtgaaggaagaataatacttagagggccctttaagatcatcttcatatctataagtaaaatatgaatagatctattaatttggatccccaaagtggcagctttccaaaagcttcttcctggattagtgccaaagggaagggtgcagtggtacagacagcttagggatttttcttttgactagccccaagagtctgaaaaagaaacaaagctaacatcatttggtagcacctgccactgtaatatccaatgtgagagctatgctctagttgaaaaggtttgacattttttctgctacttaaagacatcacagagtattttgaaatgccactgaaagttccatgttaaaataattatttcagtaaatattaataaggaacaaattttgaaaaaccatataaaggaaaaaatctacgagcagatgacaggaatgcatatgtgaacaaacactgtgttaaaaaaaaaacagccgttaaaacagaaaaagtgagactgaaagagaaaccaatgagtggttaagcaacataaccacaagagtaggcttccacttcaaagtagatgggaacaagtggaggtggggtgctgaagttattccttcaagtattcacgatatgactagagatcaacaaaggctacaaacatcaactaatcccaaactcatcttggctacaattaatttggcatctagacatcgacattcttgttttgtccaaatgaacataattattgtcatctagaaagaatgacaaatcaaaccaccacctactctgctaaaattacagttaagagtcttgcattttaggataaatcttcacctatggggtattacaaaccttgagaggctatcactgggtttctctcaccttactttacctagagatggctttgtaatttccttcctttcagatcataatgcatttttccagggtttatctgggatatccaatttgagataaaaatataatgagaaaagttctgtgaaactgagcatgcataagacttttcaaggtaaagtgtacctgccccactggacagtgaaagctttctgaagtgaaaggtaagttatagatcaagaagacaccccacagcagaaaccaggctgccaagtacactggcttccctcagaaaggaagtactctttctctaggacggtgggcactgacactcagtttctttataacataacaccaaacagtgtctacagagtctagcctgagaaatctgaaactggatgataaaactaaacctattacctccatcattcccaaagaaaatcctgcttcttttcctgctctacttgtgtcaatttgtgagtcacagtctagctaagcacttaagctagaaacttggagtcatacacatttctaactttcagaggcagggttaccattgaacaatgaaacaaatacctacagctttctatgggcaaggcctcatgttagattataatgacttcaagaacacaaaaccctggatctccgggactttcaaaaacaaaacaatataacggtacatgtaatttcaactgtttttagaggtaacattgtatttggggagcattttatctgttgaactagacattgctagatatttgctttgaaaagaataaaaagctattgagtactctagactagaaaacaattcataatgggtaaaaaggaaagtctttgaaagagagaaaagctggcatgggatttagaagctggtacggtttggctgtgtccccaaccaaatctcatcttgaattgtagctcccataattcccacgtgctgtgggagggaccaggtgggaggtaattgaatcatgggggcagttaccttcatgctgctggtcttgtgatagtgagttctcatgagatctgatagttttataaaggggagttcccctgaatacactcttttgcctgccaccatgtaagacttgcctttgcttctcctttgccttttaccatgattgtgaggcctccacagccatgtgaaactgtgagtccattaaacttctttccttttaaattacccagtttcaggtatgtgttagcagcatgagaacagactaatacacaagcacaggaaatgatgcttcgaggattcaaagtgatccaaacgaccagaagcttgggttttaacgcatacatgggggaaagagtagaaaaagtacccaatagatcttctagaaaataccgccatagacattaaaaagttgataaatgagttaaacaatggattagacataggtaaaaagagatggggtaaactgaatgacggatctacaaagtaatgagttagcagtagagaaagaggcataataccaagcctaggctaattacttcatatttctcatcatttttcacagtacatataaactagtggggtttttttgttttgttttgttttgagacagagtctcactctgtcgccaggctggagtgcagtggtgcaatttcggctcactgcaacctccgcctgctgggttcaagtgattctcctgcctcagcctcccaagtagctgggactacaggcacatgccaccacgcccagctaatttttgtatttttagtagagatggggtttcaccgtgttggccaggatggtctcaatttcttggcctcgtgatccaaccaccacgacctcccaaagtgctaggattataggtgtgagccaccgcgcccagccaaattagtgggtttttaaaaaatcattatccctaccaaatttaattattttctttcaatggggataactgcacagattttgttggatttaatgtgaggatcaagtgagataatgcacatgaggtgtgaacacaatgcctggcatagagtaagtgctctatacctgttagctactattgttattgttttaaggagatctgaacaggtcatttaacttctctaagtctgttctcatagtaagacatggataatagttaccctgtttacctaccaaggtcgttacatatatcctcactattataacttgtattttccaggtgagaaaattaagaatacataaatgggttagaaatttgcgtaaggttacagagtaagtggttaacttgattccataaagctactccaaaacttcttctctgaaccactgcagcgcagagccacacccttcattctgaagtctatatttgaaatggagtgatttataatttttttaaaatttagtattaagggccaggcacagtggctcatgcctgtaatcacaggactttgggaggctaagatgggcggatcaccttaggtcaggagttcaagaccagcctggccaacatggcaaaaccccatctctacgaaaaatacaaaaattaaccgggcgcggtggtgggcacctgtaatcccagctactgggaagcctgaggcaggagaatcacttgaacccgggagtggaggttacagtgagccgacattgcaccactgcactccagactgggcaacagagtgagactctgtctcaaaaaaaaaaaaaagaaaattcagtattaagtctaaaaactttatcttctttatcccttacctttttggaaggtaactggagactgcgtagcctttcttactgctgctttggctccaccagcttttttctgtatggtgaaagtggcagttcctatacagagagacaaacattattagccttccatagacatccatgatttttatatatattgtgagttatttgaggacagacaccttggtgatcagctttgaatctgctcaccaagccctgttcacagtaggggcccagtaaatggtggctggtttgaaccaaggtggcaaaacttaagtgcagacaaagaaagggaatactttgctttgacacctggtatccttcaagcacagccatactcttttttcaaatggcaaatgtgttttgacatctctggcaactggaaaagctagggacataataagcctcttagcagtaaacacctagacaaaatgccaagttaaattttatcaaccgaatgattagtttcttaaactcaaagattaataacaaccatttacttccatgttatgcaatatctcttattaatataatcctcaacaactctatgaggtaggtttcaaataacttatctgagggcaaaaatcagcagcagagctgggatataaacctaagtttagaggatttaaaacttagacttttatttcttttttttttttttttttgagatggagtctcactctgtcaccaggctgcagtacagtggcgtgatctccactcactgcaacctccacctcccagggtcaaatgattcccctgcctcagcttcccgagcagctgggactacaggcacacaccaccatgcctggctacttttttttatttttagtagagacggggtttcaccatgttggccaggatggtcttgatcatctgacatgatccgcccacctcagcctcccaaagtgctgggattacaggcgtgagccaccatgcccggccgacttttacttttttatgcctaagatgcctctcagttactaatcatataatctttgtattgtagttgacagaactaaacataaaacaagcaacaataacacaaactactcctggccaggcatggtggcttacgcctgtaattcttgcactttgggaggccaacatgggaagattgcttgagcccaggagtttgagaacagcctgagcaacatggcaagactccgtctctacgaaaaaatttaaaaattacccaggtgtggtggtgcacacctgtagtcccagctattcaagaggctgagatgtctcacactaccaggcacggtggctcacacctgtaatcccatcactctgggaggccaaagctggcggatcacttgaggccaagagtttgtgaccagcctggccaacatggtgaaaccctgtctctactaaaaaatacaaaaattagttgggcacggtggtgcaagcctgtagtccccgttactccgaaggctgaggcaggagaattgcttgaacctaaaggacagaggttgaagtgaggtgagatcacgccactgcactccagtctgggtgacagagcaagactctgcctcaaaaaaaaaaaaaaaaaaaaaaaaaaaaaaggctgaagtgggaagatgatctgagccagggaggtcaaggttgcagtgagccatgatcacgccactgcactcccttctgggcgacagaatgagttcctgtgtccaaaaaaaaaaaatttcctaacagtatggaagcagggctgaagaaattagccaaaaactacatactgctttacaagatagaaagcaacatagagtcaaactcccaagcatattcagaaaaactcttcatttacgaatgaactacagtgaatttgaaaatcttgatggagcctcacctccccacatgtgcaatgactgaacttgacctatgtgagttcaggttatctgtatcactgactaggaaaaggtctggaatcagtcttgcctggatttccctccattctcccaaacactgggggacctgaaacttctgaatgtagccaggtgaaatggttgggtctgggtgtgacagaggccacaagaacaaggggagccacagcctgttctactgaggcagagaagttagaatatccacaagcactcaagctgcctcttttatctttgccttaaaagacaggacaatagccaggcatatggtattattctctgacatggtataaatactataatacccgcctattaatatccttgaacaataatttgtttataaatagctatgcttaggcaaaaagctcaataaccattttttccatttatccatttgttcaatgttcgagtatttcatctgttcaacatgaggggtaataggaagatgagcaagggaatactgctgcaaagcatttaatctagtatggggcatgaagtttacaggtaacaacaacaggacacctgttgtagtgcttcaagagggacataaacatgtggttaagggttcaaaggacagaaaaataactgctttagccaccattatctctaattttcatagcaaccatgcagattaaatattagcctcaatttagaaatgagaatgtagaatattaaattgattatatcagcgtggatgaactaaagaattacaattaggaatgtcttcagacacacagaagtgagacattcaaggtataaaggagcacaaatcatggcatgtggttggaaaacaagctgctgagcagcacaggttctatggggaaaggaggtcaaggaagcaggaaaacacacagatgatgccttgaaggccaagcagagggtctagacgtttctgtgtgggtataagtgttgctgagggcttctgagcccaggagtagcaggagcacctcctcaagcataatccagcaagggcaggtgagattaacggaaagacgggctaaggccatagcaaccgtcaaagcacaaggtaaaaataaagacttgaaattgaacacatataacaggaggacatatttccatataattcaagactttttcatcagatgttaagaaaccatggctcaggtttttaaaaccttgacaattttagatatgtatttaattctggcaaatatatcaggtacaaaataagtttttttatataagcatgtttcactattttgaaatttcagttttaaaagagcagtattttcttactgtaatttgtcaatcaaaaaagccaagagctggtcaggcatgatagctcacacctgtaatcccggcactttgggaggctgaggtgggtagatgcttgagctcaggagttcaagaccagcctgggcaacacagcaagaccccccatctctacaaaaaatgaacaaataaacaaaaattagctgggcatggtggcacacgcctataatcacagctactcgggaggctgaggtgggagatggctcttgagcctaggaggcaaaggttgcagtgagccaagatcatggcacagcactccagactgggcaacacactgtgtctcaaaaaaaaaaaaaaaaaggccaagagctaaccaaaccacgaagggtttcatctaaagaattgggatttatggaaatttcaattttctaaattgaggcagcatactgaagtgttggttctatgtgtgtaggctctagacccaccctcggattaaatcttggctctaccacttcctagttgtatgatcttgggcaattatttaagctttctctgacttggtttccttgtctttaaagtgggaacataatagcacctatctcacagggttgtaattaaagaacgtaaacagaacctgccacataattagttgttattttacttttttttttttttcagacagagtctcactctgtcgccaagctggagtgcagtggtgcgatctcagctcactgcaacctccgcctcctgggttcaagcaattctcctgcctcagcctccagagtagctgggactacaggcgcacaccaccacgcccagctaattttagtattttcagtagagacggggtttcaccatgttggccaagatggtctcaatctcttgaccttgtgatctgcccacctcggcctcccaaagtgctgggattacaggcgtgagccaccgcgccgggcctattttacatttttaaatgtatacatttatactacatgtcagctattataatacgttgttaatatataaatatgttacaaataactatgttttacttaagtaatcaaaactcaaatatggcacaattaaagaaaggtgtaaataatggacatatcttgaaatgggaaaataattttcaaaggataaaaacatgacattatttcaatctgagcttcttagcattcctattctgtgatgtattcatcctgcaatctatcagaacttgatttgttcaaatgcctatatctttagccagatatacaaaagaaacagactcccaaaaaagttataccctactaataccctgattgttcaatgttattaaaaaaaagccattcggctgggtgtggtggctcatgcctgtaatcccagcactttgggaggccaaggtgggcagatcacctgaggtcgggagttcgagaccagcctcaccaacatggagaaaccccatctcttctaaaaatacaaaattagccaggtatggtgatgcatacctataatcccagctatttgggaggctgaggcaggagaatcacttgaacctgggaggcagaggttgcggtgagccaaggtcacaccattggcactccagcctgggcaacaagagtgaaactccgtctcaaaaaaattaaaaattaaaaaaagccattcaaggccgggcgtggtggctcacgcctgtaatcccagcactttgggaggccggggcgggtggatcaccaggtcaggagatcaagaccatcctggctaacacaatgaaaccccgtctctactaaaaaaatacaaaaaattagccgggcgtggtggtgggcgcctgtaatcccaggtacttgggaggctgaggcaggagaatggcatgaacctgggaggcagagcttgcagtgagccaagatctcgccactgcactccagcctgggtgacagagcgagactctgcctcaaaaagaaaaagaaaaaaaaagccattcatttaggaagattcctagggccttacttcaaagcagaaaaaaaaaaaattacagctaagtctttatcaatgcctcgccttctgttcaaatcagaactcctttttactaagacttataccttttactaatgaaaacacaactttggagacaagaaggaataggtccaaatcagacaatttataaaaaagctttaagtcttaccatgtggccaaggtgagccttgaggttgcccaaaagacttcctcttatggatataactcggtttggacatatatttgacttttccaggtcgatttattagaaaactgtgaccatgttgattctctctatagtagaaatcacataattattacattcccagaatctcatatcagcgataaactttaacatttcaaaaagcccaaattaagctgggcacagtagtgcaagcctatagccccagctactggcgagggtgggacaggaggatcactggaacccagagagtcgaggctgtggtgtgccatgattgcacctgtgaatgccactgcactccagcctgggtgacagagcaagaccctgttactttaaggaaaaaacagaccaaaatatagctcagattatattcacttgatactgcctagtctgtacctcagtgatgcacttaacatataactctcaacaaattattctttgtatctcatacctcaaacctcattttttttcacaaaacttttttgtggttatctcactctccatttcaaattctccatatattgggcagttatatatgtatttaatccctgctttattctagaaaagtctcaacgggaatctttggtatttgaagtaaactctacactacacacacagatgatctgattacatctgggtttgtgttggtagtatctcctctaggctcttaaattatgtgattatgtttacaattctaataatttattttgtcaaatgtgttgatgcttaacaacactgtactccaattcatgttcaccctatgatcaccaacagatattaatagaactttgcatgtttgttgaccatatataagaaattttatacttgggtagttttcttcagcattctatgtttagttaattcctgcctaattaactcatatataacccctctgcaggtgattaaagtaaaatacataatagtagctacagctgaatgagcataactgggcaggtctggggcgggtagcagaaagggaagtggtaagcagctggggactggctgtttctgaaagagagaagatgacacatgggaaaataggatgagcagttagaaggcaaattatggaggcaaatattaacaacaactaaataaaacaggactgcacagataccaaatttcatacttctggaatacctaaatgctctgtaagcttagtgagaaatataacacaatttttgcctttttccttggtgattctatcaatgtataaagacctcatgattatgaggctacttttttcctttatcatcataactctaagcagggtaaatgcaaatgcactgaacttaggtcacgaaagtgctacatttcttcttatcaggcctgacgttatcttgccaaatggcatgtgaaaccttgtcttaccctcttggagaagggcagtgttgacaactggaagactgagtagggctgggtttgttaggcaatggtttctgtggtagagttggtagctgtactgactcagataacagttcattcatcagaccgtacgcttgtgagattcgacgactatagtgttcagagagcagcaatctgtagacaaagaattaagcatcatttattaagagtcactttcagttcatctatccagagggaatatagtgtttgaagatcacctagcatgttctggtttttttttttttttgagacggagtttcactcttgtcacccaggctggattgcaatggcgtgatctcggctcactgcaacctccgcctcccgagttcaagcaattctcctgcctcaggctcccgagtagctgggattacaggcgcctggccaccatgcccggctaatttcacttagcattttctttcttcagcacttctaacatccttctattcatcagatttctgaaaatgattaggcagtattattaaaggtacttgtagttatggtctctggagtatttcccaaatgcatgtaaatatctgggttgggaaagggagaacagcagaaataaaagtcataaaaactgaatgaaacacataatatttgaaagcaaatttgaaaaaaggctagtgagtctcatcattttccttgcagtgataactcccataattctctgtttattgacaaaaaagagactattgtgaaaacagaattcctaaggcattaatctatgcctcagctaaggaagttagagagaaaacacagggttacagctaccaaactcacctgtctttttcatgcttcatcttttgtctcagccttatttcccttgaagtcatgtaaagctgcataaaaaatacccagttggttcattattgttcaatccaaataattaaaccattacacataattctgttatttaggaaacagtacaaaacactgtcgtgtttgatgaagcttcctactctagcataaaacataaaaatgttaaattaaaacatcatgtaattaaagtaaaaaccaatttagggaggctgcggcgggcggatcacctgaggtcaggagttcatgaccagcctggccaacatggtgaaacctcgtctctactaaaaatacaaaaattagctgggcatgtggcacacacctgtaatctcagctacctgggaggcggaggctgcagtgagctgagatagcgccactgcactccagcctgggcaacagagcaaggctccgtttcaaaaaaataaataaataaataaaaataataaaccaatttaataaatggaaggcaaaatctattttactagttcaattaatatattttattgaattaattaggagagaaccttatttggctgcactaaaaatggaaagtaggaacattttaggtggaagcacctatgctttgtactcaatcctgtaattaacctcaccaagagcttgttaataaagcagaaattagacatttaaaattatcatttttatgttttaaaatgtttatcagaaacctactacagtgaattgactgtgactcataaactcttcaagttatacaccagaaggcaaacaacaaatgtcagacacatacgtattattccagaacattaagaactattggtgtgagttacatgtgaggttcttttcacacacaattatgtatataaaaatggacactcagaagtaaattcactttttcaaggtcctgtggagaagttgtcactagcaaattaaaggtcttgttgatttctaatagaaattcaaatgaaaattttaattacattaacacctcactaatcccatccctttacccaaatagaagttaaaaaacaaaacaaaaaaagtgtttgcaatcttgaatgagaccacaaaatctataaaccaagcagttcttaaacccttagagtttacttattttgagacaagagtgcactctgttgcccaggcaggagtgcaggggcatgatcttctcaactgggcacaagtgatcttcttaccttgagtagttaggactacaggcatgtgccaccacatctggctaaattttcattttcttatttttttttgtagagacaaggtctcactatgttgcctaggctggtcttgaactcctggcctcaggtgatcctcctatcatgggctcccaaagtgctgggattacagacatgagccactattcctagccaatttattctaaatttggacacaattctaacaatcttgggtatttacttcactgacagcgagaaggtaatgtcagaacccattctacattaggctaggggaacatacacacacacacacacacacacacacacacacacagtctctctcaaacacacatgcacacactttaagattctggtcaggtacctcagtagccctgaaggtcactaccatgtctcctgggctatcaagaaaacgttacgttaacaccaatatgctcttttcagagacaggtaagtaaattgcacactttaaacaatagttcacctacttttgcaccatttggcgttttaatggaacagtttatctgaaaaattcacctaaagaatttgttatcctaatgatgctgaaaaaaatgaagggatattgtattttatttcagattacaaagtaaaagataaactgtaatctaaactgtaatctaaatgtaattttcatagtaatgtgactatcaaagtaatagtgctttgttttaccatctgaagaaaaatatacctgacctagcctggttatgtctgtatttagggctcagtaaataaatgctgagttttaaaaacagttaaaaaaacaaaaaccacacacacagaactgacattgttctgttgatacatgactggacaataattttttttgtattctttgtaggtaacttatgaacagaaaattgaagggttttttatttgttagcttttgctttatttgtagacacagggtcgccctttgtctcccaggctggagtgcagtggtgtgatcatagctcaatacagtctcaaacttctgggctcaaatgatcctcctgcctcagcctctagagtagctgggactacaggtgtgtgctaccacacctggctaatttttttttttcttttgtagagatgagatctcatgatattgcccaggatgctctcaactcttggtcacaagtgatcctctcactttggtctcccaaagttttctaagcaaataaattttataaactaagtaagggagcaggcatagaagagtgagtttttaaaatggctttaatacacatagttggttgtcgcaactgccaatgactctcattgaaaattaaaggaagaactccaattggtcacccaatcactcaacctcctcctcttgttaaaatgctatagccatcattagcctgggggacaagaaaatatttaagataattcagtataacttggttagcacaatatgctgcaacattttaagataatttattaacttttcctgacttaagtaaaacatttacttttctatatgccaaattacaaatgtatccaaattatgttaatctttttcttaaaattttgccaggaaagtaattacacatattctgtaattccattacccttgacatggcagacttactggattgcttctgggacagaaaggatcatgttcttgccctctcttttctgccagctcatttaagtactttgccattctttcttttcgttttcttttcatccaggcttgaatctctcttctttccttgtcagttctttgtgaatgtctgccagaataatgctgaattctgagaaatttaacaagcaagacatcatttgcttttaaatttgttaagcagataagatatatcatgactaaacactatttatccggaaatattttgccccatcttcaaaagtagtatatacttatgttctctagtcaactcactccaatttgttacctgaactccactgaaaatggactcagaaagctaacaacttctttataacatttaccttaaactcgattttcccttcttctttaaactctatcttacctgagtcttttcctaactctcagaaaactatatagcctcctgcattggctcctttcttctctgctcactgcttcaaaattaattatcttaaaggttctccttttgactttttttaaactttttaattttgtgggtacatagtagatgtatatatttatagagtacatgagatattttgatacaggtatgcaatgcataataaacacatcatgtaaaatggggaggtttccacttctttatctatttaacttattccctgcactatctctatcactttcaaaacttctaatacagggctgggctcagtggctcacacctgtaatcccagaactctgggaggccaaggcaggcagactgctttagcccaggagttcaagaccagcctgggcaagatgatgagatgtcatctctattaaaaaaaaaattagccaggttgaatggcacatgcctgaaatcccagctactcaggatgctgaggtgggtgggaggatcacttgagcctgggaggtcgaagctgcagtgagcagtgactgtgccactgcattccagcctgggtgacagagggagactgtctcaaaaaaacaaaaaaattgtaacacagagatgacttccaacagctgcccttatggatctactcccatgcttaggttcatgccacactttccatagtctggcccaaattaatggactaagcatggcagggatactgtgaaaggcccattgctgcaagacacaggtgactctgtgggtgacttggcctgaggttttaccattgacctggctgaaacattcttaaaactacacagtgcactgagactctgtctcccctaccctctttccctctcctttaccgggagggctgagagctgcatcatagtctgatgcttctccttacttcttccctgcattccgccatcctctcacaagcattttccccagtaaatctcttctacagctaatccaaccttagcttctgcttcttggaggatctgaactaacacacatgcagtaggagtggtctgagaaaatgggtggtgcaaaatggggatttggggcaaggtgcagtggcatgcacctgtagtcccagctacttgggaggctgaagtgggacagtcgtgaattcaagcccagcttgggcaaaatagcaaacctccatctccaaaaaagaaaattttaaaaagtttttttttaaaagatggggacttgagacagatgcatcacccagtgattgaaaaagacaccctcctaaacagaaggccagtcacaaatacaaacaatatagtttattctgaatatctgctttccttttgagactctgatatcttaatacatggcaggcagtatctccccagtaaaaccccaggcactgaatttctaatgggcttgcctggtagacatttcacacatgttgtcacaacttgttactggaggaattaagtgcattctgtgcgaccccactgggaaaagactcttagaagctggtgtctgattttccctggaatttactccatgtaccttttgcctcctgttaggataaattatagccatgaaaacgactatttgctgagttctgtgcatcctcctaggtgatttctgaacctggaggtgatcttggggacccccagcacagggtcagatctacatcagcactgcagtatgatagttgtccccagttttattgcatcctccctttttccctttcaggcatttctccaaataaatctcttgctcatcaaaatcccatctgctttgcagaggacttaaaactaatataccgatgaatattaccactcgatgttctggatgttcttctgccaccttataatctaaaactgcattctcttttttatttaatttttttttttttttttttggagatggagtttcgctcttgttgctcaggctggagtgtaatggcacgatcttggctcactgcaacctctgcctcccgggtttaagcgattctcctgcctcagcctcccgagtagctgagattacaggcttgcaccaccacgcccggctttttgcatttttagtagaaacggggtttcaccatgttagtcaggctggtctcaaactcctgacctcaggtgatccgcccaccttggcctcccaaaatgctgggattataggcatgagccaccgagcccagccattatttaattaaatttatttatttatttatttatttgtgtttttgaaatctcatctctaccaaaactataaaaattagctgggtgcagtggcacacatctgtggtcacagctacttggaggctaaggtgggagaatcacttaagcctggggaggttgaggctgcagtaagccatgattgtgccactgcaccccagcctgggtgacagagtgagatcctgtctcaaaaaacaaacaaacaaacaaaagatatattatgtccttctcagggaaggaagcaaaattaacagaatacaggatttaaaagatatttttattacaaaaaattttttttgagattgggttatgagactggctaatttttgtatttttggtagagatggggtttccctatgttgcccctgtattctttatcctgctaaataaatcaccatcaactcagtcacccaagtaaaaaagctgtcactcttaccacctgatagcctccaaatgtttacttacacctattaccctacactctccattctgatcacctcatctctaaactactgaagtaagtcttctaactggctctaatttgtatcttaaagccctgtgctgcgtgcagatggtgtcacctggagcttaaggacctgaatgcatgtatcactgctgaaagaaatcacaaataacaatacaaatggaaacatatcccatgctcatggatgggtagaatcaatattgtgaaaatgaccaatgcaattcctatcaaaataccaccataagggccaggtggctcacacctgtaatcccagcactttgggaggggccgagatgggtggatcacctgaggtcaggagctcaagaccagcctggccaacatggcaaaaacccatctctattaaaaatgaacaaattagccaggtgtggtggcatggacctgtaatcccagctactagggaggctgaggcagaaaaattgcttgaacccaggaggcagaggttgcagtgagctgagattgtgccactgtactccagcctgggcaactctgtcaaaaaaaaccaaaaaaaaacaaaaaaaaaatcatcattcttcaccgaactggaaaagacaatcctaaaattcatatggaaccaaaaaagagcctgtacagccaaagcaagacaaagcaaaaagaataaatctggaggcatcacattatgacttcaaactatactataaggccatagtcaccaaaacagcatggtactggtataaaaataggcacgtagaccaatggaacagaatagagaacccagaaataaacccaaatacttacagccaactgatctttgacaaaacaaacaaaaacataaagggggaaggacactctattcaacaaatggtgctgggataattggcaagccacatgtagaagaataaaactggatcctcatctctcaccttatacaaaaatcaactcaagatgtatcaaggatttaaatctaagacctgaaaccataaaaattctagaagataacatcagaaaaacccttctagacactggcttaggcaaaggcttcatgatgaagaacccaaaagcaaatgcaacaaaaacaatgataaataggtggaacttaagctaaaaagtttctgcacagcaaaagaaacaatcagcagagtaaacagacaacccagagtgagagaaaatcttcacaatctatacatccgacaaagaactaatatccagaatatacaaggaactcaaacaaataagcaagaaaaaaaaattccatcaaaacaatagagttaaggcatgacaagacaattcacaaaaggagatatacaaatggccaacaaacatatgaaaaaatgctcaacatcgctaatgatcagggaaatgcaaataaaaaaccacaatgcaatgccatcttctgcaagaatggacataatcaaaacatcaaaaaataatagatgttggcagggatgcggttaaaagggaacatttttatactgctggtgggaatgtaaactagtacaaccactatggaaaacagtgtggatattccttaaagaactaaaagtagaactaccatttgatccagcaatcccactactgggtatctacccagaggaaaagaagtcattatatgaaaaagatacttacacacgcatgtttatagcagcacaattcgcaattgcaaaaatatggaaccagcccaaatgcccatcaagcaatgagtggataaagaaattgtggtacacatatacaccatgtcatactattcagccataaaaaggaatgaaataacggcattcgcagcaacctggatggaattggagaccattatcctaagtgaaataactcaggaatggaaaaccaaacattgtatgctctcactcataagctatgaggaggcaaaggcataagaatgataacaatgaacttcagggacttgggagaaagggtgggaggtgggtgaggaataaagactacaaattgggtacagtacatactgttcaggttgatgggtgcaccaaaatctcacaaatcatcactgaagaacttactcatgtaaccaaataccacctgttcccccaaaacctatggaaattaatttaaaaaaaaagaacctgcatgtgagtatcaaagacaatggccaagaacaaattaagagggcagaagtccaggaacgtatttcacatggtcagccaaaacaactttataaggctaaaaacaaagcaaagccagttactactcatcttaaaataaatgttatgaatgatgaaaagttaacaatgttaataaagcatttgtaaatatacaaaaggaactaaacttctcaaaagccctttctcttgaacctctgcaaaaagaaccaattcctcagaagcgtcatgaaagcaaacccgttaatgttgatgaagctgtaatacagttgtgataaagtgtaatacagtggtgatgcatctaattccccataaaagaccaatacattatatgttttatacaattttatttttaaaaatcttaatgtgcaggcattggcacattttaaaaacgaactgcataaacagatctttcctcctatctaggaaaaatggaatgtcagaagtcaacaaaatggataaacttaaagtgctaaaacagaaggcacttcaccaaatctgttcactgaaacagttatatatccttgcttgcatctttcacgttataggctgcagtgaatgtctgtctggatagaagaacatacagaaatagtttcacggcagtaaaaatgtaagtcgaagaagtgatgagtactttgccaacgtattttgtttttgataaccttcctttgtttttgataactttccttttataagtggagaaaacaggattcagaattgaaagaaaagttgaaatcgcagaatgcagttatttgggggatggggaggttggtagatattaaatcggttttcccctgaagcaaaatgaaaagaaaaaaagcgctttctaccacaccctactgcgtgtcaataggttgaactcagtgattccctctggtcttcacagtcagctagtctcactctccccttctaatgcacaaactctagctacatctaattccttgcccttcacttataaatacaagaactactgtgattgccttctttcactgactttcttcccctgagctcccacaaacactgatataacttggtcttagagctctatctccaagagcagaaactgtatttaatttttttttagtaaaaaaaaatttttttttttgagacggagtttcgctctagtcgcccaggctggagtgcagtggcatggtcttggctcactgcaacctccacctcccaggttcaagcgattctcctgcctcagcctccgaagtagatgggattacaggtgcccactaccacacccagctaattttttgtattttcagtagagacggggttttgtcacgttggacaggctggtctcgaactcctgacctcctgatccgcccacctcagcctcccaaagtgctgggattataggcgtgagccaccgcgccaggccaaatatttttatagagatgaggttttgctacattgcccaggctggtctcaaactcctgagctcaaatgatcctcccacctcagcctcgaaagtgctgagattacaggtgtgagctatcgcatccagtcaatatttaatttttattctaattattgacatttaatagattactgttaacacgatcattaacttaacaaaacaactgaaggtaactaaatgcattagtttaggaagttagggtttaacatggtcttaatataaggttatatataatacagcagatacatcgaataatagaaattaaaataattaaatagaaattagtggaatcctttttcgtttttgtacaatattttctggtaatagaaaaatattgttaccagaaaataatgaggtcttataagttcaataataacttcttttgaaaacaaaatgacttcgagaagtgtttgtaatgtctttgcccactttttaatctagttgttctttgcttattcgattgttcaagtttttttttttttttttttttttttgagacagagtcttgctctgtcgcccaggctggagtgcattggcgcaatctcggctcactgcaagctccacctcccaagttcacgccattctcctgcctcagcctcccgagtagctgggactacaggcgcccgccaccacgcccggctaatttttttgtatttttcagtagtgacggggtttcaccatgttagccaggatggtctcaatctcctgaccttgtaatccgcccgccttggcctcccaaagtgctgggattacaggcgttgagccaccgcccccagcccaattgttcaagttctttgtagattctgcatattagatcattgttggatgcaaaggttgtgaatattttctcccattctgtaggctgtctgtttactctgttgattattttgctgtgcagaagctctttaattacatcccacttgtcaatttttgtttttgttacaactgcttttgagaacttagtcataaattctttcccaaggccagtgtccagaatggtatttcctaagtttcttctaggattcttatggtttgaggtcttatatttaaatgttttattcatcttgtgttaatttttgtatatggtgaaaggtaggggtccagtttcattcttctgcgtatggctaaccagctctctcacaacctttatagggagtcatttcccctgcctttccccctaatttttgtcaactttgtcaaagatcagatggctgtaggtatgcaactttatttctgagttctctattctgttccattggtctgtatgtccatctttgtaccagtaccatgctgttttggttagtgtaaccttgtataatttgaaggcaggtaacatgatgactctggctttgctctttttactcaggattgctttggccatttggaccctgttttggttccatatgaattttagaatagtttttttttctaattctgtttaaaatgatattggtagcttgatagaaatagtgttgaatctatagattgctttgggcagtatggttattttaaggatattgattcttctgtgagcatgggatgttttctatgtttttatgtcacctgcgatttctttcagaagtgtttcgtagttctccttgctgagatctctcacctctttggttagaggtgtgtgtgtgtgtgtgtgtgtgtatgtgtgtgtgtctgttgtaaatgggactgcattcttgctttggttctcagcttgaatgttattggtgcatagaaatgctactgatttttgtacattgattttgtatcctgaaactttactgaagtcatttatcagttctaggtggcttttggaggagtctttaggttttctaggtatagaatcatactgtcatagaaaagagataatctgaattcttattttcctatttggatgccttacgtttatttctcttacctgattcctctggctaggacttccagtactgtgttaaatagaagtggtaagattaagcattcttgttttgtaccagttcttaaggtgaatgcttccagcttttgcccgttcagtaagatgttggctgtgggtttgtcataaatggctattaatcacatttattgatttgtgtatgttgaaccaatcttgcatcctagaaatgaggcctacttgattatggtgaattaacaatcaccacaatttgatgtgctgttttcggtttgctatattttgttgaagattttttacttctatattcatcagggatattggcctgtagctttattttttccttgggtcttcgccaggttttggtatcagggtgatgtcaccttcatagaatgattggggaggagtctgtcctccttgattttttaaaagagtttcagtagaattcccaccagttcttcttttatgtctggcagaatttggctgtgaatccatctggtctggggcttttattggttggtgggttttttattactgattccatttcaggacttcatattggtctgttcagggtttcaaatttcttcctgattcaatgttgaggggttgtgtgtttccaggaatttatccatttcctctagattttctactttgtgcatacaggcattcataaaagtctctgaggatcttttgtatttctgtgggatcagttgtaatgtcacctttgttgttttctgattgtgcttatttggatcttctctctttttttctttgttaatgtagctggtggtctatcaatctagtttatcctttctaataaccaacttttggtattgttgattctttgtatggatttttggttctcgattttgttcacttctgctctgattttagttacttattttcttttgctagctctggggttaatttgttcttgtttttctagttcctctaggcgtgatgttagattactaatgtgaaatcattctaactttttgatataggtgtttagtgctataaactttccacttttttttttttttttttgagaaagttttgctcttgttgcccaggctggagtgcaatggcatgatcttggcttgccacaacctctgcctcccaggttcaagtgcttctcctgcctcagcctcccgagtagctgggattacaggcatgtgccaccatgcccagctaattttgtatttttagtagagatggggtttctccatgttggtcaggctggtctccaactcccaacctcaggtgatccacctgcctcagcctcccaaagtgctgggattacagatgtgagccaccatgcccagcctctaaattttcctcacaatggtgcttttgctgcatcccagagattttggtatgttgtgtcttcgttttcatttatttcaaataattttcttatttttgccttaatttcattgtttacccaaaagtcattcaggagcaagttgtttaatttccatgtaatagtgtggttttgagaggtcttcttggtattgatttctatttttatgcttctatgatctgaaagtatggttggtatgtgtattagtctgttctcacactgctaatagagacacacctgagattggataatttataaaggaaagaggtttaattaagtcacagttaagcatggctggggaggcctcaagaaacttataatcatcgcggaaggggaagcaaacatgtccttctccacatggtggcaggaaggagaagaatgagtgcccagcaaaaggggaagtcccttataaaaccatcagattggccaggtgcagtggctcacacctgtaatcccagcactttgggaagtcgaggtgggcggatcacaaggtcagcagattgagaccatcctggctaacatggtgaaaccctgtctctactaaaaatataaaaattagctggacgtggtggcacgtgcctgtaatcccagctactcgggaggctgaggcaggaataacttgaaccagggagtcagaggttgcagtgagctgagatcacaccatggcactccagcctggcaaaagagcgagactctgtctcaaaaaaaaaaaccaacaaaaaacccaacagatctcgtgaaatagtgtttttactatcacgagaacaggatggggcaaaacacctccgtgattaaattatctccaccaacatgtggggattatgggaactacaattcaagatgagatgtggatgaggaaacaatcagaccatatcattctgccccggccctttccaaatctcatgtcctcataattcaaaacacaatcatgtccttccaacagtcccccacggtcttaactcattctagcattaactcaaaagtccaagtccaaagtctcatctgagacaaggcaagaccctcctgcctgtaaaatcaaaagcaatttagttacttcctagatacaatggaggtacaggcattgggtaaaaatacccggtccaaataggagaaattagccaaaacaaaggggctatcagcctcatacaagtccaaaatccaatagggcagtcattaaaccttaaagttccaaaatgatcttctttgactccatgtctcacatccaggtcatgctgatgcaagaggtgggttcccatggtcttggacagctctgtccctgtggctttgcagggtacagccctctgtcccagctgctttcacagccagcattgtctgtgacttttccaggcacatggtgcaagctgtcggtaaatctaccattctggggtctgaaggacgatggccctcttctcacagctccactaggcagtgccccagaagggaatttgtgtgggggctccaaccccacatttccctcccacactgccctagcagaggttctccatgatagctatacccttgcaacaaacttctgcctggcttttccatacatcctctgaaatctactagaaggttcccaaacttcaattcttgacttctattcacccacaagctcaacaccacgtggaggctgccaaggcttagggcttacaccttctgaagccacagcccaagctgtatcttggcgccttctagccacagctagagaggataggatgcagggcaccaagtccctaggctgcacacagcaaggagggcctgggcctgccccaggaaaccatttttccctcctaggcctctgggcctgtgatgggagggactgccatgaaggtctctgacatgccctggagatattttccccatggtcttggtgactaaaatttggcttctcattatttatggaaatttctgcactgagcttgatttctccccagaaaatgggtttttcttttatattgcactgtcagcctgcaaattttccaaactttcatgctctgcttcctcttgaatgctttgccacttagaaatttcttccactggataccctaaataatctctctcaagttcaaagttccacaaatctctaggacagaggcaaaatgctaccagtctcgttgctaaaacataataagaatcaccttctccagttcccaacaagttcctcttctccatctgagaccacctcagcctggacgttattgtccatattgctatcaggcttttggtcaaagccattcaacaagtctctaggaagttccaaactttcccacatcttcctgtcttcttctgagtcctacaaactgttccaacctctgcctgttacccagttccaaagtcgcttccacattttcaggtatttttacagtagcaccccactctctgcagcaccaatttactatattagtctgttcttacactgctaaataagacatacctgagactgaacaatttataaacgaaagaggtgtaattaactcacagttcagcatggctggggaggcctcaggaaacttacaatcatggcagaaggggaagcaaacatgtccttcttcacataatggcgggaaggagaagaatgagtgcccactgaagggggaagccccttataataccatcagttcttgtgacaactcactcactagcatgagaacaggaaggggcaaactgtccccatgattcaattatctccacctgttccctcccatgacacatgggaattatgggaactacaattcaagctgagatttggatggggacacagccaaaccatatcagtcagatatcagggttgtttttttttttttaatttattgagacttgctttaaggccaagcatttggtcgatcttggagtatattctgtgtgcagatgaaaagaatgtatattctgtggttgatgggtggagcgttctacagatgtttattaggttcaattgctcaagtgtctaatttaattccagaatttgttagttttctgctttgatgatatgtccaactttgtcattggggtgttgaagtcccccactattactacgtggttgcctaaatagtttcataggtctataactacttattttatgagtctaggtgctccaatgttgtatgcttatatatttaggatagttaagtcttcttgttgaattgaactctttatcattatgtccctttctttgtccttttttactgctgctggtttaaagtctgttttatctgatataaaaacagcagcccctgatcctttttgttttccatttgcatgatagatcagaaagcctatttaaaatgtattctaagcgttaatttttgggtaaagtgctatgagctaatcattaattacttctagtaagagacaggattaaatgtatgttgtacttagagtgattcttgggaaaacccacaggatacagttatatactatatattgttagagaaaagggaagaatgacacatatacataacaaaacatgaaaaaaaaatctattctaagcttcagatttgtttcataaaaatcacattaaaatatgacaaattttgaacattcttgaatgagaagcattttaaacaggttaaaaatgaattattcaatgattacctggaggtgcccatagcttgttctgttaagccaagttcttcactggaaactccgtctttaattataaggtcatcaataatgtctgcaatatcagtcaatccagtcatctggagcggatgtactgaaacacttcatttgcaaatgtaatttaagaaatataaatcagtatctacaacttaattacattaagcaaaaataaacatgtaacaaatgaacacaaaatgataaacatatatctactgttccttctatttctgtaattctagtatctctcagtgaaaaagactaatcaacaaaaagtaatgacttggtagattttctttaaaaaggaaacatatggtccagaagaaaacccctatagattctgtttaaatttaatccatatttatataagaaaatgtagtaaatatagtctattgaattctaactacttgtgctaaaacagtaagagatataacaatcctcaatttcttaaaaatattccatacccaatgaaaacttatattcctttaaaccacaaagatatatataatgtaaaaattcacacacatatgaacaaaattttcactatctacacccaactttaaagaaaattgtgaattaactcttaagatatttacctctcacacaattcatcactgctattcatacctaaaaaaaaaatcattattaataaaaattttgggtttttttttgctttcaattgttaatctaatttagaaattatataaccagaaattaaattaaaatacttttaaacttccaaattggtttatagatatatatttacagcatatttatcctcttcctgaatatgctatctgatagtgaatactgtctacatattttttgagaccatgtctcactctgtcacccaggctaagtgcagcgacatggtcatggcatactacaacctctgcctccgggctcaagcaaacctcccaccttaacctcctgaatggctgggattacaggtgtgtgccgcaatgcaggctaatttttgtattttttgtagacacggggtcttgctatgttgcccaggttggtctcgaactcctgagctcaagtgattcacctgccttggcctcccaaagtgcttggattacaggcatgggccatcgcacccagccagtataagattattactttttctatcctgagtactcagtgtaatatgtcagaaggcacaacccttctttgcttagtacacagtttagagtactggagtgcaatttactttataaaatatacacaaacaaaaaacaaatctctggtgatctgaaagtaatatattttagaaaatatcttatttaaatccgagaagcaatttacctgtaagaatgtgtcccaaaatataatttttaagtcttgtccagtattaactatatgtcttcagagaaaaacacttaatctattcagtcttctatatgtttcattctaaatgtttaattcttctatatgtttaattctaaaaacaggattgaattaatatagggaaaagtgttctgacatctcttctcaaaaaatattccttaagattttattatcttgagataaaccaaatctgtccctaagacttacacattcacatggttttaatatgaaatacctgttttcttgaaaacatattgttctatttaatttattaacctccaaatcaaggattttattttcgttctcagaatctgggcatttgtgggttaagagcaactaattcaatttaactaagagagaaatatttcacataaatctaagattagcgtaatagtaatagttctaccccttatagctttttactaggtagaaaaagatattaatcctatgtacttaggaaagagaaggtccattaaagagacactttctatcagtatttgagaggcccctgctggcctattcacgaaaaaaagcttgaaggattctcttccaataacgactgggctgcatatggggaagtaggtgagattagcgaagatggtgacctcttgggttaaagattgaagtgtttgtcatcaaaggttggtaagtaacaagttgccctttctcctattagtaacccaggatcactaacccacggccacagtacctgtttattaccaagtaaacgttcttaaaacattatgagatttatgcatggactttttttttttttctagctcatcagctattgttagtgttagtgtattttatgtgtggcccaagacaattcttcttccaatgtggctcagggaagccaaaagactggagtctagactttgacatcagacctagttatacctttgccttagactctggcaacactaaacaaccacgttccccctctcctcctcttttacccacctagtcactgagtaccatcagttactaattcaaaatgtctcgtttcttctatttctttcccacaacactagccaggccctcattatttcccaggtcagattttagtagcctcctcagtggtctctatgcctccattctatttttcctcaaaacctccttgttttacttctctgcttggaattctcccatgttcccaaggataaaatggagtgtaaacttctcagatataattagaaccctctaccatctagccatatgagtcctgtttaacctcatttgtcaatcctccccagagaagagaagagaaaagctatcagtgaccaagaaaataaaacaagattctcagatgctttatatatgatactcagtcttcacaactttgtgaagtggaaattattatccccatatgttgatgactaaaacacacatggcatctagaaagaactgagaaaataattacaagatttaaagtcagcttcttaataggttttcttttatttaagtaacagtaatgccatttaaaatagcatttttactgtttatatcactttaataatggtaatagaacatatactaaacactcagtaaaatcattttaattgaccatcaatatctgagagaaaaaaaatatttccaagccactgtcagtgattgaactgatgtatttactatgttctattattcataggacaaagtatattcattaggactaaagaataacagttttaattgctacctccaaatgaaataaaacaaaaagtggcactaaatccttctaaatctcaatctcctcaactgtaaaatggagataataatagtgtctacacctcatagatcaggcttaaaccagaatctatgcatataaaacagtgatgtttggcacatggtagaggctcaagaaatgatggctactattttgttttcaaattaaaattcaaagttcttataattggaagagttttaatttttcaatttttgtaaaaatcaactattacagtaattccagttgctatatatttcatattaataagttacaccaagatatgatacataattgcagtatgtcttatgaaggtgacaagatgtcacagttcttcatgtgactagcaaaagttttaactttccttcccctaaaataaatattacaaaatgacttcacaaacctttcataactatattcccagtaaatcatgttcagtaacattataatggagaataagagtatgtgtaaatgaaaaagtaaagaacaataccaggagaagtagtattctgatcactggaactggaaaggctgacagctgaatcggcagtaggaaacacacaggttttctgaccagaataattttctgttattgaaaattcaggttctgaagtctcctttttgtcactttgatcttcttcatccatatgggtcaaaaaacgcactaatccagagtatatattacaattaaaataaaatagtagaggaaaaaagatcacatggaaaagacaattgccactatttccaactggcaacccagatattagaagtttgtcacatattatgctaatagctttctactgtataatgaatttaataaaaaatttgaagttaaagctctcccacagtaaataaacaagatttattagactgagctgaagtacataggcctatgccctttcataaaaacatagacatgctaaattacaaaaaaaaattttaatatacgaccaatctttctaaacagagaaatcccatggtgccagaaaagaaaaaggaactcatagctggagcagtaagtgggcaatgatgctgggatagtctactgaggaataggagatgtggttctgtacactgcaatgagggaaaaactgagctaccttcatgtatcttagagcactgaaggacagctttgtccataaaataggaaaaagaaaatctctcccctggtgaaacagcaaataagttttctatctgcatggacagcagctgagagaaaaataaaagtcaactttgagaaatcaacaccctgacttgccacaagcatgaacagggtctgaatttctaccatcaataaagtacagcaaccccaagtgaagaaacgtatactaaaatttgtttcaattttttcctacttcaacgatagcaaaaagcaaatgcaaaactactccaaagacaaacatataatctagcagaacttccactaatgataagcccatgataaaaaattacaattcacacaaaggaacaaccaaccatgaaagacagtcagtatgcagattcaacaattgataatgtgcacatatgaaatacaataatcagaaaaggttagtcataaaacatgactgaaattatgaaacagataaagcataggaacagcaataaaaaaacaggacacaacatccaaagagcagatagatttgaaaaagaaataaatacaacttctagatattaaatgtagccaccaaaattaaaatcataatgaatagctaaaacagcaaagacacagcaaaaaagagaattagtaaactagaagacagatatgaggaaatcatcctgagtgaaccactgataaagggaggaaattatgcagaagaggctgaatgagataaggaggccaggcacagtggttcacacctgtaatcccagcactttgggaggccaaggtgggctgatcacctgaggtcaggagttcgagaacagcctgaccaaaatggagaaaccctgtctctactaaaaacacaaaaaatttgccagtggtggtggcacacgcctgtaatcacagctacttggaaggctgagacaggagaatcacttgaacctgcgaggcaggggatgtggtgagccaagattgtgccattgcactccagcctggacaacaagagcaaaactctgtctcgaaaaaaaaaaaaaaaagatataaggaacagagtgaggaggtccaacatgcctctattaggtgttttagagagaaaagaaaaaatggggaggaagcagtacttcaaaatattatgggtgaaaagtccccaaagttaaatcttaaaactaaagaatcattcctactccaatataaggtaaataaaagaaatacggtcaggcacggtggctcacgcttgtaatcccagcactttgggaggccaaggtgggcggatcatgagatcaggagattgagaccatcctggttaacacggtgaaaacccgtctctactaaaaatacaaaaaattagcccagcatggtggcaggtgcctgtagtcccagctactcaggaaggtgaggcagagaattgcttgaaccctggaggaggaggctgcagtgagccgagatcgcaccactgcactccaacagagtgagactttgtctaaaaaaaaaaaaaaaaaaaaaagaagtggatgcaagaagcaactgtgggcaacaatagcagagaagagaaaataccagagagcatctcaggcaataaaaggtatcatgaaacttgttttggttttatacatttgttgcctacatatttacattatttaaattagaaattttaggccgggcacggtggctcatgcctgtaatcccagcactttgggaggccgaggcaggcggatcacgaggtcaggagatcaagaccatcctggctaacacagggaaaccaagtctctactaaaaatacaaaaaattagccgggcgcggtggcgggcacctgtagtcccagctactcaggagactgaggcaggagaatggcatgaacccaggaggcggagtttgcagtgagccaagatagcaccactgcactccagcctgggtgacagagcgagactctgtctcaaaaaaaaaaaaaaaaaattagaaattttaaaatgaagtaattgttggcaaagaaaatgccaaacgttgagaaatcttaactaagtgctgacttaaaaaataaaaggcaaggggaactaaatgggagggttaaaaacagagtagatctaaaatatttgaaaacagttatcagaggccgggcgtggtggctcacgcctgtaatcccagcactttggaaggctgaggcaggcagatcacaaggtcaagagactgagaccatcctggccaacatggtgaaaccccatctctactaaaaatacaaaaaattagctgggtgtggtggtgtgcacctgtagtcccagttacttggggggctgaggcaggagaattgcttgaatctgggaggcagtggttgcagtgagctgagatcacaccactgcactctccagactgggccacagtgtgagactccatctcaaaaacaaacaaacaaaaaaacagtatcagagaagatggagggaacaaatcagcgctaaaaaggtctaaagtccttctattgtttgggaggtagatatattcaccttaatttaaaatgaaaaaaattttaagagacggtgtctcactatgttgctcaggctggagtgcagtggctattcacaggtgtgatgatagcatactacaacctttaattcttgggctcaagtgatcctcccacctcagcctcccaaatagctgggactacaggtatgcaccaccatgtccaaattcaccttaaattttaactcacctatgaatgttaaaaattcaagaataaccactaaaaactaaaaatctaatgtataatttctgaaccaatacagcaggaaagagagaatacagaaaactccatccaataaaaggcaaaaaagagggacaaaagtaaaggaaataaatggcaaaaaaaccaccatgaaataagatattagaaataagcacaaatatatcagtaaatacaataaatgaacagtgattatgcttgctggttaaaaaagactgtctaattatttaaaggaatgaaatctaggtacatgctggacacaaatacaacataatcaaacagcctgaaagtaaagggatatctaatttacaagaaatacagaggagaaaacaacacattaaatgacatcacagagactcaattagcaaaactcagactctgaaaaacacttcagaacaactatcttgtttcttcaacaaagaaaacttcaaggaagaaaaaggagagaaggaacccagaagttaagagacttataagccatcaaccaatggccacttatagatcttagctgggttccaactgtaataattaaaaagcttttttttttttcgagacggagtctcgctctgttgcccaggctggagtgcagtggcatgatctcgactcactgcaagctccgcctcctgagttcaagcaattctcctgcctcagcctcctaagtagctgggactacaggcacccgccaccacaccaggctaatttttgtatttttagtagagacagggtttcaccatattggccaggctggtttcgaactcctgatcttgtgatccacctgcctcagcctcccaaagtgctgggattacaggtgtgagccaccacgcccggcctaaaagactattttttgaaacgagacaattggcaacatttgaactctgattagatatataagtatattaagaattttttaaaggagtgtcaatattattgtgcttatgttttaaaaatggacctgatcttttagagatacatacaaaatatttatacataaaataatgtgctgtctgggtttcgtttcaaaataatcaagaaaaaggtgggaagagtgggtgggtgtataggtaaaaaagggattggccatgagttgataatgattaaagtttgttgttgagtatatgaaagttaattgtatgattctgccttctattaaaatagtgtagaaattttacataaaattttaaaaaataaagcatatcaaaaagatataccagaacacaggggtagtaatgttcatattaaacaaaattgactataagtcaaaaaggattattagggataaagagggttattacttaatgataaaagagacaaaatccaacaagaaatataacaatcctgaactatattcaccttatagccttaagatgaatgtaacagatttacaaggagaaataattccacaatcattatgggtaatttttaatgcaaccttctaagaaatgaacggatcaagctgactaatcagaaaaaatacaaaaaatctggacaacacaatttagaagcttgaccaaagggagatatatacacatacactacatacaaccaacagaaaatgtttggcctcttcaaataaatgtggaacataatgtaaaaactgactatcctcagccacaagggaaattttaacaaatatctaaggattgatatcatcatacacatcagctaatcaaaatgcaatgaaaatggaaatcaaccacaaaaacatagcccaatattagaatgcttaatatttagaagctaaaaactccttttacaagctaaagaaatcataatgcgaactacaaactatgtagacctgaacaccaccagatgatgatgagtatcaacattcttgtctaggtccatgcagaaacatattcagcctcaattacacatattagaaaataagaaaaaataaagttagaaaaaagccaacaagttaatgcccccaaaatagaagaaataataaagattaatgaaaaaggaaactgagaaacaaagagaattaacaaacactggtttttgaaaagactaaactgacaagactgaatgagaaagagaacacaggtatgaaccacagacacagcagaaggtaaaaacaactattctaatttcattctttcaataaaaaatgaaaaaacttaatacctcaccactgcctggccattttaccagaacctcaaattccagctcagctgatgatcacagacaaacagcaacctcagcacaaagctctgtgcaatcctcagcactatgaggccaatggcttggaatccacaaaaactgagctccaggccacacttgccccatcctagtataaaatccagaggaggttactgccttctcaaaaaaaaaaaaaaaaaaaaaaaaaaaggccgtgaggtggaagctaatcacattacaaaaaaataatcctaatctaaaaactgggaagcttatgacttcagctcacataatgaaaactactcctacttctggcactccacaaaacaatgcacattctttcagatcaactaaagcaagacttcagccagcccctatcagcccctacaaaccttcttcagaaatgctaatggtttttgaagctaatgtttttttgaattcagggccagaagagaattcaatgtgatccactggtccaatctgtagaaaaaacacacacaacaaaacaacagtaatactttgataatttcaaaataacaaacagttttatgtaagttttaaacacttgcattaatgcaaaagtgaaaaaaatgggattaaatccaatataagctaaatggtagggatcaataaaacagaggaaatttttacttatttgtagcttaactgagttataaacttttaaaaggctcaggaaaattgtatcataaaattttagaatgaagaaccttaattactatctagacaaattcgtattaaagatgagagaacaaagcccagagagattcaatgacttttttagtggcataacacggtcaacccaggtcttcaagactatttaccactcagtgtctgcccagagtatccctgggcctcttccaggactataagctgttttcttaagttaggcaagtgaagatgtttgtatttatgtgtacattataataatgtgagagcattttttaaaaatataccaaacctgctgggcccagtggctcacacctgtaatcccagcactttgggagggtgaagcaagcagatcacttgaggtcaggagttcgagaccagcctgtccaacatggcaaaatcccgtctctactaaaaatacaaaaattaggtgggcatggtggcaggtgcctgtaatcccagctactcaggaggcaaaggcaggagaattgcttcaacctgggaggcagagattgcagtgagccaagattgagccactgcactccagcctggatgacacagtgagactccatctcaaaactaaattaaataaataagcaaattgtggtgtgtgtgtgtgtgtatacaaaattaacattatttccttcaaagtggtcattttagaagactaaatatcttccttttccctgggagatatgttccaagacgcccagtggatgcctgaaacggtgggggtagtaccgaaccttatatatagttgtccctcagtatctatgagggattggctcctgacatcaaaatccacagactcaagtcccttatataaaatggtgcagtatttgcatacaacctatagacattcttcccatatactttaatctctagattacttataatatctaatacaatgtaaatgttaactattaatagttgttatgacgtattgttcaggaatgacaagaacaaatctgcacatgttcagtacagatgcaaccatccttttttgtttttattaaatattttcaatccacatttggttgaactgtcagatgcagaacccatggatatagagggccgactgtatactatgtttttttctatgcgtacatacctatgataaagcttaatttatcaattaggcacagtaagagattagtaatagctaagaataaaatgcaacgattataacaatatactgtaatcaaagttatatgaatgtgttttttttctgtctctcaaaatatcttcttatactgtacagaaggtaacagaaacctcggaaaacaaaactgcaaataagaggggactactgtacgtaagggctttgagcaaatgcttttggaactcttcctttgaaattgtctcccaaccttgtaccacaattataaataactgttctactggtgaatctttagtatataaatgtgattttattagtgccagaatcaaaactaagatagcaaagacaaccattgaacaaatatttattaaatgcccaccatgtgtagcaaaagacattgtccctaccttcgagtcttaaaaggcttgagagaggagccctatcagaatttttgagagccttttcaaaatgccaagtcacctccacctccccaacagattcagcagggatagaatgtatactctgaaaaagcatctgagtgatcttgacatgcacaggagtccaaatgcttaatggactcagacatgtggaaactccctcctccaactcctgctttggctggctttctcctgagtctcttatgacttcagactgttctcaagtcttgttgaatactcatccttacaaggcagtgtttccacaagattctttaccctcttcttttctcctccatgtgctctccctgaggagcacctatgctatcatgatttgaacttccccctaactgattactccaaaatctgtaccttcagcccagttgtagctcctcagctgcttttgaggaactgcctacttatctcacagcacctcaaatttatcatgtccctgatagaaatcattgtgcctccctcccccaacacacacgcgcgcacacacacacacacacaactcctcctcttccttagtttggaaaatggctccaccattcacccaggctggaatctggacaccactgtgaatctctgttgtcttcttcaccttcccacagcttatcaatctctaagtcctgttaatgccttccctccattcttactgctcaaattcaggcatatggttatttcctgccatggatatttagtggatctcaaacacttatcagtggacctggtatagagctagcagcataagaatcatttgtgaagcttgttaataacacagattccagggctctaaccagacctacttaaaatcagaatttcagggaaatggggcccaggaatttgcattcttaacaagtttcctatatgattctaatgggcagccattagatttggaaccactgtgacccatgtggtctccttgttcccaggcttatcctttccaatctaccttccacactactgtctgcatatctgataatatcccttcactgtttaaaattcttcagtggtttcctactgcctgcttataggagaaaatcccaatcgcttgacatggtaaatgctttctgttcctccttgtctcccctctcctacctctactgccagatgtcttaaagtccaatcccactaacttctacctctaagtaatgctcatacagctccccaaacactctatgccatttggtacctttctcctttgctcacaatattttgtcagcctttctttaattaactgatgaataccaattcattaccagctcgagtcacctccacaaagcctcctctgatgccacagcttcacttaccccgtccagtcacaacatgtcaggcatatctatgtgcctcattagacccagtatgtatgtattcattggtatatacatctatcttcttttattagattttacactccttgagagtaggtactatgccttatttatctttctattcctagaatttagcacagggcctaataggcagtagttgctcaataaatgtttgttgaaggaattaattattcatgaactcctgtgagagtgagcaagccaggatcaagactagattcgggtataaatcaaatatctggctgtagataatgactactaaactagctcaaaaggcaatttcaaaagagattctttgaagtaaggagttccaacaactgctttgatgctgtacatttatttggatgtgacagatctaaatctgggtttaaaaaaacagaaagcaggccaggtgcagtggctcacacctgtaatcccagtactttgggaggctgaggtgggaggatcacttgggcccaggagttggagactggcctgggcaacatggtgaaaccccaaatctaccaaaaaaaaaaagaggaaaaccaccaaataagcatcatagtatcattacttagtattaatatttttagcagtagtcctgcctcataacctttcagtatagtttcacatatgcttaatctttatttttaaatgtgttaaatgtttggattaaaggtgtactataaacctaataaatacattttttaaatgtcaacatgctagcaacctggaatttttgtaaggtaagtcaataatggaattcttatcctgcagactattttgcatttcccaatattagactttaagacatttaactttgtttttttttaagaggcagggtcttgctctgacacccaggctacagtgcagtggcacaataatagcttactgcagccttgaactcgtgagcgcaagtgatccttccacctcagcctcccaagtagctaggactacaggtgcacaccaccatacccgacttattattatttttatggagatgaggtctcgctacgttgcctgggctgatctcaaactcctggcctcgagtacccaaccatggtctcatttaacctattatgtgtaacataatatttgttctttaatccttttgatataaattgttcttcctttaaaaaaaaggacaaaatgtgtaaaataatttttgagacttcctattttatttaactaccattatatatataaacattaatttattttttatgtctaccttttatagaaaactaggctggtgtggtggctcacatctacaatcccaacacttttggaggccaaggcaaggctgtttgaggccaagaattcaaggctagttcaagcaaaatagggagaactcgtctccacaaaaaaattttaaaaacttagctgagagtggtggtgcacacctatagtcccaggtactcaggaggctgaggtgggaggattgcttgaacctgagaggttgaggctgcagtgagccatgatcacatcactgcactccagcctggataacagagcaagactatgactcaagaataaaaagaaaaaaagatatgaaaaatttctaaggaactgattactaactctcttatataaaatatttaaaagaaactgacaaaaactccaaatagaaggacaataatatttgtaaaattataaaatctttcagagaaaaatgataattacaagtggggttcctttaaaatcacattctagttttgtaattcatgtatttcttttcttggtaggaagcatgggtttacttcctttttgtatgggaggaccctagacaaagctttatttagagcagaagatcagctgaatagccctatatctacagaagaaactaaatttatactttaaaatgtcccaacaaacaaaactttaagcatcttcagggaagatggcttcactgaattctaccaaacatttaaggaagaaatagtaccaatcctataaaaaattttccaaaatatagaagagagggtaatattttccaactcattttatgataatagcattatacatgggtttacttcttaaaagcttaaggtaattgttctcaactgagggtgattttggctcccaggaacatttggcattatctagagacatttttgactgttacaactagggagcagtgccactggaaaccagtgggtaaagaccagggatgctgccaaatatcctacaacgcatgggacagtcccccacaacaaagaattaactggctcaaatgtcaatagtgctgaggttgacaaaccctagcttaaagaaaacaaagttctcattattttgaaaaatcaggtatccaaagttatatcacactacaaatctaataattcagtagcaaacaaaaaactaaaaataaaggtagtctaccttatcacaatgtagatctagcatttcaggcttggggaaatcctgttctatgttttcagcaatgttctgtattgctagcaactgctcgtcaattttctgaagcttagcactgagatgctctagttggtgagctgcagagcttggtgcagggcaagctgcagagacaccttgcagccgtttccacaatagataatcttctgcagagtctgactttgtgctctgtcctttgaatcggaactctggttttggcagacctaaatattaataagaataaaagcagaattgattataattaaagaagaggtattattgatgatctcattttttgatgacttcattttaaaccaacacaacactactttccaaatcagttttaattaaatatacctaaaaattccttttcagcttcttgatttctgggataagaatacataaattactacaacaaagttccacaaacaaggaagtctgaatattactttcatcccttgctacaaacatatacttcatcaaaaagcaactttaatatttttatgactttttcaaattctacttgaaaaccaaaaacatcacacgttaaaagctatccccaatattggctattactgactttatatgagatctcaggcaaacattaaacctcctaaaaccaaaatcaaagccaatgactcttcttattcttaaactcagttgattcttctcccaaatttgcaatagttcttttttttttttttttttttttttaagagatagagccttgctttgtcacccaggctggtctgaactcctgggctcaagcaatcctcccacctcagtctcccaaagtgctggattacaggcatgagccactgcgcctggtctgcaacaccttttttaaatgcactctttttctgatgttggggtctcctcctcactgtattgctcatacttcttcttctgccatccattccttttacccataagtacttcctgggctgccagcctcaactcacttctctactcactcttcccactttctctgagttatgtcattgatgaaagatcccaaatctatatggcactctttcttagctccagctccttatatcctgaacatcccagttaggttgtcccataagcatataaaaatgaattcactgcttctgcccctccaaattgctccctcttccttgttccgcagctcagcaaatagcaccaccgttcagtttcacaagccagagaccagaaagtcactcgaggctcctctctttccttcagatccaaagtgacaacaagtattgatgattctacctgctaaacacctacattcttaataccactacttggctgaagctttcacaataaatagaccccaaatgatatccctatctgtaatttatctctagcctatctagtccatcttccacaccaggcccagagagatcttttaaaaacagaaatcatgttccttttctgtccaaaactcttcagtgtgtctccaataccttcaccttaaaagtccaaatgcctccatatgacagacaatggcacacataatcttccctctctctacctctccagcttcatctcttgctatttctttaaacgaacaaacaaaatactactccatttgactccaaacataatgaactttaattttcttttcttttctttgagacatggtcttgctctagcacccaggctggagtgcagtggtgagatcttggtttactgcaacctctgcctcctggactcaagcaatcctcccgcctcagcctcttgagtagctgggactacaggtgtgtgccacaacacctggctaattattctatttcttatagagacagggtctcactatgttgccaaggccggtgtcaaactcctgagctcaagaaatccacccgccttagcctcccaaagtgttgggattataggcgtgagccaccacacccagccaaactttaattttctcaaactaagcaagttccattaacttactgcaaaatctattctctctgtctgataaatgaaattaatctgtagcttatggtcatttgaaatgctggcctaacatactcaggggtcacagagagaaaagtaaaacgtatctaagctattaaatgacagagctgggattcaaatccaggtctgttctatgtgaatctaaaagccaggctcctttcactttcccacatacttcccctgtctgaaagattgctagcttcatacatcctccatccaccactcatgcatcttagcagccccatgacagaagagagaagatgaaggctttaaaatctgaaatgctggcacttgtttgtatatgcagctgttaatacacatgccctaacacatcctaaaccatcccttccttgctcctcatgtctcctgagtgcccactgtcattatacaataatcaggcagagctagactctgtgcccaagcatcttgcaaccacagggctgactaggtccatacctcacaaccactgtggaacctaggggagacttaggtttctgttgcaggaagtctgattgcatattggattaatctaaccagtcacaggatgtagtagcttcaggttgtggagggatattcttctaggctgggtgtggtggctcatgcctataatcccagtactttgggaggctgaggtggaatgatcacttcagaccaggagtttaagaccaacctgggcaacatagtgagaccctgtctctatgaaaaattttaaaaattagctaggcatggtggtgtgtgcttgtaatcctagctacttaggaggctgaggcaggaggatcccttgagcccaggagttcaaggctacagtgaactatgatcacaccactgtaccccagcctgaacagctcagcaagactctgtctctaaaaaacaacacacacatatatatgtattttattaaaaattttaaatatatatagtcttctaaatcttgcaaaaagttaccataatgcaacttgactataaaactgaatatttataagtactattgaattgcatacacctggccataaagatggaaacaacagacactgaggactacaagacagagaaggagggaggaaggtaagggatgagaaactacctattgggtactatgctcattacctgggtgatgcgtccaatcatacctcaaaccttagcatcatgcaatatacctatgtaacaaacttgtacatgtgtcccgaatttgaaataaaagttgggaaaaaaagtactgttggctaccatgcctgtttatttttggtgtgctatttgagaatttcccaccttttacaatatgagaattgctttctaacatcaaaacactcatgaactcacaaagaatatttatttttagccctattaattgagaaaagacatatgcataaacagatctgtgacttcttacaaaatatccatggttcccagctttggaatcatgtctctatttcatttacctacttgcccccatgctccttagcaagggacaaccctttttctggtttcttttgcaattaccaaattttggtgcttgtttccaatacaacagtaattcaggagagggtcatgctatacctcttggctgtttacctttgttctgctgtatgtctgatggtgtaggtgaggtgacactaggctccttcacttctgtaatgcctgctctcaagctttttccatccagacaagctggagttacttctgcaggtttagaaaataaatccatagaggaattggctgattctatcaagactatgaaaagcattcaaagactgattctaaacttctaaataaggtaatccgaagattaacagaacatttctgtgcatgtaaacatccaaaaatacagtgggtttgtaggaggagaggtaagagatgtgagtagggataacaatgctatattaaagaacttttcaaattatatttgttttaaaagtaggaaaaaattaccttgactcttaaaattatgtgggggaacagcattagtaactgaagctgccatataatgtaactctgcagacgatggaactgctagatgatcgctttgctgtttgataacattatcatttgaaggctcttctctcacaggtaattcctgtagaagatcattagcttcaatgtcaatcacatttatataagtatgtccaacctgagccaaaacacataaaaccaaagagggttacattctttttactctatgtggtcactccgccaaaaaaaaaaaaaaaaaaaaaaaaaaggcttaattcttcattcttattaaaaacaaggaaagaagggcctgaatgtgcctaacttaggaaaaggagcaggaagtatgtattattggtcttagtttataatatttttggcataatgcttaaattaatttttgaacctttactacaaagctacatagatgagatttttaacctcatttcatctacccaattgaataatgtctacatgaccataatacattttagcgcaaaggtattattaaaacttctgaataaaacacaaaccaagtttgttactgtatgaggtattgagggtgaccaaggtttctctgacatttcactggaaagcttcagatttagatagacatctgggaccaagagctgaggagcagtcaaaggctcatgttctgaaaattaaaaaagaaataatcaggaacattcaaaaaaaggctgtaaactgctccaaatcatcagctttgtatgaacaagttagcaacaaacaacataaattgtacttcttgaaatctaagtagaagtgacatgggtataaataattaaagcacattctattctaagggcaatttaaagtaattcataattgaatgtaagctgactattgtttctctcatatgaatgatttacaagaacaataaagtaactaaattacatcaagaaaatgctaaaatttcctatttccgtatcagatatagtaagtcatgcttgtctactttagggaagtttcaacaaaaccagattttagaagattaacctataactaatttttttttaacttgaacactttcttgttatttgcttatttttattgacagctttattgaaacataattcacattttttttttttttttgagacagagtctcgctctgtcacccaggctgcagtgcagtaacatgatctaagctcattgcaacctccacctcccgggttcattctcctgcctcagcctcccgagtagctgagactacaggcacccaccaccacacctggctaatttttttgtatttttaatagagacaggatttcaccatgttagccaggatggtctcgatctcctgacctcgtgatccgcccgcctcagcctcccaaagtgctgggattacaggcatgagccactgcgcccagctaattcacattcttttttttttttttttttttttttttttgagacggagtctcgctctgtcgcccaggccggactgcggactgcagtggcgcaatctcggctcactgcaagctccgcttcccgggttcacgccattctcctgcctcagcctcccgagtagctgggactacaggcgcccgccaccgcgcccggctaattttttgtatttttagtagagacggggtttcaccttgttagccaggatggtctcgatctcctgacctcatgattcacccgcctcggcctcccaaagtgctgggattacaggcgtgagccaccgcgcccggcctaattcacattctttaaaagggtatcattcagtggtgtatagtatattcacagagcctataattaaattttaccacttaaggtgttttaacatctaaatttcacaaacgttaactgcttcttatttaacagtaaaataaacaggcctgtcacagcagatcaacaaacagtttaactctgtgccttttgttctaggcctctagccttatcttctagcactgtattttcaataaagcactattttcaaatgtaactcatattgagtacttgttaccaaagcttaaatttaaaccacttaaaactagaaaaaaaaggaaaataaaaatactgaaatcattccctctctcttaattgattggtttaaccgcttttttaagggggatggtgactagctttggcataatgcagatacatctttaataagtcatactgttcttaggaaaaaaaagaaatcacacatgatatgcaagaaattatttgctgcttggtaccacattcagaaacaacttcttgagaagtagcttccttatcttgtagtacattaaaaatttaagacaaaaagagaaaacaaaaaaatttcacaaacacaagaaaaaattaaaatatatgaatacagataattagatattatgcataaaaggtgataggtagaaacaaagagtgacaacttaacaatgtaattttaaataattaatgtaatttcaaattttattattatttatatcttgggccttcacctagatgaatagcagactcaggaaacagctgccaacttcgataaactacttagcaacaaaagcaatgtacctccaaggctttctcaaagacatgcttagataatgaacatttaagaatgtttctcagttccgatgtggtggttcaagcctgtaatcccagcactttgggaggccgaggagggcaaatcacttgaggtcaggagtttgagacaagcctggccaacatggtgaaaccctgtctgtactaaaaatacaaaaattagccaggcgtggtggaggtcacctgtcaggagaccttggctatttgggaggctgaggtaggagaattgcttgaacctggcaggcggaggcaatcttgagccaagattgcaccactgcactccagcctccagcctgggaaacagagcaagactccatctcaaaaaaaaaaaaaatgtttctcaaatgcagagtcatcatttatatcaaaaccattttacatgtgctcaacttcattcagaaagaaatacaaattaaaataatgactttttttttttttttttggagacagagtcttgctctgtcgcccaggctggagtgcagtggcacaatctcggctcactgcaagctctgcctcccaggttcatgccattctcctgcctcagcctcccaagtagctgggactacaggcgcctgccaccacacctggctaattttttgtatttttagtagagatggggtttcaccgtgttagccaggatggtctcgatctcttgacctagtgatccgcccacctcagcctcccaaagtgctgggattacaggcgtgagccaccgcgcccagcctataattactttttttgacctatcagattggcaaagttaaaaagtttagctaaatcacagtaataaccaaaaaagtctcttatgcaggaagatactcattgaagcataatttgtaggagaaaaaactggaaactgtctaatgtatagctggaagaaggaatatgcttatgaagtacttttttgatgacacagggacatgtttgccatacatataaatcaaagtgaaatgaacaggatagaaaatacgggtatcccttgtaatgcaaatctaatccactcctgcaaatgtgctggatagtgaattttctgattccaggagactttatgacagtatttcaaatggaaataaaaaggtgtcctagcccatctaattttcccaaacatcattaaacaactcttaaataacaacccatcaaggataactacatataaagcattttaaatataactttttgattaatattcatttaattcattagttagcattcaatatgcaataatactgaacacattagagatgaattgccgtcaacattgtagcaaacatactatgatgcaaataacaaaataaataatatgttaaagatacactctaatttaagagcatcccaaggtacttggaaaaaaataacactgggacccaggaggattaaactaaactctcatggaaaagctagagaagatagccataatatctggacaatgagagtttagatagtaagggaggacacctatgctatatactgtatttaacaatgtaaaatgcacaaaagactgaaagaaaaaacaatatcaaaccgttattgctaagtggtgtgattatggttaattttcatcttcttcatagattgctaaatcacccaaatattctacaatgattacatttttaaaacataagataaagttaggctaaaaagcatgcacaaggttctgtacatgggtaaaagaaattgtttactaaaaatcataaaaaagaatttctgtgataacaatgggtagagcactattcaagatgctattcataatgataaataatattaaagaggaaatttgtcaggaaacattccaaataataggtcctccaacacttatttcctctgctcctggacacagttaaatacccctccctcaccgaacccagtccagtccttcctagctcaccttcactagccacaatcccaggcctcccaaccttgggcatgcaattccagtaaaggtaatcaataacatagagaatccaaattcaaagcattatatttactgacttaggatgtagtctatggcaattttgaagaaaagtgtctattatgttttacttaagttatcaatttgatttctacagtatataccaagactggaaagaaaaatctaggcagagtaaataatatcacataattaaaaattccctttaaatcactgtcttaaaggaaaagtctagataacttaattgtatcaaaatatatgaatttttttaaaaagtaaaacagcatttacctgggtctgtatttgtacttgcatcttgacttcctatagctttcttttttacagaggccatgaaatgcaatccagctgaagtattatcatcttgtagcatttcttaaatataataaaacattggaagtaatcattgagaagctaacagattaccaggagcccagcagcacagtacctaactcaatggaagtaaaatatggggtgtcaggatgttattaaatttttttttttttgagatggagtctggctctgctgcccaggctggagtgcagtggtgcaatctcggcttactgcaacttccccctcccgggttcaagtgattctcctgcctcagcctcctgagtagctgggattacaggtgcccaccaccatgcctggctaatttttgtatttttaggagagacggggtttcgccacgttggccaggctggtctcaaactcctgacctcaactgatccacccgcctcagcctcccaaagtgctgggattacaggcgtgggccaccgtgtccagcctaaaatgggctttctcaatgaagtgttatgtaagttgaatctcaaagacatggtagaatcaaaaccaaaactgttgaggactctgcacgtccagcttagaaacctagatattcttctggctaatgaagatccagtagaagctgttaagcagagaaatgatatggtcagattcatattctaggaaaacaacctagccagtgtgtggaaaataggtttgagtggatatacctagtaatggtgagggatggggaaacaggttaaatttaagaattacaaaggaagcaaaataggtaagaattggttactgaatggataagagggaagacagaattcagaatcatgtgtttctggcttaggctgatatcaacacaaatggagaaagagaacataggaggaaaaaacagttggggcagagtagaaataatgaattcagaattcacatggtgtacctgaggtaatttctacacaagtggaaaaactcaagaggaaagaaaatcaaaatccaaagtctactgtgagagtttgggtttacatgtggatttctctgggagatctcccaggaagactaggtagaataagaaagtattaattatggagcattgtggtataatgaaaaatatatatttggtctacaaagacccagtttcttgcacacaggtcctcagaatcttgggatttcctgataggagtgtctgttatttctaacgagccccttttgatcatacctaagtttatgctagaggtgtctctttgcaagcccttagatagcttcagcataggccctagtcaccagaggaaccaaccacatgatgagagggttagaactaccagcccccaattcactcatcctactgccacttctgggaaagagaaggggctggagattgagctcaatcacaatggccagtgatttaatcaattatacctatgtactgaaaagtcaataaaaattctgaagcaaacaggttaagggagattccaggttggtgaatacatggatgtgctaggagaatgaccatcccagagagggcatggaagccctgtgctgcccacccccaccactgcgtatcctttataataaaattgtaatcataagtaaagtgctttcccaatttctgtgggttttctagtcaattatcaaacctgagttgaggggggtggagtataggaacccttgaatttgtagtcagctgggcagaaatgtaggtagcctcattttcatattgtacatatttctagaaagctaattttaactctaaacttagacattacattaatcatacacatacataccaaaaggaacgtcgaagtcatccaaaggatgggaaccacaatgttcttgttgttcctaaatgaattcccacaggattactctatgattaactcaaagatgtgtattatttttgaaaaaaaaatcaatagctatgaagattgaattctcatgtataacttcaacttccatcattctagacataagtattctatcaaattatttactctatcaaagtaactctacaaatgaattcagaaaatacataagccaaacaataaaaaagagcattaccaatttaatgtaacgttcctaggttaccatgtgcaactctcttctacagagtagctttgataatactcaaatagtacaccatcctgtcaaaaatctttcatggactcaacaaacatttgtactaagtgcctctaaacatgctcttgaggactgactgaaaaagcatgccttttaaaaatcaatgtaaacaaaactattaatacgtctctatttaatctgttgttgcaaaaatagttagtcaccaaatatagaaggtatattttaaaagacctgacttaaagctgggcatgatggctcacacctataatccaagtgttttaggaggctgaggtggaaggatcacttgaggtcaggagttggagaccagcctgggcaacacagcaaggtcccacctctcaaaaaatattttttaattagctgggcatggtggcacacacctgtagttctagctatttgggaggctgaagcaggaggattgcccgagcccaggaggtagaggctgcagtgagctatatttatgccactgcactacagcctgtgcaacagagcaaggccctatctctaaaaaataataataaattaaattttaaaaaaagacgtgacttaaaatagaggttacacaacaaacctgtttgggaaatcctagaggaatctcagagaacggtgaaactgtattaggagaagcccaaataacataatatatatattaagatgtcatagaaataagcaaagggtgatttcaaatataaaaaagccacacaggcagatgctctaaactgcagtttttcatgtaccatcaagttgcttttcacattcagaactctatgtctactgctctgtggagggaggcagcagggactgatatactgaatgatatgaagatcctcctagtcacagtcagaagctcccagcaatcagactagataaaccacaaagacataccaaactcagtgtacatgcaaaccagggaagaatctatagcagtttttctataccttgggtttcttaatgatttctgaatcatcattattaattatggaattctctggtcgaaaagtcacatttggttttctcctcagtttctcacatcttttttcttgcagctctttctcagctcttcttctttgcctgttaaacataatagcataaaacatacttttacaactatagcaacatttgcttttcatttatcatgctatatagggatacagttgacaaaattacgttcataaattattttcaatagcatttaattaaattggcaagatattctgcaaatacaagcaaatataagcaaaacaccaaatgtgaaatttatttctagaacctctactactgaactgactattctatattagtcactggaatctaaggacaggtttacacaccttaggtaattattaaactctcttttctgtggatttgaagctggtgccagaaaccctatcagatacctccatttgtctatttgaagacattaagcacacttagtcacctcagcaaaattacagcaaggaggaaagaggtctcaaaatgctaaagggaagacttaatttgaagagggaatagatggaaacagaaaatttctggaaagagagcactagtgacagattttacagtctgataaatgtgaaattttaaaagtattttctagacttagtaataatctaccaatcaatatatgcggtaaaacactacagtaagtgctcttcactagaagtcacagccttgcttttcacatacacatttcttagtgccctgaaacaatttacatcacctaccctcctgcttactgtaagagtctaaagaatacggtaagatgattggttcaaagtattagatgatacagtagtccctgcttatccatggtttcactttccaaggtttcagttatcagagttcaaccatggttcgaaaatagatgagttcagtgcagtaagatattttgagagacagagagaaagagatcacattcttataacttgtattacaatatagttataattgttatattttattactagttattgtgcattgcttactgtgcctaatctgtaacttaaactttatcattggcatgcatatatagaaaaaaacaaaatatataatagggttcagtactatctgcagtttcaggtatccactgaaggtcttggcatgtattcctggggataagggaggactactgcatatgggatattgtaccaaatatttgagcagcaaatgactgttcatcctattaccgacactgtaaaagaatcctccagtctatgaatggtaggaaagaattccttaataaaatgggaaaaaattatagtatttgtctcgcaaaataggaatttttctcacataaaatgttttcagatgcatgacacttgaaaagaaaactgaatgtgcaattgtgtatagcctaggagactgaaccagattactgtgtgattataaataataatgaacttgctgatatatgatattatcaaataaaatttcacttaagccttgcctttttttactgtcctttccttgtcttacttcaggtggttctattttgacctttagaagttgaaggtgtccagcatcaccttgttcaaataaattatgtgttagtttctgttggctttgtttaaacgcaatgaggttttcaagtgggataagttgtgtttttttgcactacaagaaagaaacaaagcataagaatgacaaattgcaaactcaattatgtaatatttcaacaaaagactgaggaaaaatacatttgtttaaattaaactgtgcaacagttagaacaaatcaaatataacaaattgatttaaactggcaatatgagtatacatatcttagagaaaaagtgatttaaagtgctgaaagtttcaaatgggtcatcctatttcagaaattaagctagaagttctcaacttcctaatttcattcccttattaaaaagctttcctctggccaagtgcagtggctcacgcctgtaatcccagcactttgggaggtcgagacgggctgatcacaaggtcaggagtttgagaccagcctgaccaacatggtgaaaccccgtccctactaaagatataaaaaattatccaggcattgtggtgcgtgcctgtaatcccagctacttgggaggctgaggcaggagaatcacttgaatctgggagttggaggttgcagtgagctgagatggcgccattacactccagcctggtgacagggcaaggctccgtctcatacataaaaacaaaaaaaacctttcctcttataaatgaaattatataatgtccagcatttaacttaaaattgtttggaacagggaagatgtagaggcacaaaaaccacagatggaacagaccagcaatatgctgaaaatccctgaagccttgggaattgggtgataaaaacttggggttcttctttggctcgttatatgttcagaagaaaaggaagcatggtaagtattttttctaaggaataaccatttcctttcccagtaccatcttcaaatcataaaagtacaccacagaatgcattactcaattacctccctaagatagtactgctctcctcaaaactagagcctaaaccattttaatttcataaatcaaaagttatacctttaaagaggacttggtgggtttataaaactaccattttaatatatatgctactaatcacagattctgggtctatttaacaaatttaacctgtcaaagatttgaagatcatacaataattgctaggaacctcaaacaatatgtgtgctcacttgctctccactctacacacacataaacaagagcatctggtaatttttttgctttcttttttgagtgtttaaatctgacacagagtacctggtaattttacttcttatttcttcccagagcagcagaaatatttatgaaagagtccagtaaattccagtattgatagaaagacctaaaacctttaaaatacacaatttttttttaatagagacagcttctccctatgttacccaggctagtctcaaactcctggggatcaagggatcttcccatcttggcctcccaaagtattgggattacaggcatgagccaccatgcccagctacaatcattattttaaacctaatttttatatgctattttctataacaagcatttttttatgtacaagagcttttcagtgaccatacagtacttatggtatgaaaaaaatagtgcaggacactgcttttgcattaccatacaaaaattcattaccctattttctggggacaaatgtgaatgaagtaatgacaatcttgggtattttctttcttctgctataggttggataggtgttgagggaactgtaatagatgctcttgaggttgatggaaacatattaggaggtttaagtggcaggtatagtaacggaagtccaaaggaatggtgaggagatatctcaagggtccctggcttaacatcaaatagtttttctggttttataaacactgaagagtcctgttgaggtgtcaaattttcttgtccaacatattgatccaagttcacatgattaggaatttctgtaattacagtttctgcccacgtcttctgctcaacttctttttttctggcttcagtgttatactggcttacattcaaatgggatgctggagtagtttgtgctgctctctgtggcagagcaggttggaaggagtcagataatccccaagcctctcttggttgtggcaaaggcctgaagggaacttgtggaatacttcctgtatgtaagaaaaggggctggaattcttgtttagacttaaattgaagcaaaggaaagccatcaccaggactaaatgtttttgcatgtgggataagtctaggtgccttctgaacaacagaaggtgtggacaaaaggtagaggtgagtatttccagcaggagctggataaaacgaagtggatggtaagttttgagatgatggaattggtccttttttccggggctggccatttaattgacataaaggaatactcccatgtggaacattctggaagagaaaaaagatattatgtaagtttagaatatattagaaattccttcctttgtaaatggcattcagtatgttttgcagtgggtagaatgtagtaactgctaaaaaaaaaaattatttattcaataaaaaacacgatgactattgaactactcaggacattattatttttttttttctgagacagagtcttgctctgtcacccaggctggagtacagtgacatgatctcggctcactgcaacctccacctcctgagttcaagcgattctcctgcctcagcctcctgagtagctgggattacaggcatgcgccaccacacccggctgacttttgtatttttagtagagacggggtttcacgatgttggccaggctggtctcgaactcccaacctcaggtgtggcctgccaaagtgctgggattacagacatgagccaccgcgcccagccattaatggtatttttacatacattacctgtacgtttccagtactattttgaccagatgggatagttccttcatggcagtgtgggctgttcttgcgaggctctctggcgttctctcccattgactgtggtttaataaaaaatctctccttaagatttttgttgctgtcttcaacatcaccacatcctcttaggtttgattcttggctttcccctaaatgcacagactgagactgctgtacaagttgttgtgtatctgggagattagcaaaggatgatcctactatttgcattaggctcatgaagttgatctgttgcagcttgaataaaacaaaaattgaagcgatatcttaaaatataacaaaaagaatctaaggaataacaataatcatctgagtattctacaatagtcacacgtttgtcttaatatctatgagaatcatgaatgctgagcaggaggcagtcagggaaattttttttttttttaaagggagaggaaaaaaatgataacttcctgtcaaccaggcatatgaatactcacttgcgaatgaaacttggaactatttgtaaacagtttacagtattcagtttccataaacatcccagggatcaaaggagtgggataaagacagattctcagaataggccgggcacagtggctcacgcctgtaatcccagcattttgggaggccgaggcaggcagatcatgaggtcaagagattgagaccatcctagccaacatgatgaaaccccatctctactaaaaatacaaaaattagctgggtgtggtggcacgggcccgtagtcccaactactcgggaagctgaggcaggagaatcgcttgaaccagggaggcggaggttacactgagccaagatcgtgccactgcactccagcctggtgacagagtaagattctgtctacacacacgaaaaaagacagattcccagaataagtatattttggacagttttcagcaatgagcagaaagcagtacacaggtgaagagcaaggaattcccttggaaacgctgactaggtgaaagtagtcagacaccagttgtccccaaactttgctgcacattacaatcacctgagaagtatttataagtcccgatgaccaggtcactccctatcaataatcgcaatgtctgaggataggaaccagcatctgtattcattaagatgaccaggttatttaaatgtccagaaaagcttgggaagcactagcatagacattggcttagctggaacaagagatttacagcaggcataatgaaaagataggctagtacagaagttcacaaacttcggcatgcatcagaattacctggaggacttgaacgactgctgatccctatcccaagtttctgattcaacaggtctaggatagggatctgagaatttgtatttccaaagtctaagtgatgctgatactactcgtccaggcatcatactttgagaaccactagacttgtgaaagtaaggcaggaaaggagggaaggtaaagacttcaaagtgaagtttttgaaggccaacagaagaatttgcatttgatagaacaaaccaatagggaaatagtgcaggttttaaaaaatgtagttttcttttaattataaagtaaatacacacaggaaaaaacagaaattttaaaaataaaataaatatcattcataatcctaccctcaaaaataatgagcattgacattttagtatatttcctttctctagcttactctctctctctctctctctctctctctctctctctctctatctatctattctatctaaaagacaaggtctcaccctgctacccaggctggagtgcagtggactgatcatagaccactgtaacttcaaattcctgggctcaaagcatcctccaacctcagcctgccgagtagctgagactataggcatgtgctaccatgcctggataatggtttgctttttgagtttttgtttgtttgtttgtttttgtagagatgaggtcttgctatgttgtccaggctggtctcaaactcctggcctcaagcaatcctcctacctcagccacccaaagcactaggattacaggtatgagccacctcttataaaatttaaaaatataaagaggctggcttctttctatttttaaaacaagattgatatcatatattatacaaatttgttcctgaaatttactgaagatttttaaacaggtgactaatattattaaaataatacctgaagaaagtgtcctagaatatagaagacaatggaagaacaaaactaagaatctaaggttagccactgctatagaaatagcaagtggctattaccgacatatagtatgggcaaaaaattcaagagggcatagtaaaacactgggtaggggttgtgaaagaaggcaaagatgacttttgaagatagtgattcttaatcttttgtgtgcatcagaattatctggataatgtgttaaatatataggacagtgaccagtgaagtccccaagtaatccatctaacagtttgagagatgtctctaaaacattaagatggtagaatcagtggtgctactaaacagaaaaaggaaagaagggactagggagaataagaataaaattagtttcagtaagtttcatgggacagggggacatgctgaacaactattctcatcaaggcccctaagttcaaagagaaaattagtgcagctgggcacagcggctcacgcctgtaatcctagcactttgggaggccaaggcaggcagatcacctgaggtcaggagttcgagaccagcctggccaacatggcgaaactccatctttactaaaaatataaaaattagccaggcaaggtggtacatgcctataatcccagctactcaggaggctgaggcagaagacgcttgaacctgggaggcagaggttgcagtgagccgagatcgcgccactgcactccagcctgggcaacagagtgagactccgtctcaaaaaataaaaatataaaaaaaatttttaaaaagaaaattagtgccgagaatcatcaatatggaaatggtatatattacatcacataaaaggatatggaagtgaatgtaggacaaatgagcagaggtttagatctgaaggaaactaatgtttctaaaaaggtaaataattaaccattgttggtaaacagaaaaaaaggatagccaggtatgatgaaagtcaaagtgaacagtaatttgaaatgcagctgagagtttcaactcaagcacaagaaatatggataagaaatatgtgatagtgtcagctggaaaataaaccttggatacttttgagtaggagcccactaatctggtttgattactccccacctcacttttgtgagcagctgcatcccaaagagctcagtaaaaataggtcattgtgagaagtaggtagcttagcctagacctctgggccctagaggtcttttttttcctagtagaatttttttttcctagtagagtttcctagcagagtctcactatgttgcccaagctggtttcaaactcctggcctcaagcaatcctcctaccttgacctcccaaagtgctgggattacaaacgtgagccactgcgcccaaccagttataaacatttgaatgaaaagtacccaaagcagagaaatgcttgtgatataattttaccttgtcaatttctggaaatctattaatattttaaaaccctacatgtacactatgtgtagatttacttacttatatagagatgtgcttacctgaactaatttaaacatttcatcttgcagcatctgcctaacggactccgaacaatctggtaactgagccgtgaattcatttctctgggtcttctgaggtgttggagcaggtggttgtgaagcaacattgactccatttgatatcagaagtggaactgaggaagatttttctttatatgtagaaatctgtgcactgcgtggaaagcatttaaataaaaaacatgcattaaaattgacaaaaaacaaattgaatgtctatgatcagaatattttgatcccacttttgtcttccaatttaaaggttattctagtagttttctagaaatttaaaccctaaagcctttctctctagtgcccgtcagccccccagacacattcgtcatcagctcaattttcatctttattaagggattgtctagtcagtgatgggctccttcatagggtgttgcaaacccaagagctgacatatattttacttgcctggtccctgtggacatctgaatttgagacctgtggaatcattctgattagctgtacagacttcacaatttgtaatttggcttagaaatatgtttttgactaaaattaatgatccagcatagagttaagaaaactacggaaaaactgggtttaaaaaacttaattctaggatcagtagagaaaactactgtttatcatcattaaatgtgaaacaatagtactgtgaacatttcatttccaagcaaacctcagagtttaaatgtaccataaaccctaataaaaaatgcttatttacaaataaaaattaaggatcaaagcaaggtgtttaggttttttttttaaaaaaacaaaatgactgttgggggatgactcctcaaacatagcagatactcaaagttttctacattttataaactaagcaagggagcaggcagttatcagattcaaacagatcactgtttccaaaaaagaaaagaacatattaaatttcatatagacttatttaggtttacactcattcccatttggcaataatatttgccttttatcgagcatcttaacacacccaataaaaaaactttatttggcaaattcacaaaaaataggcattacaactgatctatcttttccttttctgccaaagtgaaagctttgagtgttgctccttgagaatcatgtttctcacagctgctgccagcctccactgtccccagctttcttagctgggtgacaagggagttagttgcccagtgacagggatctggaatctaaagagtaagcggagccaaagaaggtttaggaggcaccctctggcgactgggttcctgaagtgtgatggaagggggaatgggtttcaggctgacccctcttcaggcattcctagtaaagccacaaggggctccagggctgtagaggtccccttgggcacagggtgggtgcattcatgcttgcacaagtcactggcactcaggaaggccttgggacagtaggggcaggtataggggtaaactgagctgtaggtacagctggatgtgcacagcccaggccagtctcagaagctctttaaactgagtgtagcaaaagggccggatctgggtatgaggactcatgcagacgcaacaacattttgtgaagaaggtctccttgcacaaacagatctgcccattttaaaacaagtttattgggctttgctttcaacaggtctcaaggagatcgattctaactatgaaaatttttttctgaggtaaagctgtgctatattttcctatttcggcaagatttctaaacactaagcactctgttcaaaagaaccggatgagtctgttctgtgagagaattaaaagcatttcaaacactacaagaaatcagttagaagctgaaaatgagcaacaacttcatctttcaataatatatcactactttttttcagaaaagactgttcaacatagttcctgtgtaactttaaaatacaatcgctagtggaaactcagtaatgaaagatgtcagatctgtgtgcttatgctgctctttcaatgttttatgttgctttcatttttcttagtttttagtcaaaatgtagcaattgtttcaaaaatggtacagtcggcatactttcactctgtgatttgtaaaacacaactatttttaaatggtatagtaggcaaaacttcttacctagaaatttctgaactcgtatctacttgcattgattgaggagtggtatgcccaggatgtgaaaaggcttcgatcatactatcaataaaaattaacaggtgattagtaagcaagatattctttgcattatctaaggtatgagtgatctatgctcagccatctaagagtctaaacatcctctaatcttctataatgtttagctcataattacaatctgtttacatttgtctccatagcaattagtaacagatctaagcaaaagcaaaaaaatatgtctggatgacttaaaacaccacttaaatacggctgactgctcagcaatgaaaacaacagaacccaaaatgaggggacatgaggttagttaagacccaaatttcacctatagaagagggagacactatgctcagaaccctagagcccattgtcacatttgaaactgtaaagaggctgggcacgatggctcacgactgtaatcccagcactgtgggaggccaaggcaggcagatcacctgagctcaggagttcgagaccagcctgggtgacatggcgaatcccatctctaaaaaaaatacaaaaaaattagctaggcatggtggtgcacacctgggcaacacagcaagaccctgtttccaaaaaaagaaaagaaagaaaagaaaaaagaaactgtaaagattagtgtttgtcttctctctctctcttcttgggtaattttccgaaggaatcatttttatgaatagaagtatctaaattacttgtaaaggcccatagtattaaatgcattctttttaactgtccacagaaaaactaacaaaatttgcatactgaacagaaaaagaaaatctaattatgttgccttttttttttttttgagatggagtcttgctctgttgcccaggctggagtgcagtggcctgatctcggctcactgcaagctccgcctccccgggtcatgccattctcctgcctcagcctcccgagtagctgtaactacaagcgcccgccaccacacccagttaattttttgtatttttagtagagacagggtttcaccgtgttagccaggatggtcttgatctcttgacctcatgatccacccgcctcggcctcctagagtgctgggattacaggcataagccaccacgcctggccatgttgcctttctgatctaagggaattctaaaatttagaacttctaaaattctaaagatttagaaatcatgtccaaactgcaacacatgaaaactgccttcagctctccttgaagcaataagctagccggcagtgtatgtgtacatcatagccctaatgaatagtgtatagtaatcatcacaacagtgaaagattttatacatacataaaataatttataatcattctttatttgattcaataaaaatggaataagtatgaaaagtggttccctacttagcagctaaataagctttggcctatttacagctttattttgataaggctgatagtgatgagagaacaaaaggcattttagatatcattatttatttcactctatcaatacatagaagtataacatttaccaaaaatcattttaccataactataaactgaagttacagtttcactagaaacacaataccaccctaaatcatgtattgtaaattatgaaggaaaaaagctgaaagcttcactgaggtaaccagtgacaatcactgtcatacttttttcccccttaccctttttgttcagtcgatttttcctccataattgtctccagtggttcttccctttgacactgaacctcttctgtgaactcctgttaaaatgaatagtacccaaaaagaaaacaggtaaaacaaataggtattactgtcttgagtattttgagtctcatattagccacttaaccagagtaacaacagtctacaagcaagtgagaaatcaaacagtaaaatgtactcccagtcctgctctgacctaatctttatactgtgtgaattgcctccactctgtcacactgggctattgagcatgctaagttacaaagacaagattgtgtcagtagactaacacactgtaaattatatacacctaacactatatgattattcatttccctgtaaaaacaactataaaaccaggaaaaatgaatcttttttgaaagaattgttacaaggcaggcagatctacttgaggtcaggagctcaagatcagcctggccaacatggtgaaactctgtctctataaaaaaatacaaaaaattagtcaggcatggtggcgcatacctgtagtcccagctacttgggaggctgaggcagaattgcttgaacctgggaggtggaagctgcagttagccaagatcacaccactgcactccagcctgggcaacagagcaagactgtctcaaaaataaaaataaaaataaaaataaaaaagaattgttacaacagatagggcacggtggctcacacctgtaatttcagcactttgagaggttgaggctaggagttcaagaccagcctaagcaacatagcaaggcccagtctctacaaaaaaatgtttttttttttttaaattagctgggcatagtggtgtgcacctatagtaagacccagctacttgggaggctgaggcaagaggatgactttattccaggaattccaggctgcagtgagccatgatcgtgccactgcactccagcttgggcaaaagagcaagaccctcatctcgaaaaaaaaaaacaaaaacacagaattgttacaataattggaaatgtctatgttccccctggaaattcagtgtatagagttttgagaaaaataatatcaaaaagtatatatatgtataaaaagtatactacagctgaattatactttttaatttttttttttaaaagacagggtctcactctgttgcccaggctggaatgtagtagcacattacagctcactacagcctcaaactcctggagtcaaatgatcctctcacctcagccttctaagtagctgagactactacaggcgcatgccaccatgcctggctattttttaattttttgtagagatggagtcttgttctcttgaccaggctggtctaaaactcctggcctcaagcaatcctcccgcctcagcctcccaaagtgctgggattacaggcatcagttgccatgcttggccatacttccatactttttaaataaaggacacatttgctactcttgattaaataaatttgctaaagcagtttatgatgtgaaaacttcattgcctgaaattattggacaggttactacactgtactagaatttcagggaaagaaaaatgccacacagcatggctatattctacaacccatggtgcatttttaagagctagccctgctttgatatatttaataacaatgaataaaaacatgtataatttaaacactatacaaaatgaaagaagaataattatatccactatttattgacttacttcttctaactgctgtggtaaagtcatcatgcaaatggcaagactgggacttctgaaacctccaacagattcttcaatgtcttctagcgataagtgaagatgaagagaaaactgatcatttaaaaaataagctattgactttttagggggctcagggaatattaccagaaacaatataatgacagaaatattttctatcctttttataaagacagtctttgaaaacacctggagtctattccatcttcatcaggtaaatcccagatgagccttgagaggccttattattcagtatgtttaactccacgtagtgctctgagagtttctgtcttaaggaagactgctggggagaggtttatagagttgcttcacagaaattaacagaccataattattatataagcagcacaagacgcccaataatggtaaaagagcaccaacataaaaataccttagatcttcttggttttattaaaaccaaaattagagttaatatgctcaatatttcataaatatttaattctcttaattttttattttaggctactgtaaacatactaacttaggtataagactaaataagttacctcagataatattatttaccaatttcaaattaataaagccaaaaaaatagattatctaaatgaactgaccttcatagtctgatatgtgcatatccatttcctcttctgtaaatgcttctacttctaaaagattctcatcaatatctataaattcttttttagtattatgagtgatggaaataatatcatcattgatttcttttatatcaggattttttgcttcagttggcattctactgaaaaaaatgcagcaactaaaattacaactattcttggagataaagagctaattcagttttgggttttttttttgtttttttttttaagatggagtctcgcccaggctggagtgcaatggcgcaatctcggcttaattcagttttttaaaagcaaagaacaaactttggtttcatatttataaaatctttctttaaaaaattctgatacacagaagctcaggtaaagattgttcagtaaataactaaacatcatagtttttatttactcgaatgattggaataatttcaactaaaattatcattctcacaaaggactcttcatgctataatgggttttgccttggtattcaaagctatgttactcctagcattgcttcatatataaaaatggatgaaaggattagttcaacttctgatatgggaaataaattgataaaggaatccctcaggatgaattaattgctctctcagaagatataagctagaccaagagggaagaaatacaatttgcaatgaattgttaaagcacctcagaaagctcactgcctgctcctctacttcaaaaaatgctcattcctttaactttcaagggtttgatcttccctttaagcccaaatgccatcaaactacatgtcttatattgaaaagaagagtataatcggcaacttacttcaagatattttgacaagatttattctgaccatttctttcctcagttccacctggagttgctactgcaactgaaccgccagcatctgatttgctctccctctcaatattgggtccaatctgacacccagtgtcacgattctctaccatctaaagcaaaccatttaaagtatttagtatttattgaaccctttatttttcaccatattttaaaattattcattctttctacaggaattctgaataatcctcttattcatttatcaaatatttactgcatttctacaactcaatatttgttgctgaagcaatgatcaagtctttattctaactggaaaaagcaaatctgactacctaaatagtattcaaaagaaatcagccttacaaatttgtaaggcatattgtcattgttttcaggccacaaaacaatggcaaaaaaattataatatcctcatttcattccctttgctatatcataaagacattcagtagttatttcaaaatgacatagtagacaaaaatacatgcagctaaaaacacaaggtacatcctttttgtctcacttaaaatttccatatacattacctagaaatacacatttcaaggatgactaatatcacagtatcatataaactgtataccttatgataacagaaaccaatctcaagggaaaaaaaggactagtgtggtggctcccacctgtaatcccaacattttgagaggccaaggtgggaaggtcacttgagctcaggagtttgagaccagcttgggtaacaaagggaaaccctgtctttataaaaaatttaaaaattagtcaggcatagtggcatgagcctgtggtcccagctgcttggaagattcaagtggaaggatcacttgagcccaggaggtcaaggctacagacagctgtgatcctaagactgcactccagcctgggtgataaagcaagactctggaccaggcgcagtggctcacacctgtaatcccagcactttgggaggccgaggcgggcggatcacaaggtcaggagtttgagaccaccctagccaatatgatgaaaccccatctctactaaaaactacaaaaattagtcaggcgtggtggcgcgtgcctgtagtcccagctactcacaaggctgaggcaggagaatcgcttgaatccaggaggcggaggttgcagtgagttgagatcacgccactgcactccagcctgggtgacagagtgagactccatctcaaaaaaaacaaaaaacaaaacaaaacaaaaagcaagactctgtctcaaaaaatgaataagtaaaaaataaaacaaattcacatattcacatacacacacacacatacacacacacactcacatccttcagcctagaataaactacttcagaataaaagcacttgccattgactagggaagaaagaatagttaattaaacactaactcctctactgactcccccatctgcctttctgtgtttggttctccaacctcttctggcctgagagtataagaaaaactatcccctaacggacttgatgagacatcagtaattaaaactacagagccacctagtcctccttcatctgaaccaaaacctgaaactgaaaggagaaataatatacgtgtaataccacttgtaatatcacttaaaattatctccttcctttttttcttttttataaatacacataaaacttcaaaacctcacagcctctctgaaagcactttattgttaagaattaaaggaaccactggaagaaaaaaataggagatactgattataatcaacattgtcattaattttctattatttaatgattctttaaaagatgggaaatgtaaacatagttttaatctaaaatgagaattctcatttgtaagtaataaacaattgatatgcttaccttaataatggcattttttgccttatatgtagcaaaatagggttgttccaaaagccataatgatgtaagaatggcagctgtagaggtctttacacgaattactggactgtactcagaggatgactcagttataccagaatcacagagtagccttctattagaccaccttatcatccattccagcagtcttcctatactgccaaaagtgtttagtgctaaaggaagatcttcttgagggttaatatcattgcactgaatagctttgaaaatacatcttctagttttaatggacttgggagtccaaaaaatgtggtttgatgatctctggattagacatttctctctagtgtcatcttgtattttgtaaattgacctttgttttaaaccaaataatccactcattccttcattcttattgacttcattcgaaggatattgtaaaaaaggtttgatcccttgattaaccagtactgatgatgaaagtttctggttttctaaatgcatgccatattcatcatttaaagaggatgatttttctgattcataggactcaggagcaacaacaaagcaagaaccagctctaaacacattctggcttttagttttgctctgatgtcgttttaatgttgtatgtacatcaaaaagtaaagaattaagttcatgttctctaagctttccagaaaaactagttagaaatggaatgtcagcatccctggaataaggtaggtctctttcaagaatgtaactcaaaaacagatcaaggaatttaatatattcatcatcatcacgttcaaattcccaaacacctattacaggaagtgtattttgtgataacttttcatgatcttctttctttgtaggattttctttctgattacacattttccttttatcagttggcttatgaattgatgttaattccatgtgatttggggcatttctatagcaaaaaaataaaataagacaaaattagagatcatttaatcactaaaactgatcttagaattgacatggaaaattctctccaatgattaagtcatgtatattttgtgtgcctcaattacctacatttcaaatgagggagtgggactaaatgatttctaagtgttttcaagagtggaacatttctactatgagatcaaaaaaaaattactatcaaaagggaaaatttgtattagaagagattaaaatgtgtccacagaaatttcactataaaagaacatgaataatttttctgtgggtaaaagaaatagtcctctaatgggtcagattttaggaatacaaagtcaacaaaaactccaagccactgatatacaacaaaatttaggatttcttgtttctctcttgcatctgcccgctcagctcccctaataccatgtgtaataagcaagactgaccttttttgttttaccacacaaaaactgggaactttttctaaacacttttagctgttatgaaacctgttgggcggacaccttaactgcccaacaacaattccttttaaatgtttcttctcaacatgattcctagggcagaacacagatccttagttccctcagtaagagaacaggtgttggccacctgggctgaaagcatcccatcccttctgattgaggcaatttccttccctgaaatatttcccttaaaaatattaaggaaatttaaggaaaaatttccttaaaaataatatggctaactcagtaacctcaaactatttaagtctaaagattactaaaaaaaactgaaagtcctccagtgaagtgtagaatttcatctactcctttgattttataatttcagatggcaaaattatttcatatatcaataatacttaaagtaaattttcgaatgtatagtctcattttatactcctaatattcttatgagtggagggggtggcacttatcattcatattattaatagcacaatcagtgagggttgctgggaccagaaatcagctcatcagatgcctgaaagctacttttcaaaggaagtgaatgccagtgattaaaagatctcaattgtacctttgatagatatttatcctacttttttcttcaaccgacaaagcttcagagaacgtatctgcatcactgtgaaccacagaatctcctagttctgtgagtgtacttctgctcaaactagtccccagggaatatctgtcaacacctggagcctcatctggtttctcttcttcaattggttcccatatattcacttcaaaagagcctatatttctctgcacacgttttagagctttcaccctcactttctggatagaatgcatgacaacagacatcatttcctcagtctggggtcctggaaagaaaagaataaaaagtcttagtgttcattaaaatatttcaattcaagacataggagacccaactctggtccctcctggggacaagaaacctaactgatgactaaggcttatttccacattcttactggtcgtgttttcttcagtatttactggaaagatattttaaagtagaactgcagaagctaaagaaggtccattaaagaacacagtaaaagagacagaacctagacctcatgaagaaaaagtatgccctggaaaaaaaaaactttaagtgatttaactgttttaaaactcagaaggataattatatttaataaaaagaataatgaatgttttttctattatcacatagagaataagataaaatgaggataattctagccaaaaaaatcaaggacatttttcttactaaaagtaataagaaacaatagcaagggaaggttttcaaggctgcctatagaaacattttaaaacattatttaatacataaacagaatattttagaggatgtcaaaaaaaagtattaagaaaaatacaaatcacaaatacaatatattaatagaataatacaaaatcactggacatacctggacttaaatactgaattatagttttaaaaagcagggtaattttaattctttaaaaattctgcaacattgtaaatgtacttaatgtcaatgaattgcatattttaaatggctaaaatggtaaattttatattatatgcattttaccacagtaagaaatgtgtgtattctaattttgaagaacaaaattagaagcataaataaccataaagggaaattacttgttttcaacaaatacttgcaatatacaaagtaccatatgctcattttatattatcttacttaatcctctctgaatacacatcataaagcaggtaatactatgcccactttacaaataaagatatgaggctcagagagactgagcaacttgcctaagatcgcacagttactgactgacagagccatgagccgaagtcagcttcatctggttccaaagcaagagattagtctttctgcaatggagaaatgtttctaccttctcatactcctatctcaaggaagaggcaaaaatgcatagacacataagcaacagtaaataaatattttcaaaacaaaaagggaatcttctgcaatttatctgttagctatctgagaaacaacaaataatacctttcacaacacagtgtctgagtctctggtgaagagagtgatatttgtctcttaaaggaaccctcacgtcctcaggatagggaaatgctttcacgaaaatttctgctaccttcagaaaaaaaattgtttaagttttatgagaaacatcattctttttttttcttccattccacaaatattttattttaactcaaaatataaatgcacatttcttactaatcttttgaagtcaggtcaaagcctctctctgagcatctgtctgctaataggagtttagtatcaacttacttttttattttaaaatatgtaattgacaaaaactgtgtatattcaaggtgtacaatgtgatgatttaatatacgtatacattctgtgctgatttccatagtcgaattaattagcacatccatcaatacacacatttaccattgtaatatcctcccttatcaaatttcaggtaaacaatacactacgattaactgtagtcactatagcccggcgcggtggctcacgcctgtaatcccagcactttgggaggccgaggcgggcagatcacgaggtcaggagatcaagaccatcctggctaacgtggtaaaaccccgtgtctactaaaaaaatacaaaaaattagccgggcgtgttggcgggagcctgtggtcccagctgctcggaaggctgaggcaggagaatggcgtgaacccgggaggcggagcttgcagtgagccgagatcgcgccactgcactctagcctgggtgacagagcgagactccgtctcaaaaaaaaaaaaaaaaaaaaaaaaaaactatagtcactatattgtacattggatccctagaacttattcatcttgtaactgaaaggttgtaccctttgaccaagatctccccatttccaccacatccccagcctctgacaaccaccattccactctctgcttccgtgagtttaacatttttatattccacacacaagtgaggtcctacagtatttacctttttgaacccacaagatattatgctaagtgaaataatccaaagaaaggcaacatcatccttaattaaaattaaataaaaatcttttaaagtctctgattctgatgtagtttactttcacctacaagcacattacctttctgattggtggcagttctccaataaggctcaaaattatatcctgaataagttcttccatattaaaaaaccgagagaaaggcagcattctataagcccattccactgcactaagacagtgctcaatcatacaagaatcaaactccacttcaaggtcctaaaaggatattgaaaaacattcatttcctttttagtttagatggtagaccagaatgagttcaaaagaaagttttgctacaaacaataaaatcttcttttaaacaataatttcccacttaacgtgtgttcatttttcttatttttgccctggtaaataccttttctccttttacattttctcttgctttctgatattgcctgcaactataggataacttatcacggacatgcagcatccaacacagagcacaaagttctctgaagcaacctaaagcaggaacacaaatatgaaagaaaatcacatgagtatgtacattaatattataacaactccaactctgctgatcatttttttcaaaataaaggtctttatttcattcattataaaatgaacacatgctcattgtaaatttatataaaagtccttatataaaagtcatggagattgacttataagtcactaacagatattcatttatgtttaaacatttttaatactaaaaactatttctaatagtaaataattttttattaaaagcaatacaagtacacaaagatatataaaatcatactatgtatgctgctttgcaactagcttttttttcacctactatatcttagatatcttttcacatggtaatatactaagtcttcttgttgccaatatggtgttccattgtatggagcatcaggatttaactatacacaatgcacaggctcacaatccagctatcaaaacaagttttcactcttctgctaatcttaaatttctattatagttaacatgtgaccaattaagtgaaaaccatctcatgttctatggttaataggaccttttcaacggggtggtgtaggctctgtagacagagcaagaccttgtctcctagctacttggacacctgaggtgggaggatcgtttgagcccaggagtttgagaccagcctccatgttggcatggatgtggtgaaaaggaaacacttttacactgctggtgaaaacgtaaactagtacaaccactatggaaaacagtgtgaagattccttaaaaaactcaaagtagatctaccatttgatccaaaaatcccactactgggtatctacccagaggaaaagaaatcattatatgaaaaagacacttgcacacgcttctttctagcagcacaatagcaagaccatctctggaaaaagaaaaatataggaacttttcctttggaggaagaaagataatattctaaaatttagcattcattcatttatgccttaattgtttatttttatttattttattatgattatttttttgagacggagtcttgctctatcttgcccaggctggagtgcagtggtgcgatcttggcctccacctcccaggttcaagtgattctcctgtctcagcctcccaagtacctgggactacaagcgtgtgccaccatacctggctaattttgtatttttagtagagacagggtttcaccatgttggccaggctggtctcaaacttctgacttcaggtaatccacctgccttggattacaggcataagctaccacacccagcctatgccttaattttttaaataagccttatttttacaataaactgacttttatattagtagtcagtattttcattttctttagggagctatttaatatgctttttaaaataaatattacaaagtcaaaaagaacagtttgacattatggaaagtgggcagaaagcaggtcttctacacattctattcatcccaatagtgagagaggatggtgggtacatggccccagggggactatcagggtctccagtgagcattttcacactacagcccaccccacacatcagattctcatagattctgccgggggagcacggcccaatcttttgagaaaggcatcattactgacagatgtgtttcattatttcatatttcacaggcaagctgggatagaactaaggccaagaactagcaagacacagtgcagcaacatactaaacagtgactcatctaaaaacatcctttatctgtgtttttcagactgtggattacaaccttttattagttactaggctataaaatcaattcagtgagtctcaatcatctttttaaaatagaatacaacagaatatatcaagcgtgcattgcagccgggcacagtggctcatgcctgtaatcccagtactttgggaggacgaggtgggtgtatcacctgaggtcaggagttcgagaccagcctggtcaacctggtgaaacctcatctctactaaaaatacaagaattagctgggcgtggtggtgtgcacctgtaatcccagctacttgggaggctgaggcagaagaatcacttgaaccggggaggtggagattgcagtgagctgagatcacgccactgcactccagcctgggtgacagacttgagattttgtctcaaaaaaaaaaagaaaagaaaagaagagtgcattgcacacagtaagagtaaaggtagttcattaaattttcattctaacttcatatgggtgtgtgcatgtattaccttgctataaaatctgcacttattttaaatcatggtcaaaaatgtttgaataccaaaaagatgtaaccaactgaaaccagaatagaacgggttctactagacaaacgatcgagtttccacaataaataaagggcatgaaacagaatgggggcaaggaaacttttatagattaagatggacttataggccaggcatggtagctcctgcctgtaatcccagcactttgggaggtcaaggtaggactgcttgagcccaggagttcgagaccagcttgggcaaaaaagtgaggccctgtctttatgaaaaaatgaaaaaaaaaaacaaaaaaaccaggcctggtggtgcacacctgtagtcccagctactcaggaggctgaggtagaaggatcacttgaacctgggaggtcaaggctgcagtgagctacgatcacactataaaaagagaaagatttatatatcaaccaaaatgcaatgtgtggtggaccttgattggatagatttttttaaaaaaactatagaaaagacatatttgaaattatcaagtaaatttaaacatgggatagataacatagtcagatgccacataatggcactcaggtcaatgacagactgcatatactatggtgcacccataagattataatggagctgaaaaatttctgtcacctagagacatcatgacatcatagtccacacattactcaggtgtttatggtgacaactgtgtaaacacacctactgcactgccagtcatataaaatctagcccatacaattatatacagtacataatacttgataataataaacaactgttactggtttatttatttactatactatgctttttatcgttattttagcgtatactcttacttattaaaaaaaactgtaaaatagcctcaggcaggtccttcaggagttattctagaagaaggcattgttataagagaagacatctccaagcatggtattgcccctgaagactttccagtagaaaaagatgtggaggtggaggacagagagattgatgatcctgaccctatgtaggcctagactaatgaatatgttgtgtcttagtttaaattaaaaaaaaaagtttaaacagtaaaaaataaactttaaaatttttcaatagaaaaaagcctggccaagcacagtagctcacacctgtaatcgtagcacttcggcaggctgaggcgggaggatcgattgagcccaggagtttagaccagcgtgagcaacatagtaagaccatgtctctattttacaaataaaaaaaattaggccaggtgcagttgctcacacctgtaaagccagcactttgggaggtagaggcaggtggatcgcttgagctcaggaggccaagatcagcctgggcaacgtggtgaaaccccgtctctactaaaaatacaaaaattaaccaggtatggtggtacatgcctgttgtcccagctactcaggaggctgaggcaggaaaaatgcctgaacccgggaggcagaggctgcagtgagacaagatggcaccaatgcactccagcctgggcaacagagaccccatctctacaaaaactaaaaaataaattagctggtacagtggcttacgcctgtagtcccagtactcaaggggctgaggttagagaatgttttgagcccaggactttgaagttgcagtgagctgtgattatgccactgtatgtctcttcagccaagtatgattacaagagtcaaaaaggttttaatttttttttaagttcataaagtaaaaacattacaataatctatggttaatttattatggaagaaaaatatttttaataaatttagtatagcctaagtgtacagtgtttataaagtctacagtagtgtatagaaatgtccgaggccttcaaattaactcaccacccactcactgactcccctggggcaaaaacttccagtcctgtaagcaccattcatggtaagtgacccatacttaccattttttaaaatcttttatactgtatttttactgtaccttttcaatgtttagatatgtttatatatacaaatatttaccattgtgttaaaactgcctacagtattcagtgtagtcacattctgtattcagtactgcagtattcaatatggcaacacttctttttagagacagggtctcactatgttgcctaggctggagtgcagtggctattcacaggtgcaatcattgcatacaatagccttgaactcctaggctcaagcaatcctcttgtacaggtttgtagcctaaaagcaaaaggccgtatcacatagcctcagtgtgtatgaggctatttttgtctaagtatatcctatggtcacacaacaaaattgtctaatgacacatttcttaggacgtagccccatcattaagcaggcctgactatatatgatattaaagatttattgtaaattttgtcagtcatgataatagaattatggttttaaaaaatacctcatctggccaggcacggtggctcacacctgtaatcccagcactttgggaggccaaggcgggcagatcacgaggtcaggagattgagaccatcctggctaacacggtgaaaccccgtctctactaaaaatacaaaaaattagctgggtgtggtggcaggcgcctgtagtcccagctactcgggaggctaaggcaggagaatggtgggaacccgagcttgcagtgagccgagagcgtgccactacactccagcctgggcaacagagctagactccatcaaaaaaaaaaaaaaaaaacaaatacctcatctgggccgggcatagtggctcacgcctgtaatcccagcactttgggaggccgaggcaggtggatcacgaggtcaggaattcaagaccagcctgaccaacacggtgaaaccccgccctactaaaaagtacaaaaattagctgggtgtggtggcccgcgcctgtaatcccagctactcaggaggctgaggcggagaattgcttgaacctggaggcagaggttgtagtgagctgagattgtgcatgccactgcactccagcctgggcgacagtgcaagactccaactaaaaaaaaaacgacaacaacaacaacaaaacttcatctgttcactacatatactgaagtacttattgtacttatgatgtactcagatttgctttcatgtgttgacaattgttgcaagtgggtgagaggtactcgagtgcttatacatctctactttggtttaaattttccgtaataaaaaaacttcaaaagagtgtgaaatcctgggccaggcatggtagctcacacctgtaatcccagcactttcggaggctgaggcaggcggattacctgaggtcaggagtttgagaccgacctagccaacatggcaaaaccccatatctactaaaaatacaaaaattagctgggcgcagcagcgggtgcctatagtcccagctactgggaaggctgaggcaggagaatcacttgaacccaggagatggaggttacagtgagccgagattgtgccactgcactccagcctgagtgacagaataagactccatctcaaaaataaataaataaataaaattaagagttaaaatctactattttaggtaacaaactagggaaaggaaccttgtttttttgtttttgtttttgtttttaaagaaacagggtcttgttctgccgcccgggctggagatcagtagcaagatcatagctcactgcagcctagaaatcctgggcgcaaggaatcctcctgcctcagcctccccaaagtactgagattacaggcataagccaccgcacctggccagaaaggaactttttttttctttttttttttttttgagacagagtctcgtcctgtcacccaggctggagtacaatggtgcaatcttggctcactgcaacctccatctcccaggttcaagtgattctcctgcttcagcctctcgagtagctgggattacaggtgcacaccactatgcctggctaattttttgcatattttagtagagacagggttttaccatgctggccaggctggtctcgaactcctgaccttgtgatccgcccaactcatcctcccaaagtgctgggattacaggcatgagccaccacgcccagccagaaaggaaactttttaatctagccaaatcacttctcaacaatcaagagaccaaatcaaacaaaagaataattaaacagtagaactcatgatcaaaatgaaaatattaaaaatatgtgttcaaatctttatttaagtcatttcaaaggactatgtccctatttatgagcaaatatcttttaactgggattgttgtgaatttaactcacttcttacagacctagatttttaagaaataaatgagattgtacatacttttccagatgacacctgcctggcccttttgttacgtgaatgaagagtctatgaaactaagctcatgacaggtgagagaagcaatcaagaagcatttcaatgccgtttcggttggaaaaacagacaatctgagccccaggacatgtaagattatactaagggtgagtgagttaagaataaacttttttttttttttttttagggacaggctctcactacgttgcccaggctggagtgcggtggctattcacaggtacaatcattgcacacaagaccctcaaactcctaggctcaagcaacctcctacctcagcctcccaagtacctgggattacaccactgtgcccagctctaaaataaacattttaatcaaagtctaaagataagatcagggctggccaggcgcggtggctcacacctgtaatcccagcactttgggaggccgaggcaggtggatcacgaggtcaggagatcaagaccatcctggctaacacggtgaaaccccgtctctactaaaaaatacaaaaaaaattagccgggcacggtggcgggtgcctgtagtcccagctacttgggaggctgaggcaggagaatatcgggaacccaggaggcagagcttgcagtgagccgagatcacgccactgcactccagcctgggagacagagcaagactccatctcaaaaaaaaaaaaaaagataagatcagggcttaatataaatagaactgataaggattaaggaaggattaaggaggaaagagtgaaatgatatctaaagttttacttctttttaaacttgttaggcaaataactggacatagaccacgaattaagaaattaatttaggtcaggcgcaatggctcatgcctgcaatcccaacattttgggaggccaaggcaggtagactgcttgagctgaggagttcaagatcagcctgggcaacatggcaaaaccctgcctctacaaaaaatacaaaaattagctgggtgtggtggtgtgcacctgtcatcccagctactcaggaggctgaggtggaaggataggttcagcccaggaggtgtgttgcagtgagttaagatcatgccactgcactccagactgggcaacagagccagactctgtctcaaaaaaaaaaaaaaattcagttaaataatgaagcatgacataaggtaataggtatcacaatttgtttatataagaaatttctgacttactatcatatatatcatatatatatacatagctgttaaagtacaatatttacttgtaaacacaaagtaaaatatcagagcatattgtactttgaagagtcaatactttcccaaatcaaatgaaaaatataccatcattcatactctaagcaagcagttcattttggacaaacctattgctctaatggaaacttcatcaagcttgtggtctccagctgctccaggtctaaaaaatgcgatacctcctttacagtaattaagtaatgactgaggaaaaggactcagtgaaggaagggatcctttcattcgaatctaaaagtaaagaataaccgaacatgttaattatcagctgtataaatcacttttaaaagaaactataaaagaatcaggcaggtaagataagccacacagaatggaaaacacagcacatgaaatcagctatattttcagaaacttacaaatttaattcaggaaagtcactagcttgttatctcaaaaaaaaaaaaggttctaagtaaatcatttgtactctcttgtcacaattttgcctgtataagaagaatttaatgctatttttccctggctttcctcactggcatagcaaagaaaataaagaaatttaagaatcttaatcttatcccaaataaagctgtgtacagtaactaaaacaaatacaaaaaaattatgcctacatacataacttttaaaaaactaatctataaatggcagaattagaaagacaccatttggcagcccctaataatgactctaggcaaggatcattagtaaatgctaacagagtaaaaagctgaggggttgacggggatacttgatagagggtgtgacacgatccaaactcaatctcctcatccctaaaattaaaataagcaaacacatgtgccatgtgcgagagagaagtgcacaatacttatgaaagattcatttctaaaaaaatttgaggccaagcgaggtggatcacacctgtaatcccagcactttagggaggccgaggtgggcagatcacttgacgtcaagtttgagcccagcccggccaacatggtgaaactccatctctactaaaaacacaaaaattagttgggcgaggtggcaggcgcctgtagtcccaggtactcaggaggctgaggcaggagaatcacttaaacccgggagccggaggttgcggtgagccgagaccatgccactgcacccagcctgggcgacagagtgagatgctgtctcaaaaaagaaaaaaggaaaaaaaaaaagaaaatttgaactccaatctatttaaacctctctacctcaatgagcacagattaatgaccgggttacaggggtaaaaaaaggaaagagaaacaagctaaacgacactaaatgaagaaacgatcagacaaatctagaatatggtgcaggaaaaattacctagttttttttttaacaaaccaagaataaaaagaggggagcttctacagataacaggctgatttaaatatatttggagatgataaaatttatttccacgtttcaggaaagggctctaagagacataaacctgggaaggaagcattaacagcaggcttgcaattgattttctcctgctagtgtcacttccagaaagacacaatctaatcaaatctcctgggaagcatgctaatgacagacttcttgtcaaatacattaatggcatttactaccaggatggtactaagaggtagagagagagagagccagcaaagaaatgggggaccacagttctacagccacatgcaactgaattctaccaacaatctgaatgcacctggaaacggatgttcccctagtgcctctagaaaggaatgtagccccgctgccaccttgattggccttgtgagactctaagcagagacctagctgaaccaccctgtggtggttctgatgcacagaacctgtgggatattaaatggctgctattttaagctgctaaatttgtgttaatttggtagggtagtaatagaaaactaatatggctcagaatctttgtttcagcaccattttttaattgagctataactcacatatcatcaaagtcatcttttaaaagtgtacaattagtggtttttagtatattcacaaagttaggcaaccatcatcactgtctaattccaggtcattttcatcaccccaaaaagaaaaacaaaagtagtcactgtccacttcctcctctccctaaccccggcaaccaaccactagttactttcagtttccattgtgtttcaaaaatacttttagataacttatcaaagttatctaaaagtctctccaaaggttcctactaaaaataattatattgttttaattaggctgaattaatttaattttacttaggctgaattaaaaatatttggagatgatgaaatttatttccacatttccaagagagacagcaggcatataaaggattttcagctagataaaaagacctaccaggtgtcctatctggctagatatctgataagaatgaagcgacagctcagctgaagtcaatatagaaggggatgaacacctgggaatcaaactgaattgcacatctcagaaaatagcaagggggagaccctgactagtggaggctaccggatggaaacagacgagaatgaactataactttccattctctgaacccacagaaggccccacagaacacagacaacacctcaaggagaactgggagaaagccctggactgagtttcaatctttaatgacaggggagttggaaaaaaaaaaaactgtaattgcctggaattaatggactagattacactatcttttgctagacatggtggaactaacctagagaccctgttcagagtcctcacctttcaacaggaagaatctggtctgtttgtttatgaataaatctgaaatttgtggatttatagggcaggactccttgggaaaatataacaattataaaaacaataatataaatatgagtaatttcagttaacacagcatgtaaatgactaagatatttccataccttctgcatgacttttcttgcccacctcaactgcaatatataccactgtgctacaggaaaagaacactgagccgcccggaaaagcaggagaacacgctgaaggattccagataccttctggcgattatttttttcagcttttaaaagaagatcatcaccatcttcctgaggaaaataaaacaatccattttagtggctagtaatgagaaaatttagaatgttaaaatgaaaataaagataggctaatgagctgagcacagtggctcacgcctgtaatcccagcactttggaaggctgaagcaggaggactgcttgagctcaggagttggaagctgaagtgagccatgattgcatcactgcactcaagcctgggccacacagggacaccctgtctcaaaaaaaaaaaaaaaaaaaaaaaaagataggctaatgatgctcactgcttctcaaactaggatgttcctggagatttataaaggaaattctgaggcacgggctctgagatttcaactatggctatttctagaattgagaaatgttatctcccctcaacgtaaagggataagctgacccttgttcccagtcttacgctagaacagttaaagcccgctactccagactccattggtgggatgttacagagaggtccatctaagcagaatcccttttctcttcctctgctgggaagaatcctacttatatttcaatgttacttcctctgtgaagcccatccctctgtgctacaacagcactttgttcacacttctactgtagctttcaccaatttattccatatcaatttatacctgtatcccactgtactcagaactcccaagaggaagggccttgtcatttgtcttcgtatggccacagtgttcacactcaagtctgatacatagtaggacccaataaatgtttgttgaataaatgctatccaaaccagtagctaaagattattttcccagataatgagataatgtgagcattgtaaacatctgcttccccaacatccttcttccctgcccacttcttaacagtactcagtttttgagtatctgcccatctcctacatggctcatatgattgagggaaagctcatcccacctcaaggaaggatctattcacaggccaagcagtaccttgtgttaagcctagccacagtgactgtttaaaggacaggcatgtgacccaagccagtctcactaagagtgaatctcaatcctcttgcttggaatgctgggacagaaataattttgccacttctctttgtctcaatcactgtgcccatggacatggacaaggcatccttagaagctgttagtggccattctgctcccacaaggggagctagtcttcaggtgaagatgacacctcagaaaacaaactagagcaaaagacagagcccaagtctttggtaacataactaaatcagaaacctgccctacaactaggcttcttcatcacgtgaaccaataaatgccgttattgtttaaaccattttgaccaagtgttttattacttgcaacacaaggggttctaactgatatacggtgacatttagaagaaaccttaccaaggagaattgctttaataaaaaagaataaaatgaagcactactaaaggcagtaaccactcaaactactcgaactattatctgcacaggctatccaaaaaactttaaatgtcatttcaaatttctaaaccaattactaaagactcagatgcaagaggaaagatgaattattgagaaatgccatggactttttattccttccatttgtaaaatcaacaagtaaaatgttttagactattgaaatataaccaaataggacaaatgagaaataaaaaactagaggtagaagtcgccaatattgaaacaggagatagtaaaaaaataatacccagaaacacttcaaagtgttaatcaaatacttaaaagtctaaatgtaagtaatttataataacactttaaatcttaaaaccagctaactataatgttatgattttttaataagagcagataaaaagtttctgagaggaatatagtatttataatatagaactatcaattgaatagtgtaggaaaaaaaaaaccttttaaaacaaagtcaaataaaaataagtctttcttttcttttttgagacagagttttgctctgtcacccaggctggagtgcagtggtgcaatctcggctcactacaacctctacctcccgggctcaagccatctacccacttcagcctactgagtagctgagactacaggcacatgccacgatgcccagctaatttttgtatattttatagagacagggtttcgccatgttgcccaggctggtctcaaactccttgactcaagcaatcttcccgccttggcctcccaagttctgggattacaggtgtgagctactacacccagccaagtctttcaaaaaaggcaaagacaaagagataaataagagactgaaataatgtatggcttctaattctgacactcattatttcatttgttagcctaaaaaatgcctaatttttaaaagtctggatattaagattaattgtgctatattgttacaataattttaacatttattgaataattactatatgtcccaggtcctgagctagaagattttacaggatatctcaatcctcacaaaaatgccatgagaggtactattatcatctgcatttaaccgatacggaaacttaaacagcagtttagtacattccctaagattatacaattagtgaacagcaaagctgggatctatacgtttgtctttagagcttgaatttttaacctgatgattattatcaagttaattattttaaaaacttgacaaaatcaactttaaattaatttaaaagttaatgctataagcttacttcactaagaatagctggctggggacagtacaatggaggagctggaagatacaagccgaatggcactaagccccacagtcttttactgaagtccttggcagagtctatcagaagttgaaatgtctccgaaagaatatctgcatcggccataactgatgctttcagtacttcttgtactgaaccaaatagcagatttgcatcttcctcttcaatgggatctatcaaatacaaaaatttggtaaaatagttaaagcttgtattaaacttcttatccattttgtaggaaaaaatttcaaatctaaaaacattcattgtcaagaatgaacacattggttgacatacaaacatccaaacttacagacagaaattacaaactatcttgttactttaagattataggtaagaccatgagacatttttatacaagatattgtagaaacaactatacaataaaaatattcttagaatgtagttctgagtcaaaaataattgaaaaaatattaatgggaaaagaatgtcaagaaagacaccaaaataatataaaagattgtgtgagagtaacttttccttttttttttttttgagatggagtctcactctgtcacccaggctggagtgtgaagtgcagtggcaggatctcggctcactgcaacctctgcctcccaggttctaccaattttcccacctaagcctcctgagtagctgggattacaggcacacactatccaggctaatttttgtatttttagtagagatgaggtttcaccatgttggtcaggctggtcttgaactcctgatctcaggtgatccacctagcctcctaaagtcctgggattacagacatgaccaccgtgcctggccatttttccttttcttaatagtacatgatagtactttgtaataataagttaataaaaatgacttatgaaggaaacaggaaaacacaaaatagtcatatgtatagtacggcttcaactatgcaaatatctatatatatgtgcacatgtcccaaaaggcaaaatgtaagatgtggtggtagaactggaaactcagggatttttctactatgaaatattttaagcatactgtaaaatatagaatatatgaaagtacagaatataatatgtcaaacacttatgtactgacttctcatccttgtctgatattaacatttttgctatattcaacttaggtagccactatccagcatttggtgtggatatactggaattccaattaaatatatgttgtctttctgttgtgtgttctacaaagcttaacttctctttcatatttttcaaatctatgtccctatctattttgtatatatttatctttctttatatattttatatatatatatgtatatgatagctcagatgaatagctcagattcatcttttccagttcacaaatttgctcctaaattggtttagtaactttaaccatctattgaagtttttgtttttaaatcaggttgagacataatttacatactatatccatcctttttaaagtatacagttcaataaaattaaacaaatctatattggcttgtaataacatttccatcactccaaaagttatacttctttgtagtcaattccctgtttattctcaggcaacccctgatctgttttctgctcctatagttttgttttttatagaatgccacagaaatggaatcatacggtatgtagtcttcgttcctgacttctttcaggacttcttaccatgacggttctgtgattcatctatgttgtcacaagttatcagcaatttgttcctcttcactatttgttattccattttaaagatatatttgaatttgcttatccattcaccagttgacggacatttgaggtgtttccaaattttggctattatgaaaaagttgctataaacattcatgtatggatatttgttttgtttcattttttgagacaaggatctcactctgtcacccaggctggagtgcagtggcacaatcatggctcactgcagacttgacctcctaggctcaagggattctcccactttagttagcttcccaagcagctgggactacaggcatataccatcatgcctggataatttttgtattttctgtagagacagggttttgtcatattgcccaagctggtctcgaactcctgggctcaagtgatctgctggccttagcctcccaaagcattgagattacaggcatgagccactgcgcctggcttcatgtacacatttttgtgtacatgaatatttgaatgggcctgtttctatttctctttaatggaatggaattcattcaagagcagctaaagagaaaaaaatggaaccctttgaatttttatttgcttgttgtttctgacctctggcaattccccttactttatttaaagcttggcctttaagtggatattttttgtattttatctagaaacacattttatctatgtatttatcgtggaagagttttcagatcatttaaaacaacatattgccaaaactcaaagttcagactggggatattttagtcccttctttaaaatccaactttcacacagtaacatcttttcattgattaaagcaaaagaactgcacagaaaattatcaaagaaaagtttatagtcagatttccaagcattataggttctctcaaaacagaaatgttataagttttaggaatctagagttagaagtctcactctttactggagcaaagcaccaataaaaacagaagggcctcacagttgccctggttttacattaaatatacgacattaaatgactgatttcattactttttatctaaatttctccaactgtaaaacagataaattttataggattcctgtgtgaatccatgtaatacatgtaatattctatcatttttaattttttaataccattttgaacttttcaaataaaaaagatctataatttatgcactaggtgagagttgaaataaatcactcctaagtacccttccaggcttgagattctacagctccaaaagaaaatgatacaaatgaagcgaaatataattagtgtaaaggtatgtatgaaggctactctcaacatagtctctggggtggccttgctctgcaggaggagtcagagagctgtaacactgcggcatcaagaaagctactttaatatttaaaaaaaaaaaaaaaggcatgtatggaaaatcagaaaatcattcagttatcaacccttgtattgtaagctggcatcaattttgggtgttcccatggttaagtataaatatcatactttcatttttcagccgggcgcagtggctcatgcctgtaatcccaacactttgggaggccaaagcaggcggatcacctgaggtcaggagtttgagaccagcctggccaacaaggtgaaaccctgtctctacaaacactacaaaaattagccggacgtggtggcccacgcctgtaatcccagctactcgggaagctgaagcaggagaattgcttgaacccggcaggtagagtttgcagtgagctaagatcacgccactgcactccagcctgggtggcagagtaacactccatctcaaaaaataataaaataaaataaaaataaatatcatactttcatttttgataagtttatttcaaagtgttaatacatttgtagacatgtataaactttttaaggtattataaggtttatattaatctgacacgaatcagactatacatacataacacacctgtaaactgtttatattttgagcccatttcattttttgcttccaaagaggctggttgacctaaaacacactgcagtttttcctgaaaaatctgtgctggagtcatacggagtggtagattcagactctttttcttggacctgaaatgacatcaaattaagggaaatgaatccaaattttgaaaaaaaaggaaaggtttcacatatcaaggactaaacatgaaagtttaagaaacaatggaatttacttttttatctatcgtacatgtaaaaaagatatattcaaggaaatattgtattaagaccctccacgattatgatcctaatatactccccccattcttatttctaattgctaccctaaacacgggctttactaacacataagtgtgctaaataaatggtttttgtttgttttgagacagggtctcactctgttgcccaggctgacgtgtaatgacatgatcacggctcactgcagccttgacctcccgcgctcaagtgatcttcccacctcagcctcccaagtagttgggaccacaggcacgatcatcgcccctggctattaataaatgttttaacacaaataagtaagccactgagctgttcaatacagtaaccactaactatatgtggctattttaatttaaattaactaaagttaaattgaaaatttaattccttggtctcactggctgcatttcaatagttacttgtggtgagtggctaccatactggacaacacatttctatcactaaagaacgttccattgaacaatgctgaactaaggattccacataaaatgtaaataccagcaataagagaaatataaaatacatagttcaatcatactatatcttaaaattgcctaaaaatccatacctcatgaaattgctatcacgtttacagaacagctggaaagccacaccaattgaaacagacgtcttccagtctccaagtttatatgccaaccacacagcctctggaaccaggccaccaataaatagtaattcaagtgcatattcaactgtccacacattagagagattctgatctctaacaacactggccaccttagagtgttgcagaggaataagtcgaaaggactgctctgtgagtaaatttttaaaaatggattattacaatcacatccaaactcatgcttctttacatgggcatatttatctcttcaatcagtattatctacaaaaaaccaccaggaagatacatacaaaatgggctaaagtaatactcaacatgccctagaacacttttaacactgaagaatgtgcctcattcgtgggtcatgaaacaaatgccagcattattttaaaaatgaaacaaaagagaaaaaaaacaaaacagaatagaaagtatcagacacaaaataaaggtaaatactgtttaatgaaacttttgtgtcaggtaatatgtaaacacatacaaaaaacatttatatctactatactactggttcacaaagtacaatttattaccgtgacatgggtcacaatgtgcaatttattactgtgggatgctcagaaatacatgtttatttctcatactagattatgaaatgtagaaggcagagactacattttatctgactttgtgttacccacagtgttatgcaataaaagactaagttgaggtaacaatgaagcatattaagtgtcaatattagtgttgattacaaagcagaaaagtgtgatgttcagtaattctgactaaataataagattgccatctggcctgtgatttaatacaaaaggataatatcgttccccctggccttctgtccctttccctaattgaagtaacttgataaagcaacttaaaaataggataaaagaaatgttattaaaaaatacatgttgatgggatttttactcattctctcaaaataaaagtcataaacagcattcatgagcttctctgttcctcgaaatggtgagtttctcacatgacctatacaggctatgcctactgcaagaactaacattttagctctctgacaaacacatcaggaaaaacaaaaagttttcaaccacttggatgtctgattttgcataagcaaaggagccaggagactggctaaatttttcctatttttattcactacgagcaaggtaatataccattaaaataacttgaataattaaattttctgaaaattttactactttcacacagtaaaaaagttcacgaccttttaaaatatcacaccaaataagcaactcaaatccctagaaacattctgattagaaaaattaacatgaaatgtatatgcatcctgaaacattcacagaacataggagtttgaacacatagttcaaaatccatggttctacgactgattatatttgctgaccacttgttgccatctttattaaatttctgatagtattttaacttgtactactctaacttaggtgtgccttgtacatacatatgtatctgttcatgtctactcttgcttaaagccctccaacagcttcccatgatacttaaaattcagatttcttaacatggcttacatcatctggcccctttactgaatgcaactcatatcactctccacttccttctctagtttttttttgtttgctttggtttttttgttgttgttgtttttgttttgttttgttttgttttgtttgagacagtcttgctctgtcatccaagctggagtgtaatcacgtgatctcactgcaacctctgtcatctgggctcaagcaatcctcctgcctcagcctcccaagtgactgggaatctcaggtacatgtcaccatggcgggctaatttttgtattttttgtagagacagggtttcataatgttgcccaggctgatctcaaactcctgaactcaagcaatcggcctggcttcccaaagtgctgggattacaggcataggccaacatgcccagccctcctcctctagtttacagccacacagatctttccgtttctcaaacacatcaaacttgttcttgccctggggcttttacacaaactcaggttagaatgccctgtgccttgatgtatccaactcttttttgttattaagagttcggcttagaggccgggagcggtggctcacgcctgtaatcccagcactttgggaggccgaggtgagcggatcaggaggtcaggagatcgagaccatcctggctaacacggtgaaaccccgtctccactaaaaatacaaaaaattagcccagcgaggtggtgggcgcctgtagtcccagctactcaggaggctgaggcaggagaatggcacgagcccaggaggcggagcttgcagtgagccgagactgcgccactgcactccagcctgggcgatagagcaagactctgtctccccccccccccaaaaaaaaaaaagagttcagcttaactttcacctcctcagagagctactcctgaaattccaatctcaaattgccactcagtcacgctgtattgctctattttaattctctccataacagttataaccatttgatatatcttgtttatatatttaaatttctgtctcaacatattagacgtaaaccccgtaaaagaacaagtactttatcactttgttcattgcagttaggataaatctgtttcacagatgaaaaaaaaaaagaaaagaaaaaaagaaaacatgcgcatgcgccgtagctctccagaacgggaaggctgtactgagccggtctcgggagacgaaggatgggatgtgaggcggtcctgccttgccgccttctgtccctagtctccgggtccccgccctccagccgcctttgattcgtgactgggtcacggtcctcactcattcctcagaaccgcgaagaaaggaagctagcgtgtttgttagaaaacctagttgggagtgcaaggcagagagcgttcagcacccttgttcctcccgacccctcaggacagaagcagggctctggagggcagggattccccctcgtcttggccctacagccccagctgggcactaaactcgggccacggcggggcgagcgaggcgggctccggaggaagctgacggctgatgatggctcagtccaacatgctccccgtggctgatgtgttgagtcaaaatgaactgcgcaaaaagctataccagacatttaaggatcggggtatactggaaacactcaagatacaacttcgaaaccagctaattcatgagttaatgcaccctgtattgagtggagaactgcaacctcagtccatttcagtgcaagggagctccctcttaataagtgcctctaactctttagtggcagatcacttacaaagatgtggctgtgaatattcactttctgttttctttctagaaagtggtttggcaaaagaaaaggtatttactatgcaggatctattacaactcattaaaatcaaccctacttccagtctgtacaaatcactggtttcaggagctgataaagaaaaccaaaaaggttttcttatgcattttttaaaaggattggcagaatatcatcaagctaaagaaagttgtaatatggaaactcagacaagttcgacatttagcagagattctctggctgagaagcttcagcttattgatgatcagtttgcagatgcttaccctcagcgtatcaagtttgagtctttagaaataaagctaaatgaatataagagagaaatagaagagcaacttcgggaagaaatatgtcaaaagttgaagttttttaaagataccgaaataggaaaaattaaaatggaagcaaaaaaaaagtatgagaaggaattagccgtgttccagaatgattttgagaaagcttgtcaagcaaaatctgaagcccttgttattcgggaaaagagcacccttgagagaattcaaaagcaccaagagattgaaacaaaagagatttatgctcaaaggcaacttttactaaaagatatggatttgctaagaggaagagaagcagagctgaagcaaagagttgaagcttttgaactgaaccagaagctccaggaagaaaaacataaaagtatgactgaggcacttaggagacgggagcagaatataaagagttttgagaagacctatgaccaaaaactcaagaatgaactcctaaagtatcaacttgaactaaaggacgactacatcattagaactaatcgactgattgaagatgaaaggaagaataaagaaaaagctgttcatttgcaagaggagctcatagcttttaattcaaaaaaggaggaactcaatcaatctataaatcgcatgaaagaacttgagcttgaattagagtctgtcaaagcccagtctttggcaataacaaaacaaaaccatatgctgaatgaaaaggttaaagtgatgagtgactattcactactaaaagaagagagactggagcttctggcacaaaataaattacttaaacaacaactggaagagagtagaaatgaaaacttgcgtctcctaaaccgcctagctcagctggctcctgaacttgcggtctttcagaaagaactaaggagagcagaaaaggctacagtggttgagcatgaggagttcgaaagccgcaaacaagctctgcacaaacaactgcaagatgaaattgagcatactacacagttgaaggcccagatactaggttacaaagtttccataaagaggttaactattcaggttgccgatttaaaatcgcaattgaagcaaactcagacagccctagagaatgaagtgtactgcaatccaaagcagtctgtgatccatcattctgccaatggattaataaatggcaacatggtgcttcacaatggtgagataagtggggatttcttgaacaatccttttaaacaggaaaaagttctagcaggtacggttgcatcaaggatcacaaattatccaaatgcagggatggagggtagttcccctgattctgaccttgagtttgtcgccaatactaatgcaagggtcaaacagcttcagcaagaggcggaacgcttggaaaaggctttcagaagttaccatcggagagacattaaaaactctgccaaaggcccactaccagcaaagagcccaccatctctgcacttgctggaagccttcaaaaacattacttccagttccccggaaagacgtatttttgcagaggacagagttgtctctgagcagcctcaagtgggcacacttaaagaagaaaggaatgacatcttggaagccctgacaggcagtgcagcctcaaggctatgcgggggcacttcctccagacgcctctcctccacaccccttccaaaagcaaaaagaagccttgaaagtgaaatatatctggaaggtctgggcagatcacacattgcttcccccagtccttatcctgacagaatgcccccgccatcacccgctgagtctaggcacaacctctccatccctcccttctccagccctccggagcagaaagcgggtctttactggagacaaaatgaacttcaagacaaaagtgaattttcagatgcggacaagctagcttttaaggataacgaggaatttgaatcatcttttgaatatgcacggaatgtgccaaggcagtttgaaatggatgggccctctcctgccggggatatgcttcatatgggcgcagctgtagctgctgtgcccctctcatatcagcacccaagtgtagatcagaaacaaattgaagaacaaaaggaagaagaaaaaatatgggaacagcaagtgaaagaacgaaagcagagagaagaaagaaggcagagtaacctacaagaaattttagaaagggaaagaagagaactagaaaaactgtatcaggaaaggaggatgactgaagaatcactgaagattgaaatggaaaatgaattagaaatgagtaatcaagaaatgaaagacaaatctgctcacagtgaaaatcctttagagaaatacatgaaaatcatccagcaagaccaggagtcggcagataagagctcaaaaaagatggtccaggaaggctccctagtggacacactgcaatgtagtgacaaagtcgaaagtttaacacgcttttctcatgaagaaccagatgactcttggtaaccatgtttgctgcccagcttctaacttacataccatgagaaattacataacatttactcctttgtaaatgtttctctatcaacagataaaactctgaataaaaatgtgtaatccaaaaaaaaaaaaaagaaagaaactacaaatgttttcgtattatcaatttcatgtggtgcaagctagtatatgtgcagcactaagaatactgtgtggcaaatagtaggcacttaataaaaattagaatgaatgaatatcatagaaatttgtgtacctgtttatactgagagcagggcagttatctagcacaggattagatgcattttgaccatactaatgaaagtattaaatttaaaaagtaaatggtccaaataaaataataaaagtaaatcatccaaataacattaaatactgaattagcaggctcaatatttattaaatctctacattttgacataaatgaaggtggcagctctttcactttaaaaattgaaacttcagctgggcacacctatagtccctgctacttgggaggctgaggtggttaagatcatttggccgggcacgtggcgcacgcctataatcccagcagggaggccaaggcaggtggatcacctgaggtcaggagttcgagaccagcctgactaacgtggtgaaaccctgtctctactaaatacaaaaaattagccaggtgtggtggcatatgccgataatcccagctacttgggaggttgaggcaggaaaattgcttgaacccaggaggtggaggttgcagttagccaagatcacaccattgcactccaccctgggcaacaagagcgaaactcagtctcaaaaaaaagaaaagattgtttgaggccaggagttcaaaaacagtctgagcaatatagcaaaattccatctctaaaaagaaataattaataaattaaaatttaaaactaaaaactttataaagatcaacttgtcccaattttgtgattttaaaaagccatgttcagtaaaaacgaatctaagccattacttttctcagattctattcattcatagtcataaatcacctcctatgtttcagatactatgctagaacagtatcattgagtaatggcctctgtataatatgttttaaatattatattatgtgcaatgcaaaaaaagtttaaaaaggatttgtttactacattacctgttttaatatgaagtgggggaagaacattcacatgatgagggggcaaaatgcaaagctgctgattggtgaaataggcagccatgaaacgagccatggactggacgactctcactgctgcctcaggatgaacaccgcccaccattccacactcaaaatgagactttgcagcacctaaggaatacagcaatgacctaagaagattgtgatcaactaccaaaagtaataatatttaagttcccaacattatacaaaaagaaaattgcaatacctttttttctgagataagcacccatggccaatacaagctgaattataataggtaccgtacttcttaaagacaataaaaccagaaacaattacaattgacccttgaacttcacgggtttgaactgcataaatccacttatatatacagattttttttccataaatgtactagaaaatgttttggagatttgtgacaatttgaaaaaatttgtaggcataccacataacctagaaatatcaataaaaaaagaaaaaggtatgtcatcaatataaaaaatatatgtaaataattattttatcatttagtaccataaaatacatataaactataaaaagttaaaatttatcaaaattggctgggtacagtggcttacacctataatcccagcactttggaaggccaaggtgggctgatctcttgagctcaggagtttgagaccagcctgggcaacatggtgaaatcccacctctacagaaaaatacaataaaaagaaacattagctgggcatggttgtgcgcacctatagtcccagctattcagggtgctgaggtaggaggatcgcttgagtctaggaggcggaggctgcagtaagctgagattgtgccagtgcactccagcctgggcaacagagctagatagaccctgactcaaaaaaaaattatcaaaatttacacaaacacttacaggccatatatggcactgttcacagtcaagagaaatgtaaacacacataaagataaagtattaaataactgcataaaattcattgtagttcctactgtactactgtattaattttgcagctacttcctgttgctattttgaggagttcaagtgttgcaagtatttgcttaaaatactgtgtgatgctaatcatctctgcatgagcagttcatctctctagtaaagtgcacatggcaataaaaagcaacctcacaattcttgtgtagttctcatcacgtttagtgcagtaccataaaccttgaataacaccataagacctacaggaagtgccaccagagatcctggaagtgttctgaataagcagaaaaaaatcatgacattacaagtaaaagttgaattacttgagacataccatggattgaggtctgcagctatggttgtctaccatttcagacaattaatcttggaaacagataacataaacttgtggtatcaataaatacagtacaatactggaaatgtattttcccttatgatttttttttctctttttgagacagagtttcacttttattgcccaggctggagtgcaatggtgcgatctcagctcaccacaaacctcgccttctgggttcaagtgattctcctgcctcagcctcctgagtagctgggattataggcacgtgccaccacgcccggctaattttgtatttttagtagagaccagttttctccatgttggtcagactggtctcgaactcttgacctcaggtgatctgcccgcctcggcctcccaaagtgctgggattacagacatgagccactgtacctggcctcttaggattttcttaatacaactttcctttctctggcttactttattctaagaatacagtatataatatatacaacatataaaatatatgttaatcaactatttatgttaccagtaaggcttctagtcaacagtaggctattaatggttaagtttttcgggagtcaagttatacacgaatttttgacagcatgagggtgttggtgctcctaacccctgtgatgttcaatggtcaactgtagttagtaattatgtgcacatacacctaagaactgttcacaactttaagttttattttttaaatggaggtatctatacaaaatgacccaggcacgacagccttgcaagcttagaatttcattatttatttcccgtttttccttctctttccttttttttttttttttttttttttgaagataaacggggcagggcttactacaaaaataatctaaaaagcactgatataagatttttttctttttttcttttttgttttttgagaaagaatcctgctctgtcacccaagctagagtgcagtggcacattctcagctcactgcaacctctgcctccaaggtttaggccatcttcccgcctcagtctcctgagtagctgggactataggcacacgccaccttgaccggctaattttttttgtatttttttggtcaagatggggtttcgccatgttggacaggctggtcttgaactcctgagctcaagtaatcggtccgcctcagcctcccaaaatgctgggattacaggtgtgagccaccatgaccacccaagattcttaatgcttttgtctgtaccattagatctgagaatcttaatatactcccattagtaatagtagctcactagtataagattttggggggcaggcagtagcaaaaagaacgtgtggggtgggccaggcacagaggctcatgcctgtaatccccacactttgggaggcccaggatggaggatcacttgagtccgtccaggagtttgataccagcctgggcaacatggagaaaccccatcactgcaaaaaaatacaaaaattagccaggtgtggtggcatgtgcctatagtcccagctactcaggaggctgaggcaggaggatcacttgagcctgggaggttgaagctgcagtgagctgtgatcacgccactgcactccagcctaggtgacagagtgaggccctatctcaaacacacgcacacaaatgtgtggagtgaagggagatggctagatagcaggtggacagaagaatcacatcaaaatttctggcataactccaaagtgcactagcaggattagaggacatgcgtcattcccacttgagaatctcaataataatataagctggcattcacaaatttgaaaataaattagcttaaaactactaaatactgtatagataaatactaggataacattagttggtatgaagtgtatggctccaacaatagaaaggtatctttcttttccagaagtgatctgacacatattcatgggaaattacattttatatgtgtatggatttctatcttgttcactgtatgtcccagcacctagcacttctcctctcatatagtaggccctcaaaggaatattgttaataaagaaaataatgttaattaatgttacctggtttctttttttaaacaaaaggaattgagaaaattttattagccttcaagcagtagtcttcatttagtcactgtaatatttggggggaaaaaccacactatttcttcacattcgagttagagatacctgggtaaaaatttttttctcctgggtaaaacttatggaggaattatacaaaggtaagattttcagtaatcttaatcattcaaaccttatgcaaaactcaggaatcagcctcttaaatagggagtgacctgatgataaaagttattgtcacagaataaagctgtatcaatttagaagttaaaaaaattttcaaagtgtaaatctcgaccgggtgcagtggctcatgcctgtaatcccagcactttgggaggccaaggcaggtggatcacctgaggtcaggagttagagaccagcctggccaatatggtgaaaccccgtctctactaaaaatacaaaaaattagctgggcatggtggtgcacgcttgtaatcccagctactagtgaggctgaggcaggagaatcactttaacccaggaggccgaagttgcagtgagccgagactgcgccattgcactccagcctgggcgacagagcgagacaccatctcaaataaataaataaataaataaataaataaataaaaataaagtgtaattctgtatagggtgcagtgctaatgttaataacagaaacccggctgggcgaagtggctcatgcctgtaatcctagcactttgggaggccgaggggggaggatcacctgaggtcaggagttcgataccagcctggccaacatggtgaaactctgtctctactaaaaatagaaaaaaaattagccaggtgtggtggcaggagcctgtaatcccagctactcaggaggctgaggcaggagaattgcttgaacccgggaggcagaggttgcaatgagccgagatcgtgcctctgcattccagcctggtgacaagagcgagactccatctcaaaaaaataaaaataaaaataaaaataatagaaaccctatttaataaaaattaaataactatagacaattatttaataaggtaggtgtgcagaaaggaactaccatagcatgcatgactgcttgaaatgcttgcttgtaaggtggtccttggctggtatctgggaacttggattttgggaggatttccaccaccctaactgataagaagagctcactgaacctaaactgtataaacaatgtggtttacgctgaacatctgttttccctctgagagtgtagaattttggtttgtactaaggcagaaggggtttatgtgaccagccccccaattaaaaaccctgagcactgaggttctaatgaacttccctggtagactatatctcacatgttgtcacaacttgtcactgaggaaactagggacatcctgtgtgactctactgggagaggattcatagaagcttattcctggttttctccaaacttcataccatgcaccttttccctttgctgattttgctgttttctttcactgtaataaatcatagctatgagtacaactatatgttaaatcttctgagttttcctagtgaaccatcaaatctagggggtaattttggggtccccaacccagtaagtatatgcttaatatattttaagcaatcatcattaaaaattaagacaaatgagctgggcgcggtggctcacgcttgtaatcccagcactttgagaggctgaggtgagtggatcacctgaggtcgggagttcaagaacagcctggccaatgtggtgaaaccccgtctctactaaaaatacaaaaattagctaggcatggtggcaggcgcctgtaatcccagctactcgggaggctgaggcaggaaaactgcttgaaactgggaggcgaaggttgcagtgagctgagatagtgccattgcacactagcctgtgccacaagagcgaaactccatctcaaaaaaaaaaaaaaattaaaacaaatgaattactacaggttcaacttatcatgaaagttaaatcacgtaaggacaatattgcaaaaataaacaaataaataaagactatcctgtcatttaaaaagtcatatacagaagtctttcaccctgggtacagtggctcacacctataaccccagcattttgagaggctgaggtgtgaagatcacttgaacccaggagtttgagatcagcctgcgcaatataccaagactcatctctacaaataataaaataatttttaaaaattagccacgcatggctgggcacagtggctcacgcctgtaatcccagcactttgagaggccaaggtgtgtggatcacgaggtcaggagtttgagaccagcctgaccaacatggtgaaaccccatctctactaaaaatacaaaagtcagccaggcatggtggcgcatgcctgtaatcccagctactcaggaggctgaggcaggagaatcgcttgaacccaggaggcaaaggttgcagtaagccaagatcacgccactacactccagcctgggtgacagagcaagactccatctcaaaaaaaaagaaaaaaaaaattagccaggcgtgaggcacatgcctgtggttccagctacctcatttcccagcagactcatttctcggaatttatcttagagaaattattagtaatgctcacaaatatttaggtacactgcagcattatttaaaatagtaaatacatggcaacaaaatgtacaataatgggaaaaagattcaatagatttttttaagtttattggcactggaaaatattcatcataattttaaatttataagactatccagctccggtaatatatacatatacatgtgtcaaaaggccctagacaaaaaaaaactaaacttgtaagtgattttgtttcctttctacttttctgtattttcaaaattgcctaatatgaacacgtattacttccttaatgaacataaaaatttaaaaagataaaaatcagaaagtaagccaagcacagtggctcacacctataatcccaacactttgggaggccaaggtgggtggattgcttgagcccaggaagtcaagatcagcctgggcagcatggtgaaatcccatctctacaaaaaaaacaaaattagctgggtgtggtggcacacacctgtagtcccagctactcacgaggctgaggtggaaggatggcttgagcccaggcgccagaggtcagataagctaagatcactcaaccacactccagcctcggcaacagaataagaccatatctcaaaaaaaaaaaaaactcacaaaataagacatttataaacagtggctgaaacaatcaagaatgaaattgctatcaactctgtttagaaatttcaaatacattgggcctttcagacacattcgtatatacagtaaacatctagcagtctaccaccctataagcattataaatatattacatgttcattcatatatatctttccctctggttattgcctaatttaaatatacctctttgaaaaagtcaatccagatactctgcaatctcttaaacagatttttttttttttaatttgagatggagtctggctctgtcacccaggctagagtgcagtggcgctaccttggctcgctcactgcaagctccacctcccaggttcatgccattctcctgcctcagagctgggcctacaggtgcccgccaccaagcctggctgatttttttgtatttttagtagagaaggggtttcaccatgttagccaggatcgtctcatctcctgaccttgtgatccacctgccttggcctcccagagtgctgggattacaggcgtgagccactgtgcccggcccagattttttaaaagactaaaaatattctcggaaaatgatttttatgatttcactaaactgctgtaagcaatagttaacatactaaggaaaaaacacttgggtcctaaaattatgtctaacaaatagggttgtaagaaagcaatcatactatcagctcagcaggcaattactatactgttaaatcctggggattctaagatttaaaaacaaacaaacaaaaaacttcaacatagtccctgctattgggaagctgagagtccaaaatccaacataatatacttaatcaccagagaggtagaacaaccaacttttatgtataagcaatttcatgtctacactaaaaatacaaactaacaagtaaacatactgcattctgtagtcctagccacttgaggcggctgaggtagaaggattacttgagctcaggggtttgaagccaggctggcaacatagggagaccctgtctctttttaaaaatacaaagaaagaaaaaaaaaagcatacctgaaaaatctttattttcttttacaggtagttgggaccatctcaggatttctcttgctagctgatcacacaatccttgagcatcatttaaattatagctatagaggtggcagtataagagagaaagataatagcgtatctgaagaaaatacgtccttcttcctcctgaaacaagaagtaagctcaccttaaaagtatgtaagcaaaggaatgcccttggtgtagtgctcaattgacgggagtgtgtagtttgtgaaaattcatcaagttgtacactcatgatatgtaaacttttctgcatctgtttcacacttcaataaatgatttttttcacaggtgatctgggtacattacatccccaaataaaattggaattattttactcagaaagaatggataagaggtaggcaaccagcagtttcagtcttcagatatgtaaaggcagttgtcaggggctcctatcttatatttttttagcatactttgctctttttcattttaaattctaaacaatttattttctttcatcacaccctaggatgacttagattttatccaaagaaagctgcaaattcttatcatcttaacattaaggtctactaataacttttatctcaagtatacacagtatgaaacaaaagggaacatgccacaaaaaactccaaggaaccatatgtatatcaaagggatggccaaagagacttactgaagcagaagaaacagttatccaataagataggagcccctgacaactgcctttacgtatctgaagaatgaaactgctggttgcctacctcttatccattctttctgagtaaaataataccaatcttatttggggatataatgcacccagatcacaatttctccctagatgtggccatgtaaaaatgtgactatgttctgattcaagagataacattgtatgcaatttccagaaaagctgcttaaagaaaggtaaatcagctaggaaatgcaacctttctagctcttccaacctttgtcctatttgctgcctagagcatggatgtgatagctgaaggtccaggaaccatcttagcttaggtaatggccttaagattggaagcaatgcactaaagatgatgcagcagaaaaactaaaggagcctggggccttggtgataccatggaaacaccaaatcagccccaaactgcaacttctgccctcctttcacaaaggaaagccactctttctctgttgaagccactgctactttcaatctccattactagaagccattcctaatggatgtagttgtaaatgaaattaaacaaaatgtccataatggaactcattacaaaaacttttctatacccagaacttcagatctcagtgaatgctgctcttttcatccagatggacaatccccaagtcagagaactacactagccttctttctccaaatctactcaatcacaagtagactgatcaagcctattaaataactgtcaaatgtaacctctgttctccattacccttgacattgctttggtttcaaggcttctcgtctgactgattttcttgcctccaagtaaaacccacgcccctatgtcatagtcctgcaactggccttccacaactgtaccaaagtgatctttctaaacagcctattcttatttgtacaagtccctttcctacctaaagtgtcttaactgattccactgtcttcaagataaaatcttaattccttaccactccattaaagaccctccttcatcatctgttgtccatctgcctctcaacttagctcttatgatcctaccgccaatatcacatatacatatatcacataatctagtcctactaaactacttgaagtttaccaaattgccatggtttctcaggcctttttggttttggaacactatatactctgttaagtcattcccatgaccttaattggccaatctctactcaattttaaatgtcaactccaagaggctttccccagactgatgcttgcactccagcctgattgtattgaggtgttcttctgtgctccctaaacatctaccataaaacataatgagaaaagtgactgtaggcaacttgaaggtaaagttgtttatttcagttatccctagtgcctaatacagtgctgggcacatagcaggcactcaacaaagactggttaagtaaatgaattaatgaaatatacaaagccacagcagtcagaaaataaatgtaataatagaccaaatctgaccacgtaggagttgcagtcagggttccagggtcaccagctgagaacctctgtcatctcagccataccctcagctctgtatcataaaagctataacttgtttctaacatccacaccccatatccttatcaaaaactcctcgaagcccatacttaatgcaatgatacgtttaacttacatacaattcttaaagttaaattacttaaaggcaaaaagccctcgctccatgtttctctaagtctgtaagaaggtggtgaaatatatgacctatagtttcctattgagatacttgcagtctctctaaatgacaaaaaaaaaaccacattattttatttaggatctaaatctcatttttcccatcaacaatcaaccacaggctttatcacaaatcaaagaaaggacagaaggagacttatctacagatcactgaaaagatttttagtgttaccaattccaaggttaagaataattttaaataagtattcatgagtgtcaagttgcctacaacatgtattctatttggcattaggatatcataagcactctgaaatttagaattatttttaaggtctatggcaagctaaaagatgtcctgctaatataatggcacatattttttggaatttagaattactgttaaggtctacagcaagctaaaaggagtcctgctaatattatggcacatattttttaacactctcttacctttctcttcgatttcttgtagagcttttttccacagctgaacagacttttcatatgatcctaataaaaaacattcttcccctagaaagtttttaaccaacaattagtcatagttaattatattacttcataaaaatttactttgttttaaaatccagttaatggagctcagccagaaattattttgaaaaacaaatcattacaaccaattagaaattcaaagtctggttaactatgtcatttattcatggagttagaaaatattcataagatactgaccattgatagatttaagttctaaggtttgattcaagcaatctccagtactctgtaggttagcctgcaaatgacataacagggacttgacagtagatgcttcatgtgtcatcttttcagttaactgactatcagcttcaggaactcttcgatttaattgtgcttgataccataaagtttttttgtacagtattctccagagaataagcaatctgcacataaaatcaggtaattatcaaaagcaaatttcaggctaatgatgagtttagcctcctttttagcctatttttttttttgcctgtattcttcatcggtataacatacatacaaactgatcacatttaaatatagtgcaaaataaaatgattaaaaaatgccttatataaaatcttcataaatattttaagcacctgtaatcttttttttttttttttttttaagacacaaggtctcactacgttgcccagactgatctcaaactcctgggcccaagcgatcaccctacctcagcctcccgaacaggtgagattacaggtatgtgccactgcactccagcctgggagacagggtcttgctctgttgccaggctgaattgcagtggctccatcacagcttactgtagcctcaacctcctgggttcaagcaatcctcccatctcagcctcccgggctcaagcaatcctcccatctcagcctcccaggtagctgggaccacaggtgcaccacactgttttttttttcttttcaggcaaggtctcctcctgtcgcccatgctggaatgcagtggcgtgatatctgctcaacctctgcctcctggactcaagcaatcctcccacctcagcctcctgggtcgctgggattacaggcacatgccaataggcctggctaattttttagttgcggagtttcatcgtgttgcccaagctagtcctggggtcaagtgatccacccacctcagcctcccaaagtgctcgatcacaggcgtgagccactgcgcccagcctaattttttaaagaggtcatttttttaagaggtcattttggccgggcgtggtggctcacgcctataatcccaacactttgggaggctgaagcgggcggatcacctgaggtcaggagttctagatcagcctggccaacatggtgaaaccccgtctctactaaaaatacaaaaattagccaagcgtggtggcaggcgcctgtaatcccagctactcggggggctgaggcaggagaatctacttgaacccaggaggcggaggttgcagtgagccgagattgcatcatcgcactccagcctgggggacaagagtgtactccatctcaaaaaaaaaaaaaaaaaaaaaaagaggtcattttttaacagtacttaactaaaccaaaatctttcaagatcatggttttccgagactaagaaaatatgtattgtacaacatttggcataaatctaacaattttttttggcaaactaaaagtgtatacatttatcacgtataacatgacatatttaacatgatgttttgaaacgtacttaaatattttaaaaaataaaatctataatgctgagtgctaacagataaaagatttctttctggggtgataaaaacgttctggaattagtgctaatagtttcacaaccttataaatatactaacaaacactgaatagtacattttaaaatgatgaattttacaatatgggaattgtagctcagtttctaaaaaagtaaaaaaaactaagctaatagtatcccagtattaaaataagtgattatacctgtgtcctggctgttgcacaggatttactacttgaggatgaatcttgaaaaatgagttccaagaccagtttttctgaaaaccactatcttgaaacatctgaaaaataggtaccaccaatgagtcttgagctgttattttacttccatcagctgatgctgaaataacttcaggttgaagaatgtatacaccatttaaattgtcagctaccattttgagtaaataaaaacaagctaaaagtttctctgagaataactgacccttttgttgctgagtcagcaaaagttttacagtatttgaggtcagctttatcaaatgccccacatcttgtttgtatcttatatcccaataatggattgataaacactgatgaaaaagttgaaagatacaaagtatccatgcattatgtcttgagcttttgcttaaaacaagatcaagtttaggaaaaggacattttataaattgaagaatgtaaaaaaaatgagtgatacaaactactatgtaatttaacattaaatttttttctgtcacagtttttgaaattcctatagtccacgctgcaagtagacttttctggatagaatgcagttctgtaatggttctatctgtctcctcactatcatcctttgcatgtatcgtatcaaacatagatgcaaattccaatcttccttccttcatactactacacagcacatcatctcttttgttccaaaaaggacataagttgtctggaaagtgtctgccttcgttagtttcttctgcttcaaaatcctaaaacatgaggggaaaaaaatgatacttaataccatttaataccttatcaatagcatcactttggcgttcttaaatttctcttccctttaacaagagaaaaacagaatatgtttcttggaataaagtcataattgttccaagtaaataaaattctgctgctaagtacctgaaaatctgctgcattttcatttattgtttcttctgcctgcaagaatttggggacagtgaaatcggctgaactttcatttccttggtgttctaacaggctagaccttagggaattcagtgatcgcaagttcagtcctttgccttttggctaaagaagaaaagatgaaagatttccaagagcaaaatgttatctgtaattctattataagcaattaaaaattctatagacaactgtatacaattcaaggacattattgtcagtaaagttttaaatttgaaaagaaaaaggcaactttccccaatgatataaaaaagcactataccttagacaatatcacactttgatatattttctcaagcctctgggttgaatcaagtagaagtgatctcatgtgtactgatggagataggctatcaagaaatcgaagggttgtgaccatatatccatcagatataacgaggtagggtaaccgtgagtgtgcttttatagaaaatctctgtctcatagggtcactatcagaagctgatgaatcaacagaattatttgaatcttgaaacgtaaactgctgtggtctagtaaacaaacatcaaaatacaagaatcagtaagagaaagatcttacggaaaacaataatgtttttcaaaaaagaagaaaaagttacagaacaatgaaaaagcaagcaagtgaaacacacaaaaatattaaatgtgtttatatctttcaggaaaacataacacaggataaagacaaaataatatataggttcatgtgttttaaaattttcctaaatggtagcatttattctattttgtatttatctacatacaacctatttcagaaaataattcaggcagtttatttttactattaaagagagttaaatagttaactttcctcttaccatatatttaaatatgcttacacaaataaaattatgaactatcagtatactttttattaaagaggagaaagaaaaaagttgagaagatttggagagaatggtggtgagtaaaattttacctatttaaatttgagtttccacttaacttaaacatacaatattgttattatgatgtacctgattctgattacttaatatcactccttattaaagttggggctttacaaatataaaaggaacaaaccatcaaagtatattgtaatttttttctggttaggcaactattcaaatacagattttttttattagccaaatggcaacaatagaaagttggtaattataggacatacaccccacagacttctgtagaaccattaaaaataatgcctaacatggaaagatgtaaaagatatactgtgaaatcaaaaatggaaaatagtaaacaggatatatcacattatctagtttttaaaaaagaaactaatattgctattatcattgttatatgaatatttttaaaatgtgggggacaacatactaaaatgttaataattgttacctttgaagtataggattacaagtatttagttttccacattatttaattttgtaacatttgatttttgagtgctaaaataaataatgaatactatactttcataatcagaaaaaaagcagtttggaaggccccaaatattaattttaaaggagaatatgagaaaattctaatgaattatgaattagaccataacaagtaaggaaaaaatactttcactgcaggaagtgacacgtttttccattagcattgccaattgctaaaaattgtcatttttgggaggctgaggcgggcggatcacgaggttaggagtttgagaccagcccgaccaatacggtgaaaccccatctctagtaaaaatacaaaaattatctgggcgtggtggcgcgcgcctgcaattccagctactcaggaggctgaggcagaatttcttgaacacgggaggtggtggttgcagtaagccgagatcacaccactacactccagccttggtaacagagtgagactcggtctcaaaaaaaaaaaaaaaaattaaattaaatgtcatttttgctaaatataatcgaggaggccgggcgcggtggctcaagcctgtaatcctagcactttgggaagccgaggcgggaggatcacaaggtcagtttgagaccatcctggccaacatggtgaaaccccgtctctaaaaaattagctgggcgtggtggcgggcgcctgtagtcccagctactcgggaggctgaggcaggagaatggcatgaacccaggaggcggagcttgcagtgagccgagatggcgccaccgcactccagcctgggggacagagcgagactctgtctcaaaataaataaataaataataaatataaatataatcaagtaaacaccctacctcagtttcctttctataaagcaaacggaatagattaatttcaaatgtcttttccaacttttctgtcttgtaaacagttatgcatatgtgtctagccacatataatcaacatcaataacaacaaatatttactgagcactaactttatgccagacagtgctgatttataattatgtattaccttacttcattctctaaaccctaagacacaattagcgtcacactgctttcatagtaaaagaaactgaggcttaaagaataactcttctgcaagatgggagatcaaaataaatttttaaaaataaaaaaattggtacaggctcatgcctgtacttctagcactttgggaggccaaggcgggtggatcacctgaggtcaggagttccagaccagcctgaccaacatggtgaaaccccgtctctactaaaaatacaaaattagccaggcatggtggcacatgcctataataccagctacttgggaggctgaggcaggagaatcgcttgaacccgggagagggggttgcagtgagccgagatcacaccactgcactccagcctgggcaacaagagcgaaactccgtctcaagaaaaaaaaaataaataaaactaagaatgaaaatttaaaaattgaaaaaaaaaaaaagaataactaacccaaagtcatacaactaataagtaaaagaaccggtatgtgaatcttgatctgactccaaagccaaattgctacttcatctcacaagtaaaaattataatatgacacatgctatccaagtaacaaaatatcacatgtatcccataaatatgtaaaatattgtatatcaataaaaaaaattttaaaacaacaacaaaaattaaaatacggctaaatcctacagttttctatccatttccaataactttttccctttgggaaaaaagtagataaatccatatgtcaagttaattttgagttattaattttctaagtgctattattttataacaataaatgctatatcatactttattaacttttatatcaaagaagataatttttcgtgctattaaatatttaaataacttatacttacatagtcacaatgtcaaattttcaccaggattaagccacaaaaagaaacagaagaaaactacaaataagaaacagatattgagatgacagactcaaagaaaaagtaagacaatttgaaagatgaaattttttttgaatacacagtaaaagtaatacaaaacagaaaaaaaatctataaacaaattaacacaattcaaatgtctcacctatacgttattagtggatgaagaggaataaattctgctgggccaaattctatagagcaaccaaatgtaattaatgttagcaattcaccttggcaggtcaataaaaccagagagccacgttttaacatacaagccagaaaaagactatcatgcgtccagctgatatcacctacccagtaggacctataataaataagagacaacatgtttagaagagatactttacaatgtctatgacgatttaaaatgggctgtaccaagcagaggtgtgaaagttcaaaaaatgagggcaaaagaatgactaatagtagacaattgccatacacatttcatgaattttacttcctagaacaaaggagtttgctcataaacatctatttcaacaatattccaattagaaattcataagcaattaaaaaacgaaaatattcggccaggcaccgtggctcaagcctgtaatcccagcactttgggaggccgaggcaggcggatcaactgaggtcaggagttcaagaccagcctggccaacaccgtctctacaaaaatacaaataagccaggcgtggtggcgggtgcccataatcccagctactggggaggctgaggcaggagaatggcttgaactggggaggcagaggttgcagtgagccgagatcataccactgcactccagtctgggacacagagaaaaaatatatatatattcctaaagaactgagttttttagtcactcacatattagaatgaattttaatcctagtagagtctacaatcaagatctactgatagatttcaaggccacatctgtcctctctgcaggctgttagagtccctctcaacagcagactctccctcttcccaaagctctaactggtactactccttaactatttcgtgattttttaatttattttatttttattttttaaaattttatattttaacccttattcccgtcttttcacaggtgttgatatctggtgatactaatgtttaatgagacaaacagtaggtcctcctcagaaaatgacagacactaaatcaaaaagaccactgaactgagactaatactttcaaagtattatgaataatatgaatgagaaatttaccaaagagaaaggaacttgtggaaagtaaaagaaaatgaagaggcagggctagataaacctaaaaactctgaaaatgcatagaacagcatggaaaagtattcagaaaaggaagttagaagctgtaagaggaaattctcctactctgtaattttgcatggatcctggtggtagctcatatgccatcccaaatcaacacttatgttactattgactcagatgtacaggatacatatgtagggacttgtttaaaaaactaggcttggccaggcacggtggcacaggcccataatcccaacactttgggaggccgaggcaggtggatcacgaggtcaggaattcaagaccagcctggccaagatgatgaaaccccgtctccactaaaaatacaaaaaaattagccaggcatggtggtgggcacctgtaatcccagctactcgggaggctgaggcagagaagtgcttgaacccgagaagcagaggttgcagtgagacgagatcgcactacttcactcccacctggacgacagagcaagactccatcttgggggaaaaaaaaaaaaaaaaaaagactaggctctctcggccaggtgcagtggctgacatctgtaatcacagtattttgggaggccaaggtgggagaattgcataaggtcaggagttcaagaccagccagggcaacatagcaagaccctggctctaccaaaaaaaaacaaaaaaacagtcgtggtggcgtgcacctgtaatcccagctacttgggaagttgaggcaggcagggggatagcttgagcctagaagtttgaggctgcagtgagctatgatcacgccattgcactccagcccaggtaacagaacaagaccttgttgcaaaaaaaaaaaaaaaaaaaaaaagaaagacactcagctcaagatagctgactagacacaggtagcatgtaactcctccatggagaggaaccatggactgtccacttactattaagtagtaagtaagactaagagtgggaaaaggctcctgaacacagggaaacagtaagagaaaaatccacagggcttcataccccaaaacaggctttcataacctctgagtgggagaaaccctcaacccactagggctttgggcctgacacatggagctgcctaaagaatgctcagagacattgctccagaaagggaaaacacatggaatcccacaggcatccaagcctagagcagcgtcagaaagcctagataccagggatctacagacttggctgctactgcactgcttcagggaggaagaggggagaccaggcactctcaggcactcctgggaggctccctatcaccctgctgtgggctgctgttgagactgagatgtgagcaggctgcacttctcacagcttcttgcctacactgcttgcctgggagggataccaccctctctggtcccaggcccaaggtaccattttgactgtttagagctgggctacgtcccacccttgggctgagtttgggttgaggtggctgcagtcaccacccaactcagggaacaggggagaccaagctctccgaagcacacttaggagaatacccaccaccctgccacagagcagctatgtcatgggggactagtccccccaaaccatcacaacttccagtaactccaacatggactacttgggtcccagtgggttgcttcaccactactactgccatcgcccacaccataccagatacccaggggcctgagaaaccactcacacacctagaccaccactccgactactagtttctaagcatgccacctggaagcccaagaatcagccttcaggacccatcaataccagggccagtataaggtggtctagggcctaaaaacaggcacactcaccccactgctgccactactagggcctgaagactggctcagttgttgtccaagtccctaacaaaacttcaccataaccccaactaataactacaccttaagccactgaggaaatcacaggtgccaccaaccctgtgtactactgaagaagtcatacaaagattacactactacaagtatgcaaaatcaaagccaaagtatcctactcaatcaacaacatacatacatcttcaggaaaaaaattctcctctataaaagcattttcaaaaaattaaaacaagcaacggctgtaccagatgcacagacatcaatggaatgccacagaaaacataagaaaagcaaggagatatgacaccaccaaaggaccacaaaaattgtccggtaatagatgccaatcaaaaataattcccccaaaatgccagagaaataattcaaaataccgattttgaagaagctcaatgagatgcaagaaaatctgaaaaccaatacaaagaaatcggaaaatcaatatgaatgagaaatttaccaaggagaaagattaaaaaaaaaaaaaagaaattctggaaataaaaaatgaattgaaggaaatataaaatacattcaaaagattaaataatagactacaccaagcaaaagaaagaatctcagtcagacaaaaataagaaaaaaaaaaaaagaatgaacaaagccttcaagaggtctgggagtacaaaaagtgagtgaacttataaattatcagtattcctgaagggtaagagagatcaaaaagtgccgaaaacctatttaaaagaataataaatgaaaacttcctaagtctagcaagagagttagacattcagatacaggaggcccagtgatccccatgcaaatacatagcaaaaaggactccaccagcggctattatattcagaatgtgttaaatcaaagggaaagaaagaattttaaaattagcaaaagaaaagagtccagtcacctataaaagaaactcatcaatttcctctaggttttgtagtttgtgagtgtattatttcataatagtcttaatagacgttgttctgtggtatcaactataatgtttagaactggaacaatacaaggatgcctacttttaccacacctattcaacataatgctagaagtcctagtcagagcaatcaggcaagataaaaaaataaataaaaggcatccaaattatcactcttcactgacaatataatcttatatctagaaaaccctaaagactccacaaaaactcttagatttgataaatgaatatagtaagatttcaggatactttatattaacaagatgaatatacagaaatcagtagaaaatacaccaataactatgtagccaaggagtgaatcaagaaggcaatcccattaacattagctactaaaaataaaagaaaatacctagcaatatatttaaccaagaaggtaaaagatctctatgaggagaacactgataaaagaaattataattataaaacgctgataagagaaattgtagatgacataaacaaatggaaaagcatctcatgcttatggattaaaaggccaatatcattaaaatgaacatactgcccaaataaatctacagattcaatgcaatctctatcaaattaccagcgccatttttcacataattagaaaaaacaatcctaaaactcgtatggaaccaaaaacaaaagaacaaagctggaggtatcatattatctaatttctttttttttttttttttttttttgcaatggagtctcgttctgtcacccaggctggagagcagtggtacaatttcgactcactgcaacctctgcctcccaggttcaagcgattctcctgcctcagcctcctgagtagctgggattacaggggcacaccatcacaccagctaatttttgtatttttactagagacagggtttcaccatgttggtcaggctggtctcgaactcctgacctcgtgatccgcccaccttggcctcccaaagtgctgggattacaggcatgagccactgtgcccagcactttttttttttttttttggacagagtttcactcttgttgcccaggctggagtgcaacggtgcaatctcggctcaccacaacctccaccgccagggttcaagtgattctcttgcctcagcctcttcagtagctgggattacaggcatgcaccaccacacctggctaattttacaaaatccaatttagtagagacagggtttctccatgttggtcagtatggtctccaactcccgaactcaggtgatccacccaccttggcctcccaaagtgcgttagccaccatgcccagcctactaatttcaaattatactacaaggctatagcagccaaaacagcatggtactggtataaaaacagcacacagataaatgtaacagaatacagaacccagaaataaagccacatagctacaaccaactgatcttcagcaaagtcgataaaaatatacactggggaaaggacaccctattcaataaaaatagtgctgggaaaattggatagatgtgcagaagaatgaaactggacccatacctctcatcatatacaaaaattaactcaagatggattaaagacctaaacataaggcctgaaactaaaaaaatcctagaagaaaacctaggaaaaactcttctggacattgggctaggcaaagaatttatgaccacatcctcaaaagcaaacacaacaaaaacagacaaatgagaattaattaacttaaaaagcttctgcacagcaaaagacacaattgaagtaaaaaggcaacctacaaaatgggagaaaatatttgcacactatgtgtctgacaaagggctaatatctaggatctatgagaaactaagacaactcaacaagcaaaaaaaaaaaaaacctcattaaaaactgggcaaaggacatgaacagacatttctcaaaagacatacaatcagccaataaacatatgaaaaaatgctcaacatcactaatcatcagagaaatgcaaattaaaaccacaacgagataacataccagtcagaatggctattactaaaaagtcaaaaaacaacatgttggcaagtatgcagaggaaagggaacatgggaacatgtttctcatgggaacgtgagaaaagggaacaaacatgattggtgggaacgcaaattagtacaatcattatggtatagagatttctcaaagaaccaaaataggaactaccattcaatctagtaatcccactattgggtatatacccaaagggaaagaaatcattatatcaaaaagatacttgcactcacacgtttatcacatcactattcacaatagcaaagatagagaatcaacagaaccatctatcaacaaaggattggataaagaaaatgtggtgtgtgtatatatatgtatcatggaatgctactctgccataaaacaaatgaagtcatgtcttttgcagtaacatggatggaactggaggtcattatcctaggtaaaatcactcagaaacagaaagtcaaatactacatattctaacttataagtagggactaaacaatgggtacacatggacatacagagtggaataataggcattggagactactaaaagacgggaggggagtgagggttgaaaaattatctgttgggtacaatgttcactattaatactaaaagcccacacttcaccactacacaacatatgcatgtaagaaatatgcacctatggccaggcacggtggcttacgcctgtaatccgagcactttgggaggccaaggcgagtggatcacgaggtcaggagattgagaccatcctggctaacacggtgaaaccccatctctactaaaaaaaatacaaaaaaattatccgggcatggtgacgggcgcctttaatcccagctacgcgggaggctgaggcaggagaatggcgtgagcccgggaggcagagcttgcagttagccgagatcacaccactgcactccagcctgggtgacagagtgagactccatctcaaaaaaaaaaaagtatttaaggccttccttatataaagtgacttttaggctgggcatgatggctcaggcctgtaatcccagcactttaggaggccaagatgggaggatcacttaaggccagaagttcaagaccagcatggtcaatatagcaagaccctgtctctacaaaaaactttaaaaaaattagctacatacagtgacacacacctgtagtcccagctactcagaaggatgaggaaggaatgactgagcccgagagttcaacgctgcagtgagctatgatcacaccactacactccagcttgggcaataagtaagaccccatctttttttgtgtgtgtgtgacagagtctccctctgtcatccaggctggagtgcagtagtgcgatctcagctcatggcaacctccgcctcctgggttcaagcaattcttatgcctcaacctcccaagtagctgggactacaggaacatgccaccacacttggctaattttttttttttgtattttttttagtagagatggggtttcaccattttggccaggctggtctcaaactcctgacctcaggtgatccacctacctcagcctcccaaagtgctgggattacaggcgtgagccacagcgcccagccttttctttttttttttttttttttttttttgagatagggtcttgctctgttgctcagactggagtgcagtggcaagatcatagctcactgcagcctctatcacccacgttcaggtgataccccctagctcagcctctcaagtagctgggactacaggtgtccaccaccatgctcggctaatttctttttattttttagtaaagatgaggtctcattatgttgcccaagctggtctcaaactcctgagctcaagtgatcctctcaccttggtttcccaaagtgctagaattacaggtgtgagctaccacacctgacagagacccatctcttttaaaagaaaaaaagaaaaaaaagacagacaaaagagttcttacctaataagtgtagctggaaccacgggactcttgttactacatcctttaaggctaccacagagagtaacaaaattcagtgtgtttataaataatacctgagttgcctagaaaggaaaaaaaagacaagaaaactattaaaattattttactgtaaccattatttataattctggtgacacagagatctattattatattaataaactatctagggagtatttcctaactggcaaagcaatattgacccctggtagcctttgctcttttatgttccaccttaaaaacattagttaccacaatgctcttctttcctctttttcccttattcttttttcatttctgaaagccaagttttgaaagttatgggatctactttaaagaactttaccaatccacaatgtcaaattggattaaacaccaccaacttaaagaatataaagcaggctgggcacagtggttcacacctgtaatcccagcactttgggaggctgaggtgggagaactgcttgagctcaggaattcaagaccagcctgggcaatatggcaaaaccccatctctaccaaaaaaatacaaaaattagccaggcacggtggtataagcctatggtctcagctacttggggggctgaggtgagaggatcacttgagcccaggaggtcgaggctgcagcaagccatgatcgcaccactgcactccagcctaggcaacagagagagaccctgtcaaaaaaaaaaaaaaaaaaaaccagaaagaaaaaaaaaatggatataaaggagtatttagaaaaagaaaaatctcaaaactggaataaactccttcttttatagattactttctaagacagatatttactgaccttggggtctttctgattaagagttactgccagggtaaggccatctcttgaaaaggcagaaattagagctcctcttgactttactgattcacatttaggaattaaactacagagatgacagtcttgttgagcccaatgaacatggtatggcaatgatctaaaaaagtaatgaaataattgaaaacaaaaggtatagtaacttttaaatttatatgtagttcattacaaaaattaaaggatccatccaaattcctacatgtgcacatgtacttagggaatattttagagactatgttaatccattgtgttgctgtaaaggaatgcctgagactgagtaatttataaagaaaaggggttggctgggcacggtagctcacacctgtaatcccagcactttaggaggcagagacgggtggatcacttgaggccaggagtctgagaccagcctagccaacaggtgaaatcccgtctctgctaaaaatacaaaattacctgggcatggtggagtgcacctgtaatccaagctattcgggaggctgaggcaggagaattgcttgaacccgggaggcggaggtcgcagtgagccaagatcacgccactgcactccagcctgggcgacagagtgagactccatatcaaagaaaaaaaagaaagaaagaaagagaaggggtttattcgggctcacggttctgcaggctgtgcaagcatggcatcagcatctcctcggattcttgtgagggcttcaggaagcttttaaccacggcagaaaggaaatggggagcagcattttcccaagagagggagcaagggagagaaggagattccaggctcttttaaacaaccagatctcccgtgaactcagagcaagaactcattactgtaagcagaacaccaagccattcatgagggatctgccaccttgacccagacatctccaaccaggccccacctccaacattccaacattaaggattattttcaacacgagacttggaggggacgaacatccaaactatatcagagacctttcagaagtctgtgcacaaaagagaacctgcagattagctaaataaattgaatatcagagttctgttagtagagccatgtttttatatgcaaccccaaatatattatacctgcttccactaaaagtttggataaacgtatttctacataatgccaaatatttttaaaggaatttaaaaagtaggtcaggagttcgagaccagcctggccaatatggtgaaaccccatctctactaaaaatacaaaaattagccagccgtgggggtgcgcacctgtagtgtcagctactcgggaggctgaggcagaagaatcgcttgaacccaggaggcagaggttgcagtgagccgagattacgtcactgcactccagcctgggcaacagagtgagactctgtctcaaaaaaaaaataaaataaaaaataaaatgtagagaaggccaggcatggtggctaatgcctgtaatcccagcactttgggaggccaaggcgggcagatcatttgaggtcaggggttcgagaccagtctggccaacatggcgaaaccccatctttactaaaaatacaaaaaattagctgggtttgttggcgcatgcccataatcccagctactcaggaggctgagacaggagaatcgcttgaacctgggaggcagaagttgcagtgagccaagattgcaccaccacactccaacctgggagacagagcaagactctatctcaaaaataaatagatagatagatagatagataggtagatagacagaaagaagagggaaactttggggatagtatcaatgttctataattgatccaagtgatatatacatttcaaacaattgtatatatttttcaaagtctagttgtacacttaagacttgtttatcttattttatttatttatttattttccagacagggtctcactctgtcacccaggctggagtgcagtggcacgatttgaactcactgcaacctggacctcctgggcttcagtgatcctcccacctcagcctcccaagcagctgggactataggcatgcgccaccatgctcagctaattttttttatattttgtgtagagatgggattttgccatgttgtccaggctggtcttgaactcctgggctcaagtgatcctcctgcctcggcctcccagagtgctgggattacaggcatccaccaccacactcagccaagatttgttcatgttacttcatgtaagttatatcttaatataaaatataaaaataaaacaaacagaaaaataaaaataaaaaccacaccacaccattttactcaatcttacttaggcattgtaagaaaataatgcatattttcggctgggtgaggtggctcatgcctgtaattccagcactttgggaggctgaggcaggcagatcacaaggtcagtagttcaagaccacctgactaacatggtgaaaccccgtctctactaaaaatacaaaaagttagccaggcctggtggcgggcacctgtagtcccagctactcgggaggctgaggcaggagaatcacttgaacccaggaggcggaggttacagtgagccaagattgcaccactgcactccagcctgggcgacagagcaagactccatctcaaaaaaaaaaaatgcatattttctattttattaggctttttagaataaaactatttttaaataaaagaacacttaagcatttaaaaggtacaataggaaatcaaaagttatgtcccttttaaatttcaactgaattcttttccagaatagttacttttatagtcttagacaagtaaaaccatagcttgtcttatcttttacaaattctcacttcaaagaagggaaacaagacaaaacaagataaactttctggattaaacatttagaaataagaggggaagaaatgatttgtaaagcctcagaacttgaaactcacaataacatttacaaattttattacatgtatatggatcaaaagataataatgtttaaaaagggatagaaaatatggggccgggtatgatgcctcatgcctgtattcccagcactttgggaggccaaggcaggaggactgcttgagcccaggagtgcaagaacttgtctgttaaaaaaaaaaaaaaaattagccaggcatggtggcacaaacctgtagtcacaggtactcaggaggctgagctatgattgtgccactaccccccagtctgggtgacacagcaagaccctgcctccaaaagaaaaaaaaatcagtaagaaaaggaagaagaaaacatttacctcaccttacagatgtaaatacattctcatgccaccgaattgctagaaatgttaacttcaggcattccccagaataaaaagtaaatgaacacaggcagcagtctccaaataactgtagataaatttaatatactttagtataaaattaatctgaaaataaatcaagatactaaaatacatatatatattcctcatcataaaccagtaaaaaatattgagatcttgcttatactttttatccttaacattaagcttaagactaagtaatttttttctgagccagaggcaggtctcaaatgggtaatcaggttgtagtttatgctcttaagaaaatactgacattgactgtgactataactgaaaatattcttacatatttatttttctctttttatacttttatactatttaaattagcacaccaccctgagagtggggagaggggacaataaaacttcaaagtgaaatttctaacaagagtggtttggataataaaatgctggtccacacatacgaagaataccaagcagatattttaaatacgttttggttttttaagttcatgaatctgttatttcccagttaaatcgcatatttagtatcatcaattctagcttgttaaattaccaaacaagctctctctctatatataatatataaaaaatatatatacatatataatatataacatataaaaatataatatataatatacatgtattatatataatatataatatgcatataatatatataatatatacatgttatatacatatataatataccatataatatataatatatacgatatatattatatacgtgtatatatattatatattatactttttttttttgagacagagtttcactctcgttgcccaggctggagtgtaatggcacgatctcggctcactgcaacctccgcctcccaggttcaatcgattctcctgcctcagcctcctgagtagctgggattacaggcatgtgccaccacgcccagataattttgtagttttagcagagacggggtttctccatgttggtcaggctggtcttgaactctcgacctcaggtgatccacccgcctcagcctcccaaagtgctgggaatacaggcgtgagccaccgcgcccggcataacaagctatatttttaaatcaaggatagagaaaaggagttctaagttaaaactaattttaataaacactttttaaaaatgtgacccaagaaatataaaaatatcttttccatacaagaatttcacaattactatgaaaatttatggtgactaaagatatatagttataccattacacactctgctaatctgcttcacagataagagtctgagactgattttacctcattttttataaaaacagcattcactacagcttctttatcttcggtggaaggcaagagaactgcttcttcaggtatgacctgggaccaccgacccgccaatgaaaggcttttagaagataagatattctttaattccaaatattcccaaagaaatatgcatccagaaggtgttatgagcacaattcttttcccatttccagatacatacaagtacagtctcaaagagcttgctaaaaaagtaacaaaaaaagtaattaagcctctgaagtctgaattccccccaataaagtacataatttatgtattcttacaataaaaaaaaaacaaataatgttaccattcaggatgtcaaaactaaggcactagcaaaaaatacaatccaggcacggcagctcatgcctgtaatcccagcactttgggaggcttaaggagacggatcgctttagcccaaaaggtcaaagctgcagtgagctatgatcatgccactatacttcagcctgagtgacagaacaagatcctgtctctaaaaaagaaaaaaaaaggctgggtggatcacgaggtcaggagatcaagaccatcctggctaacacggtgaaaccccgtctctactaaaaatacaaaaaaattagccgggcatggtggctggcgcctgtagtcccagctactcgggaggctgaggcaggagaatggcgtggaccccggaggcgagtgagctgagatcccaccactgcactccagcctgggcgacagagcgagactccgtctcaaaaaaaagaaaaaaaaaagtacaaaaatagcaacatttatcaagtatatattatgtgatattagaaacctattattatcacagaaatgttaggcatgccagaattttcttcttcaagttgagtctcagtatcacagataaacataaccaaaactatatatatatatatatatatatatatatatatatatatatatatatatatatacacacactcagatatacatatgcacatacacagaaatacattttcaagacagtaacagaaaaatgtttcatcctcttttcctatttttcctagttaaaccaacttaaacaaataaaaaaattcccaccgactgtagctttgatcatttccttaggcttttcagttattggtatagttttcaaacaatcttgatctttgttccaaaggaaaagctctcctgtagttagtaccccagccagccaggcatctgtttccaaaaatgaaatgcaatacttacaatctagtatttcctttaacatcaccctaagttattaaaaaatatagttttagccatttgaaaatatcagtactacttaaccattactggatgttgttaggacaataacatccttcaagaaaggctgcagactaggaattttcttctttatctttcctgatagcaaattaatttcatttatgaatttatcatccaaaagaaaaacggcttctttttcctaagagaagaaacatgtgaaggactcaagaggtgccagaaattaattcaacttactgcctaaataaattatcccagaaatcaaagcgacatttaagaaagattatccatttgtaccacaaatcataaaatgaacattaagcttaatactctatagtagcctgaacattttgaattgttttaaaatacctcgttagaattaataggtaaggctacctagtagttgtatttcaatttctttgaagtttaaaattataggagtgtcctctaattctgctagccaaaactggcttatctactttttaatctttttttttttttttttttaagagctgaggtctcactttgttgcccagccttaagtggagtagatatttacaggcactatcccactactaataagcatgagagttttgacctggcccatttctgacctggaccagttcaccattcttaggcaacctggtggttaccccagccccttgatctcgggaggtcatcatattgataccgaatttagtgcagacacgtaatcggtatagcacactgcagcccagaactcctgggctcaagcgatcctcttgccttagcctcctgagtagctgggaccacaggtgcataccactgaacctgactctcatcaattttaacagtagtatgagcaagtttttaaattatttacttagattaaaatagatatagcttctgaaattcataaatccctgactctgctcattttttattacctagaaaaagtaggctgttttgagttaactttgttttcatatattctaaggcagtgattttcaaggtataactgagccagcagcatcagcaacacctcagaagtgaggagttcaagaccagcctgaccaacatggtgaaacccctagcctctactaaaaatataaaaattagctgggcatggtggcatgcgtctgtaatcccagctattcaggaggctgaggcaagacaatcgcttgaacctgggaggctgaggttgcagtgagccgagaggatgccattgcgtccagcctgggcaacagagcgagactccatctcaaaaaataaaaataaaaaaatacaaaatatccaaccctacagcagacctaattaactgaaaactttgggaacagggcccagcaatctgtgttttaaccacctctccagatagttctgatagtttgagaactcctgttacaggggagttagtggtataatttctcacaggaaatttaacactttatttcaataatcatcacaaataaagtagggttgcctactttccctaagtggggaatctatgccatatattatgaatggcattcctggattactaacgtattgtggcccatttcttccatcctagtttccaagaacacttcatagcacaatcatgaaaaccacaataggaggaaacactccattaactgttccagtaaaggaaagctcaggacattaaatattcccttttgatatatgccatctcaacttaacttaaacttgacttaaacataatatgaaaaaaatagtttaagtaaaaatcttctaaataaaccacttaacattctggaaaagctaacttgctcattataataaaaacgaaacacacacaaaaccctgttcagtgtgcaggtaggtgatcctcctgtagatcctcctccagtagatgatgttttatttatttaagatcatagaacactcctatattacaggcaaaacacacatataacatatataaaactggtattgcgtgaataaagaaaaacctacctttcccaaccaggagacacgtggccatggttttttctgcttaatacctgttgatgtcaagatttctaatcttatctccatgtttgttaagctatcaatgaccaattaagtaaaacagtcccaagattctgtaaacaataatagtaataaaatataaatgatgcataatattcactgggcattttttttttttttttgagacaagagtttcgttctgttgccccagctggagtgcagtgatatgatctcagctcactgcaacctccgcctcccggattcaagtgattctcctgcgttagcctcccgagtagctgggactacaagcgtgtgccaccacgcctggctaattttaagtagagatggggtttcaccatgttggccaggctggtctcaaactcctgacttcaagtgatccatccacttcgtcctcccaaagtgctgggataacaggcacgatccactgcgcatggaccactgaagatcttaactgacaattttcataaagttttgatttatattttatttctgagttgaagttttgctcttgtagcccaggctgcagtgcagtggcgcgatctcggctcactgcaacctccgcctcccgggttcaagcgattctcttgcctcagcctcccgagtagctgggattacaggcatgcaccaccacaccggactaatttttttgtatttttagtagaaaccgggtttcaccatgttggccaggctggtctcgaacccctgaccttgggtgatccgcccgactcagcctcccaaagtgctgggattacaggcgtgatccactgtgcccggccaaattagatgggcttgtttttttgtttttttaataaaatagctttaaaagaaaaactactcagagacagcacacaaagatctatcaagatgctagctatcagtcagcacggaggctgagatgggaagatcgcttgaggacaagagagttcgaggctgcagtgagctgtgattgtgcctgtgagagccactgcactccagcgtgggcaacgcagcgaagactccggctcaaaaataaataaataaaattgcaaataaaataaattctcacaaaagggttaaccaaatgccagagaaacgccggcattagaaaagcatcatttgcagctcctaatgaaataacaaatccagtcaatagtatcagcgctgctaaaattattgagtgaaaaaatactgggaactttatgcactgacataccctaaatccattagtcaatcttaaaattgctaagagcgaggaaaattgacgttctattcctccggatcctgctcgagaagctgggggactcgggtccggtgccgaggtgtggcccgagcctggcaccacccacgccggccgggtgaccccggccccttggggctcccgcgctccgtcagcaggcgacgctgggaggctggggtaggcccagagcgaggacgggcccggactgggtagtggggatgtaccagggccgggtgcggcgggagacggcccgggaggcggaaggtcgcggacctgcccgacagaagagtagatgaggggagaccgaggacgcccgggtccggggagcttacgaggaggccaggatcgcggggtaaggaatccgcgggcagttacctccgccaggggcagggtccggccagtcaggcgcgagaaggctaggcgaggccgactgcgcggggtgaagacgccaggccgacagctgcgggccctaccgccagccctgacgcgagcctgcgtcctggcgacggcggagggcgggcagggggcgcgggcgctgccacggcgcctgctcagaacc

SEQ ID NO: 2049 - DNA, 23024 bp, Homo sapiens
atcacagcttgatttcagaagcttactttcaaaaaaaatttattcaatgaatacacaatataattccatttcgagtgattaaaacctatttgttgtttagaaccaaacaaaactacaagaaaacattttcaaaaccttttttttcaggctgaagaaatcgtttaatccattttaaagaaatctcacatgatgttctgtcgggattaaaaatatacacggaaaaaaataaaacaaaatatatacacagaaagaagctcgcacagagtcaggcgtgcagcaacgtcacacactcattcctttctgtttcctctggacactcaaaatgtgaaagcaagtaagaggggggtggttaaccaaaccttttggtccaaggaataaaatttctttaaaaaatttaaaacgtcaaaacctgccagaataagacaatagaagagcgtatcgtcaggcgctgggaatggcaccacgacaaggcattaatgtggattcacttgcacagctgctctcataaaagctacacgattcagaggtaaccctaactatccgcaatcccaaccaaagtcatgttcatgccgctgtcctagtctggacaatcatctgtcactcatccaacacagttatatacagaatgcgcagtcccagcaacagtgtagattacagcaggcgttctctacctggactcatgattggatttcatttctaaattacatcagagctttcaaagattgaaatacacaaatctgcactacccaagcctccttgcctgtacgggaaacaaatcagaagagcatttattgggaactgacacgtcaggcctcacaggtgctgggcaggaatcacagaggcttgctctgcatcatgtcttccgttaacctgaagctttgggtttattgtgtttggcaaaccactcgtcacttttatctgctgccattgcctgtaaaatagaaatagaatatacactgactccaagcctgaaaaacaaaagacatagcccactttatatctcactgtactgaccacaataaaaaaaattaacattaaaaaaaggacccaaacccccgctccaaaaaaaagagaagagaaataaaaaaaattttttaacatttaaagagtattaatccagtacagagtgttatgttcaataaggcaagagatactggtgataatgagcaactgtggatcctcactcggcagagtcaagggcaaaccaagcctgtagccaggaagtgtggctggcggaccaacgaggtcagggacccgcatgccaggcggtaggatctctggtaaaagagcaagtcctgccactcacagcatctgggcagacgctcaagaatctttagtgtcatgaaactcagtctgatagtgaggccaaatatgaaactctacgtgatgttttagtgatgaagcctggaatgattcctttttcgtaagtctcctcccggcctactcttctgatgttggttctgtttagtttgggcatcttaattaaaaaggaagccttaagccgtgcccagtggtcacacctatagtcacagccacttggaggctgaggccagaggatcacgtgagctcaggaattcgagttcagcctgtgtaacagagtgggaccccgtctcatatacatacatacagatacaaataaaaataaatgaataatacaaagccttaacaataatgttttggttccacaagcatccctttcgttgtttagtaaggacaaacactcatttatgtagtcaaaaagagccaggtaccacgctgggttcagatgtggcagcagagacagtcggaagctttgaggagtgtgcagaacagctgagaactcagatatggaaacaagtattttgcatgacagagtgtgtgtacgcatgtgtgtgtcttgaagcatttgctataatatctacctcagcaggaagtcacaagatgaggtggcaattgaaaaagaagaaacaaatatatttattatttagaaacagtgaaggtgaaagtggctgtcctaggtagtgtgactcagagttggaccgtttcatttctaaaaaatcttagtactatctgatttattatcttgatgaaaataagaatttaaaaatcaaagatatgcttaaaaaaaccacaagtcacaaatatgcacgtttctgtcttttaggagccataaaaagtgggaggaaagaacaactaaattatttggagaacctaagaaagctttttttcttttttgaaatggagttttgctcttgtcgcccaggctggagtgcaacggcgccatctcggctcactgcaacctctgccttctgggttcaagtgattctcctgcctcagcctcccaagtagctgggattacaggcgtacaccaccgtgcctggctaattttttgtgtttagtagagacagggtttcaccatgttggtcaggctggtctgggactcctgacctcaggtgagccacccgccttggtcccccaaggtgctgggattacaggggtgagccatcgcgcccggctgaacctaagaaagcttttaagtgttgaaggacaagtaaaagaggagagggaaaaaaccctttgggttggatgcaagaagaagtatcttagctaatataaccagttcagtgggactggaatagggatgagttaggggacttagggaggcaggtgggaaagaaggtcagagggtagagaatgtccaaaaatgtcacatgctctgtcagagagtttgaaatttatctcagaggcaagagagagctatcggattaaacggttttaaaaattactggctgtttgctttgggacagaccgtaagttgacaatgaggcctttcaaagggaaagctgataggcagaagacatttcagaggtagaactcacagctcttggtgactaatagctaaaataatttaaggatgaggagaaataatggtcaaaagtgactgtctgtaaatctaaaacgactattaaatgttaaaaaacaaaacacaacaaaataacaccaaaactggctctgaggattccagcgtgaacaactgggatcacagacacgctgtactgtccagggagggagcagggcgcagaggaagaaaaaggactaactgtaaagcctgaaaggcttccatccaggccccggcctgcacctactcagtgcgtgatcttcagggatgaaggggaataatttcatcaccatccaggccccggccggcacctactcagtgcgtgatcttcagggatgaaggggaataatttcatcaccatccaggccccggccggcacctactcagtgcgtgatcttcagggatgaaggggaataattatttcatcaccatccaggcccctgcctgcacctactcagtgtgtgatcttcagggatgaaggggaataatttcatcaccatccaggccccggcctgcacctactcagtgcgtgatcttcagggatgaaggggaataatttcatcaccatccaggcccctgcctgccacttactcagtgtatggtattcaagggtgagggccaatgacttactcattcttagcctcggtttcctcatttgcaaaggctgatgctatcaaccttgcaggttatattaagaatcagagaatgtggctgggcgcggtggctcacgcctgtaatcccaacactttgggaggccgaggcaggcggatcacgaggtcaggagatcgagaccatcctggctaacacggtgaaaccccgtctctactaaaaatacaaaaaaattagccaggtgtggtggtgggcgcctgtagtcccagctactcgggaggctgaggctgaggcaggagaatggtgtgaacccgggaggcggagcttgccgtgagccgagatcacgccactgcactccagcctgggcgacagagcgagactccgtctaaaaaaaaaaaaaaaaaatcagagaatgtatatgaagcacttaaggttggatgcggtggctcacatctgtaatcccagcactttgggaggctgaggcaggtggatcacctgaggtcaagagttcgagaccagcctagccaaaatggtgaaaccctgtctctactaaaaatacaaaaattagctggacatggtggcgggtgcctgtaatcccagctactcgggaatcccagctactctcctgaggcaggagaatcacttgaacctgggaggcggaggctgcagtgagctgagatcacaccactgcactctagcctgggcaacagagtgaggctccatctcaaaaaataaataaataaataaaaataaagcacttaagaacgtaccgatatagtagcatttatttctttttatttttatttatttacatatttttagtataaatagagagttcatctgggccaagcttgaagactgcagcccgggaacatagattcaggtttcccagaatctacactcccaagtagcctttatgtaatattactggaagaagaatggatttgaggtaagataagttatggacacgctgagtctgatatgtggtaggtttcctaggtgaagaggttctcaggatataacatcggtctggacagagaaagtgctacatgtaagagaaaaagttcataagctggacttcaccaaaataaaaaattcctcatcttcaaaaactcaattaatggctgggaaaaatacttgaatttgcaagtgacgaaggaatgatgaaaaactacagtacagagtcaaggtaagagtcacgtaaggctctgtcgtactctcttcggttgtgcatatttggaattttcatcatgaaatattaaaaattattaaagaatggacaaaagacttgaacataaaattcacaaaaataagtaaatggctaataagcacatgagaaggtgctcaatatcattagtcatcagggaaataaaaattaaacctctgtggggccgagctggaaggatcactggaggccagcctgggcaacacagtgagaatctgtctctacaaacataaaaaacatcagctgggcatagtgctgcagccctagctatgtggtggctgaggcagaaggatcgcttgattgcaccaatgaaaccatttcgcatgtgctagaatagctaaaaaacccacaaaaagcaaaataagtgttggtgagaatgtagacctactggacctctcgtggacaaacgatggtccgatcactttcgatgactgtttgacactttcttatacagtaaaagcagttctactcctaggtatttactcaagagaaatgaaacatctatctacaagaagatttacactagaatgttcatggcagtcttccttataatagattaaaaaatctagaaataaaccaaatgtccaccattataagaatgaatgagcaaattgttatattcataaaattgagtatcagtcagcaattaaaaaaaaaagagctgtgatatgcaattacatggtggaatctcaaaaccatgttgagtaggccgggcgcggtggctcacacctgtaatcccagccctttgggaggccaaggtgggtggatcacaaggtcaggagatcgagaccatcctggctaacacggtgaaacccgtctctactaaaaatacaaaaaattagccgggcgaggtggcaggtgcctgtagtcccagctactcggtaggctgaggcaggagaatggcgtgaacccgggaggcggagcttgcagtgagcagagattgtaccactgcactccagcctgggtgacagagcgagactccgtctcaaaaaaaaacaaaaaacaaaaaacaaaaaaagccatggtgagtaaaagcagccaggcacaaaaggaaagaaaatactgaatgactccatttgtatgaagtccaagaacgaactcacctacagtgacagaagtcagaatagcagctgatctgggagatgaaggtgccaactcactggagatgggcatgagggaacttcctgggaaaatggtctgtattctgagtagtggttgtatgagtaaacacaaccgtcaaaacacatttaaattctacctaaattatgcctcatcaacaacaaccacctgtctgagctgaggaaggagttaaaaactggaagtgaggaggctggagccaggatgatggttacgttcagggcagaggtaaggagaggtcgcaggtaagctctcatcagagtggaggaagaatgcagaatgggaaaaacagcaaagtagggctatgggtataaaaacactttgggatgagacacagaaagaggtgcccgtgtctgaggagaaactgtcaggaagatgaaaatggtaggatggccaggcgcagtggctcacgcctataatcccagccctttgggaggccgaggagggtggatcacctgaggtcaggagttcaagagacagggtttcaccgtgttagccaggatggtctcgatctcctgaccttgtgatccgcccgcctcggcctcccaaagggctggggttacaggtgtgagccaccgcacccggcctactcaaccagcctgaccaacatggtgaaaccccatctctactaaaaatacaaaaattagccaggtgtggtggtgcgtgcctgtaatcccagctaccagctactcaggaggctgaggcaagagaactgcttgaacctgggaggcagaggttgcagtgacctgagatcgcgccactgcactccagcctgggcaagagagtgagactcccaactcaaaaaaaagaaaaatggcaggatcgctaacagcagaggagaagagagctcagggagcaggagttcatcaatggttcacatctataatcccagcactttgggaggccaagatggatcgaatgattgagcccaggaagtttgaaaccagcctgggcaacatggtgaaaccccatctctagaaaaaatacaaaaattagccaggcatggtggcgcacgcctatggttccagctactagggaggctgaggtgggaggatcactggaacataggaggcggaggttgcagtgagctgagatcatgccactgcactccagcctcggtgacagagagagaccccgtcttaaaaaaaaaaaaatgggcccaggcgtggtggctcacgcctgtaatcccagcactttgggaggccaaggcagacggatcgcctgaagttaggagttcaagaccatcctggccaacatggtgaagccccgtctctactaaaaatacaaaaattagccaggcgtggtggcacgtgcctgtaatcccagctacttgggaggctgaggcaggagaatcgcttgatcccgggaggtggaggttgcagtgagccaagattatgccactgcactccagcctagttgacagagcaagaatccgtctcaaaaaataaataaaataaaatgggccaggcacagtggctcacacctgtaatcccagcactttaggaggatgaggtgggtagatcacttgaggctaggagtttgagaccagcctggccaacctggcaaaaccctgtctctactaaaaatacaaaaattagccagcatggtggcaagtgcctgtagttccagctccttgggaggccgaggcagaagaatcgcttgaccctgggaggcgaaggttgcagtgaggcaagattgcaccattgcactccaccctgggcgacagagctagactccatctcaaaaaatttaattcagtaattaatttaattaaattaagagcgaggaggaagagtctggcaaatttgtcagctgagaggatgacagattctactttccttcaggataaaatgtataaagactgtattttctatacattgcctgctttaacgttaattgtgcatctactattatgtcagtaatttgccaagctctataaaccataacaatcttatgagatagatcctcttattttctgaaatttttggataagaagactaaagttcaaagaatttaagtcaactgtttaaggtcagtcacagagttacgtgacagaaccaagaaagaccaatttgttcctttaatcattcaacaaagtatttgcagaacgtctagtacatgccaggtatgtgctaggagctaggatccaacaactactttgaatgcttctgaattactgagtttgatgagaatctaaaagtagttgctatatttggcaagaaacaaaagcacttcactgagtaacaagagccagtgcaaaacagactgaagtgaaaatgggaggcgagaaagagaaacagtgcacactcagatttttagaagaagaaatctggagaggacgtaagagggagaaacagcgcgcactcagatttttagagaagaaatctggagaggacgtaagagagagaaacagcgcacactcagatttttagaagaagaaatctagagaggacgtgagagagagaaacagcacgcactcagatttttagaagaagaaatctggagaggacgtgagagagagaaacagcgcgcattcagatttttagaagaagaaatctggagaggacgtaagagagggaaacagcgcgcactcagatttttagaagaaatctggagaggatgtgagagagagaaacagcgcgcactcagatttttagaagaaatctggagagtatgtgagagagaaacagcgcgcactcagatttttagaagaagaaatctggagaggacgtaagagagagaaacagcgcgcactcagatttttagaaaaaatctggagaggacgtaagagagagaaacagcgcgcactcagatttttagaagaaatctggagaggacgtgagagagagaaacagcgcgcactcagatttttagaagaagaaatctggagaggacgtgagagagagaaacagcgcgcactcagatttttagaagaagaaatctggagaggatgtgtgagagagaaacagcgtgcactcagatttttagaagaaatctggagaggacgtgagagagagaaacggcgcacactcagatttttagaagaagaaatctggagaggatgtgtgagagagaaacagcgcgcactcagatttttagaagaaatctggagaggatgtgagagagagaaacagggcgcactcagatttttagaagaagaaatctgaagaggacgtgagagagagaaacagcgcgcactcagatttttagaagaagaaatctggagaggacgtaagagagagaaacagcgcgcgctcagatttttagaagaaatctggagaggacataagagggagaaacagcgcgcactcagatttttagaagaaatctggagaggacgtgagagagagaaacagcgcgcactcagatttttagaagaaatctggagaggacgtgagagagagaaacagcgcgcactcagatttttagaagaagaagtctggagaggacgtgagagagagaaacagcgcgcactcagatttttagaagaagaaatctggagaggacgtgagagggagaaacagcgcgcactcagatttttagaggaagaaatctggagaggacgtgagagagagaaacagcgcgcactcagatttttagaagaaatctggagaggatgtgagagagagaaacagcgcgcactcagatttttagaagaagaaatctggagaggacgtgagagagagaaacagcgcgcactcagatttttagaagaaatctggagaggatgtgagagagagaaacagcgcgcactcagatttttagaagaagaaatctggagaggatgtgagagagagaaacagtgcgcactcagatttttagaaggagaaatctggagaggagatatggggtcagtaaaaggtttttaaaggatgggagctttcagcgcctgtttgcacgctggcgagaataactcactggaaagaagagactgatgctgcagaatggagaagagatgatcaaaggagctgcagagctgaggggatcagatggaggcatctccctggggagagctgaggggaacggatggaggcatctccatggggagagctgagggggtcagatggaggcatctccacggggagagctgaggggatgggatggaggcatctccatggggagagctgaggggaacggatggaggcatctccatggcaagagctgaggggatgggatggaggcatctccatgcggagagctgaggggaacggatggaggcatctccatggggagagctgagggggtcggatggaggcatctccctggcgagagctgaggggaacggatagaggcatctccatggggagagctgagggggtcagatggaggcatctccatgcagagagctgagggggtcggatggaggcatctccatggggagagctgagggggtcggatggaggcatctccatggggagagctgagggggtcggatagaggcatctccatgtggagagcagaataagcacagatccaccagcagtggttccagggcagcctgaggttgtggtaaggcacaaatgctaagtctagacaagcagtctacacaggtggcagtgaagacatcggtccttggctgaggtcaacccaacagcgaaaggacgtggttctgacattaagaacctggaccctgttgcttagtctcctcccacacacacttaatgccatccctctcaggcccatggtgacataaatgtagaaatgggactcacatcatccaacaatttgcttccctctggatccatcttagaaagttctcgaaatgcttcatccccgacaaagcaaatttcatgtccgtcctacaccaataaagagaaaagacacctgccaaagacatccttgaagaaacccctggtccagcctgccccctgcctgagaaatacttacagggtcggccagaatgaccacctgtactgttgctttccctggggtgtccaggctcaccaggggagtcagaatcttctggttctcccttttcatcaagtcttctaagtctggcaacttgaggaaaacagaggcaacgtgagccaggggtcacacactactcaggacacggccctcgtcagtcctagaggagtatcagataccataaagaaccaaggcgccatttgtttgaatttattatctcagctgctcttgaaacaactgctgaacttgatactaaagccacaatcaaaaaggacctcaagaagggaaggacaaagttcttagctgggttgaactagctagtcagaaagctcaaacgatctggtatcaagcgttacctctttctgggggcaagagaaggcaattcttccaaaagctgctgcatggtccaccccacccttgacgccctgtagctccagcttacactgaaataggaaagggggttattttttggaacaggttatacattcattacacgtatgtggtagaaaaattcaaatattatatactaaaggaataaagtaaaaactgagtctctatcctactctcaccccagagacaactagtccacactttcctgtgtatccttctagaagcactgcacgcatctatgtttttttttttacacaaatggtggtataatttacaaattattctgttccttgtttttctccacttaatgttaccatgtcaatacataaagatttgcctcaatctttttgctagcgacatagtaatccattccatgaatgagccgtaaattactgaaatatgtctctaatctataggacactgaaattcttacacattgtgattacagacaatgctgcagcagataaccttgcacacacttctttgtgccgatgtatgttgagcacatctgtaaaataattcctaggagtagaattgcagggtcaaagtgcaaggactaaatcgtgctcaaacgctgggttattagaaaaagaagatgaaaaagatcttgcattaaatccattcaatctcttggattaagcaattccacttctgaagagatatatccccaaatataaacaaggtaatatctgggtggtaaggttatcacttattttcttctgtttatctatataaatattgaatcactgtgaagaaactatgggaacaaccttcatgttaacttcatttataaaggttataagccatttataagcttcgtttacaagccaaattcaaagtaacaggttattcttctccaagattgctcacctggttatcagcatagcccagcaaagccctttgcttttcttcatctttttcataaattttcattcccagtagattacaccagtagttcaaggacttttgaagatcagacactgctagagttacttttaatacaggatctgttgggtaataaagcaggaatagacagatcaatttaatagaataaaatagaaagaccaaaacatgcgcatgtatacttacaaattcagtttatgataagaaagggattttaagccagtatgaagctgggtgcagcggcccatgcctgtaatgccagcactttgggagactgaggtaggaggattgcgtgagcctaggaattcaagaccaatgcaggtaaaacactgagaccttgcctgtatgaaaactttaaaaaaattggctgggtgtggtggctgatgcctgtaatcccagcactttgggaggccaaggcaagtggattacctgaggtcaggagtttgagaccagcctggccaacatggcaaaaccctgtctctactaaaaataaaaaataaaaaaaattagctgggcgtggtggcgcacgcctgtaatcccagctactcgggaggctgagacaggagaattgcttgaacctgggaggcggaggttgcagtgagccgagatggcgccgttgcactctagcctgggagacaagagcaaaactctgtctcaaaaaaaaaaaaaaaaaaaaaaaagattagacaggcgtggtggctcatgtgtgtattcccagccacttcagagatggaagcaggaggatcgcttgagcccgggaggttgaggctgcagtgagccaagactgcactactgcactccagcctgggtgacagtgagaccctatctcgaaaaaaaaaaaaaaaaaaaaaacaaagacagtatgaaaagcctcattattcaatggacggcgctaagaagactggctaatcatttggtaagaaaaacttacatcttcgaaataaatgacaaaatacattcctgatgggttaaaaaaataagtttagagaatgaaaccatgaaaatactagatacagatgattatttatacaattttggagtagaggaagatttttctttaaacctgacaccaaagatagaaaaactatgaagaaaaaacttctgctacataaattacacaaaatggaaaactcctagacaacaaccaagaaaaggaattacaatcaaaactagagtatacaacacagtagggggaacaactgcaatatattggacaaaaagtccttaatatgtaaatcacctgtaaatatcaataggaaaagaatgaacatgctagaaaaataggcaaaaggcacaaagcaataatccacaaaacaaggaattagaatggtcaaataacatacgaaaaaatattcaggccgggcgcggtggctcacgcctgtaatcccagcactttgggaggctgaggtggcaggatcatgaggtcaggagatagagaccatcctggctaacacggtgaaaccccgtctctactaaaaatacaaaaaattagccgggcgtgctggcgggcgcctgtggtcccagctactcaggaggctgaggcaggagaatggcgtgaacccgggaggcggagcttgcagtgagcccagagcgcgccactgcactctagcctgggcgacagagcgagactctgtctcaaaaaaaaaaaaaaaatttcaacccgacgcccccaaacaacaaagaaattagaattcacataaaatcctttgttaactaatgtgcaaataatgttaaaagttggcagtgttaactgtgttagtgtagaggggaaaatcacaatcatgtaatacaagtgtaaatcagtacatttctgggcaatagtttgatggaatgtaccaaaagctttaaaaagtgctcattgcttttgaaagaacaagtccattttcagccactccaaaggtaattgtggatgtatgaagggcttttacgacaaagacattcaccagtgttgcttagaacaataaaacactaggaacgacataaatatccaacaatagagaattgtttctcttcctacaatgtaataatacgatggaactcctaaaaaaggatatacagaaatgtatacacttaattatatatacgtatttttgacaaaagattggaaagatatactctaaaatgtcagcagtggttctctctgggtacatgggtgtgtgtgttttttttcagcttctctgcttgtctaaggaaaaaacttgattattttgtaaaaagaataaaagtcatattgaaacacctactgttactggaaacttttcacattgtaaagtgactttctaaagagctgttccacgtctccatctgactacgataaattcagtacatttttctttggctttactgccttagtcctgtttgctagaacagcaatattgggattaagacgctgtttctcacaagtgcctccgcctggcaggctccatttttttctttccatttacttcaaaatcaacaaatcccagttgacttggagcctgaagggacgcaggacaggaagttaacgcgtgggtgaagctgcacagaagtgggtaattcaaaggaaagatgaatgccagccggacagaaggtctgaccacattgtcaaccagaaatgcccaaggggatttccattccaaagaacaaaagcttcttagcaccatggggctctctattattttaagcactgaaatatcactaaggctggagagaaaaaatggatggtggagctagctgcaagcgttaagttttaaagtcagcaaaggatcaatcacctatcaacaaaaaaacaccatcaacaccctttaaatcaccagtgaggcagagaaacaccatctctccacgagtcccacacagccaagtctagcctcccacactggaacagacggatctttcttttgctgagcaccggatgataaacaaggagcactgaacattctacagactcagcatgggggcatcggggacaggaggccgaccagtgaagaaggagaatttccaggactcccttctcaggcccacttgcaggcatacgttcaccaagtaagggagtcggcacaagtgcccttgccattcgccagcattttccccgtttttgcttttgttttgtcagagcaggtagctgaatttgcaggcattaaatacaaaatgaaacactgatgaggctgcctctgcagtcaacaaaacaaaccctgcaaagtttccttcttgttctgtgtggcagtcagcgtgggggctcctcacttccatgccatccctgagtacccacgctcaagtctgggaaactgacctcggctccagaggaggcatggctaaatggtttgggggtgatcctatttctcttgccagtgattggtttaggagcaggcacagtatatcaaatctgaacaggaagtttgctggaagattctaggaaagtttttcttctgctcctaaaaagaaagcaaaaagggccgggcacggtggttcacgcctgtcaccccagcactttgggaggctgaggcaggcggatcaagtgaggtcagaagttcaagaccagcctggacaatatagtgaaaccctgtctctactaaaaatacaaaaatgagctgggcgtggtggcatgtgcctgtaatctcagctactggagaggctgaggcaggagaatcacttgaacctgggaggcggaggttgcaagtgagccgagattgcagcactgcactctagcctgggcgacagagcaagactccgtctcaaaaaacaaataatttttaaaagttaataaaaatactaaaaaaaaaaaaaaaaaagctgagcgtggtggcaggcgcctataatcccagctacttgggaggctgaggaaggagaattgcttgaacccgggaggcagaggttgcagtgagcagagatcatgccagtacactccagccggactgacagagtctcaaaaaaaaaaagcaaaaagaagtcagcatctcctctcctaccagatgggattgtgggagcatgtggccccacctgctcctggcagctctcctgcaaccttgaggggactagttctaggagaggtacccgcagagaacaacagaacgtagaaagagaaaatgtggggagctggtgaatcatctaaccttgaaatctttcccacctatagaatgcctgctctgtgagctaaaagattctataactgttcaaagtagttgggttttctgttatttacagatgaaagaatcataaatcactacattaccagtagaacagaactagtctagatcccctactgctatgtatttaagttctgatatgagaatgtagtctctccgataacaggtaaaagcactggctggggaagacacgtcacgtgaacacagactctacaaaaaaaagacaggcagccctcactctcctttcaccaaagatgcctttagacagaggcttttactggttctggtataattacctgactgaggcagactgcgattctgcaaatagaacttatatcctcccggggcctcggtttcaaaaacaccttctgcaacttccgtcagtggccactccagcttcctggcgttgctgacagcctggctagaagcgagcgtgattccctacaacaaacaacagtacatccaagtacatgatcacaacagatattttacagaacaagacaatgagcccaacccctattgcctactgcctttaggtaaaatcacctaagatttaactggcatccaacattttcttctagtgatttaaaaacaggttttcaatgttttatcccacaaacattcagacctttgtgaataataggacagaaattgaaatgccagtgaagtctgattcatttaacaccaaagataacgtcttctaattctaaagatctagccacagaaatcttgatgttacctgggtctgccagctagctacctatttaaggtgacctgttcttgcttttttaacaaacaaaacaaaaataagcaaactatcaaggtttccttacatttaatcaaagtgcctagaaatgtacacgtgtgctttgagaagaccagccttgtttctggctcggtttattataatggcctctctgcctccagtcttgtaaatccattacccactctgcagccaaagtaaactttccaaaacgcatcctatagtccacccccagactgcagccagccttgttttccctttgctcaaagtccgccaatggctcatttcactcggtgacttacggcctaggaggccccctgcagtcttaccccatggcactgccgaccccatctcttaccacgctcccctctcgttctctattccagccacactggcttccttacacctcctcgaacacgccagatgttacctgacggctcttgccagaatattctctgcctggaacgcgcatcccccagatatccacgtggctaactccctgacctcttttgagtctctgctcaaatgttatctcttcactcacacacacccttggcactctactcaaatttacaaccagccacctacccccagccaaaactctgctagaaaaaaacggtatttaccataaagtcattgccaagcttgtagtctccgacgccataattgtaagtcagttctgcgacaaaatgatcatcctcaggcccaaatcccaccattgttttactccatttcccatcataaggcctagaaaataaaagtaaatgaactcagtgactacagacaagtcagcctcaggccacccccagagaactactgggcacagagagatgagcattcctgtctggtcctaaaagttctcttaaggatgagatgacctcagatggtacagaaagcagctgtgggcagtgctcatgggaccctactacaagctccaaagactatccagcatctacctgaaggaaagatttgttcaccttttctgtaaagcaaggaacagaatcctaaagacagttctccaactgacctgttatttccttgactatcaatcaacaagcatgaaattcctaataggccttggactgttccaacttgtcacggtactaagcttaagagatggacgggcgtggtggctcaggcctgtaatcccagcactttgggaggccgaggcgggaggatcacctgaggtcaggagttcgagaccagcctggccaacatggtgaaaccccgtctctactaaaaatacaaaaattagctgggcatggtggcacatgcccatagtcccacgtactagggaggctgagggaggagaattgcttgaactcagaagacagaggttgcagtgagccaggataatgaccccgcactcccacctgggtgacaaagtgagattctgtctcaaaaaaaaaaagatactggaaagccgctgcttcatctagagcatgtacttatttgcatttgtggcataatatgaaacatatctggtcattgtccctggttcctgtctcagagctcccaaaacctctggaatttcctgataggaatatcttttgttatattcataatgagcccctttcagtcacacctgagtttatgctaatgaagtgacttagagtggggcctctacatagactcaggatggggctggtcaccagaaagacaaatgattagaggactgaactttcagtcccatccaccaacctctgggaaggaaagggatggagactgggctctattaggcttgaacaatgagactcatgagcttctgggatgctgaacgtagggaggtgctggattggagcctgcccagaagagcatggaagctctgccacccactccccatgccctgccctgtgtatctcctctgtccagccatttctgactcgtactctttatgataaaccagtaaatgtaagtaagtgtttccagcgtttcccttagttccatgagccactgtagcagactatcaaacccaaggaagcaggagcgggagccctgacttgtagttggtcatcggaaatcctgaagatccagactgtgaccggcgcctgacgtggcggaaaatcttctgggactgagcccttaacttgcaggatctgacattaactccaggtagagtcagaatcaattaaataacaggacagccggctggtgttagagagctggagaatccctttgtgtcccacaggtgttgtatgagagtgcagagaaatgtgttcccgacgctcctgaagttgcctccctaatttactgccttcttaattaattccactgctttatactcatgagagtgcagagaaacagtatgtgttcccgacgctcctgaagttgcctccctaatttactgcctccttaattaattccactgctttatactcactttgagaaactgtcttctgttatccgggtgtagtcagagcctaaaggagattttaagaaacaaggtatcatacccattacaggcagctttgcagccttcttcaaattcctcatgccgcagaacctggtgtgagatttagaataaattgtgaagtgttgctagtactgctcacagcgtctttagcacagactaaaatgtcaaaacacaaacattatcatttataagctttacttgtaaaagaacaaaagcaaatgagctttacacttctcccaggatagaagcagtggaaggacgaacagcttgacaccaagggtcaggctaccaaatcagttgtgaaatctatttagattggtaagcagtgctatgcagtgggaaaaagtgtggccttcagcattaaagaagtctgatttgggccgggcacagtgactcacgcctataataccagcactttgggagatcaaggtgggtggactgcctgaggtcaggagttcaagatcaacctggcaaacatagtgaaaccccgtctcaactaaaaatacaaaaattagccaggcgtggtggcgtgtgcttgtgatcccagctactcaggaggttgaggcaggagaatcacttggaccatgagatggaggttgcagtgagccgagatcgtgcccctgcactacagcctgggtgacaagagcaaaattccatctcaaattaaaaaaaaaaaaaaaaaaaaaaaaaaaaagatgggcatcgtggctcacgcctgtaatcccagcactttgggaggctgaggtgggcagatcacctgaggtcgggagttcgagaccagcctagccaacacagtgaaaccccatctctactaaaaatataaaaaatacaaaattagccaggcatggtggtgggcgcttgtaatcccagctactcaggaggctgaggtaggagaattgcttgaacacgggaggcagaggttgcaatgagctgagattgcaccattacactccagcctgggtgacaagagcaaaactcaaactcaaaaaaaaaaaaaagtctgatttggaattctgtcatttagtagttgtgtaactctgagcaaattagaatctgagtctcagtctcctaacatgtgatgggaatggatgttatgaaagcatctcacagaaccctgcacacagcgggctctcaacgtgttagctttagccctcctttttgattcccacggctcctgccagttgaagttcccaacgcttcgctcagactattaaaaatcatccttattggccgggcgcggtggctcacgcctgtaatcccagcactttgggaggccgaggtgggtggatcatgaggtcaggagatcgagaccatcctggctaacacagtaaaaccccatctctactaaaaatacaaaaaataagcagggcgtggtggcgggcgcctgtagtaccagctactcgggaggctgaggcaggagaatggtgtgaacccaggaggcggagcttgcagtgagccgagattgcgccactgcactccagcctgggcgaaagagcgagactccgtctcaacataaaaaaaataaaaaataaaaaataaaaaaatccttattgatatccttccttaataacaccaaaaaagcacatgcctaaagcacaaagcactgatcccatcaccaccctgtttaagaacataagtgagctcccatcttactgcagcataaaatccaaattctttagcatagcattcaagatactattagaagcaatgccgacctgtccatcctgatatcccatctccttaacttcaactaagcaacctcaactaaaggcacataaaaccagcggcttcgcaaacatgtgccatctccgcactggctcttcagttttactatgtagctcctcctctcatctacctgtggatatcctatctttagacgtcaactcgaatcctggctaacacggtgaaaccccgtctctactaaaaatatttttaaaaattagccgggtgttgtggtacgcgcctgtggtcccagctactcgggaggctgaggcaggagaatggtgtgaacccgggaggctgagcttacagtgagccgagatcgcgccactgcactccagcctggcgacagagcaagactccacctcaaaaaaaaaaaaaaaaaaaaaagtcaactcgaatacaaggtctacatgaattatttcctcatcacccaggttggaaaaccgctccttcttttgtatttttataatagtggctaacacttatataatctactattaccgatatgttaaatactatacatataataaggtgttgaatcttttttttttttttttttttgagacggagttttgctttcgtcatccaggctggaacacaatggtgcgatctcggctcactgcaacctccgcctcccagatacaggcgattctcttgcctcagcctcccgagtagctgggattacaggcgtgtgccaccatgcccggctaatttttgtatttttagtagagacagggtttcaccatgttggccaggctggtgtccaactcctgacctccagtgatccacccgccttggcctcccaaagtgctgagattacaggcgtgggccaccgcgccggcacgtgtttaatctttgcaacaaccttttgatcgacgaggaaatactaacaagggacagctctgtggtttctgctatcgaaagtttggtggtttttcactatcaaattctgacttccattaccatcatctacgtacaaatccagttccaactcccaccccaacccaggccatgagctctaatggaggatatatatcagggtcatttgcacctttgttgccaaaactcaacgtagtaccctgaaaatagcagatattttaaaaatgacctgacgaattcagatccccgtctattgcaccgtctatacactaaaccgcgctcttgcacctttcaagtcttccttagtggtgtgttccctacctccctggcttatcaaaggaggtccccaaaacccagttccccaaccaactgaatcctgcaaataacagctcctcaggacccgagacagaccgcttctgggtgctgttgaaaagcagatgggttgagagttggagcatatattcagagactgagtatccgaaacggactattcagaccagccttgctagaagcagaactctgaatacgctgattttatctacatcaaaggctccaaaccggaaaacacaaatattaactagaaagcattatataacattttatttaccgtcttttccggtagacggtaagctccacaagggcggggctcaataaacgtttacgagtggcttaaatgaaaggacgtgcgtgggcacaccgcggggactaatcgtgttaggcccttctccaaggcctatgatccccaacggcaactcgccacgctcctgaagctgaacaccgcgcagggcctaaggtcggacaccctccggcttaggttcacgacacacccattttcccctccctccgccagggccggctcgggcgccggttccagcctcgcgcgccagcccctgtcggccccggcctgcaccttcatccccaggacgtcccgatagaaacgcgccgtctggaagcggtttcccactttgaatacgaagtgcagagctctgcgagcagccatgattcccgccgcacgcagccgtcacgcgcaccgtacagcccagtccacgaagggcgccacgggccgtgacgtcact

SEQ ID NO: 2050 - DNA, 10230 bp, Homo sapiens
cagccacgcggcgccagcgaggcggccggacccgcagccccgatgctgctgacgctggccgggggcgcgctcttcttcccggggctcttcgcgctctgcacctgggcgctgcgccgctcccagcccggatggagccgcaccgactgcgtgatgatcagcaccaggtaccggcgccgccgagacgccccccgaggcccggggcgctgcccaccgcaccccacccggccgcggggcccagggcggaaaaggggggcggcaggaagcccgggggctgctccctccgcgtcccggcggcccgagtttccgaagcccctccgcgtcctcccctggcgggagcggggccggggcgggcgggaatggccgatgagcctccggagcccgctccccacatctgcctgcggctggggagagtcaggccgaagggccgggccgggctccctgcggtcctcggaccggactgagcgcgcgcgctgttctctccgcccgcgctaggctggtttcctcggtgcacgccgtgctggccaccggctcggggatcgtcatcattcgctcctgcgacgacgtgatcaccggcaggtaagagcccgggccggggccttgttgcaaatgtcacatttcagtagctcgcaggctctggctctcgcagcacacgcgctcagaaagctgactaatgggaaaagctggcaccacaatgggctccttcttcctctccggagtcttcgggcacccccagcttaggagaaagtccacggaaatgagggaggacgacagagtcggagtctgatttcaggtggtgtgagccagggatccaggtccttcatggaagagataagcgtggaagcatttacgactgggagtgtggcttgattcttgcagttggcttcactgggttctcactctggagcatcactggctaacagacgtccagtgtggttagcagagccccctccatggaaaggaaccaacccaccacccccttccacgcaaacgccgctcttgcttttcctgcagatttgctaaaggtgattgagaggttcccagcgcttagaacacggacttgtacgtctatcagaggtcagtccagaggcaggtcaggaaatgtgcacctatctgcagttccagtgaaacaaatcataaattaagaccagaatagtcgactttgtacagtagttagacctggacaatggtggtgcttttattatttcaagccttttttttccccaccggtcttgctggaatcacactcactttctcccaagttgaaggaccacagtcggatgtgcaggaagttgaacggcctttccaggccctgctctcctgtgggctctgccaagtcctgcttctcacctgctgagactgaactgcgaggggcctgagcaagctgtccgtctcactctagcctgcggtcttacctgggatcaatcctgctgtcatgatttttgtgcttttcttctgcctttttaaaaacaaaactggctattggcgatgaataagtagatgctacgatagatcaagtgacatcgattgtagacaccaaaggttaatattggtgtggctgggtacaatttttcttcttcttcttcttcttttttttttaaagacagggtctcactatgttgcccaggctggtcttgaactcctgggctcaagtcatttttctgcctcaccctcacaaagtgctgggattacaggcatgagccaccacacccagcaaattttttactttttttttttcctgtcgagacctcaggctgaggtgcagtggcataatgacagctgactgtagtcttgaactccagggttcaagccacccgtcttccttagcctcccaagcttggactacaggcacacactactacacctggctaacttttttttgttgttgttggtagagacaggggtctccctgcgttgcccaggctggtcttgaactcctgggctccaacgatcctcctgcctgggcctcccaaagtgttgggattataggcgtgagccactgcacccagccaaaaaaggcctttcagggttcatatactatatactgaatatttttctattatatgccttctcattttatgccttcacatagaatgcgattagatagaaggagttaaaaatccccccaaattataggcagaaggtggtatggggccaaggatttagtcagattcttaaaggattcagacactaaaatgacaaagtcacagctccaggtggttttctcaatttaagtacttaattcagatagtacgttgttgttttagacagggtctggctctgtcacccacgctggtctgaactcctgggctcaagccattctcccactcaggcctcccaaagtgcagggatcataggtgtgagccaccgtgcccagcctgtatagtaccttttaacatttaaaaggactccccctccccgccgcctttctttttattgagatggagtctcactctgtcactcagactggagtgcagtggtgaggtctcggctcactgcaacctccacctcccaggttcaagtgattctcctgcctcagcctcctgagtagctgaggttacaggcatgtgtcaccacgtctggctaatttttgtatatttagtaaagccatgttggccaggctggtcttgaactcctgacctcaggtgatccatccgcctcggcctcccaaaatgctgggattacaggcatgagccaccgtgcccggccgactttcccacatttaattatttaatcttcactgcagttttgacaggtaagacagacaaggattatcatcttcattttacaaagaaagttaaatcacaggctagtgatagtgaagattataatccagatctcttgctaataaatcttcagaggattctactcatgagtcacaatttcagatctcttctctgaattggtgaaaacatgaaaaccctaggttcccttcaaggggagaggccagttatatttcagctaaattttagtagctgtttataggtattttacttgaaattgcttgaagaaagcacctgagaccatagatgggcattggaataagtatggcatctttttggccaaaagaaacctagctaggtcgggtgcggtggctcctgcctgtaatcccaacactttgggaggccgaggtgggcggatcacttgaggtcaggagcttgagaccagtctggccaacatggtgaaacccccatcgctacttaaaaagaaaaaaaaaaagaaaatagccggacgtggcggcaggtacctgtaatcccagctactcgggaggctgcggcaggagaatcgtttgaacccacgagtcagaggttgcagtgagctgagatcgcgccactacatccagcctgggcgacagagcaagattttgtctcaaaaaccaaaaccaaaaaaaaaaaaaaaaaaaaggaacctggctaatgaattcacctacaagtgtgttatacttgccattacttgcttgccttatttgtttattcattatttacgccgtggtaagtgtggagttgctcaagagcacaaattcagatggcgcctccgtagactgtatttccagtgttgcagttcagcggactggctgcgtccgaaatcagagacaaagttaatacagatttcagggccctcggcttacaatttagaatctctggggactggagcgcttaacaagcactgcaggtgattctgatgttcaggtagtttgagaaccataaaacgaaatggttttctacctaatacgtggatgcgcatcaaacgtttgctgaccatgtgaatggaatcctcaaatagtacatgatttcaatttagatgtttcttcacagaaaacatctgtggaatgcttatcactgggaaccacattgtatgaattgtagaggcttcccttctaatctgctctaggacggtgatcaactatgatttccattcagcaaatactgattcagcccctttggataagtaaatgggaaaactgtcttttgacctagcctctctcctggtacctaaccgctgtaatgtggcccttgagctccaggctcatttccagacctgcttttttttgttgtgttttgtgtgttttttgagacggagtctcactcttttgcccaggctggagtgcagtggcgcgatctcggctcactgcaacctctgcctcccagattcaatcgattctcctgcctcagcctcccaagtagctgggagtacaggtgcacaccaccatgcccagctaatttttgtatttttagtagaaacggggtttcacaatgttgataaggcgagtatcgaactgctgaccttgtgattcacctgccttggcctcccaaagtgctgggattacaggtgtgagccaccacgcccagcctccagacctgtttttcttaatggaattgagattatctctagaattgctttttgggtttttttgtttttgttttttttagatggaatctcactctgtcgcccaggctggagtgcagtggcgcaatatcggctcactgcaacctccgcctcccgggttcaagtgattctcctgcctcagcctcccaagtagctgggactacaggtgtgcgccaccacatctgactaatttttgtatttttagtagagacggggtttcgccatgttggccaggctgatcttgaactcctgacctcaagtgatccacccgcctcagcctcccaaagtgctgagattacaggtgtgagccaccgaacccggccagctctagaattgtaaagaaaatggccagggttgcctcccagaaactccatagagtggggttgcatgcagacaagagaaaactcacaggttccaggatttaagttagtaaaacccccaactgttgagcagctaaggagttaaactagaaatgttggatttgtgatttgggacactttccaaaccagcttcttggtggggccgttgaatcatttgtatatctatctatatcaaaatcagttttatcacaaaatgccagaacatctactacaaattagtagctaagtcaggcaagtagtgacagcaagctgcttcaacaggcagggctgagtgaatgcctgctttttgcctttgacactcacgaattggccctgaaactgagagcaagtggtctactctccctgtttatcagtttcaacatctttattgtaaagtatttggaataataatagctgatcaagcaccaagcttggctgtgagccttcataatggatatccacaatgatttcacgggccattcatatgctttctttcaggcactggcttgcccgggaatatgtgtggtttctgattccatacatgatctatgactcgtacgccatgtacctctgtgaatggtgccgaaccagagaccagaaccgtgcgccctccctcactcttcgaaacttcctaagtcgaaaccgcctcatgatcacacatcatgcggtcattctctttgtccttgtgccagtcgcacaggtatggccttccaggacagcagaccagcagctgggttgagctgggtgtctttttttttttttttttctgagacagtctcactctgccgccccagctggagtgcagtggtgtgatctcagctcactgcaacctccgcctcccgggttcaagcgattctcctgcctcagcctcctgagtagctgggattgcaggtgcccaccaccacgcccggctaatgtttgtatttttagtagagatggggttttgccatgttggccaggctgatttcaaactcctgaactcaagtgatccgcccgcctcggcctcccaaagttctgggattacaggcatgagccactgcgcccggcctgagctggatgtcttgaccgttacttaggagtcgggattgcccctcttttctttgccactcataggcacccattctccttgtgcctgctgcttcagagccacctcccccaggtgaatagtggaggaacaccattacacatgaaacgttcatgatcctccttaccaacatcaacatcaacatactttttcttttttgagacagggtttcactctgtcaccccgggtggagtgcagttgttggatcacagctcactgtagcctcaaactactggcctcaagtgatcctcctgcctctgcttcccaggaagctgggaacacaggcacacactacaacgtccagctaattcctgtaatttttgtagagtttctccatgttgcccaggctggtctcaaactcttggactcaagtgatcctcctgcctaggcctcccaaagtgctgggattacaggcgcgagccactgcacccggccccaacattctttttaacaaacccccagcgctctgtgattccctagcgtttgtcagaggttctatccttagttcaatacaagataaaaacaatataaaatacaaatataatacaaagcaacataacagtgccagagagcactgtgtggattattcttaggtcacaaaacacagattctcaaagcaaatagcctcctactttctccccagatccatttccccataaaagcccacccaacaaagaaaagcaatgggaaagctgaggggaaattcctcactcttgagtgcctggccaggggaaggcatgcgtttttttttttaattattcatttatttagttattcatttttttgagatggcgttttgctcttgttgcccaggctggagtgcaatggctcactgcaacctctgcctcccgggttcaagtgattctcctgcctcagccttccaagcagctgggtttacagatgcacgccaccatgcctggctaatttttatatttttattagagacggggtttcaccatattggtcaggctgatttcaaactcctgacctcaggtgatccacctgcctcagcctcccaaagtgctgggattacaggcgtgagccactgctcttggccggcatgtagttttattttattttttaaataaagagatgggggtctccttatgaggcccaggctgatcttgaactcctgggctcaagggatcctcccgtctcagcctcccaaagtgctgggattataggcgtgagccaccgcgccctgccaggcatgtgatttaaaagttcatagcttgctaaatattagaagctattagtcttatgctgtagatgaagaaactggggctctaagagtattcttatatctctcagtggtactaagtggcagagctgatattttaccatgcttactgctttcttgaaaaaagaggccgggcgaggtggctcatgcctgtaatcccagtcagaagttcgagaccagcctggccaacatggtgaaaccccatctctactaaaaatacaaaaattagccgggtgtgatgctgtacatctgtagttccaggtactcaggagcctgaggcaggagagtcatttgaacccgggaggcagaggttgcagtgagctgagatcacgccattgctctccagcctgggcaacaagaacaaaactccgtctcaaaaaataaaaataaaataaataaataagggtaacgtgcattaaattctttaagaagtgtctgggacctaccatctaggaaccagaacatctagggtgctttgagaccctaacatctagcacagggcctggcacattttgttgaaccaaacaggctgagtgtcttggcatgactaagttcgatacacaaaagtaggcttgcagccttccttccggctgtcatcaaaattcagagcttggtgtgggacgccgtcatcctgtctgaatttgcctctggatcctagggcttggaccatcaaagtgctgttgccacggaagcagcggtacagtagtctgcgcttgcctattgagcgtcctttgcccgtcacagttacccttttcagtagccctcgttggaattttccttctggtggtttcttaacctccacttacttccccttttcgtttcgtcatccgcagaggctccggggagaccttggggacttctttgtcggctgcatcttcacggcagaactgagcactccgtttgtgtcgctgggcagggttctgattcaggcatgtatgaatgaaatgacagagagtgtgagggttctgattcaggcatgtatgaatgaaatgacagagagagtgagggttctgattcaggcatgtatgaatgaatggcagagagagtgaaggttctgattcaggcatgtatgaatgaatggcagagagagtgagggttctgattcaggcatgcatgaatgaaatggcagaaagagtgtgggagggagtggattctgcttttccttcggagatggtgggtgtggagaaatccctagtgccaggagagtgggatgagagatccttcaacagccttaaaggtcagctggtcatctcagccagtgggggtgaaattgtaggtttgatctaagtttgatagtttgatacagctcattctattttttccctggttacacacatactttaatccacggttcctgtactcctgtcagctgggtggcctgggtcaaattcaaaatcactattggagaaaatgaggttatttgcacatctcaatatgatagtgttcaagaatgtcttctccaagtgttagaaaactagacaaacgtctgggcgccagggaatctgacagccaaggtcttgatgagcacctgcacctgtgtggcatttactgtggtgggacttgggcccgtcgctccctgatgcccagcttcttggtgaccttacctttttccttcctcttctattgcagctaaagcagcagcacacccttctgtacaaggtgaatggaatcctcacgctggccaccttcctttcctgccggatccttctcttccccttcatgtactggtcctatggccgccagcagggactaagcctgctccaagtacccttcagcatcccattctactgcaacgtggccaatgccttcctcgtagctcctcagatctactggttctgtctgctgtgcaggaaggcagtccggctctttgacactccccaagccaaaaaggatggctaaatgctcctgggagtcaggcgcagcctcacaccagctgcctcctccactcagcattccatggaccaaattgtgccctgggtagcctcagactttgggtattgataagccgatggatttgagtttttctaaagaatattcatattacctccttcttctaacttgccctatttgcaaaagcacttttgtagtaacaactattgggtcctgtcagacctccacggacagcaaagtggttttaatgcaagcccaaggatccttcttaaggtcttatctcaagagctctgggaggtggaagcatggggtgggatcggtggaccagggtggtaagtgtctgcacatctgcctgtccctgtatcagcggctacccaccttccaaaccactcaggacagtacccgtggcactgggcccgcagaagcaagggatgacttggttcttggaagtaatgtcgtcttgtgacattggcctgggacaatcattgtgggtaggtagttattgatcgtttactagataacccattggttctttgcctcatcctctcatccatgggtcagagttgaattcttatgtctatagacttccaatcagaagtctcactggtggggctgggggtgggggcaggcaggaggcatggatgggaacctgagtaggtagtgtggccaagagatcagcacaacctttgcaggctgacttgctaagtctgacagtgacaaacttgtgagcttactgcagtcagtcacagaggctgttctttttcacacaccccttcatgcccggctttccccatatccacatgcagagggcgagctcataaaactacagggaagcgtgaaatgatggctttggtagctgtttactgggtaaccccactgtgacactgtccttttcatgtgatgtggaaacctacttctgtcctccaaaccatgaaatgtgtcatctagactgcagagtacttgagtgctttgcctcccgatatgccagagcttgtggtccaaagcccattcctgtgtgtccgtcctgccatttagccacagaaggctgcggagtgaggcggcagctagcctggccagtggctgtcccgtggaccgacacctgcgcccccttctgcaagcaggattttctggtgccaacactcattcatcattcccgatcaactaggatgaatttaagactgtgctaccatgtgttctcaagtggtagtttaaaaagtggatttttaaagtgcctttcaattgtctgtgaacgtctaaaggactgatttgtctca

SEQ ID NO: 2051 - DNA, 7842 bp, Homo sapiens
agggggttatacgtaccatgtaatgctttttccactcacatggtttcaactttgggcttatttgccaaaatctaggatggaaaagtccagttatgaacatgttcctcctggctggatttgatcttgaagacactaaacccaatttcagagcatatttaatcctgggctattgctgaggccgacttagaagagacaaagtgagatgcgaaagaggagaatttttatgatagtttgtacgttacaaatacccaagaaactattttctttacaccattattgccatgactttttgtggacagtttcacataactgtaaagtccaggctgctcgggtctgacccctacagacctgccatgttgaagcccagctttttcgctcccgcacaggtaagaagctgctgatcttctgcagacccgccatgttggggcccagctccccacgccaagtcagaagctgctcatcttctgcaacagggtttggcgccgttcttcagggccgatgccctcagcaatggactttaagaagcgctgctcgtgtgccctctggagcaaggagctgacagaagggttggtcttgctcaaagtctcatagcaggtgagggtttccaaggctaaaacgtagagtggctcacagacctccgggtggagcatggccatgatgtgcagagcatggcagaacacctgggtgtaaacaaacagggcttcctgggtcaggtcctgctctggtccttgaacccaagggccagctgcctgtatcgccctgactgagtccaggaggcgggtcagactgccacagaggagtttgaccacgtggttccagccttccagaggaagccaatcacgacagctatggctgcagagaaactggaaagtcctcaggaagaggacggagagttgcaactcctgggcaaagggcttcaggttgagcaggggaacaaactgaatatattccaggctataagggacatggaggagctgcttctccagcagtctcctggtcagctggtgaaggcgctgccactcctgagggctgcaccaaggcatgacttgcaccagggccaccagaaagcctttgctgaacagtctgacctcctcaggattgcccacgtccaccaccaagagagacagcatcctctccgagatgccgctggagacgcagcagcactccatccaggccaggagccccgtgccagccccgtaccctgggtgggcctgggaggtccactcgtcttctgaaagcttacagatctcaaaaagtgtggctggcacttcacacttgaagtgcccctcgaagaagctcttcagcctcaggcccacagtccagtctagctgttctaacttgcggtggagccaggacagggacttgatccagacatccggggagaaggtctcagcattggctgatacaatctcacacaggagctccaggatatggatcgctagatccttcctatccaaagagaggcaccgcttctccttgggaagctgccagtatttgctgaagcggtccaagagctggcacaagctgaagaggagtggaaacggggagcaggtctggagccagtattcctctcggcacgcgtttgcctctagagtctggatgaagatcctcagactgaggtctacctcttcaacatctaacctcaagaaaggcaggacaaattccttcagcacctcgtctggctcaagaagagcagccactggaatcccttggggtttcacgggactcatcaggcagttcaggagctctaaaaattgcttttcttccttgggtgtagagaacttcatccagacggtttctttgaggcatgacaccatgaaagtggcagatgaattgggaccctgctcttccacaaacctaagggcagggaaggcagtgagaatctgggccaggaacttgtgggtgccgagattgaccacagccaggctgcacattttcttcaccgtgacttccgggtgcactatgaccaggcgggccacggaggccacagcttttgccaagccctgttcggaggcactctgagtgagctggttaaaagttgtattgaggtcttcctgaaaaccctccacataagccagcaacttttcagagaggccctttcgcccccaggaacgcaggatacctgcaaggactttatttttacctggcagggagaggtctgcgtaacattccaggatcaggtggatcacctgccggatctgagactcagggatggctctgtcagctgtgctgacgtctatcactgtttccagcagcctcaacaccaagtctggctgtcggaagagggccctgttactccccaggcaggctacccactcgtccgagaaggcccacttcttctcagaggcaaaaatgtagcacacttccatatggcggtccatcttctgctggatgacggccatggcaatggaagctgtgatatcctccaaggccctgttcttcagcaccgtgctcgttttcctcaggaagtccctgacacactccgccagctcagagaccacctgcctgtcctccttggacaggctggtgcggttcaggtagagcgtcgcgttctggctgaaggaagtcagactgtcgcacagccggtagctgtcgtaacttgtcccctggctgctgcggagcacggcctgcaactcctccccccactcccgcagcaggtggtgcaggaactcgcagcccacgaaaatggtctcactggggagtttggccagcgaggtcaggctgacatcccgttctgcctccttcaccttctctgccagcgcctgctggtggtagggattctgggtgtccgagttccacacagagatcaccgtggccagtttgtccagatacacggttgcagacacctcctgggggtcgtcctctgtcagcgcaaacacagtcagcatgtcagccaggttggccagcgcacagcacttcctccccgggcccaggatccgactctggatctgtgtcagcccgcggagcagcatggccaacaggggcatggtggggcacgcgtctgggtctgacctaagcctctttggaggatgggggaactcatctaaggcaggcaggtacttatgggccattgcactaaactgggagagcagggggtcctgcgggtgacccttgtgcttcatcacctcccaccagacgtccaggaagaaggccacgtcttcggcagaagtgtcaacggtcacatgttccagaaagcgctctagttctgcatggcagatggtggtgggcagggccatcaggagctggataaagagtccagaagcttccagggatttgagcagctcgaagaggatggtgtggttgatggtggggatcatgttgcccaccgagaagaacaggtcttcctgccaccgtgtctctgtgtcggacggggtcacggggtgcggctgcagaaccttggcccagatgatgatcagggctttcttcttccaggcaaagggctgggagtgtgctgcagccgaggagatctcccttaaggcctccacgatgggccgtccaacacgttcccagtcagactttgttaattctgccagtgccttagggtggaacagctgctcggccagcaagaagcctccatgcagaatagtcatttcttcacagatgttcaagggtcctgcacacagacaagccaaataagacagtatagtgaaaatgtttccagatggccactgctgttagtaggctgtcatggtttgagatgacaagggttttaaaggacatcagcggacggggagaagggatgactacaagagccactgcacagctggagtcagaaggacttggccgaggaatccagaatggcttccgagctctccagcctgggaactgggaggccaccaggtgacatcacatacagggaatggaggagaatcagagcaggtgtgaggaaagatgagttcagctttggccatcaaggtacagatgtcctccagcaacggaaatgccaggtggaagttcaggagggaagtaagctgggaaatgtgattctgagaggtatctgcccagaggggatcaccggaaccaagacggtgaatgagatccttcaggaaaagtgtgtgaaaagaaaaagctgggctgctgaggcgagaccctccagcaaaggctgggccagcagaggatgtggggagaggggtttagaaataggaggacagtacaaactacaggggccactgagcatgtaccacaggacatgacagctgagcttctcatgacagatgaagggagcatagccacagggtaatgggcacagagcaatcacacagccacagggtaacaggcacagcagcaatcacacggccacaggataatgggcacagagcaatcacacagccacagggtaatgggcacagagcaatcacacagccacagggtaatgggcacagcagcaatcacacagccacaggataatgggcacagcagcaatcacacagccacagggtaatgggcacagaagcaatcacacggctacaggataatgggcacagagcaatcacacagccacaggataatgggcacagagcaatcacacggccacaggataatgggcacagagcaatcacacggccacagggtaatgggcacagcagcaatcacacggccacagggtaatgggcacagagcaatcacacggccacaggataatgggcacagagcaatcacacggccacaggataatgggcacagagcaatcacacggccacaggataatgggcacagagcaatcacacggccacagggtaatgggcacagagcaatcacacggccacagggtaatgggcacagagcaatcacacggccacaggataatgggcacagagcaatcacacggccacagggtaatgggcacagcagcaatcacacggccacagggtaatgggcacagcagcagtcacacggccacagggtaatgggcacagagcaatcacacggccacagggtaatgggcacagcagcaatcacacggccacaggataatgggcacagcagcaatcacacagccacagggtaatgggcacagaagcaatcacacggctacaggataatgggcacagagcaatcacacagccacaggataatgggcacagagcaatcacacagccacaggataatgggcacagcagcaatcacacagccacaaggtaatgggcacagcagcaatcacacggctacagggtaatgggcacagagcgatcacacggccacaggataatgggcacagagcaatcacacagccacagggtaatgggcacagcagcaatcacgcagccacagggtaacgggcacagcagcagtcacacagccacagggtaatgggcacagagcaatcacatagccacagagcaatgggcacagaaggaatcagacaagccctgccttcactctttataaacttgccttgggaacaggcttcaaacattcttctagctttcagggaaacggtccaccccacagctccttccagtcaaaaacaaggtactcatggccctagctctgtgggagaaaccagggagtagatacagaaaatactgtgctagattaagccttccttcagggaactaacgattgacacagacttaccatggaaaacatcttgggatgtttaatcagacatgggtttaaatcctagttcagccatttaaaaatgatgtgattctggccaggttcagtggctagcacttgtaatcccagctacttggggggctgaggcaggtggatccctgaggccaggagttcaagactagctggggtaacacagtgagactccccctccatctccgaaaaaaaaaaagggatgtgatcttggtcagattgcttctccaagccttccttctgcatatgtggggataatacagacttcatgttatgcctttggggatcatgtgatatataccagtcaagcccttgctagtgggttggcactgctatctcctgaccccatctccccgggacgctatgatggataaatgagatagagctacagtaagaatccagttacagagtctaattaggtgctcagtaaatgttggtttccccaaaccttttcatggttggcaagaccagaatcttgtcactattctttgcctcccccagctcagaaacatcaaaggatgtaggtctttatcaggtatgtttcctttggcccagaaactaaaacgagggtgcaaacactgctccctattcctcattcctgagtcatctcccctttcccaggagtgagagatgctactccttcctcagtctgtcatgcccccaagagctcatattccccattttcacaggccagacaccagcagagaaaacactgactccaggagactaaggaccatcttacccctcccaccatttatgggagcggcagcaggccaagggctcagcactatgtaacccacttgtggaggcaatccatctcatctcacagtggctgagaccgactcccagggagggttacgctgcgaaggggacctccctgggggttaccgcccttctttctggctcaggaggctctcccagggtcccaaaatatagtccctcctgacgctgtaaatttaattttattgcattattggcttagttgagcagatgtttggccctaaacacctgccttccaggcgcattaagtacgcacagtttgaagtagtaagtcccagggcggttactagctggaaaatactccggtactctatcatggatggttaactagtgcttgccacagcccgcttcttaggtttattaagcacctactccatgccagacactgtgctaggtggtacacaggtaagatctcttctattcacaatcaccttttgaggactagtattcctgctctagagataaggacactgaggcgcagaaacgatttgctgagggtgtcccagcctgaatgtggtggggctgggaagcaattacggctgaggggctccaagcccttagagctctgccattccgctcctgaaaagctgtctgggggcggggaccagaccatttccccccagcctactactgctgacacatctcggggtgcctcacccccagctctcccagaacagcctcctggtcttagcagcgtgtgccaagatttagcagggagcatctagttcctatgggctccctcccagaccttgcctgtaagattctgaatccggacgcacgcaggttcacaaagtgatacctcaggagcgcagccgcccccaccgcgggtgtgacccgcgcaaccccacaagggacactgtacctcggcgatctcaatgcaaagtcgcccaaaactcagtggggagacacacttccattctccccgctctgtcgatgaggaaacgtcatgagcgtaagacacttggagcgttaagacacttgctcaagaacgcagctgccgttcaggaaatgaggccgtcggggcgcccaggggtgctcggagggagcccgtttcccaaagcacgtgcgcgagccccgggcgcttccaagggctctaacttcacgtctgctccgtgttttcaagcgcagggggccggaggcggcaagacgcggcccaacgcgcggcgggacccggaccaccccccgccaaggccaccccgggacccctagacccgccccgacgcgggggacgtttcggtccgggcccgcgcgagcgtgcgcgacaggaggagacgcgacggggcagcaccgctctggtggcgcattgctggacgcagcccggggccggggagccgcggcacccacctaggtccatggcggcgacgccggcggctgcgcggggctaacgccccctcccctccgagaactcgaacgcggcgcgggacgcacggcacgatgggagacgcaggagccacggcggccgcgcttaggcct

SEQ ID NO: 2052 - DNA, 3005 bp, Homo sapiens
caagcgcacagcgccgccttccggcagagccctcccaccagccctcaggtacccggacgtcgctcactagacccctccgcaccgtcccctgcccggcccctcttccggggtcccagcgggtcgggctcatgattccccggccccgcattcaccctcacccggtaaccccgggcgtgccccgcacacagttcacccccaccgagcgcctcccccgggacgcccaccacccagcgcggccgcaccacgcgaggcttccactcccacccgcccagctcgcgccacatacagtccctcaacgcgctcctgccgcgccgccccctccagacagcagcgttccggatcctagacgctttttgacggctggtcctccccagaaaatgcgccgtgtgagcccaaacatggtggggtttacgctggaccccgagcttgcaatctgtgcttgacaaaacacaaacatcgcgtgcctgtctcctccccctgagatcgagtagtaacagccactccaactctccacctccagcttctagcaccagggaccgcctccaccaccccatgtgccaagtggagttcgagctgcgcggccctcaagcagctgaagggtcccgtgagcgatcaggagaagctgctggtctacggcttgtacaaacaggccacccagggcgactgcgacatccccggccctccggcctcagacgtgagagccagggccaagtgggaggcttggagcgcgaaaaaaggggcgtccaagatggacgccatgaggggctacgcggccaaagtggaggagctgacgaagaaggaagtggggggcgtggagcgcgaacaaaggggcgtgcaagatggacgccatgaggggctacgcggccaaagtggaggagctgacgaagaaggaagtggggggcgtggagcgcgaacaaaggggcgtccaagatggacgccatgaggggctacgcggccaaagtggaggagctgacgaagaaggaagtggggggcgtggagcgcgaacaaaggggcgtccaagatggacgccatgaggggctacgcggccaaagtggaggagctgacgaagaaggaagtggggggcgtggagcgcgaacaaaggggcgtccaagatggacgccatgaggggctacgcggccagagtgaggagatgaggaagaaggaggctggctgagggctcctcgggaatggaaagggcttcttagaccttgatggctgaaatgtcctgaaactgtcgcaagcttagccgagacatcaataaatcacttaaactgcatgagagtgactgctgttggaaaggagaaactcggtgactgagtgctggggaggcgtccaaatacacagactaactttttgtatggttttgggtggagttcccagctctcctattacaagagcgtatgtaggtatttggaaggacgagggggacagtgtgctgtggaaatgcccaagatctgagggcaggagaccattctccagtgacagcctcttgggaggttgaggccccagccccttatctcttcaaggctgatttactaataccccagcaccacagaggggagagggactctgtcctcctaaacactaaagtcaagtccaaaagcccccactggaacacagggcctacccggttcatgttttgagggagaccaagctttccgtgatgataatgtgatgaaacaattgatgcgccagaacacagcagtttagaaacaatggagcagatggtgtcaaaatcccagccccagaaaggctcacctaaggccgggcaaccaaaatgttcccgggactattctgtacttaaccctggtttctgcttaggggacggtgggacaatatgcatatggatgtctatgtgggatttgttgcaagagcacaacacaccccttgacctatgcaagtgccagagtgtctgagcccagcttctactcctgttaatgatcacaggagcctcatacacaaccattgtgcatggcggctggagtatggagtagtaaatggtatccagaaaggcaggtctacggtggcatatgggatttcctggtacttcttctttaatagaaactatcttcacagatcatgacatcaggtcagctgcagttctcactgggaccaataaacaatagaagcaacaaccataaagacttaagaggacaaaggaaaccaaacctcactgtgtgtcttcaagatctgttcacatagttgcaggaagttgctgtagacaaagtacattactaaagaatgaagcccacccaggacatcacagcaacgaaagaactatttctggtaactgtggaccaggtgagagccacactgtagaacagcagtgctgccctctcttctttggcgaatgttatgaagacattctgatgcacttaggatcatgattcatgttaaatgtaaattaattgtaaaaataatacatcttgctccaaaatgtggtgacaatttagaagctgtccacatagccagaccactctgtaaatcacagaacctagaaagtaaaaatgtgccataattaggacagcagaaagtaacagtaaaataaagttttaaaaaaaaaaacagaaaataaggatttatctatttgtatttgcttaagaagaggttacctataggatgcagggggaatgggattgatgggcatggggtatactgtgaaaggaaaataaaatcttgggaccaaattcactaagcgaaaaggaaaagttaagcttggaaattgagtcatggaatatgcaaaaaacttccttttgttcctaaacagataagctacaagacagaaggccacatatctccccaggtggtctccctcacctgacaatataaattaacagcttatcttcataggtaagggacaaagacaacaccagaaaccatccctcaccagccgagacaaaacatagatgtactgagctgaatgcataactgttcctctgcctgctgctttcactgtaacatatagatttggtgagcagtaaatgtagatttactgagctgaatgc
